United States Patent 9,328,346 (POLYCOMB-ASSOCIATED NON-CODING RNAS) - sequence listing, part 81

SEQ ID NO: 15210 - RNA, 19507 nt, Homo sapiens
cucaagaauuuuauuauaaaacagaacaaugacacaauauaagcuuacacauuaauauuuacauuauauucaaaauauauuacagcuuuaauuuaugaacagaaauauccugucuuuucuucuuuuucuuuucuguuuucuuugcaucauugauuugcauuuuuacuugaucuuguaauuuagaaaagaaugcuugagaggacuuuaaggccuugucuuuaccuucauccugcaauuaaaaacaccacaugcuuaugcuguaaaauguacuuauaagugaaaaaagccaaaaauaguacaucaccauuacaacaauguaugcaaccauaaauaugaaaaaggacuagaauuacagaaaacugaaucaguuagcauagagguauucugcacugcuacaauguucuuauaaucuaagagagaaaggaguggaagacaagcugcugccaggacccagguuauugugaggacccuacaugaaaaauucuagaacauuaaagguugcgauuccagccagucagcaucaugcaucucuaucccgcaggugggcugucagcuggcucagacauuccagucacccagcacuugcuauccacuucccccacaaagguccccuugagcaguuuucuuucccuuguccuuaccuuuaugaaggaagcuuugccaguuuuggucagcuguuuuaacuucuccgaagcuacuguuuugcuguauuucccugcuugaucuacacugcucuuuucaagcaguuuucuccgcuucuccuucucuuuuauuuucauacgcuuuugauauuucuuuuuccuucgcucucguuucuugucuguagcuguuuuuucagcagcuguuuuuauaucuccagcuuuauuuuucuccuauuaaaaaaauaaccaccaacauauucauucaucaaguuuaacaacuaggaaacuggaauggaagaaacugcaggguagccagcaagcaggcugugcaucuguggccaaaugcacaaagaugcagagcaauccccaccugcauuccaaugagcguugguaacucagcucuuuaaaaccugaaaugcauucuuugacaggcacagacucuuauagugacgguucaguucccaaacuaauucacaagaaggcaacauggagaguuggguucucaaccuaacagcacaagaggagccagcccuccacagcauuuagauuccaaugggcuucagggacaugccagaggcagccucagcucugagcugcuaaugacagcaacuggacugaggccagagggcagagaccaaggaacagaggaagggaagggaaacaucucucuagugaggaucaauucuaucucuuuucuccucagcugccagccuauccugccagggcugucaccugcacugagguggcagaggcucagacagaaggggugaguguagguguagcaaaucaagugaggagggaaaaagaaggcccugcugcuaagccagccaggaagaugagcaccuggcagaaaccauuauuacuguguaaggcauaagcuucaauguucacauggcagggauugcugcauuugauauaucuagccucuucugauaaccaaaugcucgauucuagauucagauuccauuacuaauuagcauuacaugaauaaaauaagggggaaaugcugacacuaaacuauugcuaguauauaugcaaugcaagccauuuguuuucaacuuaacaucacugcuaguauucagauuggauuauaauaagauauugauacuagcuauuuuaaaacugcucuuacaguaacucucaaaccuguaccucauaauaaagccagaauauaggagacugguauuugaauauuauaacauuacuaguuugcuuauacuuagaaacugcugagauacauuggaauaagaacuacaagugcaaggcaaaugacgucaaauaaauggagucuggcuaugaucaacuaacuuguaacagacauuuaagguuucaacauuggcuucuuaccuugaucuccucuggggccaggagagcugcaucacuaacacucacuggggcuacuuccuccaugguuauggcuggcagauuugacacaacuuuaaucucugguacaggcuagaaaagagauaauacauucaaugggaagccagaagggacucuaacacaaaaugugugaacugugaaccuauuaacuuaaaguauaauauauaaaauacuuuauggagauuaucuuuuuuucacuugcuugaaagucagcaaaccuaauggagacuauuuaaaauguuagauauggugacagccaaaguccuaaguggacuggcaugacggcagugcugaggggcagcacugcuucaggaucccagagaccuggguauuuuaggguuuucugucucaaaaccauuccaacagcauguauuucuuuuucuuuuuuuuuuucuuuugagacagagccuugcucuguugcccaggcuggagugcacuggcgcuaucucggcucacugcaagcucccucuuaaggguucaugccauucuccugccucagccucccgaguagcugggacuacaggcgccugccaucacaccuggcuaauuuuuuguauuuuuaguagagaugggguuucaccguguuagccaggaugaucuggaucuccugaccucgugaucugcccgccucggccucccaaagugcugggauuacaggcaugagccaccacacccggcguuuucuacauuuuuacauaacauuucugccaucuucaaacaucaguucuuccaucucuuccucaacuauuccuaucuaccaugcauguggacauucucaaacaaccauuaaugcuguuugguaagauuuacugaucucuauuaauauuaucuugacuuugcuuacagaaaaaaaagcuagcucuaagaaguauauggaaaaagaugcaaggaaagaugcuuacgggaacaagagucaaaaauagacuacugauaaauuuccucaucuuucaacuacugaaaacaucucuauaaacaaauaugaaauaauacugaaaaacucaaacaguaucaaaauaaaucaaagcuaucaauuacaaaaagggggaaagaaugcaauguuaauugaaggaccaucugcuucagauuuuugucuuuuuuugaaagaacuacccaagaaauccaguaauuaaaacagguuucauacugauccugcaacuaaaauggugacuauauauugcaguuacauuagcauucuuucuuccuuaucaccauccuguccauggaguuauuugcucaaggaaacuucacaaagaacaaaaacaagccauaaacacaauaggauccuggauucuaagugagagaaaaaugagagugugaaagaaaucauuucuuccacuggaccacuguucaacuguuauuaaaaacacuguguuccauucuaguguuuaaagagaaauauggagaaaaagaagacaguccaaaaagccacaaaaugcugggcacgguaacucacgccuguaaucccagcacuuugggaggccaaggugggcagaucauuugaggucaggaguuugagaccagccuggcuaacauggugaaaccccgucucuacuaaaaauacaaaaaaauuagccagccgugguggugcaugccuguagucccagcuacucgggaggccgaggcaggagaaucgcuuaaacuugggaggcagagguugcagugagccaagaucaugccacugcacuccagccugggcaacacagugagauucugucucaaaaaaaaaaaaaaaaaaagccacaaaaaauaauggcugugauuaguaaauggagucuacagagauggugugaaauaccaaccugaacaugaaaaaaguaauaucaaggggaaccuacacuagcaauucuacauuucuuaagggaaaaaagaaaggcuuuucauuugggcacauagacacauauacauucacuucuccuucacuucccaguauuccaaggaaugucuaaaggcuuccguguguuagauccuagcuagugcgaggaacagaguggaacaguagaugcauuucgugcugccugaagacaaguagagagcaaugaacaacuagcgaaugacugcaaaugugcaaugcagcuaugaggaaaaggagccaaguggugagacaugcagcaaggugggaaggggagucuacccuagguaaggagccaaggaacaucugcaaggagggaaaggcgucuagccugggcaauaaggagccagccaugccaaaaaggaagugcagccuacugggccaggggaagagcacagugagaaagcgcaagggacuuggccugcucaaggaaucagaagaucaguggggguggggguagcaagccaagggagaccaaaggggugggaagagccagaucacacagguaaggcccagaaaggcccacguccuucaucucaguaagaccugcuggacaagaggaguugagaaauuccacucaucucuucaccuguuuauuuuacacagcccauagcagggacuuugggaaucuaaagaugguuccugccaucaagaacuuacuugcauguaauuacaacuggauuaaaagcauacauauauaccaaaaaaaaaaccaaacaaacaaaaaaaaacaaccagguuaaaaaagcuuacugucugagaagauaaaauauuugcaugggaaucaccuagccaucaacuaauaauaaaggaucuuggagauuagcucuucgguacaaaugaaacguaaagcgauugccugcaucauaaagcuaguuaggagcagaacucagcucagguucugacuucuagacuagucuuuaauucaugacauuccauuucagacaacaacacaggcaccaaagggcaacaggugaacaaguaccaaaggaugguacaagcauguuuuauggguucacagaagcugguaagcaggagaugaggcuccaaggaauagacagguagagccaagucugggugacagacagacaggggaggagcauuugagagggcugggccuggugaaggaacaucaugcggagacagcugggcccagaguuaguucucacucucccaccuccuaaaccuugguuuucuccccugugaaauggaaacuauaguaccugccucaguguugugugcauuaaguguuaguguauguaaagaaccuaauaugacacauagcagauacuccauaaaugcugguauagauauccauacaucuccaaacccauuauacaaugaaaaugcaacagaagacugagaggguagggaaaggaggagucccuguggcuacggcugaggaucuuuuaaagugugagguaaguuaaaacaguaagaggcaguacuagcaugaugccugaccaugcccagccccagcuggcaggggcucacugaagaucuggguagagccagaacugucaugggaccagaagugagcuuuccucauggagacccugccuggaauuuacagcaaacuacaaguuuguauccugaaacaaaauaaagagcuagucucacaaaggaucaaagcuaugaaggucacccugcucuagcuacacacugaacuguuaacacacuuaccgguuuagggauaaaguggaaguuugagagggcauccaauuuuaagaagagggaauccaucaucuucugaauuucuacauguucuggauuuucuucuucugcuguuuuuugcuuaggaaauaaguucaacaaugucaaacuaagcgacuugauauauaucacaggacaaaacacuaaaggucaaugagaguauuucuaacuucucaucacuaaagcuucagcuacaaagaaacauuccaaaagcaaaauuaaaagcagcaguaccaugaggguuccagcaccuaccagagaugugaugugcauuuuaggagcuacaguaaccauuaccucuaauacucagaacuuaaaaauuuaauuaccuugguauuuacuucugucaaaaacuaagcuauuccuaagauggcuacaguuguuuuuaaaaggaaaauagcaagugauaacaaguguuggcaaggauggagaaacuggaacccuugugcauuguugauagguaggaauguaaaaugaugcggccacaguggcaacaagcuuggcaggucuucaaaaagcuacacagagaauuaccaucugacccagcaaugccacuccuagguguacaaccaggaggauuaaaaauagauacucaaacaaauacauguacauggcacuauuaacagucaaaagguggaaacagccugaauguccaccaguggauaagcagauaaacugugguaaauacacacaacggaauaccguguaaccauaaaaaagaaaugaagcacugacaaaugccagucuugaaaacacaacacuaacugaaagaggucagaaauggaaggccacauaugguaugguuccauuuauaucaaauacucaaaauaggccaauccacagagauagaaugcagacugggguuuguuggggcuggggcaagugaggaaaggguagcaacugcuuaaugcguauggggcuuuauugugggcugauaaaaauguuuuagaacuagagagagcuaguaguuacauaacacuguccuaaaugcucccaauuuguucacuaagugguucauuuuauguuauauaaaucucacaucaauuaaaaagaaaaaaaauggcccagcaugguggcuggcugggcgcgguggcucaugcuuguaaucccagcacuuugggaggccgaggcgggaggaucacgaggucaggagaucgagaccauccuggcuaacauaaugaaacccugucucuacuaaaauacaaaaaauuagacgggcuugguggcaugugccuguuacucaggaggcugaggcaggggaauugcuuggacccgggaggcagacguugcagugagcuuagaucacgccacugcacuccagccuggcaaccgagcaagacuccgucucaaaaaaaaaaaaaagaaaaaaaagaaguaaaguguuaauauagacuucauaaaauuauccaaauacccauuuggaugguagggacuuuuuuguucuuuuauuuacauguaauguguuaaagauuuauucucacaaaucacauugaaaaaacugacagcaauuuuaauucuacugaagagaaaaagaaaauuucaugcuucucucucuguccccuuuggccccaaaugcuuauucuaaaugccuaagagggcuuuuuguuuguuuguuauuaagacaugaaaaaaagaaacccaccagaacuaggaaacgauaggcucuuugccuccugauccugaugacagagaugcauucaggucuguuuccaauguccaucaucagcacccaccuuccagccauagucaggcaucacgcuacuacugcuuacuauuuuaacguaccucacacuuuaaaaaauccuaaacauguccuuucaccucauucuagguaacaauaucuguaaaaucaaauauguagcuauauauuggcuacacagcauuuuucugagccacauuacauacacaaaugugaguaaaggguccuacaugugcuguuuaccaucauuucacuucuagaacuagccuagcuacuagaacuccaaguccauccucaaaaacuucugaacuggcuguugacuucuaagagagaaaugaaacuaacauuuagagcuggcauaagcuauugcauuaccuaucuaauuuuuaauucucguggucaucaaauaccuucuguaucuacccaaucuccucaaagauucaaaugaaacuguacacauccuccuucagcuaccaccuuggauugcaaggcagccaggaagaauuuuaauucaaaucuuuucaguucuucaguuucacaguggcaucagggcaauuugcuguugcuaacugaggggcauucauuaacaaaaucuggugggaaucguaaauggcuuuugcagaagaaaaaugccaucugaucccuaaguacccacauucccaauaaaucaaaugugaaggaauaauucgauuauuauaucagcauauaauauuccuaggaauaggaccuuguccuauuauuuaaccagcgauuucuuccuuucuuucuuucuuuuuuugagauggagucucacucugucgcccaggcuggagagcaguggcgcgaucugggcucacugcaaccuccacuucccugguucaagcaauuccccugccucggccucccaaguaacuaggauuacaggcacaugccaccacgcccgucuaauuuuuucguauuuuuaguagagaugggguuucacuauguuggccaggcaggucuaaaacuccugaccucaagcaauccgcccgccucagccucccaaagugcugggauuacagaugugagccaccauacccagcccagagauuuuaguuaagugaaagaaaaaacagaccuaaaaaucagaaugaauucauaaucauguaaaauauaucaguuacuucaaaauaucaaugagaaaugcuuuuaaaguuguagcaccaccauaauugcuagaaaguuaaugaguuguaaaaguaucaggugaccaaagucuaauugcaaagcaaccccccucaaccccucacauccagcgggaauauuagaacccuucuauuccuagcaugcucugucucauacuuacaugagguagccaaagagcucaagauuucuguuucacgauuucaacagucacaaaaagccuaguucucuacuucuauuucuuuaauaauaauggcuuggccuuacaggcuuccucaccugguugaguuugauguacuccuguucauaaauuucagcaaggcucaauuuacucuucucauggucuaagguuaaacgcuuuuuauauucauaugcauccucuuuagguuuuucuuuacguacuacaucaucccaagccugaaacauaaagugcagguagaacauaacaaaaccuacaauuuauuucuagguucacuuaagaaucuuccucuggaauauuauuauaauaaauauuaucaauauauuaauaaauuaucauuaauauauuaauaguaaauuauaucauuguuauaauaaauauuuauuauuacuuauuacagaguaagcaaauuauagcaaaaagaaaauuuucaacuccugaaauaacuauucaagucacaaagaauaaacauuaggaaagcaaagaaaccauuacucaaauaucuuuuucuguuuuaaaugagucuuccuaccugguuaccaacuuuaauuccacauuuccccaucacaguuuguuuaaaagucaagccuugaguuaguuuaucauguuucauuucaaauuuuaagauguucugcacaugauacucacccuuuaaacccuuucuauuuuagacccacaaguguaggcaaacauuauacacauguuauaaggccaucucuuacuguacaugccauauaucuaaguuuuauucuaaguuuacaaaaucagaucaauucuucaacaaaaaccacuagguuuuuaacauuugaaaaaaauacaccauugagaaaugguuuuaaaauuguagaacuaccacaaugcuaggguuugaauguccccuccaaaacucauguggaaacuuaaucccugauguggcaacacucagauguggggccuucuaggacgugacuggaucaccaggguuuugcccucaugaauggcaguugcauuuauggauuaauggguuaucaucagugggggaaugguggcucuuaagaagagcaagagacaccugagccagcaucuuagcaugcucagcccuuucaccaugugaugcccugcaccaccuugggacucugcggaauccccacugguaagaaggccccucgaccuuggacuucucagccuccauaacuguauuccuuuuaagucacccagcuucagauauucuguuauaaguaacagaaaaaagacuaggacauauauacugaauaauuuaccacaccagauacugugccuaagccaaggguucugggugcaaccaucacaggucagccaccagcuucacugagcaccgcccaaaaggucagcaagacucacgagaaaggauaauggcuucuugcuccucucaggcacaauacucgucuuuccuggauacuacugaagagcaguaccucacacaacaaaagcugacuagguagccuagauuuaagguuugugaacacuaagugaaaauaaaaagcaauaguccuacucucaaaguacucucacauuauuucuaaaaaucuuggugacauuuugauuaaguuaaauuuaauucuuacugaccugaucucuuauccucuguuuaaugauaucuuccaguugaagggugguuuccucuguaaucacaggugcuaaaggauauacaacguuuauucauuagguagauauccacuagaccauugauucagugcaguccuuggacccacagcaucagcaacacgugggaacuuguuagaaaugcaaauuccugggccacccccauacuuccugaaucagaaaguggggaagagggacagcuaucugugcuuuaacaagccuugugaugcucccugaaguuugaaaaccacaaaacuaggauacauaugguaguaagugcuaauacuuuacccaagguacccagggacucuuccccucuuuuccauucucucuuccauugaaauaaaaugaaaacucauuuugauguaauggguacaagaaagaagucaaugagaugaccacaguuucagguugaaguucaaaauuuaaucaguggaccaugacaggaugcaagccuucaaaacagauuacuacaagaaagcugauuacaaacuauacauuagguaucauuagcguauuguuaaauuuuuuggguggauuaaugguacugugauuacauaggagaauguccuaguucuuagacgauaucugcaaaaguacuuaaaagugaagugccaugagauuggcaacuuacuuaaaaaaagggcacauauacaaucuuacauaugcuagggagagaaagcaaauauaacaaaaugguaacuggugaauccaauugaauagcauauagguguucacuguaguauuuuuucaacucuucuguguuuauaaguugauuuuuucuuuuuugacagagugucgcucuguugcccaggcugcccacgcuggagcacacuggcacaaccuuggcucacugcaaccuccccuuucuggguucaagcaauucuccugccucagccuuccgaguagaugggauucugaaaucugccaccguaucuggcugauuuuuguauuuuuaguagagacgggguuucaccauguuggccaggcuggucucaaacuccugaccucaggugauccgucugccucggccucccaaagugccgggauuacaggugugagcuaccaugccaagccauguguuuacaaguuuuuaaaauaaaaaguugagggaaaagaaacaccaccccaaaucuuuguaugaaauggaaccauggaaaaagcacagacaugaaaacuacagaagagggcaccauacccauccggacagcauggucaaaguguagggucuccuccaggaggcuguucucuggccucuucugugcugucacuucccccugaagcugccacggcuuuuuuucuaacaacucuuuuucuaaagaugcaauuuuuucauucaucuaagaaagagauaaaauaacuaguauacauuuagaaaauaaaaucuuauauuuguguaaaagcaaaaaauaauuuaaaaagugggaaagcaagaaacguacuguucuacgauucuguucuugccaucuuuuuauucugucgaugacuuccuauuucugcugccuaugguggggugagcugcaaacaauuucuuuuccugauuaauuuaaaaugccauguuuauaauauacuaaacgcccccagaagcuuuugaguuuguuucugggcucuauucuauucaagugaucuaucuauucgcaagucaaguaauucuuugauuagaauauuaguaucugauggagucugacccuuuugacuccaaacucaaauucuuacucuaacuucuuuuuuuaaaauuuuuuugaagcagagucucgcucugucgccuaggcuggagugcaguggugugaucucagcucacugcaaccuccgucuccugagcaauucuccugccucagccucccgaguagcuggaauuacaggcgugugccaccacgcccggcuaauuuuuguauuuuuuaguagagacgggguuucaccaagugcugggauuacaggcgugagccaccaugccuggccauuaucucuaacuuuuaaaagacaacaaugaugacuucaguguauaaaaugccagccuuuucagcuaccuuacagaauucucuuauuuuccuaauaucaauucaguuuauccauucgguuuccucuccaaauaccaacacuuucauuuuucacucuuaguggaauauaaauacaucugcaguauuccuaaucuuuuuuuuuuuuuuuuuuuuuugagacagucucgcucaguugccuaggcuggagagcaguugcgugaucucagcucacugcaaccuccaccuccuaggcucaagcaauccucuuaccuuggacucccaaauaacugggaccacaggcgcgugcaaccacgccugacuaauuuuuguauuuuuuguagagacgaggucuuaccauguugcccaggcuggucucgaacuccugagcucaagcaauccuccugccuuggucucccaaaguguugggauuacaggcaugagccaccgcaccuggcaguuuuccucaucucuuaucuuuaucuuuuguaguuacacuggccuaugcgucuaaaagaauguuaaucaacagugguaauuguaauacuggacaucuugucuuauuccugaucuuaaagggauguuucuagaaugaugcaugcaucaugcaugauggcaguuuuuggcuuaaauguauuuauauuccgcuaggagugaaaaaaaaaauuagaaaugaauauugaauuuuaucaaaugucuuucugacauauauggaggugacuauauguuuuuucuccuuaaugucuugcagucaggaaucauacuagauuuucuaauacugauucaagagaauaagguucaugcaguuguguggcaucauuuuuccacugugcuguaggauuuuugcaucacuguucaugaaugagacugugcucuguguguguguguguguguguguguguguguguguguguguguguguuuuaaugcuaccucugucagguuuggguuuucaugaccuaacaguuucaaaaaaaaaaaaaaaaagguugaaaguucuacuuuauucuuuauauguggaaauugaaauaaauuauuuuugauuuauugaaacuuaacuugaaggucugauauaauuucacaauaaaaccaaaccuuucuuucuuuauuuguuggggaagggcgggaggagugggguggaaggauacuaacucauugauauuuuauaauggugcuuuuuuucccuuagaauuucucuaucuucuggggacaaucugacaaccauggauuuaauucagauucuuagauuuuaaaaacaauucuuuugauauucuugguaucuuucauucucugccuguucucuuuuuuuuuuuaauuuuuucagacagucucuagcucuguugcccaggcuagagugcuguggugcaaucauagcucacugcagccuugaacuccuggacucaagagauccucccccaucagccucucgaguagcaaagacuauaggcacacacuaccauucccagcuaacuuuuuuaaucuuuaguggagacgggcuuuugcccuguugcccagguuggucucgaauuccugggcuccaaacaauccucccuccucagccucccaaagugcaggugugagccacugugccuggcccuauucucauuuuuauugugauaaaaauuuuaagguaaauaaaugauagagccaaauuauuagagccagacuacaucuacaaaaauuuaaugaaauuucacuugucugaaaucaugacacaaagaaacaauuuuuaccaacuuugaaagauauguuugugaugguauaaauuaaaauucuggcuauuuggcacucacaaaaaucuguggagcaccuuaaagacauaggugguauccgcugggcgcaguggcucacgccuguaaucccagcacuuugggaggccaagguggguggaucaccugaggucaggagcuucagaccagccuggccaacauggugaaaccccgucucuacuaaaaauacaaaaaaauuaguugggcgugguggcgggcaucuguaaucccaacuacucaggaggcugaggcaggaaaauugauugaaccugggagguggagguugcagugagcuaagaucacgccacugcacuccagccugggugacaagagugaaacucugucucaaaaaaaaaaaaaaaaagaaaaagaaaaagaaaagacauaugugguauccuccaaaacaguggaaacaguuaagaugcucacaggacagcuuuaucaggagagacaugcuauacauauaaagauauuagggacagagaaaaaaacaauuaucuuuaaaaauuuuuuuauuuuugagacagagucacacucugucgcccaggcuggaguccagugacaccaucucggcucacugcaaccuccgccuccuggguucaagggauucuccugccucagccucccgauuagcugggauuacaggugcccgccaccacaccuggcuacuuuuuuuuuuuuuuaguagagaugggguuuuaccauguuagccaggcuggucucgaacuccugaccugaagugauccaccugccucagccccgaaaagugcugggauuacaggcaugagccaccacgcccagcagaagcaacuauuuuacucacaggccccaaacugaaaugcaggcacugauuuugcaaaucagaugcuuuccauauggcaagauuuuugguuuuuuguuuuaagacaaggucuugcuugccgcccaggcuagagagcagugaugcaaucuuagcucaccgcagcaucaaccuccuaggcucaagugauccucccaccucagacaccagaguagcuggacuacaggcacacaucaccaugcccagcuaauuuuuguauuuuugguagagacaaggucucacuauguugccuaggcugguucugaacuccugagcucaagcgauccucuugcuuuggacuaccaaaguguuaggauuacaggcgugagccacugcaccuggccaagauauuuguuuucaaaggaugguuaauaguuuucaaaggaugguuaauaucaaguauauuaaaaauuccuuaaauuacuaauuaccuuuuccugucuuuuuucaaaggaggauuuaacuucaucagaauuuuucuuuacauuuaaaacaccuguaucuucaguuuccgcaucaucugguaaagcaaaggucacucuuuucaagcuuucuuuauguuguuuauugucuucauuuucuugaaggucaucaucuucaucccuacaauaccaaaacucuuauaaaaagaaauauacuacuuuccauuagaaaaacaaaaggaaacaaauuuucccuuaauaaaguucuuauuuuauauaccuaaugcaaccaaauacucagaacuuccaaaaucauucaguuauuaaggaacaaaagguauuauuuagguaaaacgcuauguaagaaacagaaaaaaaaguguccaacauauagaaaauaaauuauucaucaaucuauaauacaaaucucuuaucucacaaaaauaacaggauuuuauugacacaaaaccaaaucaaaguuccugguaaggaagguuugauugcuacuaccagagauauuuuucuucauuaagugaucucuaaugucccuuuacagucagagacuuuccucuggcuaucuugagaauaucugauauuagagaauagaacuugcuaagacaaacacauuugauaacuacgaguacacacacaugauugggcaauuccagcuuacaauguaaaggaugguucaaaauacucacguuuccgaaauacuuaguucuucugcuucuucuucagcaauuucaucaucuucuuuguuugaauccagcucaucaucaugaacauuuguuaugucuucaucacuuucaacuggaucaaaaaaaucuuuguauuucagauuucuggaacuuuuaccugacuaaaauaaaaagauauuaaaaacuauuaauuagggauagaaaaauauauuaacacaugcauauagauuugcauguauauuguauguauauauuacuuucugacuuaauaacacuacaagcuaauaacuaauaaccaaacuaauaacuaaauaauuauuaggugaaaauggcaacuaauaacacuaccacaaaauuauaagaccaacuggaacauaaauugaauggaaguacagauucauuuauaacugauaagauagagcacaauauuucuuaucacuaaaucuucuaacuacaauuaaaucucuccuagaaaaacagaagaaaagcuaauuugaggaggaaagugcucucucuucucucaaaacuuuaccuuaaguuuuuuacuuccaaacagucccccuucaucuucaucagaaucaauaucuucaaaaaaaucaauaucuuccuccuccucaucauuaucaucuuuucguuccucuucuuuuucuauguuuucuaaauaggccuccauuucagagaguuugaagaauuuaucaucuacuauggacuuuucucuugguuuucccuguccuuuguuuugcaccuugcucugcuguuccaauuugcugauaucaaagucaaggucagaauccucaucacugaaaacggggcuuuuccucagaucagauuugcuugaguuuucagcucucucacccauuucaggaucaucauuacccaugucggacacuuccuccuccucuaaaucuucuagguccuccuugucaucagccucuaucucugaaccauccucuucacguuccuguucuucacucucugggagaagacugauaucuucaucauuaauuguuucacuaacugcauucugaaaguauuguaaaauugguucauuuugcaauuccaguuguugccaaaucugcucaucaucaaaauuuucuaucacaaguuuuugcaaggggcuuccauggauccuaccauucucuaauauuuuauuaaagucauaaagcacuuuuguuaaagaagugaacuuugaugccaaucccucuugaauccuauugggaggaauuaagugagauuuagaauuacagguaauaauuucacagcacucuuaauaaaaauaaaaaaaacccaacucuuuuguaaaauaaaauuugaaugaaguauaaguauagauucuggcccccaacaacauauaagcugaugagcuacacugauauauaaaaccugucaaccaaguaucugugaaucggcuguauagauuuuaggcaggaaaaccauuauaaaucuauuugcuuggagauauauagugaauuaaccuuaaauuaucaauucugcuacauuauauaccacuccauucauuuguucacuuauucauucaaugaucaacauuugcuuuggcuacaguggucaaggaaaaccucucuuagaugucacaucugagaggaaaccuacagauaaggagauagucuuauaaagguugggaaacauguauuccaggcagaagaaauccucuaagaugcaaauccucuagaggugagcuugaggaaacaaacaggugaccauggcuagagugugaaggaggcagagggugaagcuggagagacugaugggagccaaauuaugcaugguucaggaguaagaauuugucauuuaaaguguaaagagaaaacauuuuaagcagagggaugaaaugaugauuuacacgaaggaaggagaaagggacgagggaggaggaggaaaguacagugauuagaagguugaugcagcauuccagcgaaaggauaauggugauuuagacuggaguuagagcagugaauaugcugaguauaguuuggagguagaacugacaggauugcuaaagaauuagauauagaauagagaaaaaugaagacauuaaaguagcagccuaguuuuauguuugaguaccugaaaagacagaagugccauuuacugagauagggaaggcuugggugguggugucaggccucugagcugaagcucagccauuguaaccccugugaccugcacauauauguccagauggccugcaggagccaagaagucuggggcagccgaaaaaccacaaaagaaauaaaacagccaguuccugccuuaauugauuaaucaacauuacaacauuccuccauugugacuugucccugcccuaccuuaacugaucaaucgaccuugugacauucuucuucuggacaauaagucuuaugaucuccccaccauguaccuugugaccccguccuccucugcuaauagauaaccaccuuuuacuguaauuuuccauuaccuacccaacuccuauaaagcaaccccuuccccaucaccauuaguugacucucuuuucggacucagcccacuugcacccaagugaauaaacagccuuguggcucacacaaagccuguuuuaguggucucuucacacagacgcgcuugacagguguagcaugggaaaaggacuucaggggauggcagaguauagguggguagaaacaacaauucuauuaaacagacacaacagcucuauuuuggacgcagugaauuugagaugcuugacaguaccaaaauuuuaaaaaucguuaaaaguuguacaguguggauaucccaguugugugcuacggaauucaaacuaagcucagucuguaguugcugugagcugggaacucagggaaagguugggguuugaaacauaaaugaguaauaauuucauagaucacauuuuaaauucuucaacaaaauacauauaaaacgcuuguguugggaagagacauggaaguucuauuucugaagaagcuuagucaugggggguggacagacaagugacaaguucguacuuucaauaaaguaugcuaagcgcuaagugcuuugagagcacauaggaggaaggagaaaccaacagucuguguguagagggaugggggcguaagaagcccaagggaagcuucuagguguuaacaauugagguuagagugauuucaguaacacucaacugagagauccaucuauacaaauuuuaacaguuuuuaaaauuuugauagccuaggaaagcauaaacucugaaauuuggggaaaagcgauuuuacguuuccccuuaccuucccccagcuccacaauuugccggaggccugcaacccgcguccacgugagaccccggucgcaccccgagcccgggaucugcgcacuuacgugaggaagcacucgggccgacccguggcuuugccgacuuccgucagacaccgcuccaggguccgucgacgccagaccugcggcgccauggcugucagcaacucccgacacaaugcagcaugcaagggaagggagccgcccggaaaccgcgcggcaaagaugcgccc

SEQ ID NO: 15211 - RNA, 1284 nt, Homo sapiens
aaaugaaauugaacuuuuacuagagcuguuuaaacacauucuauugaauacaacuguauuuuauauuuucuuuuauuuuuauauuauauaaauuuguauuuauaaaacagcuuuuauuaaaaguauuuuugcucugaauaauuguauuccauacauguaaauauaaaaaauugcuacauggcccuuuaaggcauuuaauaauuuuacaaaauacaguaacacugcagaagaaagacauaagaaguuuuacuguuaggaacauucuccaagccagaaaaauaggcauuagaguaaggacauuuccacauucaauauuaauugauauuuggagcagaauaauucacaguuaguagucagauugauagagacaggagguauaacagugguugccagcagcugggggcagacaauaggaaaauguugaagggguacagagcuucacuuuugcaagaugagaaguucuggagguguaugauguugauggcugcacagccaugugaauguaccuacuacugaacuguacacuuuaaaauuguuaacaugguaaauuuuauacauguauuuuaccacaauuaacauuuuuuucuuaagguuuucaaauaaaaaauucgguaguuauuugaauaacuaaugcuaggcaggacuggucagcaggaaaaagcugcuccaaagguggcugaggguaaggaaagccuucguaaccccucaggcaaaucaacaaagagaucuuuuacuacaggaaggugcuacaucugccucagagcagaaguggugcagcacugauuuagguucugaauuucuuaaggucuaacacugacauucuucacaugcuaacaguuccgauguucaggugccucacagaagcaaugucaaaagaaauaugcuaucugccaagcaaagaaacaaacugagaaacagcugugucugccugugcaugcauaaacuuaaccaggcauaaaggguuccuagugacacguaucugcauggcaguaccacagaguacugccauguaguugaauuugaauugucccguaaaugccuccaaaaagauuucaugaugauauacaacugagacugcacacuacuguguggacagaagguugccuuccaucgggcuaagcuccacaauuaaguaaaaacugccaaaucuuuugggcagaucauaaaauguucgaagucaggacaagcuggugagacugacucacacacuguaaggacuaucacugaacauuuuucuguccuaagucccagcugacuuuccaugacaguuguuuaauuuccaca

SEQ ID NO: 15212 - RNA, 6447 nt, Homo sapiens
uacagaggagaccgcugaagcguccaggcgccucccccagacuggagaagaaagcugacucccaaacccaagucucugaccucccuucaaggcggccuuuccugugaucagaggagcugccgccugcagcugcccgcaccgcgccagggugcuugguggacaggcugcuuucagagcgagccugagauacagacagacgauggccacacaauauauaaaaaacagaacucuggcccacgacccacagugaccugccuaggaaaccaaccucuuuaucuauagcaaacagcccgggaagccagucucuugcaggaggccagccucuuuuuuuuuuuuuuuuuuuuuuuuuuuuuuuuuugagauggagucucgcucugucgcccaggcuggagugcaguggugcgaucucggcucacugcaaccgccgcuucccggguucaagcgauucuccugccucagccuccucaguagcugcaccaccacucacggcuaauuuuuguguuuuuauuagagacgguguuucaccauguucgucgagcucaggcuggucucaaacuccugaccucgggcaauccacccaccuuggccucccaaagugcugcaauuacaggcaugagccacuucuuaucucuaguaacaacccaggaagcuaagccaucauuuccguaaaagucagucuaaaauggccaggacuugguuaauaacugaccgauucucuaauuuuuguccucacuuuccauuuaggaccaacccgagagagccaacuuugcaccccuaccaaucccauaggaugcccagccugcagcgaggccccccagcuuccccacgacaacggccucccggcaggaggccccggaggccuucccuuugucccacuagaaagcucccgcuccucugccagccugugggucucugccacacgcaaguccugguggcuggcgcucuugccguugaaguccugcuaaacaaaaugucuuugcuccacucauuucucacuggucuuccuuuauuuccaccagagggagucagaagggccagcgguuuuccggcaugggguggucaaagggaccuggcgaaauauaugggagcaggacuuugcucuuucuuccugauuaccgaagaauauugggcucaaucagguuucuggggagaagaaaucugcuuuugggucuguuucuucgaagcaacuggaaauccguauuggaaaauuagaggagcagaaauaugaacaaaaauuagugcuucgcaaaugggaaaauguaacaagcagaggcuacgagaaaggucccaauaacgugggaugaauuccucaaaaauuggcggcaggugacgggcaucccuauuuggccaccagauggcgaugagcgccugucuuuagcuccuccuccgcccacuccaggaguuuggaaagacugggccuacgccccucaacacuccguccggucuuugaaccagaggaaugagggacucugucgcucugucugucugucucucuguucacauggaugaaaagggaagggcggcacuggaucuuaggccaggaggguagauucugagcugauuuuuuaagacaagucacucaauugcccugggccuguuugauuguuacuauuuuacuccccacauuuuaauuuugaaaaauuuuuuaaauuucagaaaaguugcacuaggacacagugaauaccugugcacucuccaccucgacucacugauuguuaaaacgcugucacauaggcuuuugccccucuuucuccacacaaauacacacgcuuuuuauguuuugaugaaucauuugccaguaaauuauacaucgugaugcuucacccguaaauacuucagcauguaucccugaagaauaauauuuuucuacacaacagccguauaauuaucauuuucaguaaguguaacaucaauacgauauuauuaaguucacagcccauguuagaauauucucaauuaucccagaaaugugguuuauaacuauuuuguguccugaucugggaucccuugacaauugcaugacauugcaaucacacacugcauuacacuguauguuucuuuacuuuucuuucaucuggaagagucuucacaccuuuuaaugccuuuucuuuuuuuuuuuuuuuuuuuuaucacauugucguugcauuaaguccugcaacuuuuagccucuucaucgggggcagaugcugguguguuucacugcuugucuuauagaauaucccauaaucugaauuuacucaaguuuuuccuaaaguuuagauuaaaguuagcuauuuugggcaacaaccuuagagucuaguugagugguucccacuaaaccccacccggggcaccugauauuagguguuccugcuacagguggugcccuguuuggucucaugguuaagguggugucuaucagucccuccuuuguaaagguuaacauuauacccuuugcgauuaguacacaaucuauggggugauauucugagacuaugugacaauucuguguuucugcauccuuuugccccauggguuuagccuccguugcugauccuggccugaaucaauuaguacaacggugguugcaaugagaaaguuuugcuaaagcuaccuuucuuucuacauguauuaccuggcauucuucuguauagaaaagcauugccuccucaccuguuuaaguaucacuauggacucauggauucuuuuuuuucccaaguaucauuauuuuuuugacacccaagucauccccaauuuguccagggggagccccacuggggugggagagagcccccuguguuccugugacauaucgcugucaauuuugggacgccuccuuacuucccggcaaaacaagaucuuccagucuccucuuguacuuucuaagcccaggccuugauucccuugagcaaaaauugguauuuagaaaccaagaucugggugugaggugugcucaucaccgcuggggugucacugcuuuucagcccauugaugggacacagcucuguauuuaacaugaguguguucugaugccuccaauucaaugcagcaaagggguuuuuuucccucaucuuuccauaauccacaauucacgacuguaucacucuucauuccauuaucauuguuuuuaaucuguuaaauaaguggcuuggaucagaugaugccuaggucaguucucgucccaauauuguuuccgguggucgucuugcaaaguacaguggccuuuggguaggagucuuuggauaagcaugacagucagcccagcaacaggcugacaggaaggucaccauguggacuuugcaaugccaagucaaaaaaggcuccacagggccugucugccucuccuuccuggauucacagagacacacccaggucucaggggcaagggccagacagcugaacauggaaucaagguguccagauugcaauccaacccucuccacucacucugcguggccauuauggucuuuccguauggaaugguugguacccaaacugaaauggcagccaaaugcaagaugcaggggaggcugguuaugguuuuggcuuugacaacaaaucuuaagucucuauugaaaaucuuuaaauaaaacucuggggaccaucauaaaauaaacaaaacaacagcaaguaaucaaauuauuacuguaacaugacccaauuaugguacaaauaccuuggggaagggcuuagguguggcuguccuuacaauggcagccucccucucagcaccuccuccacauccccugagcuggggcuggagcccugaacugcagaaggagcaggggcucagccucaggcugcuuaacuaacuccacguggacucugggcaagccgcaguggaggugagcacuuuuuugggcucuguucagcuugagacacuuuguauuaaccucuccacugaucuguguggcacugacucagcccacauuucuuuugcuguggcagacagcauggccaaccggaacccggacugcacaccccacagugcagagcccugccuggcugccucugcagcucaaccucauacccacuaugcagcagacacuaaaucaguguuugugagcugaagagauucaagccaccaagaccugcaagcuauccacucugugcacuucuuaccagaucaaucauccugaaauaucaaagucugcgcaagaccuuucagcucucccuagcccacuccgccuuuagcagaacauccaaagucccuccuuugcagccugacagccccccaguuggcuccaacccacuuuuccaacuuuaugucuuccugccucuuucauagcuucucccugcccacccagagcagccucugaucuauagcgaugcccuuugccuuccuacuggcagugauuugugggguuaauuuauucuggguaaaagaaauuaggggaaggggcacacucccagggcaggggaauucgaggccaaggaaaagcugccaaucaaagugcagaaacugcuuguucauaaaucaacugcagggcucacaaguaggcccaacauugacauuuguaggaaggguuuuggggaccacaaggguguagccgugcuguugguaacugacuggcccaugugcucaaagggcugcuggggugcucuggggcugcagaccucccccgccucccuacuggaauguggguuaccauggugaccaaaggggccaagaugggaggacaacaugggaaguacaaggugggcugggccuggagcuaagagggugauaugguuuggcuguguccccacccaaaucucauccugaaggagauagagaauuacggguagcucccauaauuccuauguguugugggaggcaccugguggaagauaauuaaaucauggggcgguuucccccauacuguucucaugauagugaacaagucucaugagaucugaugguuuuauaaggggaagccccuuucacuugucucucauucucucucuugccugcugccauguaagacgugucuuucaccuucugccaugauugugaggccuccccagccauguggaacugugaguccauuaaaccucuuuuucuuuauaaauuacccagucucaaguauguuuuuaucagcaguguaaaaagagaauaauacagagggucuuugcauacacccuuagaguggaccuccuuucuccucuuggagaaagcagauguugccuguucccagagcucucuguaggcacauacccacugugcuucugcaggacugacaucugauaaacucaagcugggagggaagugguaaaaagcagaagucugcaaaaauguugacacucggaaaauagacaugcuuggaaaugguuucugggcuggauggagguugaaaaaccugugcaauuucuaccuggucuggggcuagucugaaaacugauuuacaaaaguuauuuucuuguucaagcacagacauuacagggugcccagguguccacaaaguggcagagagaaacuagaaaaaaugcacaguuaaaaaaguuguccagggcugggcgcaguggcucaugccuguaaucccagaacuuugggaggccaaggcagguggaucacuugaagccaggagcucacgaucagccuggacaacauggugaaacccugucucuacuaaaaauaugaaaaaauaaccaggugugguggugcacaccuguagucccagcuacuugggaggcugaggccgaaucacuugaacccgggagauggaaguugcagugagcugagauugcaccccugcacuccaaccugggugacagagccagauuccaucucaaaauaaaaaauaaauaaauaaaaagauguucaugcacuugacauuaaaaccuaacucuuccagcccugaagcccucauuagcccucauuauuuauuugugucuaguccaggcagaaucacaauaaacaagauuccgagagagcaaagccagcaauuauauaauccuauccaugaaggcuaaacuacaaaaucaaagacagcugguuaaggagaagccaucaauucaacacaggagugguuaagcuccacccacccuaucacaaacagguggagaauguguucauguugguuuuucaagcaugagcccuuuaaauuucaguccaaguaaaaggaaguaccacuuucucgagaaggcucagugcaaugauuucagaaacuuguuuuccacggcagugguggugacuuggauugcuuucaagaaggauuagguguauuuaagggcaacugcuucauuagagacugauguauaagaaagaucuccucaucuggugauggaggcugcuguucaggagggugcuagacaccuucacaugaugcuucuuggagauguuagccauaaaauugucacagugaaugaggcauugccccacaaugacaucucuuauguuuuuauaucagugcaaaccuauuaguugaagaaaaaaauuguucaaugaagagcuggcaucuacaaagcuuuuagccugguuugaaccuc

SEQ ID NO: 15213 - RNA, 1188 nt, Homo sapiens
aagaagucgcuccaaaaucgccagcaccacagcaacucaauaggcuucuauuuccauccaccaaggccaggacacucguaugcucccggacgcccucuccggcgucccuucgcugagcccggccuggcuagcccgccaccccgcccgcuguuacccgacugcccgcaccgaccaccugcggccgccaaggugcggcagggggcgcugugcggccgcagaggccgcgccgggccgcgcucugauuggcuggaggccgcggcccucgcccaggccgcccgcccagucugcccgccccguccgcuaagugccugggcucucccgcucgcgucccagucugcgggccuccggggcagcggcgaggccggagcgucgcggcggagaggacgagaccgggacaagaccagggcaggagggagccggccagccgcgagaaccccgcacgcccggcaagaugcuguccuggcggcugcagacgggccccgagaaggccgagcuccaggagcucaacgcccggcucuaugacuacgugugucgggugcgggagcuggagcgcgaaaaccuacuccuggaggaggagcugcgcggccggcgcgggcgagagggccugugggccgaggggcaggcccgcugcgccgaggaggcgcgcagcuugcggcagcagcuggacgagcugagcugggccacugcgcuggcggagggcgagcgggacgcucugcggcgcgagcugcgggagcugcagcgccuggaugcggaggagcgcgccgcccgcggccgccuggacgccgagcugggugcgcagcagcgcgagcugcaggaggcgcugggcgcgcgcgccgcccucgaggcgcugcugggccggcugcaggccgagcgccgaggccucgacgcggcccacgaacgcgacgugagggagcugcgcgcgcgcgccgccagccuuaccaugcauuuccgcgcccgcgccaccggccccgccgcgccgccgccacgccugcgggaggugcacgacagcuacgcacugcugguggccgagucguggcgggagacggugcagcuguacgaggacgaggugcgcgagcuggaggaggcgcugcggcgcggccaggagagcagacuccaggcggaggaagagacgcggcugugcgcgcaggaggcaaggcgcugcggcgcgaggcgcucggguuggagcag

SEQ ID NO: 15214 - RNA, 316005 nt, Homo sapiens
gcgcgagcccccaguguguggcagcggcggcggcggcgcggcgaggcuggggcucuuguuuaccagcauuaacuccgcugagcggaaaaaaaaagggaaaaaacccgaggaggagcgagcgcaccaggcgaacucgagagaggcgggagagcgagagggacgccgccagcgagccugcccacggccggcgcucgcagacccucggccccgcuccccggauccccccgcgcccuccacgccccucccgcgcgggggcagcuccacggcgcgccucgccucggcugugaccuucagcgagccggagcccccgcgcagagcaggcggcggcgggcgggggccgggcgggggccggcgcggggcgggcggcggcgcagagccgggcggcgcggcgggagugcugagcgcggcgcggccggcccgccgcuuuguguguguccuggauuugggaaggagcucgccgcggcggcggcggcgcugagggaggaggcggcggcgagcggagccaggaggaggaggaggagggggagccgcucauucauuuugacuccgcguuucugccccucgccggccucgccugugacccggacuucggggcgaucuugcgaacugcgucgcgcccucccgcggcggaagcucgggcguccggccgccucccgcgcggccagggccgggcuuguuuuuccucgccuaggcagauuugggcuuugcccccuuucuuugcaguuuuccccccuuccugccucuccggguuugaaaauggaggccgacgacgccgacagcccgccccggcgcgccucggguucccgacuccgccgagcccugggccgcugcugccggcgcugaggggccgccccgcgccgcccgccccguccgcgcacccggagggccccggcggcgccgccuucggaguauuguuuccuucgcccuuguuuuuggagggggagcgaagacugaguuugagacuuguuuccuuucauuuccuuuuuuucuuuucuuuucuuuuuuuuuuuuuuuuuuuuuuuugagaaaggggaauuucaucccaaauaaaaggaaugaagucuggcuccggaggaggguccccgaccucgcugugggggcuccuguuucucuccgccgcgcucucgcucuggccgacgaguggagaaagugaguaugugcccgccgcccgcggccacugcgggaacuuuuccuccgaggggcugcgcccuguuugcgaaacccgaguugccaccgucgcagcugucgggcccccgggcucgggagcggcgggguggggcgcagggcggcucugccgggagggaggcugcagcggacccgggacccgggcucguucgucuggagccccgcgggcccuggcuccgcgcauccccgcgcgggaagggcuuuucucuuucuccguccugacagcccagccguguuucccggcuaggcgcgaggacucgguagggaaguuggugccggggcgggcuccgcgguucccgggccccgcgacccgcaccucgccccuuccaugcgcaagagccucuccgcacacagcgcugauccccugcggcgcgcaggcagcagcgacagcacccugggccgcaccgcgucuccgcugcuggggcugaccgggcaguggggagcgggcagccgcccggcccgcggggugcgaguugcccucgaggggggaggugcccugcggagaggccccgaagccccaggacacgucuccaagcgcccgucgcugccucccgucgcccaacgugcuuuugccccucgggcuccucggguuccuggccuugcccgucacuuuggcccgcuccucguuggguuaccugcccccggcgucccggggcugggcgguggggugaggggaagcgcucucugggcagccccccgggaagugcgaggccgggagucuuccucagcuugucucuuccggggagcgccacuggguccccaguucagagggcucugggauggucucccaguuucucccgggccgggggauggagggguacuagggccgcauccgagugugcguugguggguguguggucggagccgacgugcauuccgacacacgugcucgcagcgcgggguguagucgccgccucacggggacaccuagacgcccgucccuggcgagaggugucguacgcugugguuucagcgccagggucugcggcggcgcggggaggguguuguguuuugcgagcgcggagcccuggccuugguuuuguuguggucggcgucgugucgcccucucuucugccgccccgcacuuccuuuguacguaguuaauaagcagugucgcuccacauucgcugucuuuugcaaucugauagcuuuuguuuugguggugucggguggggguuaguagggaagcgcggggaugcggggagcgagaacuccccccggugucuacggccggaggagguggggguuuuauucuucugaaaaaguugaaaguguggcuuacugguacauucaagaugguaggguaauuugaacacgauuaaaaguuuaaaugucgcagaacugggacugggaacggugagggcguguuggugaguaaugguugccgaggguaugcagguggugccgauuaacuuugaaaaaaucacgacugagccuucacgagugaggcggggaaggaggaggcagcggagguuguauggccccaucaccggggcaauucagaaaggcuguuucuauaaacaaauccuuaaacgucugguaagaaaugaguccgcgacggaacgagagcagaucgugguucgcguguuuacugccgagugggacgcggacuggggccggaccuuccacagaucugggcucuccugcucuuuguuuucuaaacuuucagcggacucgauugggcgaaagccuuccggcucccuuuacuaagucguuuaggugguggcuggggggacaaaggaggguuuuuaucuuuaaaagauaaguacgguuuagaagacacgggagaaauaauccauuuuguuauguuaugcaguugaacuguauagcuucucuaguuuuguguuuuuaauguucugaaauucaaaacagcagggauggccuucgccgacgcaggagucgggcauuuuaaaauaggcuguuuuucuuuuggagcguucuucuugaaggauauucuuugugcaagacggcgauuuuugagaacacaggcaggagggaggggguguuuuaauguauguuuuuacuccaugauaccaaagcuuccccccaggaucccuuuacagugguuaguuccuggaaaccugauggguggucagaaggcaccccaaaucucgauuaugguuugcugaagucuugacugacucaguaccugccccucccuccaucucugaaauguggagaauuaaaagcuaugccugugaacgggcguucaguuuuuagccgggaaggugcuagaccacuuaacucugauagaaauaagcugcugagcccuaucagggagggcguucuuucagcuguugucugguggagaaauaaagacaggguguugguucaguugcagguauuuugcuggcguauugagagauuagaguuuccucuuugagugugauggcaguagaaagaguguuguuuaucuuagaaaacuuaguuucugaagcagaggcagucauauggauguguuuguuuuguaucaccauaaugugaacagagcaucuaaaugaaggcgguucggagguucugagugauagccagauaaucugagggcuauuuuguuuuuaaaaagucagcaugcacuuuaaauuuauuguacccaucuccuuaaaaggauucagucaucuuucuaccccaggcauccuguugucacagaaauguagguaugugaaauguugguguuuaaagaaguuaguguuuuauuaccagaaggagaacccagaaaaagaacuucugaaagaaccuaaacagcaaauuauaguuuagauccucuggagagacauagcaagcaaaugguguuuuguggaagggugggguuugugucaggauuugaaauguaaaaggucauaauguuugauuugucgaaaaagauuagaaaaguucaacucuaagaaauaugcuaagguugaauagaugaagcuuaaaaauaucacaaaaagugaaagaagucagucacaaaagaccacauaucguaugauccgguuuaugugaaaugucuagaauaaacaaauccauagaggcagaagguagaugagugguugccaggggcugggggcggauggaauggggagugacugcuggugggcacaggguuucuuuuuggggugaugaaaauuguucuaaaauuaguuuguggcgauggcugcauagcucuaaauauacuuaaaaccauuggauuauguacuuuaaaucggggacuuuaaugguaugugaauuauaucucaauaaacccuuuuuuuuuuuuuuaaagaaaugugaucagguugaaaauaacuuguuaugcuaccuuaaauuacguuaaaauuauuacauacauuugacaggcugaugucucucucucuuuucauuuaugaguuuuucagauccgugaguugcagcaauacaacaaacugauaauugaagcuuagcaacagggauucaaucccgcaguagaaaugggcaagcaggagaaaaagaaucuugguucuauguagcuucaguuagggauugaggagcuggauuuaaaaaacacaaaugcugguggagggcagauuuuugacaauagaaaccucagcugaaucugaaaugaugguuuuuuucaggauagaguuuaggagcugagucugaagggcuguuuguauuuccaguuuuauuauguuuuccaacaaagaaagacauugcuguuuuaagauguuuuaaacacucauuuuuugauaugccacauugaccacaagugguaguaaggacugaggaugaacagaacaguucauuuuaaugcaguauuguuguuucuuuucuuugcaguuuuauuuuauuucuuacauaguuccagggucugagcaggagaaagaaucuuuaggaugcaguaguuuuaggauacacuguuucaaguauacagugauuuuuauaaaauuaaaauuccuuacagaacgaaagguuuuaaaauguggcaaaggcauuuuuguuuugaaacugugugcauuuauccagauuuacccuggccuuucaauaggaaaagaccuagagaauaauuguuguuuacauuugcuuuuggucuuugucuaaggcuuaguuuacuaauaaaaauguuuccugcccuuccuauuguugcaagaucagggcaguaaugaaaaucaacuguaucauuuucacuuguugccuuagaguuuuugccaagaggaacccucaagggacggugguuuccuuuuaaaucugguuucauuuguuuuguaagaaugugcuguaagaagcaacugaauccagccugcacuuauugugcaccuacuguaugaaagcugaccuugugcuacucagugcaugaaccugcagagucuugcaugaaaccaccuuucuugaaauucagauuuuuuuucagacucaguauagggugcaguuuucaaguagacaguaguuagcauuuuaaagguucuuuuaaaaauauuucuguagacuuaggacucuaguguuguucaucagaagccuuuacccuauaccuuuuuugccucauuggugcuuuccguuauauugggaugucacuguagacugugacauacaggugauguuaacccaucuugacuggcggcacugucuucuuuauaacauuggauauggcaauugugauuuacaaacugcaguguuguaguugccuuuuuccaaaaauuaggagucacagguguguacaugaacguugcauagcauguuuugaguuguaagaaagauggaacuuauuucagaaguuuucuggauuacauauugcuuaguuagcuuucuagaaaucaggaagcauucauaauuucagggcauuuuauaauuuguaaauaacuugguguuuuuaaaagcgugagggaguaagagugaggagacaaauccugaaaguuuuuguuuuuuaauuguaaagcauacaagauacauuucuuuauagguugugauuuuccccaauuuguuuucaaaacucauuuaaaaaucagaccuaguucauggaagagguauuugcgccugugggcgaacuugauuugaacugcuuuucuuagccagcuuaggacaggugcugaguccaggggaugagcucuucucaauuguacuaaauauauaauaguugcacacauguuacggauauaguuucuugauuuccagucugagauguucugaaggaaaauucugaacacuuuagagacaacaaagugccuaaugagugaugcacucugaucccuccuggaaaaugguguuuggcaucagcuuagcaagaggagguuuuccaguuauuuguaaagaugugauguggcuuuaaguggggaugggggaggguagcagccccaguguuuguggacauugagaccuguugacauuugggaagcauaacugaguuccacuauuugaaaagauuaaaacuuugauauauguacacauccccucaugccugcacccccauccccgagggucuggaaaagaauugauuuguucugaggaaggaacauauauuuggaauauaaaaugguuaguaaacaaaggaucuuuaaaacaaguuagauuguuaucucaagagaagcauacuuccucggcaugauguuuucuuuuguuaaauugcuuugguuuuauuugacucaaaguauuaacaauaccuuugauuuugagacuuuuggacuuuugaagacuaaguuuuuaaauggucaauuuuacucguuugaaagucccagauaccauuuuugaagauuucucucccuuuuuuuccacugaugccggcuuuacuuauguuuuauuuucaaaucuuaaggaaaaacugauauuuccuuacuugaacugagaaauagucguuuucccucccucuuuucuuccacaguaaauacauguugaguacuuacuggaugcaguucuuuagguuuagaaauuauuugauacuguaaaaugucuuaccauaaguuuuuaaagauacccgucaaacuauagauguuacugccauguuuauuaaaaaaaaaaauaaaacgaaacaaacuaguaagcaagcuuaaaauuuuucuuuuuccugcccuggacuacagauuuuuuuuucuuuuuuuuuuuugagacagggucucuggucaccuaggcuggaaugcaguggugugaucacggcuugauucugccuugaccucccaggcuccagugauccucccaaguaggugggacuacaggcacacaccaccaugccuggcuaauuuuuuguauuuuuaguacagacgagguuuugcuauguugcucagguuggacucaagcgauccacucaccucggccucccggagggcugggaucacaggugcgagccaccgcccccagccuacaagaauuuguaaacucauagauugcucuucuguuuucacuggaccacaacagaaaguaguuucuuuuauggugagggaugaacaccuacgauugcaauauaaguuguugggccuuguguccauggagcucacuuggugguugguggucuugaagcauucacauucuuuggaguaguggggcggcuggcuagucacauggggaagaugugcacaccuguggauggggccaucacacacugcagcgauagcugggccuaccuuacugcucaccuggcugggcacagcggcuccugccuguaaccccagcacuuugggaggccaaggugggcagaucacuugaggucagaaguucaagaccagccuggccaacauggugcacccccuuucuacuaaaaauaccagaauuaaccgggcgugguggcccgugccuauaaucccagcuacgugagaggcugaggcaggagaauugcugaaacccaggaggcagagguugcagugagccaagaugaugccacugcacuccagccugggugacagagcgagacuccaucacacacacaaaauacauauauaaaaauaaauugcucaccugguaauagucuggaaaacauuuuuuuuuuguuuuuuugcauauuuuaaagacuuuagaaaguagucuugcuaauccagaaaguucuugcggggaggaguuugaaacuuuguuuuaucucacuccucagucuuagcccccuuaauaccauaggucucuacuucaguaagaguuacauaauacgaaugccguuuguucagaauuguguaucuccauccauccguccaucguccaaauucugcgaguuugaaauacauuguuguugcuguuuuguauacuuuuguucaaccauuuucuuuuuaacauggcacuagcuuucucaaacuggcuuuggaauuauuugucaguuuaaaaauaaauaccacuuuaaaaauuacucuugacaugggagaacaaauauauuuugauaguuguuagagcauaaauauuuuauagagcauaacuugaaauuuuuccugauacauugugauugcuuucagcuuguccucugcuguaaaaaauauagucgugguuagucucuguaaaguugguuauugggaauaugugcuugauuacguaaaugagacaucaccaauuuaagucagccaaaguuuagucaauagaacuuuaaagaacagaagucuaaugguaauuagggagagaugaauuuauuuguaggaguuuuccccaaauucaaagcgucuuagugaccuuugauaacuuccuggaaaaaguaggaagcauggagagaaauuccagguaggagcccaugauccaauugacugcaucagcuuacaaaguguuuucuaagucauuagcuauuaauucugucuagauuguaaaaucccucucaguuguguccacauuuaucuguguuguccuguauuuauucucuuuaccuaauuucccugagucucauuuuagugggauaauacacaagcuuacagacucaggacuuuaaagagaagcacagauugccacgaaaacaaaugaacacagagaccaguagcagcagagggagaucugcugugaggcuucccuuaguucuguugucugauuucuguggauaaugaguucacugcauauguuaggucacaacaugauaucguguagucguagguacagaacuuuuguuaugguagccuuucuucgucaggugauacaauugggauuuucuuucucacaugcaccucaguaaaauuuucagcaacagagauuggcucaggauggaauuuguucaguuucaguucugcagccuguccuuuucuggggagacucauuaauugaauguugccuuucgaucucacugagucacuugaaaucgcucagauugaccccuauuccgggauccagccugguccagugcagaccugcauugacucugacuacaugcugaguuggccucugaaccaguuccuguaccauucccuuagucugauggacuugccagcuccaaauacucagaacgugccucuugugguccuaggaucaaguccaggguccuuagaaucaaguaaugaaacagguccuuaguaauccugugcuguagggauccacuguuaguuccugguacuccccagcaucugugcauuagcuugauggaaaggaagcuguguuaugccugucuucaaguuuuugcuucugcuguuuccauagcugagaauguuuuuccucuucacuacucugcuacuucuccuuccauccucaauacugaauagcagaaagugccgcuuaagaacacaggaaggucaccauagcuuuaguuucuccuuagcugccaauuaguucuuugguccuaaaguuauuaacuuuucugagucuugauagaaaugcggagacuuaaaaauauuugggggagacauuucuccuuuucucacuaaacaacagaaugaaaaccuuuucuaacagguuuagaaaaccaaagucagaaaaauugugaggaaauagaauagguuuuuuaaauugaaauaauuuccaaguuccagguggaucuguaaaauagggacaagaucauaacuuucaaaaggcagcacgcuaagucaggugauuccuuucccccauaugccuuuucugugguuugaauaggucagagaugccaucuuuacauuuccaagucaaauuccucuuccuucuugaagguuuuugggauuucccuaacuuguauagaucuacuuucccauuacuccuuuugaguucauaacccacgguuuugcugguugacagugauuugucuuguuccuugcuuguaauuuuauuaggaccauggagccaaaguggcugguuugaaucucagcucuucaguagcuaagcucucaggcaaauaauuuaaucuucuugugccucaguuuccucaucugugaaauuauaauuuuaauagaaucuacuuuaaacauucauagaaaucaaauucguacacaugucaagugccuagaauagaaccuggcaccugguauuaagcccuuggacuucaacugcuacuguucuuaggguugugacauccucgaacagagauguucuuuggauagaaauauaaggcuuacuugauguuugauuguccuugccauuuaaauauguuauagaaccuggcacauaggugcucaauaaauguauaauaaaacuuuauuuugcuaagguguuuauuaacaagauggcauguugcuuauuaaacaguugugauuuuuuuuuucaguaaacgauggucaucccccugcaguuugccuuccauuucagagaucuguuuauuacacuuucucccuuaauauugucauuugucaauuucugcucacaccugagagguguccagugugcacuuugcccaucucgccuaugcauaggcuccaucuaguggccagaagggaaauucagcauauuaggugacugaauuaauagugccccaaggaggaagauagcgaucccaacccacucucuggcuugcuuccuggggacugauugcaagaaaauguggauacuacagacuucuguagaaaucacugggcuacaguuuuggauuaagguuacucuacugugucagugcgagcuguccugagagaauuagggucuuccuaagugaugcagacaggcgcacugcaacuccauggcagagcuguuaacaccuagugugucuuuuacaguuagaguuuuaagauaauuuuacaggacuuuaauaaauuuaaagcuccaaaauauuugagauuagagauuaaaaaaacacuacugauuucauuuggaaaaauacagcaagauuuaccuuccauugcucuauuuaaacagguaguaacacuuucauucucuucucucuccccuuuggcuauucuaugugguuaagaugcucgccagccagaaauacucacagagaauaagaauaaauacauccaguguuguguuaggucccacaccgucuauauuucgcuagcuaauuuuauguauuuuguuucauguuuuauugauauuuucagaaucuuucuugcugagauuacacaaaauauauagcugguuauucaguuuuacgugucaaaagccuuaaaccuguuuccccaugauugccuuuuauuauuuuuaauucggaaaucuuuguuuggcugucugagagagaacuucagccucccuuccucccagacauuuugaacaguucaggcuguacucauucgugucucuuugucuuggcagguggaagccccucugcuuggaauagcaaacaauacuaccagcuugcccucuggcaagcuccuuuaagaguuagcuguaauuucacccucucucuggccuugauucugcaugcagaaugauugcacugacuugagcuccuguggucucuugcuauaccuccuauuugggcaucucccccauauugcuuucccccaccauuggggaggggaaugguaccuugguuaucuuugaauucccaggagguggcccagugccuggugcauaggaggagcugaagaaacggaagacuucuuaaagggauacucgccauucacuuugaagcacuucuuuguacaacaaauuuauuuucaucugaucauugcaccucugcuagccaaaacauuuuaucacaccaguuacugcugcauggaacuugaaagcaauaaaauuaucuuuaaaaucauuguuugauuaggcuuuuugcacauugaggugaauaaaaaaaauuagaacuccuggaaggguaauuugugagucuggccuugugucaagaucaccucaucccuguggauggagacuuuguuccauaaguucccuauagauaagauguaaugaauaauucauuggcaccgauuuaugucuguagugugcuuuuaaacccucuuggagcuggguuccugaggaggaagcaucugcaggcuggacucggcugccugguggucuccggaguggccuggugcagagggccaggguggcaucucagaaaguuggguggguaggguacuugcacaccugcugaccuugaguuacaggguggaccuaggucauuucacaggcccuuccagccuucagaucucaagauacuaggcagagagagagauggagauuugagggagaugugguuggaacaagcagaaucaccacguauggaaguuggcuucuauuuuuugcauuguuuucuuggugaggccaguaagcuuuugccucacuccugggagggacaguagcaaggucuuacaggucucucuaucauugaagcacccucuccaacccugccgguuuugguugcuggugaaggccuuugacaguguccugguagggcgacggugaggccagcucccgaccucuggacagaagaaagcuuacuugucuagguuggugucaaggggacuccugaacuuaaugaacaccuuagaaauuauccuuaaagucuccucuuccgaggaguggggugggauauuucuugcagaaaauguaaacauaaucauuugaagcuggaauguuaauauucaagaguagcuuguaaaaaagcaucuugugaaauucucaugugaaugcugaaccggcuggaugugaacuuagcuggacagccuggccugucuuugcucugcucuucuccgugcgguuugcauaugugcagggcuuccuuugaagccuuguccccucaaacaauucacugucucccucucucccacgcauggaggcauguuggaaagggagcuccaggccucagugucucugccugugauuggaauaacacugcucuagcagggaugccaaugagaauuagcaauagauaauguauccaagcugcccagcaaaccuggcaaauagaaagcauccaauaaauggaugcuuuucucuuuuuuucuccuccucaugguggguggcccuggugggcucucucuggggccuccaguccuccuuccccacaacacuggggaauugcugccaguugaauagggcccuuuuuuuuuuuuuuuuuuuuuuuuuugagacagucuugcucuguugcccaggcuggagugcaguggugcaaucuccgcucacugcaaccucugccuuacugcaaccucuuccucccagguucaaacaauucuuguggaucagcuucccaagaagcugggauuacaggcgugugccaccacgccuggcuaauuuuuuuuuuuucuaguagagacgggguuuaggcauguuggucaggcuggucucaaacuccuggccucaagcaauccaccgaccucggccucccauagugcugggauuacagaugugagccacuguggcuggccaaggagggucuuuuuuugcacaucuacagugaaagguuugaacccggacgucugagucucaggucaguuguugaaaccacuaaguaaccaccuugcuucucugugccugaagagaauggguuuuuagguuaaccaggcugacugguucaaggucaugucccuaucuguggaaggggagugggaguggaaggugaguggugacagaguauggaacccuguuucugauaucuagauuauuugagggccuccaguggucucugcuccauggaaagcauaugaaagaauaugauuuuuuuuuuuuacucgagcuuguugucuaguugggaaaacucaacuacugguggagaguaacagaugcuaugaguuuagugcuaaguuaugggaugcugaccggagagaaguaugugggcugcaggcaguggggucacggaacugcagaauggcuugagaagcuuuaaggaggaugucugacuuuagugugcccuaaauauuugacucucaagauccaaggaggcagcuccccaggagaggaagggaccaugugugguguggguggcagugugcacugauggaguggagagggugucagaauccgguguuuguguggugggaaggaauugacugcuggcuagagaaugaggagcgcugaaaccuuugcaccauugcaguggacccgcugagaaggguguucuggggaggcugcucuggucucucgauggagucaggauugggggacagauagacaccccggugugagccagugaugguauagaugagggaggcagugaggacaggcucagggagggaagucuugucucuagaccugagaccaggaagcaggaauggacuggacagguuggcccagcugagggaggugacuggugagauggguccucggugugaggggcuggguugccagaggagcugugggcuggggugguuugucgagagagcagucccaguugauggagaggcaggacccgcaaaacagguuggcugcaggacugggggcgguagcacagggcagcucccgaggagacaccuggcacuuuuaaggcauggaauggagagagcuaggggagagcacaccugcagugaggcaauucacauagcaaaguucuccggaaacugcaguguucaacuuuuuuaaagaauagcuggauguuagaaaaguggaggaacugucaccuuuauuaggggcaucauggauaccugguagcaucaagggcuaggguuaaaacccguggaguaauacgcccuccuauuguguuccucuccucuaaaaaugaaggugaaacuguuucaggugagcgcuguuguuguucguuugcuggggcacugcuuucugauuuuuagaggaguccaggcuggagacugaccccugccuuuuucugaguugggccggcugggcccgaggcugguucugggcugggccaggcugaugcaguggccuugggcuucccgaggcugggagagggcgguggcccccgcuacccugaagagcuggccaacgcggcagggcucuuuccaguccuuaccaugcaagugaagaggaacaguuuguuuaaagaggggugccagcuucacauccaggccuggacuuugcuacuggugcuuuugaacuuguguugauuuauguuuguaaauugacuggacacauugugguucuugaugagaagcaauugcccauccuuagcccacgauuagugccacucucugggugcugccuguucugccacuguaacuguuuucacuugacaaauaacauuaaaaaacacaguucugcaagagacuuccugggagggugguaucauuuggccugugggcuuuuguaacacuuuccugcuauuaggagagugaauucugaauuuucaaucacguucaccuguuggagcaaguagaguuucagacggucuccgcuuuucucgacuagaaagcaggccuucucccuuuuccccccagucuuguuucaugacaccauuccccucugagaugaggguuggagaauuagaagucuacugaugcauuguaccggggcacguuauugacccucucugcucuccuuuccucaucuguaaaauggaagauaaugccacccaucaggccgagugcgguggcucaugccuguaaucccagcacuuugggaggccgaggugagcggaucaccugaaaucaggaguucgagaccagccuggcuaacauggugaaacccugucucuacuaaaaauauaaaaauuagccaggcacaguggcaugcaccuguaaucccagcuacucaggaggcugaggcaggagaaucacuugaaccugggagguggagguuggagguuggagguuggagguuggagguugcagugagccaagaucgcgccacugcacuccagccugggcgagagugagacuccaugucaaaaaaaaaaaaaaaaaagugucacccaucuuggaggaucguuaccaauacuucaugagugaauacauacacauuucuuagaaccuaggguuuauaaacacuaggaguuagcugauacuauuguugcuaaggauagaggaaauacgcauuagaaguuauuuacuuccuuuaaaaaaaaaaauacccuuuggguguguauugauucugauguuuugcuccuagcuacauuugccguuuuuuuuugacugcagaauuaggaaccagcuucauuuuuuuuuuuuuuuuuggauggaaucucgcucugucguccaggcuggagugugguggcgcaaucuuggcucacugcaagcuccaccucccggguucacgccauucuccugccucagccuccccagcagcugggacuacaggcguccgcugccacacuaauuuuuguauuuuuaguagagaugggguuucaccguguuagccaggauggucuugaucuccugaccuugugauccgcccaccucggccucccaaagugcugggauuaaaggcgugagccaccgcgcccggcaggaacccagcuucauuucuuguaaagagaguuugacaagcgcuccacuggggauagcagcacagcuuccuccuuuucugucccugucucccuccugacucugcaucugccuccguuugaagcauccuccuccaguaagugggucauuuggauuccaaggcccuuuugaggccauggugauggaucauuugcguuaucaaugugaacuguggaugucccuucgcccuucagucucuuccuucuucaaggagggggagguaauugggggucauguggccuggggaagagccuggucacgagcaugagggaugugagugggacuauguuuccagccaaaauuuagggcacaggaucugaaaaacacuuagauuaaguaucugcaacacaaauuaggguauuuuaaauugaauguggagaacccugagaaccugugcccuuugugcguggauggcugcuugcaaggaugagcauccccagcuggagcggcccauggcugccagaacaggagaaggcuucagucaggugggaagccagcugcaguguguugccugaugcaggauggugcgagaaggagcugcucucuugcucugcucccuggaucgcacaaggucuuccugagaccagaauucaagguuaguccuguuuaggcaacuugguagauggacuugaauggucuugcuaagcgaauauugccuauggugguauuugcaaggaaaacaaaaguguuuugagcccagacuaaccaauuuaacaaugcuaguagguaaggauacuacuguuugcuuucugugaugagaggucucuuaggaggagggguuaauucuuuugauuuaaaacuuacuacuugaggcaaauaggcacaugaaaagauguugaaagucacuagucauuggugaaauguaagucagacccacaauugguacuucauacucauuaguauggcuauuaccaaaaacaccagaugauagcaagcauaggccaggauguggagauguuggaacccuugugccuuacuggugagacuguuaaaauggcacagccuuuuuuuuuuuuaacaggaagaugauauggugcuuccucaauaaauucaucauagaauugccauaugauccagcaauuccacuuugggguauaugcccaaaaagaagugaaagcaggggcucgaacagauauuuguacacccauguucauggcagcaaauaauucaaaauagccaaaaagugaaagcaacucaaggguccauccauagacggguggauaaacaaaauguggucuauccauacaauggaauaucauugagccuuaaaaaggaaggaaauucuaugaugugcuacaaugucugugaaccuugaagacacucugcgaagugaaagaagccagucaugaaaggacaaacagugcauaauuguuacccuuacgugagcuauguagaguagucacauucauagagacggaaaguagaauggugaggggcggugaauagaggcuggggggagggagcaaugaggaauugguguuuaauggguacagaguuucaguuugggaacauguaaaaguucuagagguggaugguuacggugguugagcaacauugugaaucagugucagugaacuauacacuuaacaaggguuaaaauguuaaauucuuuguuguguauauuuuaccacaauuuuaaaaagcuuauuucucaauuguuuaugcgaguauauguguggaauaguuggggagacaaauucaaggagaccaguccuuguccauggcgguccuagguaccacgggaucacugcgggggaacugugaggucaggagaggccuugaaaaaaaacgcagguuugagcugagucagauggaaugggucuguuuucuauaucaagagacaguauugcagauaauuuuuuucuuucaaggaaagcaagucaggagucaaacucaugccaccguagucacaaaugaaauuuauugcuaaucagccaugugacguguaauugcuuuuucauuuucuuauuuuuccagaagagagauuuguuuagauguuugauucccucacugauuaugauuauacuggaaguuuuucauuuguuuugacagcucaauuuuuuuuuuauuguaaauggacugccucauuacagaggggggagcccuugaaagaaagggauugaccucugcaggcaagaaucugagcauccuaaaaguagaaaagggcuagaggcuucgccuuacaggccaggaagcuuggagggacgcgcugcuagagaccauggcacgcaugcugugugucgaaggccagguccgccugucugccucuccagcagauacucucuggggcuauuuuuuucugcuugguugucauccuuugguuuaaccaggcgccagggcucaggccuggaccugcuggauuccaaagaagacuucgagguggccgagcuugucuggcuuccagaggagcuuucucugucccgcccgggggaguggcucaccuuggucugagaccaaugggaggaagccugcugcgggcaacuggucugugccuggaaguuggacuugcauuuucucuggaccuccaaagcaaacccgaaugaccacucucauccuccccuuuugcuuguuuguguaugugcuuguuuugccuggucgucaggcaggagguggugucagaugaugagagguguugcucgucccuggguugguucucuuacggggcuguauggaugucuuagcucagacugcugugacagguuacuauagacugagggcuaaaaccacagacuuauguuucucacaguucuggaggcuggaagucugagaucaaggugccgaccaaauuugguuucuguuaaggguccauuucuuggcuugcagaugacaaaugucauguguccucacaggguggagagagcaaggggcucuggucucuuccucuuuauguaagggcauuguugccauuaugggggcucuacccucaggaccucaucuaaaccugauuaccucccuaaggccccaccuucagauaccacugaagguaucuggggguuggggcuucaguauaugaauuggaggggacacagucaugcaguucagaacaguggagcagugugccauagugaagggaucuccagaccaggauucucuauggaaguucuuggccaggucugagaguugguuacagaucauuaaaauuuacauggaauccaguacuugaaaguacaugucuucaggauggcgcugagcacauucgccucuguaaccaaaugccugaaauguguagugcaccuucugagcaccccagugcuuuccuuaaagugaaugcaguuugagaggaacucaauuauugagaaauuuuauaugaccccauuucucucauuuuaggacagauaaguugcuuauuuuaaacucugcaggagcuacauagaggaaguuauacuccaggagagcuuaaauuucacucucugaaaacucuguuccauguaaguacauuccuccucucuccccuccucagugagcacguacccaucagauguguggaauucuauuaaaagcagcuccucgugacccuccagggucuguuuuguaaagcugacaccagcaucagugaguuggaaggggcugccacagaagacagacuuacugcugcagcccgcuucagagcccucaguaguacuuuuuccucucccagcaaauccaggaggcugggaaggugauuguuaauuguuuaugagcauuaacuguuuaccagucauacuuacuauuuuaaaucugacccugccauuauguuguuuuguuucuguucacagcugagcuuuaagcuggguagaauuucgugaugagucacuccuaugacuguaaaaucaguaucgaucaagccuuccuguucauccugugagcaguuuagagacagaugagacaggcuuaugguuuccacuggcucggcuccgugcgugugcggauugggcuuccugagagccugguuagccccuuuuaucugcucucugaaaccugcgcaaggguguuuagcaugcaccuugaaaccucugcugccugaagacagugugcuuaaaugaaggguauacaaacccaugugagguuuucucuucccuuuuccaugaacuccaccccaauuaccuguuugaauuuugcaugccaguuauuuucagggaacuagugacccuuuucuugccacccugggcuuugaauugaaggccagugugccaccuuuucuuuggcuuuguuagaacguugcccucagggucauaugugcuggcugcuaugaauucuuacugcuugauggacagagaaaggugaggguuagauaucuggacagggcaugacagggcgggucaucgaguaggaacauugggaccuuuugcuuccaggcuugagcagugggugagaaacacugucuucccauuagggcagugggugaaacacugacuucccuccauccucugggcagccuugucagguggguguggaagcugaggugugucugccccaggcugugcagucagccccguguucuagcuucccgugccgaaccuggcccuggaggcugucugccuggcaagggggcugcacaaagcucggaggggcauuucuggugcuugguagaugguaggccugcccccagugcacugauaagagcaugggcugagagugccacuuggauucggcuacagugggcggcagagugggggugacugguguugcuuuuacucuagagcagaggaggcagaugagguagaucggggccccagggaugcugagcugagcuggguagagagaauuugguuuuguaggauuuggagacagagacaaauuuggaguguuuggauguucggggaccugcaggagguaugugagguguguaaaaugcagccccuguuuuaaaaagagcuuacauugucucuugagaagauaaggugugcccagcuguggaauggaaccagaugcuuuuaugagugaggauggagugagcacacugggaaagagcccuggaauuggaggaagagaucauuuugcccagagggaucuuggaggucuccuggaggaggguacuuagaugaucagaaggauuauacuagacuugaugggguggucuuggcaucagaacuuuaaaaauguauuuuggggcuggaagcaaggcuggagaggaagguuuguuuaaguuguagugggggaugaggcugggggcaaaucagggaugguuuuccaggucuguaaaggcugggguaagaggaaugguugguucuuaagagcaaaaaaaaucccuuacauauugguucucuuauuugugcuaaguuaaauacaugggaggcuacugguguuuaugaaauaacccugagccuuuuuggggagguaguaguggaugucugauggaagagauagaagacuggucccagggguucuuaguggcaccuuccucucaggucaucacugugcuuuugcacauugcaguuauauuugacuacauuugauuauggcagauuuacuuagaagggcacuggaaaaaagccucccaaauuacaacugacacaggaaaugacuuuauuuucuucuauuuuuuuucuuugcuuuucucccccaaucaacauacauuuuuaaaccugucaucucacaugaccugccgguagaauugauauguuuaauuucuguagaaaauaacuggaaauauuucacaagcuccaguagcuuccuguuguagggacccuuaggacuuuggaaugagaaguuuucuauugaguugucauauuuggaaggauaaaggugcccucuuuucccucgauccacauaguagacuccugugugcgggcauuuguuuggugucucacguugaugcaaaugcagccauugcagagugagccccgcucuguuacuggaucuccauuugcucaaaagagagcagugucccccuccaaaucugcaugucugaaagcauucaugcagguucauugcaugggucuuugcauuuuacuuagacuuagcaaaaaucagguauagucuuuccugaaaacaaaagugaccauuguuuuuaaucaacugcaggguguuuggaguugugaaauauuuagggucccgaguccauuccagauucaacauugggaaagaaugagaaagcugaagccuggggcaggcucugucugcagaaaccaugggcuaucacccccucuccuuagcagcauuguaaacaaacgucauuuguaaggagcaugucccaacugagcuuguaauuauaggggcaagauuuguguggugguaggggcauggagcuggagacugggggcuuccuuauugguucauuuauccuggcccuucucuuuucucucaagucucagcucuuuuaagauucagaaaauaaugcaaaaugccuaagauuucugaaauuccuggcuucagagacuugacuacauaaaagagccaggauuuucaggcuggccauuucaggaucagccauuucccacuuccugauucauagcuuccaggauuuguaaugccuguagacuuuuuucucuuuugcuuaaaaguggccauugaaagaaaaaauaaauagcaaaauccccaucccagaaguucuacuuccuguuguuguacuauugagcucugaaaaacagcuuuguaaguuuaggcucuuguuuggacuauuucaguggaauucuugagaucuuuuuguuuggacaggcaaguaugaaggcgauaagucgaaagaacuacagcuuacucagcacagaaaugcagaggcucaaauuuaaguucuuccuuagcuuuaugguguguauauuaauauaauccaagcaauagugaguugcuuagccagggugcacagacauuuuccacaaugccaguuguuucccucauaauguuuaauguuuauuuuuaaaggacauauuugggcacacguuucauuuuugccuguaaaagaauugggaauauuuaugauucuugcaacaaaggagaaggauccaaaguaaccaagaaaaugauggacuggcagccuucacauuuucccacaacucuuuucaugaaauaaaauguagauaaggcugggugccauggcucacgccuguaaucccagcacuuugggaggccgaggcgggcggaucaccuguggucgggaguuugagaccagccuggcgagcacggcgaaaccccgucucuacgaaaaauacaauacaaaaauuagccgcgugugguggugugcgccuguagucccagcuacucgggaggcugaggugggagaaucacuugaaccugggaggcagagguugcagcgagacaagauggcgccauugcacuccagccugagugacagagcaagacuccaucucaaaaaaaaaaaaaaaaaaaaaguguagguuagcaaaagugccuacaguucaaaugcuuccaugcuaaacguuguauuucuuccggucucauuugugaugagagucauaagauuuugagaaauacaaaaaccuuuccagcuuuauaggaugauaauggcuuggccacucaaguaguucugauuggguuaacuaauuuugguccaguaaucauuucauuuggggugaauggauuuuuccccccuaaauacggguaccuggaaaguugaagcagugaaucuggugaaacuuaaucagugauuucguaaggguuaacaaauguuucugggugggauuccuaauguccagcuuccucuguguagcucaguaagucuucuuuggagacacuagccugcauuguaagacugucacaugggagcaucuuuuuauuuuauuuuacuuuuuuuuaaaaaaaugaggucuuuauuauccuggcuggagugcaguggugugaucauggcucacuguaaccuugaacuccugggcucaagugauccucuugccucaaccucccaaguaguugggcugauagacaugagcuacugugccacguagcauucuuggggauuauuguaggguccuuuuggaccacacaugguuuuauacucuguagcugauugauguacuggcaugucagugacauuguguguaucauuacacuauuugguuaauugauguacugguggaauagccaucuucuggaggcucuuguuugcauacuucucuuaguggcggacuagcgguuguacaguaaauagaugaucauucucgcucuguuuuaccuuuccucagcugcucuucuaguaggaaaauaacagcccucuuagcuguagucuucuggaggcucucucaauaauagaaguggaaagaaaagacucaaaucccugggcagugacuuuuuaguuguuucauuugcuuuuaaggcagaaacaccuuuaacucuuaguagccuuacagaucauuuuugaaaacaccugugcuugccuugaauggggcggugaccacuggauccccccaugcuggguacauguuuugcagucacagacacugcuggccucaccuuugguggugaaggaauguuuccaauuucugcugaugguguagugcucuugggagcugggugcucugaaugagcagaugggcaucugcuuuuuuaagcgugcuguucauucugcaaaauaguuauugugcaaauaccugauaagcaccaggucugugccaggcgcuguauuuuguauuuugcaugucugaggccagcaucuuuuucccuguuccuuuuucuccucauccagugaacuuuccacugugguuguaguuugucugaaaaagauuuggaaaaaauguacagccauguuucucuugucuagagaagcugucuuaaggacuucgacaaguuucauuggcagagugaaugagugguggccucugaauaguugaaauguuaaugcuaucuauagguucuagagaaucugugucuuuaaaagucauagcgauaaagucucagcuuuuugagagaguggguuucagacauauuuuaaaauacuacuauacaggaaaucugauuguugcauugaaacaggauuuguuaucacaucacgguuagacauacccaaaaggcaaaaacuacaguggucaugauggcuuuacauaagauuuuggaggagaaacuguuagcuccaugaaagcaggaacuguguucacucuugaaugccugcuaccugcacauggugaauguucuauaaauguauauuaaagaaauggagguccuuagaguuccaagaucaccgucaauaucaucacccuaggcuuccucguccuuccaguuacuucuuuuccagaagaguccauugccuccuuuauaugaggucuacagagcgcguucagagggcucuuaucauugauucagcaaucacguguacacauagcacuagaaugacuucacauauuugaccuguuuaaaaauaacgugcagcuaugacgaacagcgaaccuuugauuagggacacauuugccugccgccagacacuacaaguauuauguguauugcuuuuuucaaauuauaauaguaauagaugauuaugagaagaaaauuagaaaauaaguuuucugucucucuauaaaaggaaaauaaaaauuauccuuaaucucaagguaaccauuguuaauauuuuguuguguuuuccugagauuuucccccuagacuuauauguguaucuauauauuuaaaaaaaugaaauuaguaguauacuauguacacacauauugugaauuucugcccauaacauuauaucuuuaucaccuggaaugaggucuuuaaugaaauuauuaaaauuaaaauuauucuauaaaugcuaaauuuagguauuuuacaauuuuuuuuuuuuuuuuuuuuuuuugagacaaagucuugcucuguugcccaggcuggaguggacugcaguggugcaaucucagcucacuucaaccucugccucccagguuaaagcaauuauucugccucagccucccgaguauuugggacuacaagugcaugccaccaugccuggcaaauuuuuguauuuuuaguagaaacgggguuucaccauguuggccaggcuggucucaaacuccugaccucaaaugaucugcccaccuuggucucccagagugcugggauuacaggugugagccacugugccuggcccauuuuauaauuuugaucauuaaaaaaugaugugauaaaauuauuguguauuguuguugauacacuacucugauuaauucuuugggcuagauuccuaaaaguggaaaguaaggaauaagaauuguguaagugugcaugauccuagauaaauauugccaaaauauuuugcagaaaauucuuaguuucagcuuccagaagcagugucugucauccauacuccaccagaauugaacacuaaauugagcuuugcaauuuuagcauuuaaaaaguuguaucauuuaauauagaauagcagucucuucauuaugaucuucccuugccuaguaaguuuauacucaagucaaaaucgguuaaucaugcauauugauuccuuguuuaucuuuuucuuuuaauucuuuaauacuucuagaauguauuuguaguuaagugaaguaagauaccuccuccuguugacgauuuaguuuccccacauugugcuguuuuuuuucuucacuggauuauguaacaauaucuuuucuuuuuuuucuuucuuucuuucuuuuuuuuuuuuuuuuuuugagagagucucgcucuguugcucaggcuggagugcagaggugugaucucuguucaaagcagccucccccuccccaguccaagugauucuacugccucagccucuuaaguagcugggauuacaggcgugcgccaccacgccuggcuauuuuuuuauuguauuuuuaguagagaugggguuuccacauguuggccuggcugguguugaacucccggccucaggugauccgcccaccucaccuucccaaaguguugggauuacagacgugagccacugcgcccagccuagagacucuauuuuauuaguguuuuuuguagacaaagucucacucuguugcccaagcuggagugcaguggcgccaucucggcucccugcaaccuccaccucccggguucaagcaauucugccucaaccucucgaguagcugggacuacaggcaugugccaccaugcccggcuaauuuuuguauuuuuaguagaaaugggguuucacuauguuggccaggcuggucuugaaauccugaccuugcgauccgccugccucgaccucccaaagugcuaggauuacaggcgugagccaccgcuccuggccgagacucuauuuuaaagcugucuucucccacugauuugccuuuuguuugugguaaaaucauuuugucuuaaacacuguagcuucauuauacauguuaacaucugcuaggaagaaucuccacucagguuaaaaaaaaaaaaauuugaagcaccauuauuucaggugaacuuuguguguguguauguuguuuuguuuuugcaauucuucuccgcuacucuuccaaaaaagaaaacacaaauucauuagguuuugauuguuaauaaaucaguuugggagaaaacauuuccagauauuugaauuacucauucaaggacauuucguguuucuccauuuacucaacuauuaucuaucuaugaagaaaucacagaaggucauagagguuguauacuuuuccuuuuggguuauuucugguuaaugaaugcuuuuuguugcuaauguagaaggaaucuuuauuccccauuguuuauuuuauauuuuuaaauuuuuuuucaauuaaaaaaaauuuuuuuuucauuccugagacagggucucgcuccguuacccaggcuggagugcaguggugcggucaugacucacugcagccuucagcuccuaggcucaaguaauccuccaccucagccuccugaguagcugggacuacugguaugcgccaccaugccuggcuaaguuuuuucuuuuucuuuuaggggcaggaucuugcuguguugcccaggcuggucucaaacucaugaccucaagugauccucccaccuucaccucccaaagugcuggcauugcaggcgugagccaccaugccugaccuuccuuguuucuuuuaggugauuauugguugugugugaggaaagcucugguauuuucuguacuuaucuuguaccuacccaauuuguugauugcucuuauucguuauaauagucuuucaguugacucuuccuaauuuuuuugugccgagaaucauugaugacaaauaaggauaauuuggucuccauuuuucugguacauaauacgucuuuacuuaccaucaguugugugucacuuaggaauauaaauggcugaaaauaacugaaagccugccuaauaagggaguaggccgacaggggcugacuuuucucaaguucaggcagucuggagggaaggagucuguggcugcugugaggugcucaaagagggugugaggacugggcuccuggcuucuguuuguucauccuuagccuguggcuuuuguccucgugaacacaagaugaccuccaggaauuaugucuguuucaggcaggaagaaguugagaaggaaugaagacaaaaggcaaaaaaggcagaaugacaggucagcaagcgcugcucagccaguaggcccugcuucuccuuggccagaacugaguugcaugcagcuggcuagaaggugggagaugaauguggguauggcuaguggguugggcauggggguugggccaaccaagcaugguuggucauagggucuugcugcauuagccugcacauccagaauuguuacauguugauuacaggcauauuuguccuuuuuugucuauauuaaugauaaugccucuguuucucaauguguaaggcaucuuuugguuuaagagguuuucaucauguugaagaauugccugucuuguuuucuugggugauuuauuaaggauggguguugaaugucaucagaugucauuuuggcauucauuuggauucagaagugguuguuacaccuauuaauugagguaggaauagauuaccuaguaguaaucccuccucaaauucccguguuaaacuauuuuugguugcgguggguggcuguuuaaauuccuaauuaaauuugguuugcuaacauauucagauuuuuuaaucucuuauuuuaaaugagauagcuuuacaguucucuuuagaugaguucuuuuccagauuuugcugucaggccuagacuaguuuuguaaaaugaauuaaugacuuuuccuuuuuaccuucucuguaacaguuuuuauaguguggcaauaaacuguccuuugaagguuuggaacaacucacuuguuaaaugccuggaggcugacacuuaaaaaaaaaaaaaaagaauaguuuuuguuguguuucuuuuuguuguugguguuguuuuuagucuucagugcaguggcauaaucuuggcccacuucagccuugaccucccaggcucaagcaguccucccaccucagccucccugguagccgggaccacagguguuuugccgccacacccggcuaauuuuuuauuuuuuuuguaguuuuuguagagaugggguuuugccacguugcgcaggcuggucuagcauuacugggcucaagugguccaccugccuucgccucccaagguggugggauuaacaggugugagccaccaugccuggcguaaaaagaugguuaguuuuuguuuugugacagcuuuaaaaaaggucuuccauggguguuggucuguuccaggguucugguucuuuccucugaugcucuuuuuuuuuuuuuuuuuuuugaaacaggaucucgcucuugucccagaugguguacagugguguggucauggcucacuguagccccagcccacugggcuccagcaagccucccaccucagccucuggaguagcugggacccauaccuggcuaauuuuuaaauguuuuuuagagacagagucucgcuauguucccaugcugguuuugaacuccugggaucaagcgacccuccucccuuggccucccaaaguguugggauuacaggcaugagccaccaugcuggccuucugguucuuuuuaaaucaauuuuaguaauuuaguaauuuccagcaagucaauuaaaaauuauagcucaguuguauguaguauuuucugugugguguuaugcccucuguaucuguuuucucagauguuuuaguugcuuuucucucuuaaucuugauuagaucugccagagcugugcuuauuuuguguccccauccaaauccagaauuaauugccgugcuccacauguuuuggucaaugguggaccucgucuguaacaguagucccaugagauuauaauggggcugaaaacagugcuguccccuagggauaucgugucuguuguagugcaaggcacugcucacguguuuguguugaugcugguguaagcccacugugcuuccagucagaugaaagugcagcgcauacaauugugugcgguaccuaauacuugauaauaaacaaccauguuacugguguauguauuuacuaugcuguacuuuuaauuguuagaguguacuccuuauacuuauuaaacacaaaauuaauuguaaaauagccucaggcagguccuucaggagguauccagaagaaggcauugugaucauaggagcugauggcuccgccuggguuacugccccuguagacuuccagugggacaggauauggagguggaagacagugacauggaugauccggacccuuuguaggucuaggcuaacguguguguuugugucuuagcuuuuaacaaaaaaguuuaaaaaguuaaaaaaaaaaguuaaaaauagaaaaaagcuuauagaauaagaauauaaagaaaauauauacaagaaccaaaauuuaagaaaaauaaaguuuguaaaaguaaaaaaaguugugcuuaagcuaaguuuaauuuauuauugaagaaagaaauuuuuaaauaaauuuagugaggccuagguauacaguauuuauaaagucuacaguaguguacaguaauguccucagccuucacauucacucaccacucacugacucacccgagggagcaacuuccaguccugcaagcuuuauucguggugguacucccauauacguauguauacuuuuuuuuuuuuuugagacagagucucgcucugucgcccaggcuggagugcaguggugcagucucggcucacugcaaccuccaccucccaaguucacgccauucuccugccucagccucccgaguagcugggacuacaggcgccugccaccacgccuggcuaauuuuuuguauuuuuaguggagacagcguugcaccguguuagccaggauggucucaaucuccugaccucgugauccacccaccucggccucccaaagugcugggauuacaggcgugagccaccgcgccuggccuuuuguuucguuuuuaagagacagggucuagcucugucacccaagcuggagugcaguggcgugauuauagcucauugcagccuugaacuccugggcucaacugauucuguugugucacccuccccaaguagcuagaacuacaggcucaugccaccacacuuggcuaauuuuuguuuuuuaauuuuuuguagaaauggaaucucacuauguugccuaggcuggucuugaacucuuggugucaagcaagugcuuggccucugaagugcugagauuauaggugugagccuggccauauguacuuuuuuuuuuuuuuuauccuucuuacuauauuuuuauuguaccuuuucuauguuuagguauguuuaaauacacacauacuuaccaugguguuacaacugccugcaguauucagugcaguaaugcacuacagguuugcagguugguagccuaggaguaauaggcuauacuguauagccuagguguguaguaggcuauaccauugagguguaaguauacucugaucacacaaugaugaaaucaccuaacugugcauuucuuagaaugcaucccugucauuaagugauacguaacucugcuucuuuaagccucuguagcacuuugguuauguuaggauucugugucuuuacaagucugcuuugcugaucgauugugacaucuugagggcggcugcacuacuuucugccugcaccuuguuucgcaugucuaccuggcgcaugacauacaccucguuguucaguucuugcuucucugcuugugucuuugcauucaccaccagcuauucugauaguuaucaggagguuuucauugauugcagucucgugcaaugggugcagguaauggguagccuuauggaggagaaaaugcuuaccuauuuggguucauuccaaggaguaguucaaggauaaaccucuaaguuuggggagugcuguaauuugcuggauaugugagccauagaagacagcuuggauggcaucugaugcuuccuggcugcagggauggaggcagcagacccuccugccuggggugguugguugccaucccugucgggggcucaugcuccacccucaaggcuauucuugggggaguugugacauggcuuucauaaaaacucaguggaauuuuacccuguguauuaguuaguaaaggugagucugguucaguugguuugagucaaaaaaucuguuaauaucucugcuuuagaccugcaucaggcuaauacuugaauuuagggucugucccuggugucaucugaauuuuuguuugcuaugugugaccaaggagauggucacucuucaggauggguggguggaggggagaaaugcuaugauuucuguugggucaugugaaaucaauuuggaauguggauggggcccuuacacuuuuucuuuugagcuuagugauuuucuguguaggguggagagcgauuaggaaggaauucaccacccuuagguccucaggcauagggucuucuaggggcaggacugaugagugaacagcaggguggauggagcagaaccguuggaaccuucagggcaggaccugccaccauuauuuggucacaggaaguguucaguggugaacuuguuggaaaugauuuugaguaacuuccgucuccuaaaucauauuaggacucuuuggucuccuaugguuaucugaguuguuuuccaggaggagcugggaagguaccaggagaaagaugacugucccucucauguuugcugaggguguuccuguaaggugagcuaguguuccuuuuagggcccguggagaccgaccuucacauugaagaagcauaucugugcuccgagauguuuucauggggagaagugucagguguaauuauaaaaggagucuuucucuuuaaauacuguaggcgauuuagaaauaguggagguuuaauugaagagcuugucuacguuuuuacauuuuccuuaggcacagagaaacuaguaucuuucucuggguugccuuuuuuuuuggagacagaaucuuacucugucauccaggcuggagugcaguggccugaucucggcucacugcagccucugccuuccgaguuccagcaauucuccugccucagccuuccagguagcugggauuacaggcacgugccaccaugccuggcuaauuuuuauauuuuuaguagagaugggguuucaccauguuggccaggcuggucuggaacuccugauuaggugauccacccgccucugccucccaaagugcuaggauuacaggcaugagccaccacaccuggccuggguugcuuuuuaaauucauaccuacugucuuauuugggucucaaaugugaucagugguuauacuuuucuugcuaugcauuuaaguuggagcaggcuccggggcaccacuucccucccuagaguugaugaaccccucauaucagugaccuccccaugucacaguguaucucgugugcacugcuagauauucugaucacacagugcugagauuacugguuucucucccuuucucuuucugugguuauagggauucuuuaagggcaggcaacauguucuuuguuuccauaggaucugacaaagugcauggcauagguagguguucaucaaaagggguggaauaggguugaucucaaggguuuuaagagagaucugacgaguuugggugugugacuuaaaaagcagauacagcgccuuuucacggauacaccuccgugauuccucaaguggucuggcuguguuuauuuuaggauucuaaaaguaaaguguucuguucugagucuuucacgaucugauguucuccaguucugugaggucuccuccuuuagucccaucauuggggcuguuucugcucggaaggccaggaaguugcuggaagucugcugggcuuugcaaagggacuuuugcuugugugggcauugcccaguuguguuacaacuuguuuacagccguugguuuuuaagggaugagguaaucuuagcucagcuuaguguaauacacaacaguuuuguuuauugagaaaaucauuguugaaguuuuucagauguuagagauguuaugaauugcaaucaagucgguauccucuuauauaagugcaucugacaagcccauuucacaacuacaucucaucagucacaguuggauggcaagguuuauuguuuaaaguuuuuguuuuuucuuuuuuaaguugggaaaggaagacagaugguuucagaagccaagaaagggcacaaaggcguggauauuuggaaaucgggacauaauucaccauucuucuuaauuuuuucugaucucuaagacacugagacagcuguuaauugaauugcuuguucacaguauuugagacguaaugaaaugugaguguccuaaucaccuggcgggcguagaucuuugggauccuccuggaggcuuaguagggcugcccugagcaguauugucuucuccagcugggccucugagcuguaccaugugcccgugcucagccucagucccucccucagccaguuguuaaaucacuuuggacgugugacagccucaacaugucacagcuuuaaaaguucagauuuuaaaaagguaaggaaaugaucuccuagugagacaacuucugccuaaaaaauaaaagcuucuaagacauaaauucuguguuaugaacaacuugcaauuuucauaguuuucaguuuuagcucuggcagccucugauagaucuuaaauauguuuaucacagcuggaaaaauguuuuauugucaucuuuguuuaucauaauaugccaccuacucugguugugucuuacaacuguagcucugugggguuuuuuuuguuuguuuuaugcuugcuaaugggggagguggggggugugggcggaugaauauaaaugauaccuagaaauugaaauuggaaaaaaaaauguauucagccaguacucuuuccagguuauagcuaaacgucaguuggcaaccucuaugcugugguuuauugaguaacacuuaauacuuagcacagcccucagugaagaucuuuuauggccuuuucugaauguuauacaaacauaacuaaagcuuauccagaugaggacagggaccuuucuuuccuuccuuuuuaaauggagcaaaauuuggccacuggguugcuguggaugagagaguagaaggagaaaggcagucaucgggagacugugugcugagagagcgcaugugggauuuggcuucaggaagucugggcuugcauucuauccagcgcuaauauuuagugagugugauuuggggcaaauuauuucgucucccugagcuucagaauguuugaaacuuugugaggagucugaccccacacuguaggcucccuccauguauauauuucuucuuccuuuuccuuuuuuuuuuuuuuuuuuuuuuaaauuuuugagauagugucucgcucuguaaccccaguuggaaugcaguggcauggucauggcuuacugcagccucaacgucccaggcucaagggauccuccugccucagccuccugaguagcuggggucacagaugugugccaucacgccuggcuaauuuuuaacauuuuuuguagagaugggagucucacuauguugcccaggcugcacucaaacuccuggacucaagcaguccucucccuccagccucccaaaguucugggauuacaggcaugagccaccaugcccggcuggaacuguuggcuuugaagaagaaugaugcugugcuugccuuugcaguccugucaccauacuuccuggaaaguggguggacacgcuggaugguagauguugaguucuuuagaugccuggaugcuuacaugcuuuguguggguucuuacuggggcuguaacuuacuagaggacagacuccaacuucugcuuacuuagucuggggagguuaauaauaaucuagggcacccgcuucccaguggguuuccaucagucuccuccagcccacucuacucucuguuagccagcugggcaccucuuccucugugucccuucgguaucuucccaguggcucuuuccacgacuggcucagaccauguguauaucugcucauugucuguccagggucccuccaaagaugccucugugggcugggccccugguggugcuuccuccagauaauuguugaagauggaacaggagugugcaagaacaccagcgugcuuccaguauucaggucuagcggcaggucccaggcaucagcggcucaccacuccaccgcagguagccugauugcccagccuuggagccgcagccuccuugggugguguggcagcugucagugucugaaaccauuuugaacuuuaaaggguggugucagacagcagcuauugaggcuacuuaaaagaauuuuuuuaaauguacgaguucaguggcauuaaguacauucauauuguugugcaaccaucaccacuguccaucuccagaacuuguucaucuucccaaacugaaacuccauguccaucaaacaacuccccauugccuuuuuccccaagucuuuggcaaccgccauuccacuuucugucuguaaauuugacugucuggauaccucauguaaguggacucguacacuauuuguccuuuugugacuggcccauuuuaugagcauaauguccucaagguucauucaggcuguagcauguguccagaaucuccuuccuuuuuaaggcccaauaauauuuaauaauauauguaugugugauaacacauuuauauaauguccauuaccaugugguauauaugcuuauccauuugucugucgauggacacuugaguugcucccccgcuuuggcuacugugaauaauaugacugugaucauggauaugcaaauauuuccuuaagucuuucaguucuuuuggguauauacccagaaguggaauugcuggaucauauggcaguucuauuuuuaauuuuuugaggaaccacuguacuguuuuccauguagacugcauaagaauuccaauuuuuccacaucuugccaacguuuauuuuuauuuauuuuuuuaaauuuuuuauaguagcuauccauucuaauggaugugaggugguaucucauuaugguuuugaugggacuuuugaguuuuagcaaauaucaaugaaguauuuaauuuuuuuuuuuuuucuuagagacaggaucucacauuguuguccaggcuagagugcagugaugugagcauaguucacugcagccucaaccuccuaggcucaugugaugcucccaccuacgcuuccucaauagaugggacuauguuccugcgccaucacuccuggugaauuuuuaaauuuuuguagagaugcggucuugguacauuuucuaggcuggucuggaaguccuggccucaagcaguucuuccaccugaaccucccaaagugcugggauuauaggcgugagccacugcaccuggcuuauuuaaauuuuuauggguaugaauucacuuaaaagcugaagguuuugagaggagagggagcaugugaaaaaaccuaaagguuuugggaggaggaggagaaggaagagagggagcaugugaacaagagcaacugauuacuuccuugucauucauuugcccaguguuuacuaagcaccugcugugucucagaccugugcugguuuggcccuugugaaggacaguaaauacagugcaguuccagcugcgcaugggaucacaguccaguagguaaacgagugccuaaacuuaagagaaaugagugcaguugggguccuguggcggugaaggggcgagucugcacccaggcgaguguuaaaggccuggccuagagaagauggguguuuugauggaaggagcugcugggaagcauguguacucggugucuuggaguuuagaaaccucaguuggcuccaugucucguccuuaguaaaggaauaucgggagcugagacuggauguauugacacaggucaaaucacagagucuuaggccauuucaaggagguuggauuuuucucuggaaggcacagggagguuuugaaggacuuaaugcagaagaaugggcacugucagguuugugguuuggaaaguccgccuugguaguaggguggagggugcauuauggagggcuagaccaggguccagcccccagcgagaugcugugugguaaccaggggagagagagguggugguguuagaagccacgacuuggcauagaagccaaagcauccccagguugucauuguguaauuaaugguuaaguuggggcaagaaauaaagcucuuaaaaguguccagcuguagagcucucugccuguuuuuaucuucagauuuuugucuuugccaucucuggccuccaguggaaggccgaaguuacuuaacuuccuugcuggaagcagggcuccucaugauugccagccccuguuugguagugguccuggagugcuguggaaaugggauacuuggugccacuuaccuuggggcuuugcuccugaacugcagcggugucuugugcucugugguuuguagcauggaacagaggcugaugggcggggaguuugagucccagugauugaggcccccugccugccugcaccuuacugaaggaaggacaugguggcuucucagugugcucucuggugaucugaaccuagauucuuguuucacggguagggggcaggguuuuggauucagcccuggccagcccuggcccaaguucauagugucaguaguauaguucucccaccacccccuucucuccugcuccuguuuucucccccgccccuucucuccuacucuccuuccucucccacucucccuccucucucugccuuucacuuccccccacacucucucucccccgcucccaacuuucuuucucucuucgacucaccacacaacacacaccugugugugugugugugugugugugugugugugugugugauggcacuguuauuucauguguauaccuuugcguagcguuggcacaugugggaaugcuauuauaaugcuuucguugggggucugugcuaaccacugcugagugugcuucauguuuucuagacagcaugagaccagagcucuccaccuugccauuagcuggugggagaauuuugagaaagucacccaauugcucuuaaguccucauuuuuuuuuuuaaaucuguaaaaugguaucacagaugcuuauagcucaagacuaguugaugagggucugugacucaaaaggccccauagaugggguucagagggccuuuggaaauggcgugcaagcucuuuguaaguguauuuuuuuuggagaaagggcccagcuuuuuaucagacauccugagagauucaggaccuaaaaaauaaaccuugauuaaucuuggaagccucuuuuuacgcaguacgcuuugauucaucaguauaugcauguggauggguucucagauggccugauguuucuccuccuuccucuguguggugggcgacgacuuuggcugcccagauguuaacaucaguaagcagaagcucagucaguguuagcaaaauuaaaucacucugcaaaaaucaauguuagugaaauuaaaucacuugaucuuaaaagcagcaugaaauagcaguuuuucaucuucauugugcuguuuucccacucuagauaucuugcagauuuuuuuugguugcuugguugguugguuuuuggcguccuuuucaaggacaagcagcuuuggacaguugcacuacuuuuuuuuuuuuuuuuuuuuuuuugacagagucuugcucugucacccaggcuggggugcaguggcgugaucucagcucacugcaaccucugccucccagguucaagcaguucuccugccucagccucccaaguagcugggauuacaggugucugccaccacacuuggcuaauuuuuauauuuuuaguagggacaaaguuucaucauguuauucaaauucugaccucaagccaucugccugccuuggccucccaaagugcugggauuacaggcgugagucacugugcucagccaguugcacuacauuuuuuuuuuagaugccauuguugaggauccagggguuugucauagauugauuaaucagaaaguauuaaucuaaaguauuagaauauauugauugcaggcagggaccuugcauaguuuaaagaugacucagaaggcacauuagguucuugccacacuuugcugccaucacagauggaugugaguugcccccuuauauaggucucucgggaugccccaguggagaacagcauugauguugaacagauccuguccgauggagagauaccagcguuucagccagcggugugagugagggcaggggccaccucugagggugcuugcucccucacacuguccucacgcugcccucaagcugugggcaaaggagagggauccugugccaucacagcccuagaagcagaauuccaaaaugugggcuccuuugggugugguuugggggucaaggagauagagcaaguaaggaaugaacuuugaggguuuaugaucauuuucaugaugauaaugaccuaaaaacaugcuuggcugggcaugguggcucaugccuauaauuccagcacuuugggagacuaagacaggaggauuucuugaguccaggaguucaagaccagccuggacaacauagggacaccccaucucuacaaaaaaauuaaaaaauuagccaagcaugguggugugcaccuguagucccagcuacucaggaggcugaggcaggaggaucccuugagccuaagaggucaaggcugcagugagccaugucugugccacuguacuccaacuugggugacagagcaagacuaucccaaaacaaaaacaaaaacacaugcuuaugguaggcaauuaaaacaggagguaaggaguaaacaugccaggccccuccuccucuccucugacucuuccuucuuccccccugcuucccaaggguaagcuuugcagauacuugcuaugcaagcaaaaaugcuauucuuagccaucguuuaaacacagauuugcaauuugugguuuuucauuuauauaaauuuuggcucucuuccuauagcagaaugaucuuuguuuuuaaaaugauuuuaaguauacaauuaauaugugaauguauguuucuuauggaaauuagaacaauacacaguuacagaguagaaggugauaggugauauagcucacccucuccucuuccugcuacucuccccagucugcuucacuccccggaaggaacuacuggcccaucagcaugucuccuuccaggcauuuuuuccaugugguuauguccaccugcauaagaaacugggggcggcaggguggggcgguguuggcgggucaggcagaagcaagccacagagcaguaaggguacuuuuuaaaaaaacauuuaaauagaucccuguuguccugcggcuuacaugcucaugcauacucacuguuucuuuaaauaaacuuuuucuuuuagaauaguuuuagauuuacagaaaaguugccgcgauagucuagagagaucccauguaccucuuaacagcuucgccucuguuaacauucugugucaccaugguaauuugccacagcuaaggaaccagcauuaguccaugacugucagugaacuaaacucaagacuuuuuuuggauuuuaccaguuuugcccaauguuccuuuccuggucuaggauccugugcagaauagcgcaucacagcacauuacauuuagcugucuccuucaccucuucuggucugugacagggucucagacuuuccuuguccuuggugacuuugacaguuucgagggacacuggccagguuuugugcacacugccccuuaauuuggaguugucucaugguuuuuuuuguuuuuuuuuuuuuuugagacagagucucacucgucucccaagcuggagugcaauggugcaaccucgacucacugcaacuucugccucccagguucaagcaauucuccugcuucagccucccgaguagcugggauuacaggugccugccaccacacccaacuaauuuuuguauuuuuaguaaagaugggguuucaccagguugggcaggcuggucucgaacuccugaccucgggugauugcccaccucggccucccaaagugcuaagauuacaggugugagccacccugcccggcccaugguuuucuuaugguuagucugggaccauggguuuuugggagcaagaccacagagcugaaaugcccucccuucagugauuugucagcaugaccuaucaccauuguuguuaaccuucaccaccuggaugaggcaguguaugcguggggacauacaucuauuugccccacugacaugaggguuggaucucuagaagaggagucacuguucagagguuauaggcauuuguauuuuuuggcagauguuguccuucaaaauggcuguacacauaugcuccucccaaaaguaggagagugccuguugccccauguccucacucaagcuugguguuauuagauugguaauuuuuuugugugugaaucuguuaaguuaaaaauauuucuuucuuuggccgggcacagaguggcucaugccuguaaucccagcacuuugggaguccgaggcgggcagaucacuugagcucaggaguucaagaucagccugggcaacauggugaaaccccaucucuaccaaaaauacaaaaaaauuagcugggcaugguggugcuugcuuuuggucccagcuacuugggaggcugaugugggaguaucacuugagcccaggaaguugaggcuacagugagccgagaucgugccacugcccucuagccugggugacagugugagacccuggcuccaaagaaaaaaagaagauugauugagauagggucuugcucuguucaggcuggaaugcaguggugucaucaucauaguuuacuguagccuugaacucuugggcucaagcaguccugcuccuuuggccucccaaagugcugggguuacaggcaugagccacuaugcucagccaagcuaaaaauaucuuagugugcauuucucuaauugucagaaguguauuuauuuaccauacccuggaaaccuuauguaagaugauggugaguuuggacuuuccaguaacauuuggaaacuguuuaguaccaagcucucauuaacaauauaaacaaaauaggggucuacccuuaaggaaucaaagccauuaucuaaaagcucuuucccgcaacaacuaccugagauaauguccuuggucauaugccccagcauuuaaaaauggaguuagugagagucuguuguuuaccaccugauacauugguaagagcugcuugaugguauggggacaucaguagggaggauauagacguagccacccccgcccuagauaguaggggccucagggugggguaagccugggugggggagguaugagugguggaacagugggagacccuggauccuuagucuccagcgugauugcauuuugccaaggcuuugucccaugucccuuugucccguguuccauuugcccgugguguugccuagagagcauggaggggcugguggagcaugcucugugguucccuaacccagggcuguguggggagagcuugcagcaccccccugaccccauaugaacguccuugcuauuuccugcugugccauccagcaacuauaggaugcugugcuguggcugggagaccuguuuggucuuggaagcuggguccuggaugagcagaaugaggcaggcauagaggugauguuggcuacgggcaggggagcguuugcuuugccuuggaguagugccauuuccauguagaggggcaagauuuaccacccuguuguggggauuugagacuuuggguuuuguuuuccuuuacaccuugagcuuuguucuacagcaggucccugggaagacugguccacaaagcugcugaauggggcugcuguccuucagcccugccuccugcugcagaaugcagaggacgcuguagacuugcuuggugggugccugggguuuucugccucccuggugcacugggcacagcggcuugccugccuuuugggucgucuccaccucccagggauguuuuuguucccugaucgaaugaccuccuguuuuguuuguuuuuugagacggaguuuugcuuugucacccaggcuggagugcaauggcaugaucucggcuaacugcaaccucugccucccggguucaagugauucuugugcuucagccuucugaguagcugggacuucagguguaugccaccaugccacgcucauuuuuguauuuuuaguagagaugggguuuuaccauguuggucaggcuggucucgaacuccuggccucaagcagugcgccugccucagccucccaaagugcugggauuacaggcgugagccaccgugccuggccugaccuccugucuucuguuuuugcccacugucaaggguagacuucuucaaggcuguacuugugcuauccuaaagaggaguaaugggagacauuucugacuuugucagcaugcugcuuggcagcaccugccucguuucuggugaccauuuggaaauguguccuuuaucugguagcaaggagcauuuacauugaucccuaugcacuuaauuggcauacuuuuauuccucuggauuuuuuuuuuaaagcauaauuguucgugucuacaugauguaacaugcugcugacuuuuaagcaaauuaacagaguucgugcugaagcgcaagggugcagggaaacaaaaugggaggguuauuaaaggggugaggcggcuccucaaagaugucacugcaccauucauucuuguguuccuggcccauggcaggcucauuaauccuccacgacaauccauuagcaugccugucaacccuucagagaagaugagccauaggaaggcuuagggauccccacuugaacugcuguguggcucuaugaacauccccaccuuccuggagugaggugguuguggccaccugacuuuccccauuuuuuuuuuuuggaccucagccuccagcgcuccugggccagacucagggugggggggaugcaggugccagugacugacacuuggccccucacacuucacugccugauuugcuuuaaaggcaaggguugcucaugcuugucugagcucuccaucuguuugagaauuauauuguucucaacuggaacuuguaaaagagaaaaaaauguacuucucaauuuccauggaagaauauagauuuucuggugggguggaaacuuucuuagcaugaagggaucuuugugugaucugcgcaucagcacugaauaaagaaugggugcgccgaagucggggaggccgacuuuccuguggcuugcuggggaaaguuugaacuguguguaagcagugcguggaaggaaagcuaaguguggagauaacgaagggaaugggauuuaauagaaacagggugugaugaguggcaguugccugaugaaguggaaaucuuguguuccaaauuugugagauccauuucuguccucuaaggaaaauguuguaugugcaggaggaguucauguaguuggguuagauuguguuuucugucuuuauuuuuuuuccugccucuauggguugugaacaaaaacaagaauuugauauucugcaguauaguuaacucgugcaaacaguguaugcuuuucagugggauauaaggucugaaauaauaggauuuucccuaguaagucaguuucauuccuuuacauguggguuaugagauacaaagugaagcucuguaaagcuuuuuacgagcucccuguguugcccuccuuugacgggucaaggcauugggguugacagagguuucuacucucagaggcuuuaaagaggugcccacucuggugagauggcugucagcaugcacgaugugugugagagagcaccucuucaaucauaugcaccuggcuguagcauccuugucagccuuaagagauaccuccaaagcggaauuuucuaccccuagaaucaugugaggucaucucaauuuaagccccagcucugcucccuaaauuaccugagugaucccagguaggucauuugcucauuguuaaccaucaguuuccuuagcugcaaaacagagcagauaacaccccaaaagaguucucauaguaaaucacaucaggcuuacacaaucucagaaaugugcagcuccacaggaaucuucauuaccucuuuaggcaguccagucggguuucaaaugaauccuacugucuguucuuauauggaaccacagucccucacccuguguugaucuaaguucucuguuucucuccuccagcagggucauaaagagccugaccagucccccucccuggagaccuuugugugcuggguuucugcagccguucuccaugagaagggacuucuggucccugcucucacuuggauguucuuccacugacuuaucucucuuaauguguggaggcagaaacccaguuuucagggucucuccccuggccccuuacuaagucucccuuagguacagucuaagacugccugacuuuuucuucuuuuuuuuuuuuuuuuuuggcagccacaacaucacaucgucacauacagaaauuauauccaauuaaaucuccuaagucuuuuucacaccuccuacauuugugcauuucuuuuuuugcacccaaguguccaaauagcauuuauuuccucucuauugcaauuccaaucuguugaucuuuuuagcucuugacucugucauccaguguauuugccauugcuccuggaaacuugucaucuuugaauuagauaaacauuuuaucugugccaucguucaaguaauugauaaaaauguugaaaucuacaguacucagaaagagaccuguggccucccacuagagaccuuccuuggucuguucauuaaucagcacuuuguaggguaaauugaacauuuacuaagcuauucagauguaguucauauuucuucaccuugucaacaaagagaucuuagcaaggcauuguagaccaaguauguguuccuggaauauacauauuaagaaaaaauccuuaugccaagaaaaugggcacauccccaaaacccagguuauuguaguuuacggcuucugacccagggcuucacuuuguagcaguguuuuucuucuguuuuugccuuuggcugauaccacugcuagagugcagauaagagaauguuacuaccagggggcuugagugucgggcuaugauuggcugucaucuggagcagagugggacugagcugcucaggagaaaggucuucaggugauuuuuuuugggaagcuaagagcacugguuuuagacauccucuccuggcugaugaugggauuggccuucauggggcugcugucuggcugggcuggugggcagagguuccuguggguguggauggagaaauccuaaaugccgaggguaccuggucuuaguagaaaucguaggaugccucagugaagaagucagggaugcggauuguccuccggaugcuuggaugagcgugcaguggaaaaaguacuccuuugggggaagaggugaaucuggagguguuagagcagaagaguaaaugcagaaguuguagcagauacaaaggcuuuggcaagagugggagugaucauugaagggaaggcaggggcuugcugggacaggcuggagccgugauggacccucauaguaacccugcugcauuuuacaaaggaagaacuguguugggguacagaugugccaaacacucaaaguuagaaaaucaacgcagucgguuguggcuucugcccuugaaacaucagauagugagaaccugccacuguucaguuugcagagugguugguugcauacaguguuuuagcucuugcccacucaauacagagguugcaugcgggcguccaccugcuccgccaccucugccugcuuguggcugugugcccagagcccauuucccuggggagucagugcagcacuccugggggacccuucuguuuguguccugacgaaucugacugugcuggaugcagucccacagccacaccugguauggguggcaucuuuaaaggccuggccugugugugcuguaucugcagcagagcuguggccaaaccugcuuuccuuccaucuggguuccccuugguucucggugguggacgggcuguguggucuccccucagcuguccacuugcacuuguguuaaaaugcggcagaacuuucccucuauacuuaaauuguggugaaauacguaugacauaaaacuuaccaucuuaacuuuuuuuuauugagacaggaucucauucugucacccaggcuggagugcgguggcgcgaucucugcucacugcaaccucugccuccuggguucaggcgauucucaugccucagccacccgaguagcuggaauuacacgcgcccgccaccaugccuggcuaacuuuuguauuguuagagaugggguuucgccauguuggccaggccggucuugaauuccuggccucaagugaucccccugcuucggccucccgaagugcugagauuacaggcgugagccgccgcgccuggccuuccuuuuuuuuuuuuuuuuaagagauggagucuugcucugucgcccaggcuggagugccguggugcgaucuuggcucacugcaaccucugccucccagguugaagugauucuucugccucagccucccgaguaccugggauuacaggcgccaggcaccaugccuggcuaauuuuuguauuuuuaguggagaugggguuucaccauguuggccaggcuggucuugaacuccugaccucgugauccgccugccucggccucccaaagugcugggaucacaggugugagccaccacgcccaccggccucccaucuuaacauuuuaaaguguucaguuuaaguaccuuuacacugcuguccaaucaaucucuagaacacuuuucaucuugaaaaacggaaacucuguacccauuaauaacucccauucucuccuaccacagccacgggcagccacuuucugcugucuccgugagucugacuacuuugaguaccuaugagcagaauccgcaggauuucuccuuuugugacugccuuauuucacuuagcauaauguccucaagcuccauccagguuguugcaugugagaggauuuccuuccugugcaugaacuagagugaugcagggacugaccucuggccaugugaugggugguuggugauggauccaagagguagcuggucucugaauacuagcccaguccuuuuccuugcuaggaaaguccccagaucagauagaaagccucaguauuucaagaagcuucuguuuugacaccacauccaugaagaaucacacugcaggguaggggaacagaugagugggauuucuacacuguuaucagcuagacuuagauaacuggcuaauugaaaagaguacaggucacuuaaggaaacuggagcauuguagggcaagguaaagugcuuuugaaaugaggaugugaacuguaacuggaaugauguaauguguucuacaaaaugaagccagugagaggacaggggacacagggccgacuuuuauuuaggacauuugccugguucugagaagaaaguugaaagucacgagagagagggaaaggaaggcagaaggaacuugguuuuugcaggugccugcucagcaugggccuugccccagcuuggcuguaccucacagcaccauccacuggcucuacagucuguccuucggagguuuagggugcugucucaugcacagugggugcuaggugguagugaggacagggugugggacuaggcaggugcugccccucggaaggccucauggugaggcaaagaucucuggcuccgagggacucuaucuccugguguccugcuucaucgagaagccagccacccaugggaacuguggauaauuagaaaggcuuagaggcucuucuaaggguguuuuuugaaauauggagaccuagaauauugggcuuugggauauuuuaagaugagaaaggcauuuggaguaacugucagagcagauaaaguuguuuuuaugaagauccgggaaaacgguuguuacaaauacagcucugcaccaauucugcgccagucuguuuggcuacagaugcuuucaguggaggggacacuggggcuuguguucccuuuagucuuugaauucccguuaaaguuuccaugucuuaaguggcguggcaggauagaaacaucucacccaucuuaguaaguucuuugcuguauguagcacucugguuuuaacguucugagccuucaggacugcccuugaugugugcauuuauuuuguugauaugcaugauguguggguggcucugcggcaguaaaacaguucacauucaaauuacacucgguuucuaauuucuguucucagaguuuccucuguaauggaaaucucuuacauucuuaucauugccuucaguuauugaauguguuagguggccaggauugcugucugugugaaaugggaauguauauauacaacguaaacauguucugauugacacgugaagauaaagggcuuaacaugaauugugucgguuuacacuuacacagaaaauucuacuguaauaaacugaagugucaguaguguuuguuaucauaacauugucuuuuucccucuuuucugaucucugauuuuucaauuaggaaugaggccuaaagaaacccaugcucucucuucucugagcgcaaggagggugugcugagaccuugaagggcacagcaugggaggaucauauacuagggagagucugucuccaccccauuuuucuucugcuuugcuuuguuucguaguuucuucgggcuucuuggggguuuucugagagagagaaugucaauuugagaaguaacaggugcacaggcuuuaccugcaccacacugcagauaagguggguagggaggguagugacagguggugugguggguuauucaguucuuuccuagggcagugggucucacaggguggugcuuaggccagcagcaucagcaucaccugggugcauauuagaaacaaauuuuggggccucaccucuugcguuuuaacaguuccuucaagugguccugaugcauguugaggacuuugaacacuccuccuacaagcaaagugaaguugaccucccacacacuugucucagucugcuuucuagcaucugucccauugccuuuguuguucuccccgccacacgggcugcaccccugggauucccccagcugccaccaggcaucagcuccagcugccucccagggugugcuccugccucugcuuggaguacccugccucccacucuuccuggcaagacccugcucaucuuucagggucgucucugcugagaagucuuccugaccuccucggagauagggaguuguggggccuugucuuuauguucccaggguucugucuauugcgcuauuaaaacuuuuuuuuucauuuaauuugccacuugcuagagagaugguuguucugccuucguugugcaaaauucagugauacacuaauccucuccuaaccucuuaaaucauuuugacuuucacagagugauagugucuagagaggguuuuuguuguacuaaguuauugguuccaaagaauucauuuuaagaggaguaaagaacuacuauaguaugccgcuuacugagacaaaaccgacuucucacauaagcccaaagguuuuguuauguuggauuuuaccauuagaguuaaagaugaugauugguucacuaaugugcuuuaccuucacagugugccuguagaccuguaguaaaagaaggcuaauuauguuuccugaugucuuuuauuuccaacuauaagcuaagccuaucucauuuuuuuuuuuuuuuuuuuuuuuuuuuuuugagauggagucucguucugucacccaggcuggagugcaguggcgugaucucagcucacugcaagcuccgccucccggguucaugccauucuccugccucagccucccaaguagcugggacuacaggugcccgccaccacacccggcuaauuuuguuuuuguauuuuuaguagagaugggguuucaccguguuagccaggauggucuugaucuucugacccgugauccuaccgccucggccucccacagugcugguauuacaggcaugagccgccgcacccggccaaccuaucccauauuuuuaaagaagaguugaucaaguaguuacccauuuuaacuaaauggauaacuauaacauucuuuaauggaauuguugacagagggauaaucaguguuuuugcuaauucaugccacccuccuuuguuguauguuaguaauauuuacauuggggcaacaaaauagaucaguauuuccauuaauguuuacuuaauaacagcugcuaaaagguauuacuguuugcaguaacacaaaagcacuuaccugauucuuaugccagcuucuauaggguagguagugacagcccauuuugcaggugaggaagaugggguuuagaggugaggugugucugccugagagcaggagcugguaaauggcacucugggcucaugggagucacgcuguuuuuuuuuuuuuuuuuuuuuccuaggaccucaagguugugucuaagacauaauuuacaguucucguguaggucuuccaaauacuuagcuacacagcuuuggggcguuuucucagccaaaugcuuuucuuuagcccuucucauauuaacauuuaguucuuagggauuuauuuucaaaauauauauagcuuguauaugccauucaccuaaguuguuagagcagacauucugccucuugaucuuuagaaaauaccuaagaguauuuuguuaacaguacucauuucagcugaaagacuuuauuuuaaaauuuaauuuaauuuuauuauuguuuuuugagacagaaucuugcucugugucucccaggcuggagugcaguggugugaucuugacuuguugcaacgucugccuuguggguucaagugauucuugggccucagccacccaaguagcugggauuacaggcgugcaccaccacgccuggcuaauuuuuguauuuuuaguagagaugggguuucaaacucuuggccucaagcgaucuaccugccuugggcuaccagagugcugggacugcaggcaugaaccacugugccugacuuuuaaggcuuucuuuaaaauggcaucuuuuggccagguguggugguaaucccagcacuucuggaggcugaggcuggaggauugcuugagcccaggaauuggagaccaaccugggcaacauagggaaacccucucucugccaaaaaauuaaaaaacaaaacaaaaccuagguguuaugguguaccccuguggucccagcugcuugggagcugagguggaaggauugcuugagcccaggaggucgaggcugcauugagccacgauugugcugcagcacucuagccugggugacagagugagaccacgucucaaaaaacaauaaaaaauaaauaaaaugacaucuuuggagaagugaauucuacccagguaccaagccccugccugccccucccaacucccuucccugacucccagcacccccaucuguuuugguucugcuguugccauucucuggcuuuggggacuuugcugaggccccacuguccccaucuuccagcuguacccuuucucucugcuucccugcuugucuuauucuuuacagggcugccugggaucucacauuccaaaaguuuuuggguuuguuuuuggaucaugccaauaucgguugcuuugagaagggagaaaggguauuuugcauuuuccuuuuaaucaucggugaguagccacaaagggugugucucucccucuugugcuguguuuacuguuuacucccucggugcaugaauuauuucauggcaccaguggagcauauuuucuucucuuuccuguuuguggcuugcgccuccugaacgcugcuaucauucaugguccagcuugguuuucuuuuucacuguuucuaucacaaaaccuccugaagaccaguggugucagucauaggcuccaaaacagcugguuccuaggcccugccucgugcucugugguuugggcuugucuuuucuuccagaguaaguggguagcuucuuccuacuuuuuuucucuuuucuucuauaaaugggaggaaaagugugaaguauggagacugcucuuucauuugaaggaaauucacaguuccagcucuguaguguggccucuguuaacuaguggucaacacugacuguggaaggggggccagauggcaaagugaagcagauucuuuccuccugucugcauuuugauugcaguaugaaguucaacuugcuucagucuuugucuucauguuguuucacuagguacugaauuuugugaucuguuggaaauaacaaguaaauagaugccuaacgcuuuauacagguugagccugucuaauccaaaaauccaaaauccagaaugcuucaaaaguuucagcuuuuggagcacugacaugacaccacaaguggaaaauuccacaccugaccucaugugacgggucacuuuucgaaacucaggcacacgacacacaguuaauuuaguguccccaggggaaaaaagacccucccggcccccuucagcugugaugugucuuuuccacacaugcccagauucccucagacaccuccacaaaggguaauaaaaugguucguuguauacaaacuuuguuucaugcacaagauuauuaaaaauauauaaaaugacuuuuuagagaagcgagaagagaaaugagagguaggggagggagggaggaguugggggacaguugggggaauaguugaagcuaagguguuuaggcagagcucugaggaggugacguuugaguggagacccagauggcuagagaauggggcagccuccugaaggagcagaagcacugugggcggcaggguaucacagaggaggagcucgguguguuggagguuggugagucccguggagucuugucagaugguguugggacagggacggaccgugaggaggcuggaucauggggaauguguugcuuuaggccaagcuggaguugauaguggcucagaucagagcuaaaguaguggagacacacagacauugaaagaaugaugaaauucacucauucugcgugugucccaugucauguguccgcugcacaccaaguacuguuuuaggcacuggugauauaauugugaaccaacuggagcugcggugagagagaccaugaaaagaagggccagagcgguguccugcagagggugguguaccuugggagggaaguguguaggguuguugaggaacagcgugcugcacagggaggaaagacguggggcagcauugugggaagagcaaccaagauucucauaggcuugggagcggaagcccugaggucuguugcuggacuagauaugugaggugugagaggagagaagaaucaggaaugacucuuugauucuuaacgugagcaacucagagaaugagagugcugcaguuuacaagcuuggaagguggauuauguggggggaugagugaguuguuugacaccucaauggauauacucggauguauacguuagagcucaaaagagucugggccagugacaugaauuugaucauaucuagaguaugaguggcacaggaagccacuugucuggaugaggugacagaggaaaagguugaggauagcaaccaacauuuagagguaagguagaaggcagagcaguguggaaucagggaagccgagaggaggaggcaaugccaggugacuggaaggucaagugacacuucgacagugucacugagggcucugcuaggagcuauucggugucauaauggggacagaagcucagucggaguggguuaaagguaaccaggaggugagggugcugagaggugggacuauugacaagccuugugucaaguuuugcuauguaggggcugaaaucuaauguaugugacuguguauaagugacuugacuuccccaaaucuguuuccucaccuuuaaaauggguguuugccaagugcugguuucugcuauucuuuucucugucuuaggggugucauuuucucuuugguaaaacagaagaauuagaugauaugaaguuucacauucuaaguucucaagcuuugcccacuccucagcccuugggucccuccacuuccucuucucuucgcuaucucugcucaguuucugucuuugauuguaauguaaugcccagugggacuuuucuucucucccucgucuguucacuuauuccguccugcacugggccaccagauuaauccugcaaaaggccucacaugggcuucucucccgcucaggagccuugugggggcuuuauuccucugagaugaaaguucuuauccccacaugugauccuuuaugacuugggugcuaucaaauucauuuccucaacugcuccccucuucacccugaccaucagaucugcuggcacaugggcauaccuuguucugcauugucucuggccugugggauauuuaccgagcuuuaaauccuaggcacccuuugggagccggccugugugcagagcuccccuuagcacgguggcacaaagcuuggacaccaccucuugucuguccugcuuaauuccauucacaucuagaguggacucgcugugugcacaccacugaccaccugccucaugugacaguuguuccucaugggucuuagcucuuugccuucaccaugagccuccucagagggcagggcacugccuguuggcauuucucgugguaucauacauguugggugcuucccaaauuaauuacaucagucagaaaacuucacucuaucugagaagcuuuaauaguguacuugggauuauuaaauccuaaaaaagguuaucacaaagaguuuucuuggugugugucugugcuuagaauuuagaaaauaagucauccaguauugaggccauuuuaugaaaagccuuuaaaaucugcaaaugcguuggcccagcacuuccacuucuagggauuuauccuaagaaaauagucuuggguaucugccaauaauguucacuggaguguuguuuauaaugugcaaaacaggagcuaaccuaaauguccaacaauaagggauugguuaaaaaaaaaaaacaacccucaugguguguauuaauacucuggaacuacuguccccuuaaaauggugauguagaaggacauguauugaccuaguaaaauauuaagugaaggaaguguguuuacaaaugucauuuuugucugauuucacuuaccuucauuuauagagaguggauaauuggcauagauaguguuaacauuguuuaucguggaauguugagaucguugaugauuuuuacugguuuuuuuuuuuugguuauuaccucuaaacucuguaggaagcaugcuuucuugaucaauaaaacuuaaaguuggaguuuaugcugcuuuuauucauaaaaaaaucacguuuuuaaucuuguuagguuauccuuuaugucuacauuaaugcacguguggagagaacacagucuacucggcuuaugucaaaugguagugggaagcauggaagcaugcguuuuuuaguccccacuuuacaagucacagugacgguucuccaguguagaguagauugauugcccuguguccuucaggcagggugcaguaguaaguuauugauacuuggcugcugagcugucguucaggccuuggcaacugacgcucugcagaacggaccaggagugugcggugguggaguccggcuggccuggguugcagauuuaacuuucgccucugccucugugugccucugggcuguaagcuuuaguuugcacgguuaacggggauggccucucccauggucgguuggaguguguugcacagcgucugguccaguguuggcacuguauaaaugccagcuaacugguuagccaccuaaacugucagucugcaacccacagcucugcagugaacaauugaaccucauuucuuuaauaauaauacaggauuccugaaaaccaacuguauuauuguuuggaaaauaguuuaaaaauuauuuccuucuaacugagacguuuacccucuugucucccuucagucugcgggccaggcaucgacauccgcaacgacuaucagcagcugaagcgccuggagaacugcacggugaucgagggcuaccuccacauccugcucaucuccaaggccgaggacuaccgcagcuaccgcuuccccaagcucacggucauuaccgaguacuugcugcuguuccgaguggcuggccucgagagccucggagaccucuuccccaaccucacggucauccgcggcuggaaacucuucuacaacuacgcccuggucaucuucgagaugaccaaucucaaggauauugggcuuuacaaccugaggaacauuacucggggggccaucaggauugagaaaaaugcugaccucuguuaccucuccacuguggacuggucccugauccuggaugcgguguccaauaacuacauuguggggaauaagcccccaaaggaauguggggaccuguguccagggaccauggaggagaagccgaugugugagaagaccaccaucaacaaugaguacaacuaccgcugcuggaccacaaaccgcugccagaaaaguaagaaugaugcugacugcugcuuucucucugccucucucucuccucuccuccuccuugaccucccuucucuucugagugcacgaguuccgcugggcagggugcagucguguugcauuuaggacguggcaugccugcugugcggaagugguucccagugggggucuugguuggcuuuccuuugcaucugggacucuuggauugcgggacuguggcguggcuggaggccaucauggcugcugucaagacuguucaaaucacauguuagaaauaauccagcacacuccugggcuagacacuugcugaccuucagcuuugaauuccugaugagaaaggugaccuggugugcuuggaagucccugagccuuggcagcugggggcugcuuaugugucagcucuuucauccuuugugcgaagugauauuuuuuguucugcaggacuuccuuaguuugaauggacuuggaauaugguuaaauaaagggaagguaaagcacuaacucauauccugugaaagugguccuuagguccuagugaugauguuaugauacucagguguccugguuaugacagagcaccuggcccaggugggagaccucuggacccauuucugcaagucccagguucaggcuguacuugcagguagcuguguagcagggugcauuuuuaaaccucugggauucuguuuucguucuuuuauaccuguuuacugaacaguugugaaaaucuuaagauuucacgagugaaggaacuuuggaaaguauuuacuguucugggggucagauggugguauuuugaagcuucuuguauauuuaucugcaauaugcuuauuuucccuugagaauaacugagcucuugccuucaugugaucaguuccuuaagaaccaggcuguuugguauuaaaaugugacucugagccuucaccuuauugcauucagcaauaguuauguauauuggcuaggaagcuuuuccucacugguuugaagucaguguguuagcuauaaauagcuauuauuuaaguguuggcccaguuaaagauguaaggaacccauguucucuaguuaugaagaaccaagaaaccccaaauuguuagacuugccuaaaauaaauaaaaggcgagaccccacaggggugaaguguguaaaguaaauaaaggacagaccucccagguagcccuucaguucccguucaaccaguccugaggcaggaaaaggaucuguguacccugaucugccacgcacuuuucuauucugcagaauuggaucagugcguaugugaacauugauuagugagggcaggggucccacuggcugcagccaguaccuuguagagcucugagaaugcagucaggccacuuuaagguuggcuggaguuggagggagaucuuaugcuaaagucacuugugugguugauuaaaacugcccuaucauuaaguuacccacugguuugagaaaacaacaaaauauauuuuuuaaauaaccuugacauuuaaaaauuuuaucugaaaaguaaaagguguuaucaagggaggcagcauggaguagaaaagagauguugaauguggugaugagggccaggaaugaccuuggaugggccagcccuucugggcuguaguugggcuuuuuuaggauauuucuagggcaguccaguacaucccuuaguggugaucauauaugggcaugaggauguuuugaaaacucauaagcucuuuagagaagggaggugccauaugaaacgucauuaaguggagaguuguucacgaacuagguagguaguuacuuuggucuugccauagguuuuuggcuguuucugaugagcuacugauugaagaccccugggguaggggugaggccugcauucuggguccaagucuaagaguggcgacuagaaaugagcaaguuauuuaaauugccugggccuugguuucuucauauguggaaugggguaaagccugccuuccucauagggcuguuggaagaugaaaaggaggaaggaaaagcaccgugaaaauguuaacgaugguuagaaggugggcucugcuggugacagacagagccuugauaucaccuguugguuggucaccugcuuccccaaggccacgcccugcagccuucuccuugaccaucccagcccugcugauguuccuugugauuucacaauggaguacuuauauaaaauugguaacugcuuuccgggaaauugacuucccuuccccuuguccugaaaacucaggcaugggcauauuucuuggagauuuucuaguugaaucagaacuuccucuugguuugcguagauuccauuuagaccugcauuguccagugugguagccgcuuauugaguaagccacguggcuuauugaguacuugaacuguggcuuguccgaauugggacugcuuuagguguaaaauauacacuagauuuccaagacauaguauagcaaaaacucuguacaccauuucauuaauaauuacuauguugauaacauguugaaauauaacauuuuggauauauuagauuaaguaaaauguguucuuaaauuucaccugccuguuuccuuuuuauucuuuuuuuuuuuuuuugaggcggaguuucgcucucaucacccaggcuggagugcagcggcgcgaucucggcucacugcaaccuccgucuccuggguucaagcgauucucuugccucagccucccaaguagcuggaauuacaagcaugugccaccaugcccgucuaauuuuuguauuuuaacuggagacgggguuucaccaccauguuggccaggcuggucucaaacuccugaccucagaugauccgcccgccucagccucccaaaguguuaggauuacaggugugagccaccaugcccgacucuuuuuaauucuuaauguggcuacuugaaaauuuaaaauuacagauguggcuugcauucuguguugguaagcugcuuuagagcauuucuuuuaacaccaggaguucuuccccucaucaucuuuuuggcugagucgucacugcagcgcucauagccccgcauguaccucuccagccagaacccuuaggaaucauuuggggagcuccaugaagggcauugaguccaggcagaauggcuaccuugaguucaacauaagcauuaagauggccauucgaaaacauuaagcacagaagaaucccauucagguaaucuucuguuggcuggcuguagaacuacggagaacaucuggagaaacacgucaagggugugugugaaaucguugagccuacucgauuuugucgugcuguugcgcgguuuucacuuggcacuguccuuuaaacuccuucugugccgugacucugcagugucuggcagcguaguagacucuacucccucuauggacgugaucccucuguggguucucugcacacuucuguauuucucgguucuuuuuggauuuaggaguggauuuuauacauuuuugagucauuccuaaagagcgauugacccuuaaagaacuguguacagugguuuccuuucaguaagaacauaguuguguggcacccccugacauguggugugguugauucuucuuccuugucuuccaacgccacccucuuaugagucucuuccuacccccacaggugccgcuucucugucucccuucccucagucuggcuuuuaacgguggucuccugacauaguccauucaggcugcuguaacaaaaucccauacccugaguggcuuacacacaacagaaauacugcucacaguucuggaggcuggaaguccaaguucaaggugcuuaccagauuaacugucuggggagggcccacacucugguucacagaagcaccuuuucacugucuucacauguuggaaggggcgagggauuuuuuuucuggcgucuuuuuuauaagggcacuaaucccauuugugagggcuccacccucauggccuaaucaccucccagagccaucauacuggggauuagguuucaacauaagaauuuugaggggacauaaacauucagaucauagcauggcuggaguucuguccugggcucucuuuucacuuuccuuguucucaucucauccacugguaacugcauugccuccugucuccaccuaaacuuccaaguaucuccagcccagaacccuuuugaguccaggaccugucauucauauccaucccagaacccuuuugaacccaggacuugucauucauaucagaccaccacgagcauuucacuacagccucugauggucuucccuguuuccucacuuuugccuauuuuuuuucuuuucuauucccucuuaagugggccacacuuuuguuccccugguucuuaugucaggaauguggguguccuuuggacacuuccuucuccaguuggauaccaggcccuuucccucccgaauggaauggaaaugcugcuucagcuguguuccucugcuccucccccuuacagcagugacauagccucucuccugcuauuguguccuguggcuccaccgagcacuggggagcuuuucaguaugcacuuuuuuuuuuuuuggagaaagagucuuacucugucacccaggcuggagugcaguggugcgaucuuggcucauugcaaccuccgggcucccagguucaagugauucuacugccucagccuccugaguagcugggauuacaggcccgcaccaccacacccagcuaauuuuuguauuuuuaguagagacgggguuucaccauguuaaccaggcuggucucgaacucccgaccucaggcgauccaccggucuuggccucccaaugugcugggauuacaggcaugagccacugcgcccggccaucuagugugcacuuuggacugaugagcuccccuaccugaaauccuguagcaagucccuauaggauaggcaugugguacagugugaagcuccugaguggucaacagcuaccccgugacaacaugccacacuccaugugccacucccucccgccugccugcuguguccuuggccccaguggugcucucccgugcugaccagccggcacggcucaccuggccgaacucuagccuugccuuuuccucucaaggauguaaaggcucugcagauuucgggaggccugucucccagcaccugaugggacacuuuuugccccacuguaaauucuggguguauccuccacuguaugcugucaccccaagggcaagcacugcaucugcuuagugaaggauuuauuguucggaagauacauuuuccccuugagcagagaguagcguauccuggcagucuucggugagccaguuguaccaggauuaugaaaugcagauguuuacugugucauuguugcugucauugcuacugaggaguacugaccagaaucaucugcaacucuuaguuggcagagaggaccacuauggcggguagcucuuuucuuuccugccauuguggggaugauuccaggccaaagaugauggagaaguauggaaaucaucugaaagguugaagcuuggcacgugaagccauucaugacuuuguaaggcaguuuugcugaaggccaguucugcccugggagggacggaggugaauccuccugaguaccugugguuuucuuacuuccugcugaauuuaccuaagugccuguuguuugcuugcuguggaggcuuucugguauuucauuucaggugcagaugccuucacuuucccacaaaaaaaaccccaacaaaaccuaagaccuuacugcaacuaagucuccaaguacuuuuuaacccauugggaugaacagccuguggucugcucagaucacccugagugcgugugagaaggccugggcuuugccaggaaauccaggaaggcagggccgggcuguguuggaagcuggcuuagcugguggggcagccuuauuucaauuaaaagggcauugacugggagcagcaguccuggaguuuguugcauuuccuauugcccucaaaaugagaaaccaggaaaauagcagauuggagccuucgagaaggcaguaaauggcuguuuuuauugacaaaaggaaaacauuuuacugccaucucacugauggcaucucacugacuuaaaaugaaggcagguuguaguaaaaaaaaaaaagucuacauuuuuccaccgccacguucuuauauccuuguuugucagccacugcucacaagggcaguguugucuugcggaguagaggcgcucuccuucccucguuuuccucuauagguugguguggcugaccugcuagaucaaaguggaggaccuguuuaagaauguguaaauugaaggcugggcgcaguggcuaacaccuguaauccuagcauuuggggaggcugaggcaggaggaucgcuugaguccaggagcucaagacuggccugggcaacauggugagaccuuguucauauaaaaaaauuuaaauaauuagcugguuguggaggcacgugccuauagucccagcacuuugggaggcugagaugggaggauccgccugagccuggggagauggagguuacagugagccgugguugugccacugcacuucagccugggcgacauaaugaaauccugucugagaaaaaaaaaaaaagauuuuguaacuaaguuuuauggcuagcuuugagaaaggaaaauaauaauaaaaaaagaauguguaaaucaccugcuggauggggggaagaggggcacauugucuuuguagugagacuucacucaugugaugugcaguauuucaucuuaacauuuuuuuuuuaaacuuaagcuacuugugaagagcugagauguuucuguuaagcacuguguggucugcugcuggucuucugcaggccacuguuccccagacugcuaagacgaucaugacacaggcuugcauuuucagguggacucuugggaggggcuuguggacccuggaggagaaggcagccaggagaggggcaucuggcuuuguguuguugguaggaacuugucucgguugcccuggaaggccucugcucuggucagcugcucccagugugggggugaucuuuauuuagaagggggucacaugcccccaggccucauugcuaugccuuuuauagucaggcguggagcucacauucucuucugccugauugccgacgcuuguugccgagauggugaagcaguuugugugcagguucccugggaccuggcuuagcccaccucauuucuuggggcgugugccuugugccucaaagacuuugcuuuuggcuaauugucauuagugauggugucaccauccugggccuccuucagaaguuuuuaauagggaucucgucuaagagaccaaaaagcuuucagaaccacugacuuguggugauuuuugcaugccaaguauuuggaaaauaucuggagccccuucagcucucaccaguuaaaccuauuuguacaauuguucugguuucuuccugugcuugaaaagccucuuucuuuguugcguuaauaccucugucuugcuuuccucauguguaugccagugugacauucucggcagaguggggaugacguggagcgugugggcccgugguuaaucuuguccugaauugccuugcucaacuugcguguauagggugguucaaaaguuaaguuuggcugguggugaaguuggaagcaucacuuagaaacacgccuccuuugggcauauggugugaaucagggacucuggcuauaaaagguggggucucugagcaccauccugguuggaauguuccccugacuuggagguagcgagagacagccaagguguuuguuccagggaggcuggugggugggagaugggauuuuucugucuguggcacaggcaguauuaaguagagcaggcuguuuaaaucacauuuuaaguaaaaaccaaagugcacagaugaucugcagaacuucugggggauaagaagcugcuuuccucgaagaaguucaucuccaaaccagcgcccauggcucagcagccagcauggcagccccagggguacaugggacuugggcaugugaggcuggugagggacagggacagcuggguccagcagugccuuuccuagggacgguugccacgucaccugucugcccuguacuuccauuuccuuucuuugaacucggggggcuugcaucggacuaccugugccguuuccucaaacucuaaaauugaguaaguuacugaggguuuccguggucugcucugagaagauuucuugcuuccugaucugccuguguguucguguugcuuggucucucucucugucucucucucucuccucuuugauccuaguacauacaggcaagguaugcagcauuuaaaauguucauaacucaucaaauggcacacugaucaucauguauaauuugggaaucaggguuuaagaaauuuagagaucauuuauauggaagaaggaaccccaaguagaaacccaaaaucuagaccauucuggguucuaaucuguaccugccacuggcuaacauauggcuuuaagcuggauguuacaaugagagcuggaguuucgucugauugcacauagccuugcuuuucugucuuuggaaaaguagcucacuguagagcccugguaaacguuugaacugcauugcgggaguaggcagaagaacagaacaguccuuggagcuugguaggaggugugagggcuuaugggggacaguugucuuuucaagucaaggaggaauaagggcuucuggggccgguggaaagggugagucuuaggcagggaaggugaccauccagguuagaucacuucuucugcggggucagcuuggccgcuguuagguuuucaggaugucauggggcuggccaggccucaccccugauaucccugagcaucuguuccuuacaauauuguggaguccgugggggcagaagcuaccauccugugccugcccucacucucagugugacuggucuucaggauguuuagguggcuccacaugcggauguacagcuuuccccugcuuguuuuccccauggcauauuaacagcgagaucugcaagaauacaucauuuuguacagaacaggauguauuucuuuuaaacuacguuccuguguggacaagugguaucauaugcaaagguuuaaggaccguugaugccuugagauagugccaucuguuugccucagguauguggugcuaggacaaagcugccagaccucaccuuccuucagugagacaggaauaggacaguauuugaaaagcaucuaacauguuuccaagcacauagguuuuugguaaaugguggcagcugcugcuauuuuuuuuuuaaauuaaacuaucuaagaguugcauucuaagaccaucuaaaauucugagucuuaagcuguguugacuauauauguucacuaccauaacuaaaugguccuucuguauugcuuuucuaaauuguagaauuucaauuauuguaaauagcgggccauacuguaggugugguucuugcuaauuugauucguacuguucaaauucuugugucuguccagauaaacuguaucuuuacagaacauucagcgagguacauaugucuauaucggggugccaguggagucacccuagucauauguaaacucuauuuauuugguuccgaaacugaauuuauuuuguuugcaaguuugguauuugggagcauuuaagaaauauccauagauucuuguaugauacugacauuaaaucauuaaauaccauauuuuuuaaaugccucugucuguuugcauggauaacauuaaagugguuagagugggcacaguuauugguaaagauuacaaagaugugcauuuuuaugacaacuuuaggucucacauagguagccaaccaucugcuccaggaugaagcaugugccuguuuauccucuucuuugguaacgcuagguauaugugugcacacgugcacgugugcguguguguuuguguaugugcguaccacuuuauucucccacccagccucuucuccuguuuuguuuaguuucauuuuccuccucucacccccauugcaggaaacaaacacuggcucucuguccucccuuaggucuuccuuccguucaaggggaucaggugggugggaaaauguugugcaggaaugccaggccucugcccgaagccgggcuucuguuucaucucauuauugaacagaagucgcuuuuuguuucuuugccuuggucacaaacaagcgcccaguccucucuucuuucuuccugccauuuuucccagaauccaugugggaugggaacagaggcagcguauuuagggacugucgguugcuugauacccauggccuuguuuagagaagcugcacccacugccccaacguguagcugcaucugauuuguuuuugcaaguccuaaugaagggaccuggaugaaguuagugagguugccguuccugggguuaaugcagaguggcccauggagcuuagccacccuucaugcagaagguggggcugagggcagccagugugacugaggcucgcuggcccacccugagcugcuugugcccauggggccccuggggaggagggcccagcugcagugcgcauacaucugcccuuggcagcagaucugugaacccaggcugccauucuggauuuccggauagaugcaaagugcuuggacguguuuuagcagcugcugagaccaggaguugggcuuaguaguaaaaagggggaacaaaauaaaagaagaucaggagacaaagagccuacaguacaaaaaaggaaagacgaagguugauauuauuagaaauacuuccugggcagccuuacuguuugaauuaggaucacccccacccccaccucccagagguauuaguuguaaugcagagacaaauggaaacuagucagauccuuggguccuagaaaagaccagcuuuguuccuggggugguaaccuaguacaacguuuccguuccuauuucuugaccucugaauggccccuucugcuuugcuaaguagaugauauuauuaggugcuuagacuauucuucagauaggauguaaggauauauuuuuguucucuuccucagugaacuugaaaugauuggauuauuuuguaauacgucgauacuacuuuuagaagcuuuugaauaacugugucaaagaagcuuuagaagagguuuuaagcaggauugcagagaauguacugaguguguuuuuccacucacaaggaaagacagcagcugaaugcagaagugugugucugguucuaacucuuuaucacuucagggacuguccaggcagcaccauccguugggucuccugcccuuccuccucccaccccugccuuaccccuggccauucuuuugugaccaguaguccuuuaugaauggaauucugagaauguauaauuuucucagaagaaugcuucuuuagcucaccaaauauuucuuguuugcugaggggggaaaaagauccuccuuggaaaagucacugggugccaaaggugggugaugaggagagaugaacuucugggugugccuagcaaagcuguuucuguugauaggcgauuaacaaaacagccaaacuugaccuaacagacugccauuuugagaggaauuuguuuugcaggauuaauuggcuucgagguguacugguggcugugcagugaugacggcugucgugccuccugugucuucugcucauugugaugcagggcaagugcuuaggccucagacacaggcucccugaacuucguguucagugcuuuaggguggggggacuugagacccuugacuugacucggucccacuggaaagcuucuguugcuuauuuggguaaccccaacucuaucuuauugggcgguaguguuauccuaauucuuggaaauacucaguguagaauaaagagcugaugaaaauguguaagaagggaguaaguggucauuagagagaaaugguaauugggaugaugcucugaccccuucagcaaaaaauaaaaggugaaugguuuauuaugagcuaguucagauucuguuuuuggaaaugagcuugguuauacauagugcauuugaaaagcgugaagcauggacuuucagaugccagcuccucagccuccuguaacuccagucgcaaaaucccuccaguguaucuaaauaaaugcaaacucaucagugccuuaccauuauaaagcugggcuggagaggcagguggccuggagaaucaaaugacaagaaguauagggagcagcccagcuucaugaucgggggaauuugcaugaaaauuguguacacuuaagcaccauugucuauugcagaaagcacgaucuggccucuucuacugacuuuccuuccagcucugagauucaguuuugaagacaagguuguuggggaccucggauagaucuguuggccguggcuuucaguaaacacuacuagagacugaggacauguucuagacuuggaaugguaugaagcagucgaacuuuuuaggaugggcccuacccuuagggacugccuacgaaacuagaucuagaagaggaggcuguggacauuaggagguggcugcaauuggaaaguuccagagagcuuacugagggauaacggauguaggacaggaggcuggcaaagcaccucagugauagggcagaaggaaauaaagugguuagggaaggaguugagagcaggaaauucagguaggauugauguuaagucuuagaucuuugaagugacuuucucuggucuggcuuuugcuguuaccaaagugaauuauucauaagugcauaugagaaaugcugauguaacucgauuauguggaaugaauuuaaauucauuuaagucauucuuuuccacuaaaguaagcuuucccucauccagaaucugagcagcccgauagccaagcaggaguuuccuugugccauggccagugauugaugucuucuucuaugaugcugcugaaaugcuggggacucugaagcgcagcuggagugaucaaagcaaaauuaaaauacuuucucagugguuugggaguugggugcguucugcuguauuuuuugguuuucggcaucuggguuuggugugcaugcauggugagcucuagcuggagcagacguuaccuacugaggcuacgcucuucgugguuucuccuuaaccaucacccacuugaucuuccaugaagccccccaaaucuuccuuacugaggacucuugcuuccagguugcuuuugugcucauccauugcuggguuauuuggucagugaugaugguuucucuguacuuuuuaucaguagguucagaggaccuuguuuacuccucauucaucucucuccccaaacaguugagaaaccacuuguggguuaggacucaugcuuuguuuauaauguuugauucuccaaccucacagcuaaugggaagcccguggaggagauacucuguaaaaauccaucucccaugugggcuugaccccacuuagugucugagugguuugguccucauaguucucuugggggaggaggaagggaaggaggaggagguggcgauggcaguggcagcagugguggcaucuuggaccagagugagaaaucuuggaccagagacaaaagaggucuucucucaggguagugcaccaugagagggagcaccuguuuacauuuuguauccuggacaccaaucuugccuugcucuggugcuggcccugagaggugcaggaauuuuauaaagagauuuacaaaacauuuuuggaugaccaaauuggucccugguucuagcuggaaugaauaaacaaacuaaauaacaguagagugugagaguaagugugugugcuagagaaugugugcacauguauggccuaggugaguucuucacuuugcugacuugugaauuauuugggguccuaugguccuccccaucauucuuauucaugucaguccaccaucauuaaggaaguggaagcgaacacauuguguacauaucacucccauagagagggagacuggggaagagguuugaguuauaagucgcaccuagguuaggucuggaugugucuuugcagguuuccuugcuaguuccuuggccagaguuuccaucgugucccucagcugcacaauuaaggugcccccguuuugugcaagucucaugcuaggcaguaugagaugacacaaacuaggauucuguugugagauaagauaaaaacacuugacauuuaaaagagagagacaacuuaugcggugugacgagacacucuacgacuuuugccagaagagaaauagaggcaacaagugcuaggagcucagaggaggguaaguuccacauuuggaacuuuggauuaaaagaauauuugggucugguugaaaucgaggccuuucaugagaaauguccacacuugcucaguacuguuugccgaacacuguauacaaggcccucgacucgugaaugaguuguaaugcaaaacuuugccaggcauuuggaauguggaguauacuauuuuguaaagaugaggucugaauggugguuuaggucccaggccagugucccucugccccccaccuccauaugugcccucaagccgguuuggcuuagacauuauuuaucucugacuacuguguacagcuuaguuccauggggaggaaaaggcuugaugaacccuacccuggaaggcugguggcucuguuuucugauggaugagguaggagugguggaaagcugguaguuucuacuuugugccuguuuaaaaagcccccucugaggccuuagcacuuaacagauguucaggauugggggaauaaaggagcugccuuugcagaggucugugggcaugcagugggugagagagcaggcacugagugccccgaguuuccugccugugugggcaggaggauucucaguggaaucaggagcaucuccgccuggugcuggaggagguguggaguugaaggugggauucuuccucuugaaggacuugaaugaguuucuguguggcugaacagaaacugguucaacacccaugucaugauuuuugugaagcgaggacuuggggucccaagucuagguuuuagguucccugcuguaacccguggccaccgagagagaguuuuaugauaaaaugucagcaaaguaccugacaacgucucacgcuagaaugaguuucguacauguuuaguucccucucuuuuuauuccacgcucccccaccccaacuuuaaaucagaaacgugagggugcugauugaagcuuuuuauaacuuuucuuauugagaauuguucucuggaguugucuccaagaacaaaggaauuccagacguucuucuucucuccuugucucuucuguccuccagucaaagaaaaacucugcauaugaucuuuggccuggagaaauauuaaaucuauguuaaguaugcagacaugaaugggcaaaugaaggauuuguggcaaagaagaucugccgaaacaaauaagucauguaaaugggcagagggaaauauuaaauugauugcaucuuucagcuccugguacuuaaugcaaagauaaaguagugggaaaagguugucauuugaaauaauggaaagaugagggaguuuugaagcuagcugggauuuuucugccuguuaauagagugacuuggauuacagacuauaaagauaaagaguagggccguugcauuuaguauggaucaugaugcugauugcugucugagcaaccucuguacuaagggaggagaagcuaacauccccgggccuggaagauacuggauacuagcucauuaaacucuugugagaagccuucauuagcauuaugggaagacuugcuguaucuauauuaugaaggcauuuagauuuuuuuuuaaaugcauguucuuaacauuuuuuguuuauuaaguggggcaguagauuaggacugaauggauuugauucucucauccuacauagugugcccagaagccagaagguuucccagaauuuguauuauggcagcgagggcaaauuuaauuagcagauaggaaaagcuuuggagcaguuuaggccaauccauuuaauuguaucagcaauuaauauuuugagaaaauggaaauaauuaaauuuacauuucuucuaggacuuuauuuuguuauccuuuaagguuauuguaaaugaggagacuuuugaacucacagacuaaagcaaacuacaccagauaaucauuaacuuuuucuauugugugccacccuucccaaccagauuguuccauaguaucacuuaugaaccaagaaccugugagcuugcaaaacgcauuuuuaaggagucucaacuuuucugauuuguguuaaaguuuaggugugggucccagaaaugaguuucauggaggggagagguugucucucuggguggguaauacaggggccacugggggcucacuguggcuuucuggcacagacauuuaugaagcaggggugacuaaagugggagagagcagccaguucuccagcagccccagugagagcucucauggaucugccuauugcacugggguaggagccaucaccgucagcuuuucucuggcccacagugccauuuucugauuaagcugagaccucuguaauagacacguugucauuuuuucuugugucuaaaaguuugcuugacugcagugggucuccagcucagagcaggucuggcuagagaaaacaggaggugaugacuggagcacuuugcccuuauggaacgugcucugauguagaaagcaagaggauuuuccuugcagucacugaagguaccuuguguacacagaaagaagacagagggagccccggaugccucgguaucccucagagccggauccuucagaccugugcaguaccuguggauuugguuagucgaugaugcgcugccauuaaaacaaaggcaucggcccuggaauagagaaguucagugagaaccucuguacuccaugggcauuuucuaggaaauaauuucaccugcccuguguaauucucuggaagaaucacagugaguuggaaggaaacuuaagacuuggaaaaggauugagagguuagcccagaccacaccagggcucugaaggcccagcugggguuagaaccugggacacccuccagcccacugucuccuguucccuggccauuuacugccccacuccccuuucuacucucaggggcccuggaucuaaugaggggauucgugcaguuugcugcacuaauacauugcaaguggugccaaccuaaagguauucugaugguggaaucagagcaguagcaucuuauuaggucagaaucuguaucuccucuuccaagauuuuuacaugauuuaguguuuucugaauuggaaaaaaacaaaaacaaaaacacacaaaaaaaccaugucuaaauccuagcauuucaucccauguugaugaaagggcaucuuuuuuuuccccuaaucugugguuagaacucucagaaacuuuuagaagaucccuccuauguuuuggagguuugcagauuugaaccccaguuccucccacagugcuucuccaacuccuggaaugagguaaaccuccaggcagccuguugacccaacccaugcaugccggucuuugggacuccuagauguggacccuggagugaauagggaucaggugggaaaugaguuccuuugaucaagauccuuguaccagugaacugaccccacuccccgucuggauuccuguggugauuacccucuguauuagucuguuuucaugcugcugauaaagacguacccaagacugugaagaaaaagagguuuuaauuggacuuacaauuccacauggcuggggaggccucagaaucauggcaggaggcaaaagguacuucuuacaugguggcagcaagagaaaauguggaagaagcaaaaguggaaacccugauaaacccaucagaucucgucagacuuauucacuaucaugagaauagcacgggaaagaccagcccucaugauucaauuaccucaccuggguccuucccauaacacaugaaaauucugggagacacaauucaaguugagauuugggcggggacacagccaaaucauaucacccucuuagcaaggacuguguucgugaucaugacuggcauucacugaacaaugacuaggugccaggcaccucgccaguauucuuuaaucuuugcacagucuguaggguggauauggauauuacuguuccauuuuuuguggaagaggaaauggaggcaagagaccugauuauaacuugugcaaggugccaugcagcuaagcagccagcccaaauccagaccugcuuuccuaugauuuuccugcccauuacucucccaucguagcucaccuaauacuuccuagugggcugcugcugaacacacacccagggaugacuuaguggcuugucuugcucugaagaaggcuaggcaccauguuggaugaguucuugaagaugucuugcucuagucaagaaacuuuuaaaucuuuggaguuuuuguccacaucugccuaguucuuaguaaacaugauguggguucuauuagcauggcgcccucccucccuuccuaccaccuuuauaugagcggagaacaucuaugacucuuaugagaaaggaaagaugaaaaucagagugacauaguauaguuaaauugcagaugcuuaauuauaaaacagcuuguuucugaauuuuaauuccuugcuuuucucugacuuuuuaaauuccccuccuuaggcagaauucauuuuuacauugaugauuuuuuuuuuuuuuuuuuuuuuuugagauagagucuugcucuugucaccccggcuggagugcaauggugugaucuuggcucacugcaacuuccgccucccggguucaggcaauucuccugccucagccuccugaguagcugggauuacaggcaucugucaccaugcccggcuaauuuuuuguauuuuuaguagagaugggguuucaccauguuggccaggcaggucucgaacuccugaccucaggugauccacccaccuuggccucccaaagugcugggauucuaggugugagccgccacaccuggccugaugaauuauuuucauguguggaacaaaacuuugaugcugaucagugauuagguaccuuuguuugguucauuuuuaacuaaggagauuucuuucuuuuuaaaaccauucuuuaaucuuguaaaaauaucauuuaauggguggauguuuuagcugugaugaaugacagguugucguaaaggaagaaagguaugugguuuccaguaaacuuuuaauucuuuugcaaaauaaaaauaacagucguacagagaguaaaauauaugaagagucaggaagugauuuaucaaaaucagaucuuggacugcugguuuuaccaugaauuaggcucuuggaaagugauugggccaguguagguuuacauuuuuuuuuucuuguuuuauuugucaaagcaaacuugugguugccugcccguaguuuaauucugccuccuuugggcaaacaaccgacuuuuacugggagucuuucucagggagauaaaggugcacccugaaacucugcucucugauuccucagcaaagucaguccugaguauggggcuugggugucucugcaaggccuugcaagugagaugggcugucaccugagcucagguggggcugcuccugccuuggacagccuccccagcuucuccugcauuauacccaggggcuggagggcagagagcaggucuucuucugcuggucggggcagucacaggcuuuccucucggccugcuuguccuccggguggguccagcacccgcugggauuccugugggcuuagucacuguguggcggcggcagaaggacuggggaaaccgccggccggcccuggugcgcugucaccccgaaggaaugcgggccaggccggggcugcugggccuggaaaguucuccagucccuguugcagaucuggccugccgacucaaaguaaaucucucuuccccuuuauuucccaucaaauaaaaaaggaacacgagguagccacuguacucacugaagaugcauuguuuuuuuuuuuuuuuuuuuuuuaagcgagcagcagcaagauuuauugugaagagugaaagaacaaagcuuccacagcauggaaagggacccaagcggguugcccugaagaugcauuuuuuaacuugcuuuuuaacuaaguauuuuugcucugagcuuuccuggaucuguaaacacacccccagcuauucaagaugggcuucuuggugaaaagugauguguccuaggagaaaucacgccuguuguugccgcuggccaucacagaucccggugccugucugugaaaggcuggccgggcuggguggggaugagaauggucggguugucuagacucagccuggacugucuuugacuggaggggccugagcuccuccuccacugcucaagaccccgguuaaggggacagcagagcagggaugagaaguggcccucuucacaucaccucccagcaagagggccugacuuagugcucccaccauugccagccccaguuucagggucccacucaguuguauuugaauaggucucaugacaugugcuuugcuugaagagcggcuauuagcagcagacguucaagaggcugagcucaagcaggugagcauguucugagccauugugaacccagugaggugccuaugcugaugcccagggccgccugggcggggucaggcccccaucgcuucuucauccuagcucugggagugcauucugcacucucccgaggccagcugguggccuuuggugaucacccucucuguaaguuuuuaaguggcuuccuuuccucugguggagaagccagcaccuuuauccuaugacaagaaagcucuuuguaguaggugguaguagaaucagacagaucuggcuuaaaaucuuggcugugcuaccucuuggcucugcacauuggugaagagaauuuaccuuccuaaggccucucagcuacacgacuguggacacucagcuuccuucuaaggucguugugagagguaaagaaaagggguuaguccagggccagacauggcacaaugccucaaugaaauauuagcugauacuaucauaauuuuuaaauucccauaggacucacuguuaaaggauuacaaggcugacacaaaaaauacugcauuuugaauuugugucugauuuauacauuuccaaagaguggaauucucacuacaacagcuguucuuugaaagguuagaucuuuguucugagauaaauuaaguggaaaaagguguagagcauuauauguacucugauucuucagggcuuaauuuaaaaagagcauguuugcuggugaaugcugguucaaucauuaagaaguuuuugagaaggaaucccagaaaguaauaagcacuuauuuuucauggaaaggaaccggaagugcuuggugaccuccacagguaaucuuguauuauuuuugcacuguuuggaauuuuuuaaccaugugcuuuuauuucuucuauucuuuucaaaggucaguagguguuaucuggacaauaggguucuggucuguuuucuguuuucuucauuguacugugcauuaagaaaaacccuaaugugcuuuuuuuuuuuuuuaagugaaccuuuccacaucucauuguccuucagugagagcaggcuguguguguggucuuggugaacugucccguucccuggagacaguaucugggggccucccugcccuucccaguaagagcugggccuucacaggaauagaggccuaggauucgccuucauccucuugaagagcccuaacaguagguccuggcuggggucuggcauagaaugcccuuggcacgaugugugugagugugucuuuccuuaguaaauggccuugaaaaugccaugugcuucuggcaggccuggauaagguuugcccugcauaacccuuggaaagcacaguucucacuuguaacacccugucugcagguccaugauauuguaauuaaaaaguuaugggaucacaagggccuauuuaaagggcaucuggucuaaaggcacaguuaaaagcagaauuugugucaguggcucccuuaauuucucaaauaugguucuguuucuaaauucaucccacuggaugucuguguugaguuuucuguugaugaaagaauguuuaaaaaugaggcagauccaaauucuaaugucugaguguaccacugcuuaauuacuuugggcaggucaccucaccucucuuggaaagaaaggugauauacuacaucugugauuuucaauuuuuuuuuuuuuaacuagacccacaguaaaacauagauauacaccaugaucccaggacagaauaaguauauaacuaaaauaaguguuuugaaaucacuucuugucugacacagcacucacgcuuucuauucauguaguaccacgauacuuucuucuauucuaaugcugguaagagaugccuuaaacugauuuugagaacuaccaauggguagcagcuagcggcuuaaaaaggauguuauuaagguccuuuucacccugauuuugacucuguuggcucucagcugagugccccauacuuagugcacauagaguuggccucugaggucagccuccuguuuuccugugaaaaugaggauggaagagagucacuuguuucccuccuucauggcuacccccugaggacugggaagaauuuaagaauuugaguauauguucccaauagcaugauguguuucauuguucaucuguaagcauuuuuaaauauucgagaucuguaucuuggguaauuuuuaucaacuuuuuauuuguaaaauaauuucaagucaguuauuaaaguaacaaaaauaauggcaaacuugauaccuucccguauuuuuuuuucauauuuuuccuugaaugcuuacagaaauauuaaagaauauuaucacaucauuguagucaccgaugaauuauuuucugguggcuuaugauuagaagagcuugacucggaguggaaacagauaacauuugagugcucuuucuguuaauucauccuugucaauaaccccauuagcuaacuuccagcaaggcuguguuaggaauguggaaucaauuagaugaauuuugaaaauaacuuggucuguucuaaaaggcccuaugagauccaaacuguuguggccuggugccugguaacuuugauggccauuuugaaauguuaccguagugauaauucuucuggaaucucaagucauuaaaagugauauggcuaacucugggcccugugcuauaaaaauagaugucaugggaugugugaauccuuucuucaguguuauaguuaauagcaacugaaggaacguuuuggucaaaucccgaauacuuauuaggggcucacugcuuggcugcauuuuucuccucugcguaaaucaucuauccauguaauuauuaaccccuaagaaugaauagcauuuuuaaaaggguuccauuuuccccucauaugacuuugguucauucuccuccuuguuucugucucucagugaacuuuccaaaagauggguuaugaugaaaggugaaucgucguugauaacugcucuuacuuaucuguguaucgaaacugcagguagugcucuucagcucuguggcuggauuuagugccucuucuagggagggguggguguuggcacaaagcguaucccauuucccugaaugucguguggacacgugagaggacagugcacccuuugggcuuggugcugcccccuucacgcuacugaaccccagggucauaauuaaaagcuguguuagcucuucucugguuagaggcauacagguuggaggcuuguacauagccgugagccgguuggucuaggccaggaagcaaaccauuggaaaaugugguuagcagugacaguugacagcauguuugccugcaguaguggugguuggugcugcguguugacuggaguugcuugcauugggagagccugacuuggccaaguguguagcuugagaccaguuggauuccucucagagagacagucuucacccccaagcucuggguguugggcgugcagcauucguauucagcaaacauuugcugauuuccgccucugcaacuacugagcucagcuuuggggaucugaagaugaauagacacagccacacuucuggggaaaucucccuguggggaggcugacauggaaaccaaccaaaugggaguguggugcauaucuuauuagagcuuugugcaaagugccacaggaagcaggagaagggguagauugguguggagggggcaggggaagacuugccuaggagcagggccucgcaggaugcagaggaguuugccaaguaccagagauugugggguaggugaauaaaggcugaguauaaggauaagucaauucaggcagauguccucuaagaaugaaggugagaaugcuggcggaaaccaguuguggcccugucugccuucccuaggagacuggaccugacuuuacaggcagugacggugaagcagggcagugccacgagcagaucuguguuuccugaagggucucuggcagcugucuggggaaggagggaagcuggcagagccguggguggaggcagaugccauugcuauggagugagcauggggaagggggucggaggccuuuuggagauagauacagcaagacuuggugaaggaugaaguuggggcagguagaggaaaagcaaugagcuuacggaugacuggagacugacuggagaagaugaccacccuugccauuaacuaggauaggaaacaacaaaggguaggaguuugacaggggagaauguuugugcuguugaguuguugaguuuaggugcuuguggcacgagcaaggggagugagcuggucuaggagguuuuuggaaacacugaccuggcugcagagagggagauccugggacaccuguuuugggaguuaucccaguggggaaggaucacugggaagggggccaccccuuugggaggggucagugggacgacucccaagggaagagguugguuauagggaguuaaaagaaaggagcaccccucacgcgagcccauuuuucaaggauacauguuugucuuuuagauucuauaaggaguagcugcuacacagaaagaugucuacgugugggugaacaccuggcguaucccaugcagggaggcuucagcagaccuugguggcgauggaaccaccacagugauccgaggauugggucugaaggcuccuccgagucuccaauaaaagggguuguuuugaagggcucagguucuuccugggcuuuuuugggacagucuugcucuguugcccaggcuggagugcaguagaggcaaucauggcuuauugcagccucagccuccugccucugggcucaagugauccuucugccucagccuccugcgugguugggacuauaggugcauacccccaugccuggcuaauuuuuaauagagauggggucuugggcucaaguuauccucccaccucagucucccaaagcgcuaggauuacagacaugagccacuguaccuggcugagaagguuuuuuuuuuuucccccuuccaaacccccaugugguccagacgaggccagaggaucucaggggaauucccucuccgaggagccuccacugcuauugcauggcccccagcauagucauuugagugaagagcccuccaaaaucauuaagcugauuuguagaaucaguuugcugucugacuaccugaugaagaugagaagugguagaccuccccccacuguaaggucuuaacaagaucuagguggaacaugggacuguuugcaagcuacuucuguuucugaaaucacaugcuugggaucccaaauaaucuacugaaagcugucuucgggaggcaaagcccagggauuuguuuuguuugccccuaaucaucucuuccauccccuuucucaaaagucuuauaucuagauaauuuaguacauuugaucuacuaacagccagggccauaacaggagcugauauuacauaccccggaaguccuuugcaaacacacuguaguggcgauugauuaguguuccgagccauagguaacauuagccugccucguaggacccucagaugcugaccguaucugcugcaauucuuagauguaaaagagcgcgcaucguauaaaucaaaacuagaugauuauuuucauuugaaauuguuguugcacuguaauuucucaggguuuuguauuuuccaacaguggugucacuuaaugggaagaucgcucaggcuuuguaacugggcauaauaccagguauucucguuuaggcauucugcucaguaguauuaaccugaagccauaggacaugccaauguuuuuuuccguguuuuuuaaaaaaauuaaaaugguuggcuacaaaugcauccuuuuuuacuucagaguaagucggccuugguuaagucuuaauauuucucaugccuauuuuuuuuucuucaaaugaaaacauacggagagaaaauagcauguuuaugccuuuugguuguacccagcacugcccagaauggcuuacagaguuuauacccauggagguuucguaaaggugacauuaacuucgcaguaaagucacugaccccgaaccugugucacuucaggcuuagccaaaugcuaacagagcagcucaaagcuuaagcagagguaugugcuugcuaaguaaguguguguuuuggacuaauuggugacuaccauucugaacauuaacugcccuuuguguuuuaauguugccaggaggccgauuguguaaccuuuggaggcuucccugaguuuggagaacugaauucauguggugacuuccuauuuauaaugucuuugggggagcuaugaaauaacuuuucuucuaagugugauuuuugcuuuuuuaaaaguuuuuauguuguugucaauuggguauuucccuucuaugccaagacgaauuguagguucagguuucuaugcagccuguauguaaacacuggcccuaaagaaggacucuaucacucuacuuucaguuucuugcauuaaaacaaguauggguagcgguauccuucuuauuucugcuuccugguccugugugagacccugaaagguccuaauggcagugcugauuagauuguggccaggguucacccacaaguuccgaagcuggggaagguggaagugcuguuaacugacuugucccaugucugggguuuugcagccuggggagaggugaccaccccucguuucaguccagguaggguuuuaugucccugucaaaaauguguugugugaaguaccuugacuuucauuucccagggaagaaagcccguuucaauuggcucaagcggaaaagagcacuguggguccacuuaauggaagagucuaagaguggcuucaggaaguccacugggggcuccccgugacucugcccaccugcauauugucuucauucuaaggauccaggugguagcaaaaggguuguuacaacuuuaacccugcauccccaccuucagguucaguacccaagggugagcaaucuguuccaguggcacagaccuguuucaagaggucucuagccgugauagugcuaggccacugcccuccaccaguguguuccagagaaagaugcucugaugugccagcccaggccaugagguucccggccucaguaaggaagaaggaggacaagguggucccuuaggagaaaauguggauauucaagaaagagggucgcaaaauagcaaacacccacuauggcugggcaguacaggguugcagaaauauauuuugaugugugaucgcauuggagcuacuucaaagagcaaacacaccacuuugauuuauuucucuuagugauacaguauuuagagagggagauacuuuuuaucuucgugggauacuuacaguggugcucuagaagccauguacugcuucuggcuucuccuuccuuuccuccaaggcuccuccugccuccucccaaagcucugugcccugaaagagccuugagccauugcucagaugucaaaauuguauuaagcagacacaucaaauuaaaacuuuugggaucacucaccaauaugguuuccuguacaguacugcccugaggggggauuacaaguaguuaugcauccauuucauugauguaucauuuuuauuaaaaagaaaaacaauccaaccaagagaggaaguguagccagcugccuaaagaguggcgaugaugggagaugauauuuugauuacauuaauccauauccuguuaguucacuuugcuucugucgcugcugcuggugaaguuacuaaugugaacuaauuacauuugcucugaaaagccagaauuuuuaaugcaucucagcaagaaagguuaauauuaucaauuuaacagcaugaaugaaacauuguguguauugaacuugaacuguccuaaaagcuuggauaauaaaaacccaguggcuucuuuuauaacucacuggauaaacaguuauuggugagacauggauaaggcuuucuucucuuucaguuuuauggggggugguaggcagucagcauuagaugcugucuguuuacagggugauaucguaacuucgugaaauuggaggccacauuuaaaaaggcacuccuuccuuuuaaaagcuuugcaagggggcugcauauauuuuccuaauuagugggaauauuuucuuuuuucuuuuuucuuuuuuuuuuuugagacagaguuucacuuuauuguccaggcuggaguggaguggcaugaucucggcuuacugcaaccucugccucccggguucaagcaauucucaugccucggccuccugauuagcugggauuacaggcaucugccaccucaccuggcugauuuuuuguauuuuaguagagacgacguuucaccauguugcccaggcuggucuugaacucuuaagcucaggcaauccgccuaucucgggcucccaaagugcuaggauuacaggcgugagccaccgagccuggcuggugggaguauuuucaaagagaacaacaauucaccacaccccaacaugguaacagucuuuuuguuuuagaagcaucugugaauugccaagacucguagaacuaagauguauucaaagucagucgauuuucuggaaacgacccagucccugaagauagucuuuuggggaguugaguguuuugagagggacacccccucuacagggacuuaaaauggaauggcuuuuugugugugcacaugguaccugcagugauuucuuguguuuaauuacuuccugcacucaucugacuuacacagugguaaacaaugaggaugggaacaggcggcagcugcucugugccauccaccgucuugggaaccccagcguggcauucucucuggggcagcauguugaaguguuuggcuggugacauuuuggugaccaguuggcuccucauugucuuucaauguggagauuaggaaccgagcgaggauuuggaacccuugcguuuguucugccaagaacaugacuugccucuggccugagagcaguggaguaagcugauaggagcuagaaauacuguuuuggguaggacuuacccaaaagagugggcugagucacagaacucccaaguuugagcccugucaaauaaauucugaauuguucucagguauguuucucaauuggaauuuuuuuaaaaauuuaauuuaaaaaagacuucgaaaaguuaccuuguucucauuuuucuucucccucuuugccccguccccacaauaucuuagggcgaagaaaagcagguuugagaaaagcuuuuuuucaucauguauuuguaauagcuggagccugcugagaugaugagguagaguggagggagaaagagaccuugaggagguguggagggggaagggguggaaaguucugucgucuucugugccucucucucucucuugcucagggucuccagucagcccucuggguuugugcccuucgugcugcacugacaggucaaagccgacucaggccuuugaugucugcucuaggagcaaaagugauuccuggucccgcagccguucccacugccuuguguaugaaggucugcugcucugagguggaugguggcucuaggcaggcuguuuccgcugggugcgguuguugcugcagguuuuucuauauagcuuggucaugcuccuguaucuagauuaaaauccuaugacagaugggccugcuuauaucuaaacuuauucagagagucuuaugauaggcaacagguuacccuuuaccgggguaaaacaugguuuauucuacaguuuggucccguuguaaggccaggagauagagucucacuaguuugccccggcugaacucaaacugcuggacucaagggauccuuccgacucagccucccaauuagcugggacuguuggugucaggcacacaccaccuugccuagcuugaagaucuuucuucuaaaugagcgggcuuuaaagugaucagugggaccugggcagguuggcucuugccuauaauccaagugcuuugagagaccgagacaggaacaucacuugagcccaggaguucgaggcuaaagugagcugugagcacaccagugcaccccagccugggcaacagagugagacucugccccaaagcaagauaaaauuaucccacaggauuuuaguccugacuuguguauuacuaugcaguugugucugucugaggcucagauucccccccauuuaggauuuguguggcuaaaucucagaucucauuuucaggugaauuucucuauuaagguuauaaaagaccaaaauaacuggaaauucaacucuguacuugaauacuugguaaugcccagcauucucuugacuaucccauuucacaguuugccggucauuuccccaguguacucacuggauucuucccgcagccaugaaagguagguauaauuaacuccaguuuacauucaggacaauagaauguucgucaaaaugcuuuugcacauguuuucucacccugaguggcuacacuuguacagucauacccuccaaacucuaagauguauacucuuacauaccaaaacacaaagaaacaacaggaagaacaaaacucaagaggucugagugacaucuugccuugcuucacaacuucagaguuugcauugcuuuaaaaacauugguuauaagugaguguggaaacaguguguucacuauuuuuaugcuguggcugugcugugcaggagcugggcuuuucgugcauuuuagacagaauugaccuugguuaaugcuugacuugggaacuaugcagaaacauccaggaaguggugguggcugauccugaccguccucaguuuugugaagcaacagccucugugccucuuucucugcaugcucuguugacggucuagucuugagagagaaccugcugcugucccgucugucauagccuuccuagcaacucuuaggccugcgugcuguguuuucaugaucucccccaaagcggcacuuugauguuuuuucagagucaaaguaucacuguggauauuuaucccaaacaaaauugcaaacugaucaaauguuaugucuuuugauaccaaaucaaaaacgauucuugguggcugaucagguugucuccuaaaaauuugccuuuugaaccuauacugccuuuaugagaugauuaugaaaguagaaaauagccugugaaaaaugguaccuuugcuaaaaagaaaaaaaaauuuuuuugaaacuaagagucucuguuguccaggcuggagugcaguggcacuaucuuggcucacugcaaccucugccucccagguucaagucucccgaguagcuggaacugcaggugcacgccaccacauguggcuaauuuucauauuuuuaguagagaugggguuucaccauguugcccaggcuguucucgaauuccugagcucaagcagucugcccaccuuggcuuccgaaggggcugggauuacaggccugagccaccgcgccuggccugcuguaagaaaauauuaaacuuaggaugggaaaugugaucugaacaggauuccugugaagguacccaguguaggucuuagucuccucuccaguguacauuuauggaggggcaagauuucaccauucugugaagaacucugcguguugacgacugcucacgccuagggaauaaauuucagagcaugcguagauagugccauuuucuacuuaaaauacuauaauccauuauuuacuucggaaaauaaaagcauuaaggcugaaaguuuuggguuaguaaucuugauguuuuaaaaugccuuagcauuccuucauuuguuuugcuugccacgugguuuugcucugauuuacacaccucugugcauggcuaauccacugugccacucuuggggcuuuauuaacucuucucugccaguuuuucccuuagagaauaucauggccauucucuaagaugauaaaugggacuaagaguaaaugcaggcugaaaaagcauuuaacaggucaaggaucugaagcuuuuaagaaggcaaaacaauaaauaagaaacccaaacagagucuugaagcacacccaucgaaacccaaguuucagaauuugcugcagccuugcugccaaaucacaguaaaagcugaaaaggcuuuugugguuaguuacgugugauacaagaaaucgaugugucugagagaaguaggauuucucuuuuugagggggaaaaauacagcaaggggaaauguuuuauuaacaauaaauaugcggcuuaccauaucuguagggcacagauuugguuaguaguauuuuggaggcaggauaaaggaagauccuaaaaucucugugcuguguagcuuccauucgagcugcacauguuaaaaacauucuaggauccacacaguuuaaacaagguggcuggcuuaggaaaugcuucuccccauuccuuggcauccccacaacccuauuccccuacuuucucuuauguaucuggacuggcuuuuaaaagauauuuagugaaauuuaauuuucuagggaaacuccacuuugucaaaaguguaguauuccucaaggauagcuuugcuggucggcaaaucucaguugaguguauuugugguuuaaaaaaaauucuuucugaauagaaauacaaagagugauaauguuuaacauuuuauuuuuuuaaaaagcuuuacgcuguguaaauuguggguugacuucauguuucuaaacuuugucuuuuagaaugacucucuuggguaaauuauuagcagacacucucguguugacauguccauuuuccuuuccauuaagcugucuccauugcaguucuguugauauggcuuuauauaguuuuccugagcuuuuuuuuuuuuuuuuuuuuuuuuuugguaacaagauaccuaugcaagcugaaaaacucuuggcuuuuuaguuuguaucacuuccagaaacuuuuagaugcuacguauagaaguggcuuucuuuuaggguuagguaagauacuuccuuuuuuggaaauaguuuugccauuuggucucgcugccugauuugugcuuuuucuucuucagcagguagugggaggcuguguauuguauugccuuuuaccagacacccagaggggucauguuggaaaauagcauccucuuagcaaaaacacaaucccuucucugagaauaaauugccaagucuuuccaggucauugauggacucucaggugcugcauuucugcacgucggggaacaagggugaagaacagagcuaguccagcacugcuccguccucccgcauuucuucuucuguagagucuuuugcaaacuagagagucuugcagagaguuguuggguuuucccaggagauacuguaugcaaagaauugucaugaagacauaaaaucaagucuugguguaaaacuuuuaauaaauuuaaaggcaugucucuguuuuucuccuccuccauggggauuuucaugugguuaguaauaaaacuguaggcaguuguaugucuagauuucuauguaauuuguuuguguucguauaugcacaccuguauacaugugcacauguauucaagaaagaccugcaguaugcuugaaaggauugaggugccuaguuugugguaguagcugaacagagugggaggucaaaguuaagucauugugaggcaagggaacuugacuuagcccuuuaagaauuggucugucccugcuaagccaaggcuauuaguguuuucuucccuagcuguguucugaaaugguucaccugacauucagcuggguugggggagaaccucuuuaaacaucagaucuuauuccggaggaguguauccagccuucucacagcauauccuguuaaauaucuguucaagguuagccuaggccuggaguauggacagcaugaagccagaucuaaaacagaucaguucauggauaaaugaugaauuuaauaaaauuugaaaauaaaccccacauaacuagugcugcuauugaucauucauauagccagcaggaguggugagaggcuuggucugccugagguguggagaugcuugugguggggggcaagguggacgagggcuggggcugcuccuggagcaucuuuacgcggguggaggagcucugacacaguggcaguguuuguaacacuuuccaaagggauuaaaauaauucuguagaguuaacccuaggcuaguguggcuugaucugaaacagucccagccagaagguaagaacuccuguguuauguuguuagcauacaauuugcugaaguucacauuuuaaauuuuauauuuaaaaaccaaaaaguaguacugaucauuuuggacuguuucaaagugauauuguuuuuacuuguuacaaacauuggcuugccugcaucuaauugcacucacaaugggccggaugugguggcuuacaccuguaauccuagcacuuugggaggcugaggcggguggaucaccugaggucagaaguuugacaccaacauggugaaaccccgucucuacuaaaaauacaagaauuagccaggcuugguggugggugccuguaaucccagcuucucgggaggcugagacaggagaaucacuugaaccugggaggaggagguugcagugagccaagauugugucauugcacuccagcgagugcaguguaaaucccuuaaggaaacaguguguugugguaaucaugauaucauaguaaauagguuuuguucguuauuuuuuucuuuuacuuccuuuucuaccagugacuaguccuaauguguucuaacuuuugaaaauaaaguacaaauuagauggauuuaaacauacgggaaguaagacggaaauucauuacuuuuaaaaaacaauuuguuguggauaagauuuagaaauggaaacacaauaaacuguguuuccaugacacagguauacuaccaaguucuuacaauguaccuuugagguaacgaauuuucaugucauuuggaguagggcugggccagugagucacucaucuccuuguucauucauuacgugaauaccuaguaaaugcccacuaggcacccuggagucauuuguguagaguggcaucucuauacaacuguucgacuaacugucggagacacccuaaucaccccagccacaaacaaauagaacauuguaugugugcugaaucccacaaaggccagacaugaugccaugagaccaagaaggaaaagaaauaauguggaaaggguuugggguggaaagguggggaaccuggaggcgggccacauggggccccagaagccauguugaggguuuugucuucaccaaaggaucagugggagauuaguguagaacauuaaacagaggugggguaugugucauauuuccauuaaaaaauucauccuggccacaguguaaagaauagauuagggaggaagccaaucaggaagcaauuggaguaggcaaugcaaaaggcaaagugaacuuggacuagugguggagauaaguugacugcagagagaguaggaaguaaaauuggccaggccuguguugggggugggcuugugagcaggauaucaaagauaauguccaggauucuggcuuggaugacaacuauggcaaugcccauuacugagcuaggagaugcuggaggaagaucagguggggacugugagcaugaguuugauuuuugcagauacuggguuugagacacuucugagucaagcaggcauuuggaaauguggacuggugccgagaaggaauucccagcagugacuugguuuaggugguccuggaaaguagaaacacacaugagauaauucuggggauggagcuuaaagggacgucagcguucaagggccagguagaggaucaugagcuguaaagggacccagguggcuccagcacagcgaggaaagcaugcgagugugauggccaggcuuccagggagagaggaggguuuuaaggagaacaacgugcuaaaagccacuaagaagccaagcagagugagaaaugaagaccuccacugggucuugcaagaggggaggccuuugaggaccucaccugagagcugaugaaugaagugauggcuggaagcagcucuggagagggaggaauacuguggggaggggaggaacugaagaaguagagaagcauggcugugcacaggggaggugggauggcagccagggaggagcagagguggaauguggaucuuguuuuccccaacagagauagaggggggcuaaaaguccauggaagggacucugcugagagggaaggguggauccaugagacagaaggggagagcuccaguaaggacccagaggucugaggacaggccaaagcacagauggagggauuagcuuuggaugguaagaggaaggacagauggccccuuaaacaugacgguaaugcaaacugcucuguuuuuuuuuuuucuuuuggcguuugugaugaacuuuguauaugcuuuccuuguuugauccuuaucaaaccuuaugagaagaaacuaccauucuccucauuugauggaugaggacccuaagcccuggagaggccaggaaacauucccagagucccucaggaggaggacuagugcugggcuccuuuccuccuguucugcugccucugagaggagccaggauugaaucguagccuuguccucugaccuggaggucugggaguaacucucuuaugacuuuuuuagccuaguagaauugaacaugaacuucauguuuuaagggaugguugcauuuguuugaauggucacuucuuuuucuaucaguauuagcuaauauagggagaaggaagucaugcuucucaaguaaagcaacaguaucuguguauccauuuacuugauugagcuuucuacugaauuacaggaguuaaauuauacuuuguuacacucuugauauuacaaaaugauggccaugccuuuauuauaaaaugacaccaguuauucuuuccuggaggaugugccuugugucacuagccgcacuaagcacuuccccacuaguggccccaugugguugugugucaucgcugacuaccuguuacaggugaggaagcuggguggugcagagacagaaagccgguggcccagucaggagcuccuaaguggcagagcccugucuccuggguuccuucuccugucuuucuugccucucacuugaaauaagagaggacaucagaacuggccugaauggggcccugguagggcaggaacaggacaccucugugguuuuguuaugauguccugaggauaaaggagugaaaaaaaaaucuuugaggaauugaagauuucuuuaugaaagauggcugaaacuccugacagcuuuucaaauucaucuuuggagaaacuuccguuuucucuuuccuguuccgaggcuuaaagcugcccugaaaucuacacauuuaucaacagucucuugucaagacuccagggagacaagaacucuuauacauugcuguugagaguguaaaacgguacaaccuuuauggaaggcaaauuggcguuauaaaugcguguuaccuuugacccagaaauucuacuucuaggaauuuaucuuaccaauacaccugcccacauacaaauugcagcauuguuuuugauaguaauacguuagaaauaacccacguguucuucagugggagacugguuaauacacuaagauauaugcacaaaauggaaugcucugcugcugagagaaaccacaaguaugcccugcaccccugugaauagaucuccaguauauuagguggagaaggcaaggcaggcuucuuuuuuguaaaguuaaggaggguaaauaagacugcauguuugcaucugcuuguauuugugcagacugacacuagaagggaaaccaaguaacugaaaaacacgaugauucaccgggguagguggggaaacaucuaggucgggacagguaugggagugacacaccucaguguacaucuuuguaucauuuuuaaaagucugugcuugcauuauguaucaaaacuuagugcuaucuccucaggugcaggguucucuggaacucugucuagguuggucucuuggauggcauucuugcagacuugccggaaaaccaaacaaaaggugugagugcaugccuccuggauagaugucuuuuuaguguaacuuagcacaccuuguacacugucagggcgccucucagaugagucaucccggcagccccugcuccaugagugucuuccccacaguccugagugcuucuaaaaucaucuacaccaguggaggcaaaacuagauauuuucuuaguuugcagaaaggaauauuuccagacaacaugaacuuguucuccuuuggucuccuuuuccuugucauuguucaagucacaaggucugcugauuaaauuuccccuuggguuucaaaagaacuugcuuguuugguuguuguguuuugccuuuuaauuugagaguugaggcccccaggugcaugugguaaagaauucaaagggcuaaauggguguguguuguucguuauuucuuugaaccucuuggcacuugaauggugucaguaauuucacuaauuaugguuggcaaagaaacucugacacauggcuuuggagcuguguuguucuuacaucauaucucuugaguugaaccuaugcucucuugauggaugaacucguaauucaccaggugcguggaucgcugugauuaauuguuucaagcuaucaguuauuuaacucucuagugccaaauguucaggagaaaauguaagugcaguguaauguaaaaucaagccggcaacuccagcaauuugcucuucaaacuauagcucuaucaguucccauucauuuauacacuuacacuauucaauuugucguuguuguuguuguuguuguguuuuugagacagaguuucacucuugucacccaggcuggagugcaauggcauggucucggcucacugcaaccuccaccucccggguucaagugauucuccugccucagccuccugaguaccuggaauuacaggcacccaccgccacacccagcuaauuuucuguauuuuuaguagagacaggguuucacuauguuggccuggcuggucucgaacuccugaccuggugauccgcccgccucggccucccaaagugcugggauuacagccacugugcccuggcacuacucaauuuguaauaaaucaggguaaguuauuuuuggugccaagucgauuaauugaauauagguuauuuugcaucuuagauucccucugacgacuaaaucuuauaagcagagguaugugagcaugagaacugugucgggugguccugaagagauuaguggauuagaaggagauuuggagauuuuuaaaaaagccucuggacagugaguuaaaugguggguugacacucuguggucgggacuuuuuggagagucuauaaaguucugcuguauuucucaagagcuagagagagaugauacuaugaccaaauuugguuugaauguauuauaauguacugaguaucacuaauuuguugggaaaugacuguuaaaaauacuuacugacgcuuaaaaauaucaccuauagcauuaguauaaguagccaacugauuuacauauauuucauguguguguugggagagggguguggauucguuaggccaaagauuucgguaauauauuuggaagagauaaaugaagauaaagagauaaauuaccuuuugaauaauuccaaaacuaaaaaugcuucccuuaauuuuuauuucugauuuucuuauuucuaucagagaaauguuucucaugugacaaauauaaugcuuucauauuuacuucugcaugcacaacuuuuaauuaaguauuaauugauuaauuuuuuagagacaggaucuugcugugucauccacuuuggagugcagugguguagucauagcucacugggaccucaaacaccuggguucaagggauccuccuuuuucagccuccugaguagcuggaacuacaggcauaagccaccuugcccagcaaauuuauuauuauuauuauuuuuguagagauggaggucuugcuguguugcccaggcuggucucaaacuccuggccucaagugauccuccuuccccagccucccaaagugcugggauuacaggcgugagccaccacaugcaguccguguacacuuucacaccuuuuaauuucuuuacucauuaggugcauucuuuagcaauuauguguaaaguggaaaugagcgugcaaaucgucauuuucuauugacuugcacuccagaauuggaaaauuggaaaacuguaggaaacuggaaaauuagaaaacuguaggaucuaaaacaaaucgcuucuaugacuuauaauauucacuuguagaacucacuggccuuugucagcuuucagaguaugugaacacuuuuugccauguaaguaguuaguccauuggcaauggauauauguaaguugguaucuucacugcaaacauuuaguuaauugcguuuauucuugagccauucuugcucuacccuuaggacuugauuuucaguagcuacagugguuauuccagaaguuguuagaauuaagagccaggaggagguacuauguaagcuacauuuagacuccacuggacacucacauauugcacguggaauaucuuaaagggguugugugcuguggucagggugggaauuaucucuuuucuuuccaugagaccuccacugugcauuauuuaagggccugucaauugcccguuauucaaguuuuguuguucuuggaggacacuauugccuauuucuuuccuuguuuaaaaaauuucauuuagguaggcuuagcauaguugcaguagaauuuaauaaauccuuuuuuuuuuuuuuacagaauaaaucuuuuuauuacguaaauacccuuuaauuugccuauuuuuaaaauucuuguuucugugcuuaccuuguuguuagacagccaaggggauaugcugcucuuuuuagugccaagguaaaagguaaagcuguaucuuaaauauuuguauuucucuuuggucuuggugacccaaagugauuugggucauucugacauuuaaucaaguuuaaacaacauggcucuuagaaguauguuuaccagguaaucugagggcugguuaccugguaacgcaauugagaaauuucaucaagacuaauugauuaauuuauuaagcacuuauuguccaguuugccuuuaauuuucauuuuucuaaguuuccauuagcuaucauggccucacuuguuauuuaauaaugaaugguuacaaauuguuuguguguuuuuguaauuagaauguaauagcaaucgucuaccagaugagcugacauuguaaugacaugaagucaguaacaauuaugccuuacaggaaaauuaauucuguaauccuaucaucccauauuuugccuaagagauucgauuuggcugcugcuaggcugcuuaggcaggugacagcauggugggacacuucucauuuuucugguuagacuacuuaaccauaacguucauggugccaccugaaaaaauaauuuuaucguuuuagacuuuuaaaauauuuuuaggcuuuuuuuuuuuuuuuggcuuaaaaaaagaaucuguucuacuuggguauuuuguucuccuuauuucuuagugaacaaagauauuugcucgacuucuaucccagaaggaccauccuuucuucuuccuuuuccuuaccucuaagggauaugaagcugugagagggaauugcauauagcaauaccauuuugauuccagugaaaguucuuaccuuucucuuuugucauucucaaccucuuaccugaagaguccauucccucaguauauagagcaucuggaagucuaaggugcaggcaggacugaaagagcugagaaaggccucacaucaggugacacuggggcaccuggcugugcucccuuguuggggggucccuuggccugggcaguuuugcgcuucucccuguuucccugugcccugagacuuugugggucacaggcaagggggcuggccucccugaucaagggcccuuggccuaggagggccccuggauuuaucuaguccagcuucucgucguccaggugcaaaacugaugcucugagauguuuagggauuuguccaagagcagaguuggagccacaguccaaaucuucugagccuaguaugguauucugucauccuugguuucauuuuguucuguucauaaaaauugcccaaaacugcugggcaaaguggcucaugccuguaaucccagcuccucaggaggcuguggaggguggauugcuugaggccaggaguucaagccuagccugggcaacauugggagacccugucucuuaaagaaaauaauugccuaaaacuauucaggguuaaaaauuugucucuaagcuuaagaauuuggaaaaacucagaaaaguagccaccuauaacuccagcauucugagaacaguuaaguguauuuucuucuaguuuuuuguuuguuuuugagacgggaucuuacugucacccagguuggagugcaauggcgugaucacuacucacugcagccucuaccuacucaggcucaggugauccucuucaccucagccucccgaguagcugggacuacagguguacaccaccauggccagcuaauuuuuguguuuuuuuuguagagacaggguuucaucauguugcccaggcucaucucaaacuccuggccucaagugauccacccaccucggccucccaaaguccugggauuacaggcgugagccaucaugcccggccuucuucuagauguuuaaaacaaacacauuuuaguguaguugagccucugaucguuacauguuuauuuccuagcauuuaaaagccuuucagcgacauacacuccuuauuagcuuaauuuuuucuuuuaagagcuguguucuugcucugucacccaggcuggggugcagugguaccaucguaacucacugaagccuugagcuccuggcuuaagugcucuucccaccuuaaccuucugauuaacuaggauuacaggugugcaucaccacgcccagguaauuucuaaaaaaaaaaguuuuuuguagaagugaugccucgccauguugcccaggugucugucuugaaugccuggcuucaagcgauccucuccccucaacucucaaaaggcuguaacccugauuuuaaugguaguguaaagugacaugggaugaaggaaccguaacauucuuaaaguuuccccauuguugggcauuugcauuggucccaguuuuuuauaaguaaagaaggcugcagcaaacucuguuguacuacuuaaucuuuguccuuuauuucaaauuaucucccuacaauacgucccuugaaauaggauuucuguggaaagguaucaguuuaaagcucuugacccauauggccaaguugcuuuccaaacagcuuaccuguugagacucggaccuaugcuucuaaagccuaugugugaaauguucacauugucuuugggagaagcuucccacgaauaagaaaaauaagggaagaacaaauaacauaauuguuuggauauaugcugugguuuguguggacgucucccacccuuucccuuccccagcccaagucagucuucuguauaaacaacuuacauaauacagacucuucacuguuuguauuauacauguauuuugugagucugugucaguauuuguuuacacgggaauuagggcaucaggcugucuuccuaggguuccucugugcagacuuguagacaguauggguucuuugcgugcugaguugagguggccccaaaccuuucagacaguugcucagauaccuggcaguugcucauuuacccuuccagaccuuccugccucuauauuagccaaugacaagcagaugcuuuccacaaaacauucgugugugaacuguugacauuuaugacuguuuucugagcccacaccaggucauuuuucuauaaaaucagaacugugagagcucagggcauguggccauccuggauaauggguccugcugucuggggagucguuuucaucaaaauucacuuuuaaagaauagaguguuuauuaacgaaaauaugugagccuuggcugggcacuguggcucccgccuguaaucccagcacuuugggaggccgaggcggguggaucacaaggccaggagaucgagaccauccuaacgcggugaaaccccgucucuacuaaaaauacaaaaaaaaaguuagcugggcgugguggcgggcaccuguaaucccagcuacucuggacgcugaggcaggagaauggcaugaacccgggaggcggagcuugcagugagcggagauugugccacuugcacuccagccugggcgacagagcgagacuccgucucaaagaaaaaaaaaaagaaaguaugugagccuuaucccccaaauguaccugacaugugaauaauauggcucaaacuaaugauguguauaauauuaaauugacuuuguuauuauaagugauacauaauucaauuuuaguuaaaaugcauuauuucaaucaauaucaaauauugcagaaggaaaaccuaaaauaguagccaaaguuacucagaugagauaaagaauauguuuagggcuggaaaaucauacuauuuuuuuuuuuuuuuuuuuuugagauggagucuugcuguguugcccaggcuggagugcagugacaugaucuuggcucacugcaaccuccgccuccaggguucaagcgauucuccugccucagccucccaaguagcuaggacuacaggcacgugccaccacaccuaauuuguuuguguauuuaguagagacaggguuucaccauguuagccaggauggucuugaucuccugaccucgugaucaccugccucggccucccaaagugcugggauuacaggugugagccauuacguccagccuuuuuuuuuuuuuaaauaaagagggucucaggcuggcgugcaguggcacgaucucggcucacugcagccuugaccuccucugcucaagcaauccucccgccugagccccccaaauagcugggaccacaaguaugcaccaccauaccuggcuuuuuuuuuuuuuuuuuuuuuuuuguauuuuuuguagagacggggucauucuauguugcccaggcuugucucgaacuccuggccucaagcgauccaccugccuuggcuucucaaagugcuaggauuacagaugugagccacuaugccuggccaauaauuauauaaauuuugauauaaauuccugcucuucaaggagauguggguuuuuuuuccuccugagaguauauuuauaaaguuaauuggauuuuauacaaaagaagcuuuugacucauuucauuuagcuuuuaauguuaucaucugggaggagauggugaagaauucuguuagccaaaccauggcgaauuaauguuucuuacagaugguuuuauuacuuuuuaugauauuauuuggaucaugaaacaaguaucuuggaaaaugugagauacaaagaugugaguugggaggucucucuuguaugugaguuccuucuauaacagagaaaggauacuuucaguuuaagcugagaugcuuuuuccuuuucacucuugaaaagucuuuguugcaggaauuuucugugcccucccuccucugggacagaucugcuucuugauacugcagggcuccagccuuccuuccagccagcucauuucucagggaagccuuguuuuccuuuuucagaaaauuuaaauguauauuuaacgcacaauuuaacucccuuuccuguugauaauuuuuuucuucuucauauuuuguuauuaauaauagcuuacagaaugggaucaguaucaggaucgggagguaaccaggucuccaaguuuucccuuucguuuuucuuuucugcuuuuaaugagccuuaauuaauccagggagcuaggcugcaguaucuguggcucucccugauguuuucuuucugccuuucugucuuggaggggaaccugaggauuuggaaguagagggcucuacuagugcuuccuuuuuguccuuuucucauuguccaaaagagucuuaagcgaucuccaggaaauccccugcuccugccaggaaucugccugugaguauuugagugaguugcugcuuuuuaaguaccaguugagaagcugaagguugguguugugguugugauaaacucccaacaugaaaacugaggaccaccagcguuuucagcucaccuuugacucacgcuggcagcuccaggaacacugaacaggaguccccacugaaccuuugcugcguuccgaagcagcacagccaugguuaggcacugccaggcagcucuuggaaaccacagggagggaaguuuugguuccuucuuucugucuuuguuuuugagaggaaugagcuuggaauaaaagaacgcuaguaaugacugauuugcagguuagguguaaacauuaaauccucauaacaggcuaaugagaggugggagaaauuauccccauuuuacagaugaaggaacagaggcuccuagagacuaaagaacuugcuacucaaugaggucaggauucacaccuagguugaccugaggauagcugcugcagugcucacccuuccuaccuucccaagaaacaauacgcagagaauuucuuuucuaaauauugugugccuagaaggugcuuuguguuaucgaaacagauauauauguguauaucuggucucuuuaaaauucucuuuaauaaaaacaaaaagugaugcuaguguaaaauaaaagauauauauagaaaauuguguguccucguuaaucuucuuuaggaaagauauaugcauauaugcaguauaguuuuggguuuuuauaaaaaugagaucaugcuauuaguauagugaauagccucuauauagucuuucguaacauuuuuacuuuuucucgguguauggauaucaauuuaggucaguugcugcggaguuugaaacgaguuaaaauuucagcaguucacaaaauggaugauucauaguuuagucgagccaucaucuguugauggacagucaugugguuucuuguuuuuucuuucucuguguuucacuaaugaaacaggauuacaguaaauugacucguguauguguauacauccaucuuugcugguacuauagaaaaguguauugcuggcugggcaugguggcucaugccuguaaucccggcaauuugggaggcugaaguggguggaucaccugaggugaggaguuugagaccagccugaccaacauggcaaaacccugucucuacuaaaaauacaaaaauuagcugggcgugguggcaguggaggcugaggcaggagaauugcuugaacccaggaggcggagguugcagugagccuacaucgugccacugcacuccagccugaaugacagagcaaaacuccauugcaaaaaaaaaaaaaaaaaaaaaaaaaaaaaaaaaaaggcauuacugccuuguuccugauuuaaauaaaaaaauguguuuuaacaaggaauauguuaaguuuugguaaauauaguuuaucauauuuaaguuguguauacucauucauguuuuaauuuuuaucggaagaggcugaugaauuuuaugaaaugccuuuuuggcaugauauaauugugagcuuuugcuuuuauuuggugguguaauaaauuacguugauuagauuucccaauauugaaucaucuuugcauuccuggaauaagcccuaauuuguuauggugugauaaucuuuggauauguugcuauuugauuugcuaauauuuuuuuaaaaauugugacuguagccuacaaagcccuacagauaggggucuuuaguuuuuuuccuuguuugcauucuaucagguauugauauuaggauuauguuuuuuaaauaauuuaagaagaauuucacccuuucccagcaucuagaagcauuuacauaauauaggaaauaaccuguuuuuuuuuuuuuuuuaaguuagaguaaaauuaacuggaaaacuucauaggcauccccuguagucccaucccagaacauuuuaaaacaaauuuuuuaguuuuucagaauauauuauaguuguucuguucagcuuuuaagccuuuucucuggauuuugauauuuucuacuugcugggaaagaauuuaucuacaauuugaguuuaucgcacaguuauuuguaauauuguuaucauuucucugguaaucauaacccuuucucauuacuaacacauauuuuugcucuuuuuuugcuuuuuucccccuuaaucaaguuuguuagaaguuuauauauuuuauugucuucaaaaaacuagguauauuaauuuuauauuuauccugcuuuuaauuucaucucaguauuuaauuuuuauucacuuuuuccauuccuuuaaguuuauuaaguugaaugccugucucauuugcuuuuuagucuucuuaaaauaauggcauuuaaggcuauacauuuucuuugaaaauugcuuuuguuacguauuuuugguuuuagacaguugaucuccuuuuuguuguuuucuagaugguuuguaauuaaaauauuuauuugaucuuugauucugacauuacuuagaaguaugucuguccuugaauuuuucuuuugcuuaccuuuugauauuguuuauaugauuuaugaaugcagcucugagguaucugagaggauuuauuaacguuuacuugcauccaaguacaugauuaaguuuuaauugcuuuguggacauuaaaaaauuaugcccuugguaaaaugcaaagguuuuauuuucuguauuuaguaaaucaaacuuacugauugcauuauagucagaucuuccaaauucauguauguuuucaguugucaaauugacaguuaaugaugcaccuuuuauaauuuuuuuuuuugagacagaguuucacucugucgcccaggcuguguagugcaguggcgugaucuuggcucacugcagccucugucuccuggauucaagugguucuccugccucagccuccugaguagcugggauuauaggcacaugccacugcaccuggcuaauuuucauauuuuuaguagagaugaggucucacuauauuggccaggcuggucucaaacuccugaccucaaaugaucugccugccuuggccucccaaagugcugggauuacaggugugagccaccacaccgggccccuuuuauaauuuuuaaacuuuucauauuuccaagagaaaugcuuaguguauuuaucugccguuuugcuugaugcaucaauauguguaauuuuuuuauuuuucagggauuacauauuuaucacauguaauaucccucucuguccaguuuaaugcuuaauggccuugaguucuugguuugauuuuacuauugccagcuuugcuuucuuuuuacuugacuuugcuugguauacucuuguucaauuguuuguuuuuaaauagagcuggacuuuuaaaacccauugagacauuuuuguucucuaauagggacguucugccuugucuuucuuuacugugauaaugcauacauuuugcuuuauugcuuucaucuuauucaaugguugccauuuauuuuacuuucuguuauucucaauucccauguuaauugaacaaguccuuugcuaauuugaaaaguguguuauuuucaaagcuaccggugccuaacaauuugaaaaucuguauuuuucuccugaaauagguaccagcauuaaauuacuaauucuuccaccaggguuugcauuuccgcaauuucugccguucccaugacuuucucugucuccuggauguguucucugucuuuucacucauggauucuaguagauucuuauuccuugcucuugggcgcucgcauuucuucuucuuaauccuccagaaucugauacucuagagcaacagaucuuuucuguucaauuuaaaauuuuaaaguguuuuuuuuuuuuuaauuccugaaaguuuuuauacuccaauugugucuccacauaugcucuuagacuccucuucccgucuaguucuccuuucuugguucgauuaguucuguuucagcuggugccaccuguugcagcugagcuuggucacccucccucaggcuccugcgucguccucagugggucaugguuuuucuuugcuugccgauggcugcccucagccgucacacaagucauggguuagugucacucaaggaauggcagaccagcagaugguaggugauaagccaggaaacagauacugugccgcugaguugcucuguucccagucucuuccgacaacauaaggcuugggaacaguuccaccuuccauggaagccccccuucccucugguuucaccugggacagcaggaugagcagggugcagggccuucuucccuguggauggacucucaguuacaaugaccauggagaacuguacccgcucucuguuuuggagauuugggagauccugagggccucagaaggcccucacucucaucccaugcacuaccuguaagcucauuagauuacuguccuuguuacuuuagagaggggacugugagggaggcaggaccaaguauguuuauucaggccacugucuuccccauaaagacuauauuuguguacauuuuucuuugcuguauugugagaaggagguagaaaaaagaugugcaugucugcauuuggaaacaguucugagaguggugcugcaucagcggggcuggauugcccucaacuauaagaaagugggauacuuauauaaaggaagcauaauacagcauguuucucuuacaggaaggacuguuucuuagaguccucauccucugucuccaucacucaguauagcaaaucauacauuccaucaauguuaaugacaucaauuguaugccuguaaguauguacacacgcacaggggcagggggcacuucuucacuccacagcuggaaaacuugggacaaaaugccuagccagcuuggcccaaauuugaggguauugccaucuguaucucagugcagguguuucugucugauguucacagucuguuuauccagagugccccagaaaggacaguaguguuagguuaaaccuguguaugucuguucuugguuuuaauaacaguccugucuuuggaauuauuuaguguguucucucauuucucaggaagucaggauguuagugccgaagcacuucucugacuugguccgacauugaaguaccuuccccugcauuacagaagaacggccccccagggggucuguuugaugaacacauguauuauugcagugagauacucuagaaauagcuucauguccuugcaaaauugccagcacaaguaaggaccuggaaauuguugcuaugcauguaugucagaagauuucuuaaccaauucuguacugaauaaaauaaaauuuauuuucaaguuuuguagggaccuggggcaauaugucagauagaguugaauauuuucaaggcauuuuuaguucauggggcacauaguuggcuuaagauaucuauguguaucaggacugaaagguaaagugcccgaaccugcuaaugaaagaggugucuguguggccaucugagguucagccacaaugugucuugcagaauuauuuuauuuugcuaguuuuuaauuucucaaacaguucagcugccugucccgugguaccgugagacuucuaauucaagaugaccaguauuugcagacagagccacugccuuugcugccacauuuugcuugguuauugugugagaacaccauuuuucucuuuuuaaaugaauuguguuucucuuuuuaaauugagcaucugacugggcgcgguggcucacgccuguaaucccagcacuuugggaggccacggugaguggaucaccugaggucaggaauuugagaccauccuggccaacauggugaaacuccugucucuacuuaaaaaaaaaaaaaaugcaaaaacuagcugggcaugguggugcacaucuguaaucccagccacuugggaggcugagggcaggagaauggcuugaaccugggaugcggaggucauagugagccaagacugugucauugcacuccagccugagcaacagagagagacugccucaaaaaaaaaaaaauccguuuacauagugauaaauaaaguaauuacuauagugguggcauucugccuaagucaucuugaaaacugaaugcaaaaucuuuuuaauagcuccauaauggucucuugaaguguuacagauuuuuauaacgauagcuguaauacaagugccuuuauuuacugugagacuugaacauuuugaccauuuacauggguacuugugugucuccagcugagcugagugcaugucgcugcggcauugcaggcgugugugcauguuggcucuugcaacggggcgucugccagggguugucucgggcaggagaaggaggccagacuggcaccacuuguagugauuggaaugugucuaguccagcucuucaguuccauguaggagguuuuaggauggagauuguguuuugggaacuccaagucacuguccaauuuggagaguauuauguaagaaggcuuauguuuucugauuacccauccuucgauacagaccaaauaauaccacagugauaaaaaugggaaaggagcugucgcucagcucuucuuggccguguuguuugcuuuucgaugucuaauuuaugaaagcauuucaaagugacauauauacugaacagcuucgucuugccaaauguaaaauaaacuggagaugaguuuagcacagagcuuuguagauuguuguccucuugguagagucggggccuaaacaccaccuggccucugugccaguggacaggugaccugccuguccuacugcuggucucugcagcucucugucuugggcaacccuggcucugaguuccagaguguucuccaguaggagagucugcaggggcacuguggagcaccuggguaugugcacaucuguuguuggcuggcguugucucugauggcuuggggugucacagagacaugacaguacugucacugcauaccucucaagcuuuugcugaguccuacaugaguugcaggggcagagagggagggagaaaacaaugccuagccacacugagaaaggggaaagugcuacagaguccuggaaggaagcgaggauggacauggacggggaagcauucauaccaggcaggaaaagugacuucauggaccagucacagaggacagggccagggaucaaaccuuccguaauuugccuccacaguuugucugagacuggcuaccugguugagucugccagagcccugugugcagguacuaccacucacugucaccuccaggcaggaaaggccaugugaaugcaugcaucuuugcaggaacuugccccuuuccacugagguuugaggcagacuccaaccacauuuccauccaguggcuuaguggucuuacccgugagcuugaacuguugucccugccaggacagucuuugccucuguaaguaucuccauauuccuccauccuuucaggucccauucagucccuagguccuccaugauggaauauugguugaugcacuuauuccacaaacauuuguuggccaccuuucaagugccagacaacccuucuagguauggagggguacagugaugagcaagccacuguuucuggcugcagagggcucacuguuuagugggagaaacagacaaaucauacaucuuaacuacacugcccuugauugcucuuuaccuguuauaucagucgaucuugccugccuagcauuuguucccuguuugggggccuguaugauguucguuuggauaccucaggguacauuuucccaucuuugugaugauguagcucacuuggucugaaugauauguaauccugcacauguagagugaccauuauauuugcauaaauagcauuggaggaauauauaagaaaugaauaaaaguuguuauaucauuugauuuuucuuuucuuuucuuuucuuuuuuuuuuuuuuuuugagauggagucuggcucugcugcccaggcuggagugcacuggcacgcgcauagcccaucgcagccucaaacuccugggcucaagugaucgccugccucagacuucauuuugauuugugaaccucgugauucuauuacuuguuccacaaaaaauuuuaaaugaaaaaauauuucaaaaauacauauauuccggccaggcauaguagcucaugccucuaaucccaucacuuugggaggccaaggcagacagaucaccugaggucaggaguuucagaccagccuggccaacauggugaaaccccgucucuacugaaaauacaaaaguuagcugggcgugguggcacgugccuguaaucccaguuacucgggaggcugaggcaggagaauugcuugaacccgggagguggagguugcagugaaccgagauugcaucauuaugcuccagccugggcagugagugaaacucugucuccaaacaaaacaaaacuaaaacaaaaacaaaaacaaaacaggcugggcacgguggcucaugucuguaaucccagcacuuuaggaggccgaggcgggccgaucacaaggucaagagaucaagaccauccuggccaacauggugaaaccccaucucuacuaaaaauacaaaaauuagcugggugugguggcaggugccuguagucccagcuacucaggaggcugacgcaggagaauugcuugaaccugggaggcggaaguugcagugagcugaggucgcaccacugcacuccagccuggcgacagagcuagguuccaucucaaaaaaaaaaaaaaaaaaauuccuccacaacauauauuccaauguuuaguuuuucuguuacagagaucacauguacucuaacuugucaacuaaauuuaaaaggaaaagacaacuuugagagaaaauuaaaaccaaugcaguguguguaaaugccauuuugauaagcucuuauuucauguugacauauucuauggugcucgucuuacauaaccuaguuagggaaauguuuuguuccagucuggcuuuguuuuucuucauguguuuagguccuuccacuuuccuuuuguuaauuuuugguguuguacuucaggaaaugaauugaggguugcaaaugaccuggagggccuuaguuuguuugcuuguuugauuuuagcaacagucaccgugguacaccugacguggcugggacuccugauuuuuuuuuuuuuucuuuuugagaacaaagaauguguccuugucuuggcauggacuggguagccuuguucaccuccccacccaucucuccuuauuggugaggcauuguaaaccguguuaacagguagcauccacagaacccuggaaagguugugaagucccuuuggaagccuaaggguuuugaucucauccagguuguaaucuuaaauucugguacaaauucccuuguuacaacuggguuaagugguuuuaaccucuuuugugccuucauuuugaaugcuuagacuggaaagucguucagagacuccugaccgaauaaagccuacuuccaaaugaguggguuguccaggugugcuuguagaugucacauacuucuaacaaggcucugcagcugcgaugucaccuugcccagcgugaccucauuagcauguauguggcuuucaguggccauguacuuugcuucuagagcuuucuuucccauucuggguucuuaggagggggcugugcuuuguguguggccaggcagaaguccauguuuuagcuuuucaauucucuugaagaaaacaaauguuguugauaagaacacuugucauggcauccgauuuguucuugugagggcuguauuagcaauaaauagacauuuaguuugcauauuuaacaccucaucuucuuucagcccacacgucuucacuacaggauuagcuuuucauuacuuaguagagcuuuuaauuaccugaagcuuucgugucuuuacugggauauaacuuuucuccuuauuaaccagaaaaagucacagaaaaucuuguaauuuauaauggaauggaguaauauucacaaacaggcuuuggcaggauuuuuuuuguuauuguguuuuuuguuuuuguuuuuuuguuacacuaguuuuaucacaagacaagaaagaggggaacuuuuagaaauaaaaauuaugugcuaaaauaauuaaccuuccugaguaacacacacagaauguugguauaguguuugcaccagaggaauuacauauggaagaaugcugggaucuuuuaccaaauaagggaaaguagaguucauuacaaauagaggcuucuagcacagaaaagaggacauuuuauaaguacugugaagcauuuucagagauaauuaaauaauagaaaauauuaaaccaauuuaaacaauuuguaguuuuuuucuaauaaccaguaaguucuucgucuucgaauaauucuuuuauacuguucuauuuccagcuccacugagugccccuguguuuucagagaaaacaggagucuguuuuggacuuccucuuugguauauauggugggagauuuguuuaaaaaauuuuuuuauagagguaaaauucauaugacauaaaauuguccauuuaaaggugaacaacucagugacaucuaguauauucauacuguugugcaauugccaucucuaucuaguuccaaaauacauuugucaugccgcaaggaaagccuguaccccuuaagcaguuaauccccauuccccuuuccgcucagcuccuggcaaccaccagucugcauucuguuucuauggauucaccuauuuugcauagugcauauaaaugcaguuauauaauaugugaccuuuugugucuggcuucuuucacuuagcauaauauuuuuaagguucauccauguuguaauguaucaguacuucaucccuuuuuaugggugaauaauaguccauuguauccaguuguauccagaagauuugcuuuucauugccuaacuucagggcuucagacaccucaaucuuuguucugagauggauguaaacuuaauguauaucucucucucucacccaaugaucaugccaacaccuuuuuuuuuuuuuuuuuuuuuuuuuuuugagacagucucgcuguguugcccaggcuggggugcagucuugguucacugcaaccucugccucccagguucaagugauucuugugccucagccucccaaguagcuggggccacaggugugagccaccacaccuggcuaauuuuuuuuucuuuucucuuuuuuguuuuuguagagauggaguguugccauguuggccaggcucgucucgaacuccuggcaucaagugaucugcccgcuucagccucccaaagugcugggauuacagacauaagccaccuugccuggccaugccaacaauaauuauuuagaaguauguugagaauacaucccaauaauagaagugaaagcucuuuaaaaagaaaaauauucaaaacuuaccagcugaucuuauguuucauuuagaauggcugcauucuuugcaguacccuaggguuguagaaauucucccccaugauugcacaacccacuccuucucagccagugugcaccuggagucagcuguguuuggccuuaagguguccaugguccagcagggagagggcagaugggucaguguuguccugcuagugaugaguaucccauggugggcaugcugaugccacgcaagggagagggugucugguucugugcaguggcaguggugcaaccccuuaccaagguaccguggggaccuggguuagggcaggaggaggaagguguucucuacagacugcagggcuuggaggcagccugucauggggaaggguguggaugaagggugagccgggaccccaggcagguacggagcaguucaaggccgucaagugugcuucauucuucagucauuagggugucucugaaagguuuuucauugaaucagaauuccccuaauucacgaauucuaaagcuuaaguaaauucaguaauaauaaacugucaauuauccaagcgaugaauauaaauccauaagguuuuucaaauccccagaaaucccuuucgucucccaccugguuuugcugagcgccugucucuucugucucuuuucugauucccaccuuucacuuuuccuccauuuuucgcuuaauggauuuauacuuuaaaguagguauucugaaaauuccaauuuuaugaauggugugacggugagaacuuugauucauugaaagauaaaaauaaucauuacauuuuauacugcaagggucauccuuaauauucuucguauuuuuaauauagcugcaugauuugaguaguugaguuggggauuggauaauguauuuauugauugauuaacucucuggggguccauacauaccccucuuuauaucccuguggucccuuuuuaguccuuuuguaaaaacuugauaauguuaaccucugccaaaguugaugcgguaguugugaguggugggacgcaagcguguugauuuauucuuggagacagcagaaacagcaccaccuucaacuguuuugucaugaucaucuuguaaccauaauucugugcuaagucagaauuaauguuauuuuguuaauucagguuauugugaaaaucuccacaggagguuauuuaagcaagucacaaauugauguuucuguuuguagaaaaacuccagcucauccagccagccacauuauuccagggcugcauggugucagcguagggaccaggcucgguguagagaccaagggugccuuuccccuuccuuuccgcccguuaauugccuacucgcccagugguaccuucugaacuuuuagaaauccagauaggauuuccacaugguucauuagaauucauuuauuuuuuuccaucuguauuucuuuuuguuguacucccuagaucauuauuuuuaguuacuuuuuacaugcauugguuagguuuuucauguaaucucucaguaagcguacugggggaugagugaccucaguauuuaaauuuuucauaggugggaugaaaugucuuuucugagugugaguauuucuguuccauucuucuuuuccaggcaggcucucauucugugcugcaguuuggauucagggagcacugacccuucugucagguugcuccugcuaugaaggauggaagggcauuuugauacaugaggcauaacuguaauuauccgguggggcuugguuugugcuguuuuccaccucuucgucauauuuuggaaaacugaggccaaaagcaaaguucauuuuccccuuuaaaagcuucuuuaaaaaaaugaugaaagagcuuuaucaauguuuugaauaacccagaaaauauuucuuauuguugauaaucugcaguuugcaagugcagcgaaucuuguagguagauuuaccuugaguuuuuugaaacgguagaauuaauguauuaaaacauaugguuuuuaguuaaaauaggauguuaaaggaauagagcgcacgaacaaaaaacuuuccacuugaacccauguuguuucaucugacaguggguauggugucccuggcaggauagggcuuccaccuccugcuggugccgguaggacagggaagagguggggaacacugugucuccaucucccaagcaucuuaccucccaagucagaucccuggcauuguuugaauacuugcguguuuguguguggggugauguuuuccugagaauguggcaaaauaauagaaggucccaggguuccucagucugcagaccauagcugaguggugugugccucuagccaugaggugaagcauaggugaaauucagauccauaggaagacagacagacuuugcaaguuaguaagcuaacuugcuagaggaaacgguagacuccugugcuggcugccaacuaaaaagccuuucuccacaguucuguucucauguacacccucaggaccuuggaugagcuuguguguucaggaaauugggcaccgagauuuuuuuuguaucuuugauuuuaguugauauguaguccuuccaaggaaaguauucguuggaugcccuuucuacacuuuggcauugugcaagagguaucaaauuuuaaaguaaaagugcacaaccuggccaggcgcgguggcuuacgccuauaaucccaguacuuugggaggcugaggcggguggaucaugcugucaggagaucgagaccauccuggccaacguggugaaaccccaucuuuacuaaaaauacaaaaacuagcugggcgugguggugcgugccuauaauuucagcuacuugggaggcugaggcaggagaaucacuuuaaccagagaguuggagguugcagggagccgagaucgcaccacugcacuccagccugggugacaaagcgagacuccaucucaaaaaaaaaaaaaaaaugcccacaacugggcaugguggcucaugccuguaaucccagcacuuugggaggcugaggcgggcagaucacgaggucaggaguucgagaccauccuggcuaacacggugaaaccccgucucuacuaaaaauacaaaaaaaaaaaaaaaaaagccgggcgcggugccgggcgccuguagucccagcuacucgggaggcugaggcaggagaauggcgugagcccaggaggcggagguugcagugagcggagaucacaccacugcacuccaaccugggugacagagugagauuccgucucaaaaacaacaacaacaacaacaacaacaacaacaccucacaacccuggucucccagagcuuccauauuaauaaaucuagacaaugugaaaugcaaauccacuuaauauuugaugcaaaaaaauuuuauuugaccuguuauuuuaacucuuugacauaaaaucucuaaaucaaaauaaucagcaacaguuuuaaguguauaaauauguauuucuuucagugcuugaacauuuuuagacaggaagauucuugaucuucuuuguaagcaaauagcaucaaagaguaacauuucuguaccuuugugguauguaccuuguggcuaauuuguccaugaagggauaggcauuguguuuuguugcuuaagucgcuuaaggccuuuaaagcauuuccaaacucaccuauuuuugcucuaagggguauaagguguuaaaaaaugaauggaaguuaacucauucucaccuugucugcuaacuuccuuuuguucuuuuucuguaagaacucauaaagcuguaugcaucagcugcucccaggggccuucuaaggccucaguccaacaacagugcuacaggugaggaaaggaaagaagacacuaugucaucaugucauucuuuuagacuugguaagaaguauauucaagcagaucagaugcucucagaaucacagcguguuguacugcuaguaauuaaaacugaaguccacauugaauaagaaauaauuuuuuauugauugcuggcauuugugagaaaggguuuaauuagaccaggauauggaggggacuuaucgacaguuccguuguacauuguugacaugguuauuuucuguaucucauuuugccugggaauuugucauucucuucuauuuucuuaucaguagcacugcuuuuacacuuauuagcccuagcuguuugucuugcuuauuuaaacuuguacauggcacaugcucaaagauuuuuccaggcaaaauuucuuuaaagcaggauuugagauuuucuauccccuuccgucugcuggauuauuccggugaguguuaaucucccgccuuugucuuagccucucuguggucuucgguugcuuccuuguucucuguagaucuccugaguuggccauuagcugucaacagucagcacuugcugccucucaagucucuuccccuccuggcucugcccugguuuugcucucugacggggaucuaaauugggauucuuuccaguguggaauccuggguguccaccaugucacucugacuuccagaugauaaugagugugaccaugggcugaaugaaugucucucugcugggauuaaaaguuagaggaaggcaaaaacagauauugcguguucucacguauacgugggagcaaaaaaaguugaucucuuggagguagagaguagagugaugguuaccagagacugggaaagggggcgaugaagagggguagagaaugaguacaaacauucaguuagauagagggaauacauucuaauagggugacuaucguuaacaguaauuuacuguauauuuccaaauagcuagaagguuagaaauguucccaacacauagaaaggauacauguuugaaaugauggauauccuaauuauucugaucauuauacauugcauacauguuucaaaauaucauauuaaccccauaaauauguacaaauaucacacaucaauaaaaaauaaaggggaagacauagguguaggcauagauuuuuaagcugagaaccuuuugacagggaagaccagggaugguuuuaggguguggggaaucuguguaaguuggccguuagcugucaacaggcaacaaucacugucucucaggucccucccgcucccugccguguccugguucuacuugccggcagggaucuaaguuggaauuccuuuccaacauggaauccugaguguccaccaugucaaaauugugucaaaauucgucuguaugcauuuuucuugguagaaggguccccaaaagucaccacauucucagagacuucugaucccuaaaacuuuagaucaacagucaauaaaaaggucccaguugugucuuaguccccauggcaguacuuuugaacauuuaaagguggagaauugcuacugaggacuuuguucuguggaugaaacuucgaaugaggauuguuggugagaguuggauuguuguuguaugaggaagugcaccuuggaaucuaauggggucuucacggagggggagucaguuguggcacuguuuguguauuccauucaucauucaucccuccauccaagcacccacguggagcucagaaagaugacuaacacauacccccugcugcuccuguuuuucuaaggugugcugggaccauuuacauuuaguucuuuggagaacacaacuacuuaggauuuuuguuguuguuguuguuuuccuguacauugucuuccucucucccuucugguacccauuccacccucucuccccuuccucacugccguuucauagggguucucagauuccugugaauaaagcaaaccgaugugcagauaugugugcuuacacauguggacguauuugaggagguaagagggaccugcacaaggcuuuagugaguaagcagagaaguuauuuauauauagugagacccaguaaacggugaugucgcaggugaggcaguugaucuggucagaauaugccuccagagacaucacuggugaggccugcaugcauguugaaaagaguguaucuuacaucuaggcuuggguuucccccugcagcucacuuaugaauaacaacguaugcaagagauuugaacauuuucauguucaaaugaaacaugaaaagggaaaaaauuuaagguuacgguuaaguuuggauuguuugcuuauugguuugguuauuggcaauugcuacaaaguccaggguguucuuuaucagcagcaugcuuaucaaguuacugacauucaagcugaguuuccuucccucccuccuuccuucuucuccacugacauuuuuuuuuuuuaaauagguagggaggcauuuaaucuuguagcagcaugagaguagcuuaaaugucccuccucuagcaguauguuuauagcagcguagguaaggaaagcccagcuugcacagcugagcucuaaagugcauacaucccuuaaguucucauacacacacuggccagugagacccccaaacugcgaacagagaauucuaauugaaguaaaagcaugaaguuuuucuuuauugaccauguagcaacuguggaaucauuugaaaauuucugaaaacaugaaacagguguuuauaaggaguuuucugacuuaacaaaauuggugaaauaccaacuuuacuaaaaacuacuaauucauaauuuuuugauuaauaauuucuagucuggaaaagaggaauuuuuugaaaaucacugauauuuuugauauacuguuguuuucaaauugaguucucauaguguggucggcucuguucuauggaauuaauauugaacaagcuguucugaaccuaagaaagguuuguaaaaaauaaacaugaaggaagacuucauucaagaggucacuuaaaaauuauuauuauuauuauuauuauuauuauuauuauuauuuuaagaauuaggucucuguuggccaggcuggagcacaguggcacaaucauagcucacugaagccucgaacuccugggcucaaacaguccuccucccucagccucucuagcagcuagaacuguauauguacaccaccacgcccagcuaauuuuuuuuuuuaacuuuuuuuuacuuuugaagaggugagauuauaggcacuagccacugugcccagccaaaaggucacuuuuuuuuuuuccuuguuggggaggaaucaauaacaggaacaccagucaugauuugguguuuuuuccagggcagacaaauaaagaugauauuacgauguuuguuaucacagaauauguuugcuuuugauagggguugggugcugaaggguaagugguuagaaucauucuuuuucuaaggguacagccauuaauacuccuugauucaaaucacuauuuaaguuauaaauacauggauuuauuuucuaaccucaaaauuauagcaucuuaccacauauuugcaugccucucuugaguuaacuacuggugaugauucuuagcucaucuguggccaaguauagauaagagaauuagaaaguuguuuccagcgugugaacuuuuaugauuuucuuccuugguuacuguacucaguucuuuuuuguuuuguuucuauacaagaugaguagcugguggcucagaugacccccgugcugcauguacagucccauccagagaguguugggggcuguguaaaccucgaggcucagaguggcugccauuuuccuaaaagagaaguauggcugcuguuggccucaauguucagcuuuacaaaaacucccguaauuaaugaaggucaaggcaucugcaaacauuaauggggucacaagggacaaaucaguuccuugaggggaaguuaaaaugcuagauugcuuaccgcuccagacaaggcguucucaagaaguaugugcaguuucagcacaaggauuaacacggagcauuacuugagccauggggugccuugggggacauggaucagcaaccauuuccuuuugcucacagcgcccagauuuuguucuggggaccacucuuaucugcacugcauagcagccacacauuuugagugaaauuaaccccaacuagcauucgagcguccuccccucccccaaaagauggacuguaccccacacuguaaucagcagggaggcauuuccuggccacaguucagguuggucccuuagaacgcugcucagaacugugguuugguggcucugggaagcagugcucucucugagugugaauaaggauccacauagcuccaguaggugucugacgacaucuugugauccggggggaagccagccuaaggacaaagccauuguggggugagagacaggauuggcacaaucacugacaaccgcaguaguagcccagaauaaacugugccugaaaccuacccuauuuuuguauuuuuuccaguuuuaaggaaauaaauccccuuuauuguauacucaguuugaaucaauuauuuuuaucucuuugggauugguuuuugguuaaucucagcaauucagaaauagcugaagaacuaugcuguggguuuagacaucaugccgugacaaaaagaagaggaucuuagaagcgggggacauucacugaagcuuuaugagccuuuccugaaucccuucaaaucagaucaaguucucucucuccugugcuuagaaaugcugccuguuaagucacguuggcuacagcacccaucucagaucccuugugauucaguuguaaaguagauucuucuggucugaauuagaggccaaaacacaagacagaucaaaaauggggaacauauugcaaauuuccccacaaaagacugaaggauguguuuaccauugauugcacagggacugcagugucuaugcuuuuaggcauggaaaaugcaggguuugacuaucgaguuuagauuuuaaaguugaggauuguuucuuuaagaagaaauauagaauauuauucaguccuaaaaaggaaggacauucugacacaugcaacagcgugaaugaaccuugaggacauuaugccaggugaaaucagccagucacaaaaggacaaauacucuaugugauuucauuuagaugagguucccuggaguagucgcauucagagacagaaaacagaaugauggcugcggugguggggggguggggggugguuuggggaagggaguggagugaugguuucacuuuugcaagauggaaaaaguucuggagguggcuggcggugauguuguacaacagugugaacuuacuuaacauugcugcacucuacuuaaaaaugguuaaaacgguacauuuuguuauggauauuuucccacaauuaaauuuaaaaggaagaugaguaguacucgacucauuauuggauauuacaucagggaacuggagguagggucucacuuacuaguuacguagcucaggaaccuggaaccagacuccuucuccagcugggcagucccagguuugaguccuggcuccacuggagguugucugacuuggagguuaauaauaaccugccuuagucccagaguccuuagagggaaaauagguuauaauaccugaguccauguguaucaagccauugcugguuccaggccccuggagcacucagaaauggaugacccccagcugggucaggccaaguccucccugcuguagcaagcgggaccauugccucguuccccccaccuccacauggaaggugccuuuuguguccugccccaucucuguuuuaacagucacaagacuguaggcagaucuaaacuuguuugcacauuauuaucaccuggggagcuuugacgauuccaaagccaggcugccacccccaccucuagaccaacugaaucaccauuuccaggggugggacugggcauccguguuuucgaggcuucugggugaguaccuugugcaaacaaguucagggaccguugcccuagacacuguucuuccccucaugucucaaccugggccuccuaccacugccaccaccacagcuaugccaccugggaugugucccaagcccccacuugucggggaagcagcuggggaggggucuuuggccaccucugcagcuauaaggaucagagcaacaccuggcuucugugccuguggccccugcuggugcugggucccugguccgcacugaaggauccaggcagaguacagugggucucccaggucagaauccccuggguugcuuguuaaagcucacagggcugggccccaccccaggguuuccgauucagcaggucucgggcugguuggaugaugagaauuugcauuucugucaaguucccaugugauccuuuuuggggucugggaccacacuuugagaaccacuggucuauuaaacaaaucuuugcaaauuagggagguguguugugggaggaagagacugauaguugaaagaauauuugccuaaauacagugccuaguauuugccaaguacgcagccuucuuucuggcuuuaaucauacagacuuucucaaucacauguaauugcacauccuuuaagcagcuuuugacugacuuugguuuucucuuuuguggugauuuuccuuaaacucccgaagggaggguggaaggggcaagagaaauuuuuauuuauuuauuuuaauuuaauuauuuuuuauuauuuauuuuuuuauuuuuuuuuugagauggagucuuacucugucgcccaggcuggagugcaguggugugaucucaggucacugcaaccuccgccucccggguuccagcaauucuccugccucggccuucugaguaacagggucuaugggcaugugccaccaugccgggcuaauuuuuuguauugguaguggagaugggguuuugccauguuggccagacuggucuugaacuccugaccucagaugauccacgcgccuuggccucccaaagugcugggauuacaggugugagccacugcgcccagccagauuuuauuucuuuaaaaaagaaacuuacuaguuaucaggacacuuguguucuugguacuugauuuugucagcauuauuuuuaagagccucuucccuccuucccccuaccucccuguugagcccaggcucugaaauaacauaggugcaugugaaguuccccuaccugccauuaccagacauuggugcugggcggcccucaccuccaccuccucucaccugaggccacagcggugugcaaggauguggucugucuugaguguguuuucaaagcagcuguuuggucugugccuuggauguuuuuccacagauaagcccaaaagagaaccacaucuuaaaacgcccgugaccuugaauggucuuuccggaggggcggcuggauuugugcucucaucgucucagguaugugucaagccacuguuguuucagagcuggacacaggugcuuaggaaaauuccucacugaaggguuuucaggauuuacaaguucuugcuguuuuugugaccuugugugguuucugguuucacagaaggcuuuguuucuugguucuuguugcugcuuucagccuuggccuguaaucacugggcgccagggagggcugcggucuguuucccggggugugcucagauaccgugucaguucacauguguugcugcagcggcagggggccaggcaggaggggcggguguccugaagcacgcucaauuugcugaucagggccuucacuuggauuuugcacuugccgcaguggagacauuccucguagcuacucagugugguuuguuuuaagugggccauccguuaauucaugugaccuggaacuugguuaauguacuugccaagguuaaaguugagacgcuguuuguuaaaccuuucaaagagggaagaagguugccuugaauucaguuccaggguuugggagucugagagggagguggugaggggcccggggaggcccugagaaacaaaaugcugguuaaggacacagucugcucaccgaccucggaagucucuagacgucuaaagaaguccaagcaaggaaugaugaccgaagaggaaccucaagggugcaggcggcucugggaucucagcacaucucagugauggaaugagcugccggggaaugaccccugugggggcuguccaaagucagagcagacacaaacguagcucuccaggccccauaccuuggugggcaagagggcagcaagugcauccucacaguugauggggagagcagcauuucagccugcagaaaagagaaccacacagauguaagaugaggucugcacucacuugccuggucaugcagagacggagcugggagcagcugcaugacuuuucagagaaguggcacacguuuacuguaagggucccaaauguagaccacugcagaucguaaggucuagauggagggaccaauaguagggaaguaggggagaagaaaguaaaaccuuacaguauaaagacccauagaugcucuuuuguuuuugauguguguacggggguuagauauuuauugagcaccuacugcaugacagaguguucagcaaugacaaugcagagcuuaauaagaacagguucuagacuaaucuuuuagggggugaggauagaacagaaauagguaauuauguccugagaacaugagagaguguugguggacagaacggcgauguauccccaagggcaacugaagccuucacagaagaugcaaagccuguacgugguccucggagucaugccacauggugacugguuaucuuagucguaggaaaacugagaagcuuugaggcauguucuaucugucuuugugggcaucaucuucauuauuugaacaauucagagugcuugaugccuuuugcuucguucucacaauccuugacacuaagcugugggcuuggguuauagucacucauucuguuauucaugucauuuugccuauccuuccacuucacagaugagaagacugagacccagagagggucaugguuuucauuagccaaauggugcagaaacccaguggucacaguggcucucuagcucuuugucacccacagggcccuugauaagaguacggucuuucuccaggggagcaggguugaggagugggggcagcccuggccuggguggccauauccugauuuccccucccuuggcccauagcucucuaucuugggugaggugagaaaguaaggcugcuccuugacuguggucccuuuugugucuguccugcacugggccaccuucccaggggccuugugucagccugguaguggugcuaguggccuugaagugagaguggguggaucacacauggcagaucucuggcagugaccuuuucuguggauuuccggugacugaugauagccucuuuggaagucagcauaugcauagcucucugucuuuugaaaacaauggaaaaacccaccaccagccccaaaaccagcugucuuucuucuuaugaauagauauccaugaaaagcagaagaguaguuucuuguaaguacucugggagugcauaauacauuuuaaauaagauuaaaaauuauguuuuauucuuacuagcaucacugucagauaauugagcgugagagcauucagugcugugugcuugguacgaaguaguaacaucaauucaguguucaguacauccacuuuguuccagaacaauguauucaaggucgguguauuuuggcugugccacagaguucuggaaauucccaagagaauaaguuuucaccuguuauauaauccagcacaagugacuguguagcagcaaccucauguuucaugaugacuuuaaaaugcaauugauucuaaaauuuagcuuuuaaaaauuucgacuucagauuuucucugaagguuuaagguaggcuucuccuuuauuaauuuuuucaagaaauauuuaagaacacugcucugugcuauguaccauucuaagcacuuuacagauacuaauucauuuaauccucagccugguuagguaaguacugcuauucccaccguacagaugaggaaacagccucagaggaguuaaaacaaguugcucagguuacaccgucagcgguuuggacuacuucaguuucagauaaucacugugaaauuuuacuguuuugagcuacacguuucaaaaucuuuucugaugcggaacuaucauuaaaucauauaauccgcuucucuggagucagagguugacaacacauuagcacuugacucgagccucucccuggaggaggacauuccgucugcggggagccgaguccgaggcuggagcaacucuggaaccacagcccuccaguagagggcacacgagagcaggcuaucuguggagauagccuguuggcacaggggugaagaugacagaggcgaacccaagcaaagagaguuaauuagcagaguuugcccuccaggcucggagggcaagucagccuggggaccuggaguuaguucccuuuucagcugugaccauugaagacauucaucaaguucucuggcuccgggaugucagcugugguagugacuugcaugggagguuauccgacauaccucacacacuuuaacuccaccucuucagaguuuguggccaagaauggagccagguggcuauuuuuuuuuuuuaaauuuauguaauaacaaacauucgcauuuauugaaaacuuaaaguauaauaaaaaaauaaauaaaauaaaaaaagaaaaaagaaaacuuauuccugugucaggcacuuuucuaagugcuuugcaguguauugucucauuuaauaguuguuuaaauuaacagaguaggccgggugugguggcucacaucuguaaucccaguacuuugggaggcugaggcggguggaucaccugagguugagaguucaagaccagccugacaaacauggagaaaccucaucucuacuaaaaauacaaaauuagccacagugguggcgcaugccuguaaucccagcuacucaggaggcugaggcaggagaaucgcuugaacccgggagguggagguuguggagagccaagauugcaucauugcacuccagcuugggcaaaaagaaugaaacucugucucaaaaaaaaaaaaaaaaaaaaaaaaaagagagagagaguaaauaaaauuguaaggugaauauguuaucuacuugauggaauuuuuuaaacuaccuugaaaaguuuuauaguuuccuauuuacagaugaaauuaacauacuaauuauaaaucaugccucacuauucacuuuaggcagucuaucuccuuaaggaucuccuuacgguuuagauagauaagugaauugcuuaauguuuuuggaaguaauaaaacugcauuucuuuuuaauuaaacaauccagauaacaagaaguaauucuaauaggaaacuuguaggauguauuuacagaaaaucuacacaaucuuacugaacaauguagaaaagaagauuuaccagccugggcaacauggcaagcuuugucucuuaaaaaacaaaacaaaacaaaauuuagccgggagucguggcauacaauugucauguccacuucucaggaggcugaggugggaggacuacuugagcccaggaggucaagacuacagugagccacauuugugccgcuguacuccagccuggaugacagagcgagacccuguuucaaaauaaagaaaaagagauuuaaaugaagcgaaaugccauuuucucuaggugagaaacuggaauauuaucaaugucacuucuucccaaauugauuuauaauuuaaaaacaauuuuaguacuucugcagcuuguuuggagcuugauaaaaugauuguagaguuugucuugaagcuuuaauagugaggcagguuuaaaauugggggcaaaaaagaaauggguuuuaggguguagaagggacuugccugaucacuuuugcuagaaauaaaugucccuccaaauuaaauuacuaaugucgcacaucagaucguauuuaaauccauuagaagauuuuacuguuccauuagagcuacccauagcuggugaagacucugcuuauaguggaaccuaguuucucaguuuuccauuuauauuuauuuaccugagcuuuuuguaaaguaguaaguacuugacugaauuucugcuauuuaucaaaugcuuuuugaauagaaauaaugaguuaauaacauuuagccuuuuuugguaaauaguauaaacaagauagggcaaauauguaaacuacuuagaacuuuaucuaccuugcauauuuuguaccucuuauuugcauaugcaugucacaugcuccuuauguaccaugugcuauuacugugccgggguacuggggcuauauugagucuauuuccugucuuuguagacuugauggauaauuuggacagcauugugauauuccagguuuaagagucuuaagguucaagacuacauuaaauguuaauguaguccaacauuucuugaacucugaaauccucugagcaucuuuucaugcacuggccuaaaauguuuucauagcccagcaaaaggcugauuacuuauuucccuccuauugauuuuuuuugagauggggucuugcuguguugcccugucugcuugugaacuccugacuccggugauccuccugccuuggucuccuguuuauguuuuaaauagcauuucucaaaccuauuugagcaaauaacuuuccuguuaauauguaguauuccuugaaagaauugaauuugugagucccuaaucuagacacuuuuaaagaagaaacaaaacucaguaacacauuuggauaaaaaccugaauauguccauuuugggaugaaaggaagcagcuuuguuuaccauguugaauuaaguggaaaacaucuuauuuuaaucaugauugauagaaaucuaaauuuguaaauucugauuuuuauguuuuuuuuacaaugaaaauacauuuuaaaugucaccauccccuuccccaugaagucuucauuacaacuaauuuugaaaauacucucucauuuauuuauauuauauaugcauauguucuacuguauaauuuuaaauacuuaaaugggguuaucuuuuugcauuguucuguaucuuuuuucagcuuaauaauuuaccuugcuuauaauuauugucagugcuugcggaccugcucuuuaugcauuuuuaaccauugcauaaagcuggaaugauggacaugauuucuuuaaucacuccaaauuagucauuuaguuguuuccaguuuuuuaguauuacaaauaacucugcaauaaacgugucuuggguaugcauucuuuuaguuuaaaauagucuuguuccuucagaaaguugcucaauaauagacuuagaaauucuuuugugcuaauuacuguaauugcucauuuuaagaucuccuuuuauuguuuucauaguauauaauccuaaacuguuacaacugaaauaguccuugagcuaagaaagcaauguggcuuaaagauaggauuucuaaauagagacuuaaaaauuaaccuuuuuggagcugugacuuccugaugaaguggcagcacacaggcugaauauguucuacaucuggauggcccaacaucaugaugcugugauuugcgagaagcucucugccugccuaggcugcuggaggauggcaaguuaauuuauuuguuguugggagaccucccccugcccccauuaaaaaaauuauuuugaaauacuuguagauucacaugcaguuucaagaaauaauaaagaguaauuccaugcaccauuuuccuccaauaguaacauuuugugaaacuaguacaguaucacagcuaggauauugacguuaauauaguaaggauauaugucaucaccacaaagguacaccuacuucccuucuaucucuccucucuccuucaugccugguuacaaacuaaccuguucucucuauauaaaauuuuaucauuuaauaauguucuguaaauagacucauaguauguaaccuuuuggaacugaaguuuuuccaucagcauaauuccuuauagauucauucagguugcuguguuuaucaauaguuuguuucuuuuuauugcugaaugguauucugugguguaaauguacuacauuccaugagcauggcaugucccuccauuuauuuaguuuuucuuugauuuacuucauuagcauuuuguaguuuuuguaguccuguguauguuuugguagaguuacacccuaaguauuuaauuucuuugcucauugccaguauauagagauacaacuuauugaacucacuuuuuaguuuaugcuaguuuauuacuaauuaucaauacaugcucaagauaugucaacuccuuuuauuuuuauuaggugucacuugcuacauuuuguggagaauaccgaugcuguugcuagaaagugcugcugucacaaaguggguuuauagauaguaccacgcuauccuucuuccuaggcuagauuagaaguuauuuaugugcuauaugcacauagaguuuuugauuggucuauugcaaauacuauggcaucugaaauuuuuuuuuuuuuuuuuuuuuuuuuuuuuuuuuugagauggagucucccuuuguugcccaggcuagagugcaauggcgcagucucagcucacugcagccucuggcuuccggguucaagcgauucuccugccucagccucccaaguagcugggauugcaggcacccgcaaccacacccggguaauuuuuguauuuuuaguggagacagaguuucaccguguugaccaggcugguuucaaagugcugggauuacaggcgugagccaccgugcccggccccugaauccuauuuuuaaguauaaaaagucuuuuuucagcucuggauuauggugcugcaagcugauauucuucucauggcaguaaacagagaaguccuagggguaaucuuaccccucuggggaguccaggauaucugagcaucucccuuuucuuuuuacugcuagaaagaauuucugcuaguagaauuuuuauuuuggccaacucugaccccuuagguugaugucagaaugagguguaccaaccuagguggucagaguuggccaaaauacacauuuuccugcugagcaauuuagucuagguuaagucauacuugaccauaugcccuaguuuagcguccaguuugugaacauucuuuaccugaguuauuguaauucuaaucucuuauguaaaacugcagguagucagcccuuugucuccuucaguucuacaucugcggauuccuucaacuacagauuaagaauauuuggggggaaaaacaguaaaaaaaaauuacaauacaacaauaaagacaacaaauuuaaaaacuaguauaacaacuuuuuauacagcauuuguauuggguauuguaagcuagagauggcugaaagucuaugagacgaugugcauacguuauaugcaagcgcugccauuuuauugcagagacuugagcauccaaggauuuuguauccgugggaguccuggaaccaaucccccuuggauacugagggaugacuguauuuacaacaugucuagauuuucgacaacuugaauuaaaccagaaagaauaugaacacacagaaguucauguguauauauauauguguauguguuuagaagggagcaagcuguuaaacaugggaaauaguugcuaguaguuuguaauuuuaugauuacaauuuuaaaauucaauuuugcaacuggaauuugacuugauugguuagugccuuacaguaauuaaccuccaaaucaucagaaugucaucuuguuauuuagguaauugaaucuacuuuucuuguauacagaaugcuuuuuggaaacaauacacuguauaucuaguuuguaccaagaacuaauuguacacagucagauacuugcaguucuuuuggacuugaguuucuuuauccuucuaucagaugucacaauucccucuucccuuuguagcauaugaaaguaguugugugugcacuguauuugagaaugucaaguaauagaaucucuagaaaacauucaugauuucagucccagguaauccagaguuaaaaauaauguucauaaggaaggguagcaaaauuuagauuuuaauacuuauaggagguguguuaauuggccccagggccgcaggcuuuagcguucagaggacuuuagccccaaagguuuuguggaacuuuuccagaguccucaccaguacauugggaauaaauggaaugccuuuggaaguacuuugaagauugaauucgauaguguugguaaagcagucuagccugcugugauugugcuauugaugcaaauauucucuagccuguauuauuuuuccuuggagcucaggaagugauccccacccaccucaagcaguaaaggaaagagaggcaggagggucugaccaugugaggugccccaauaaagcaucuguauuguaaaucaggaauguagguauuggguuuccuuaaaacaaagcacaccuacgugaccacuagcuggagcacaaugugggcucggucugcugaaagagucaguugguugcggcugucuaauccaauuauggauggucccagcgcucagccuuucagcugcugccccuccccugcagacucugccucucucacccucccuuuuagggcuuggucuguggcuaccccagaaaucacgugcacuccuaggcuucagcgaguacagccuuguuaaucucagacauggaaagcaaguugccuaggucuacagaugaguauucaguuuccccaccaguugaccucagugcagguuuuguugguuccagucauuuggggucagcaccuguuugaagccaggacacuuagaacaagguggaggaaaaccugaggguacauacagugugguuuccuuggcucaucuaaugcagagucagaaugauuagccacauugcaaauugucuuuacucagugguuuaauuguuaaccagggaguuaauuuuuuuuuuuuauuaaacaaagaagaaaacaccucuagauuuuucugggacagauggccccauugaaagaggccaugugcugcagcgaauggccaggccucggguguggcaagugccuuccagcucagugcuugcuuugugcuccuuugccuauuugaagacguggaugaaucaaaaucuauaagccuauuucagucaaguauucuaaggaaccuggaaacacaggggauuucucuguugccucuaauacagugaaaaaccacugucuuuuuuuguuguuguuguugcauugggggaagaaaguccagguuugcauguacauuuucacucauaggauuuuuuuuuagaauaguuuggggaggacauugugcucuggccaauaacugggccagugucuggucacaagaugaucaggcaggugccugcaugacuguaggacagagaacugggcagcuagagagccuguguggaacgugaagccuuuccccacuuuguugccguccuaaccuuuucucaagucauggagaauugauccuuagacauuccuuaccucucucacccacuugaggauugcucagagccuggguuucggauugaaauagcacuauuucugguuggugacgacauucugugagccagcaauguaguuuaaauauccacaagagcgcccugguuccaucagcgccccuucguaauuggucaugagacuuggaccuccuucggggcugggacucgggcaagggaguugaguagagcuucucuuucugggcuccugggaaggauucauggcauaaaagugggacuucagcauucucugggcacaccugucucuguuuuuguccucuccugaaucuuucuggccugcagagcagaauaaagucacucugugccaaccugacuuuuguucaugacuauauuaggggcauggauagaaagugcccccauagcacucucagauaaaacaccuucaaacaaacccagaaacccaugcucacaaaaccacccaccuuaaauuaugaaacuuucaggcugacuaaauccugaaggcguuggagcgugagcaaagggaaaauggugacacagagcuuugcccuuccuaauccaaaugaaaagcucuguaacccuccccccaccuuugcuaucaagaaauguuggaccuuugggaagcagauguagaguauugauccuuaaaacagagaccucucacccuaggucucuuaaaacagagaccuuaaaacagaguauugauccuuaaaacagagaccucucacccuaggucucuuaaaacagagaccucucaccacuuucuaacugaaguggguuccacauuggaaguacuuugcagaaacuucuauuaccgcaauuacuuuugcaccaacaaauaguauccucaacucagaaggaaagaauuggaacacucagcuggaggugucugguagggacaugugucugcuuuuugaaucagucguauauguuuuuguuccugugccuggaggcccuuuguggugugagaacauugaauuuggagagggaaagggagacaaaagagaaaugggggugaugcuuaagggaaaguaggguuuuuaguuuguucaccacgcuugauggcagauuugccucuggauccucaggccacguuccuaugguggguagggaucucucucucucucucucucucucucucuguguguguguguguguguguguguguguguaaauagugauuucucuaaguuaauaaagaauguggggugaccuccuacacaugcccguaugcuauuguguaggaacaaaugcaugguaggaauggguagacucuaaucugaaagcaucaaguuguaugcaucuucugcaauuaggaaucugcucaccagcacgagugcugugguuucuguaguucugggauucagaggagcauuuuaaagauguaggauguuagaggaggaggugcagggaucuccccuuggguaaagagugggagacagucucugagucauaaucugggaccaguggaaggucaaagggaagaacuguccuguugucugcuaagucacaggcuuccuuccuguucucugagcccugucacuuacccaaggugcagcaacaauuagugucuguuuacacauaacagacaucucuuucauaaaauaauuuuuaaggcauuuguuugguagaagcuucccuguuugggggagucuuuucccugaaugcauguaaauaacuucacaguuugcgcaaguuugcaaacggucuauacugcucagccuugauugggcuacccaaggaugcgcccgcccugcugaggucugacagcucugggaggccagugaggccuguccuaaucccuguucuggccggugauucagcuccagguggaggcugugcagaaacagccccggucaucuuugugugaaauacauuugucgucuucauuuucuuuuuucuucugcugguaucuucaugguuuucagcaaaacuguguacauuacauuuuuuucuuuaccauuucuccguaguuauuucuagcauuuuuuuuucagcugaugaaagcaaaugaagaauuuuuaugcuccauagucagucaaacauugauuucucugacuuuuaacuuagaaagucauuuugcaguggcuugcguguguguauuuagacugugcuucuacaaaaaagcacacguaggcuuauggcucaguuuacuuguuccagcucacuuuccuguucauuuaccuucuuguaaaauggaaagacaaacauaccuuaaacuuaacucagaucgugauugccaacuuuguucucuguguguaaguaguuauauuauuccuagguuauggcaucuugauuuaucuuugaaagaagaaaacccucacugaguugacagggacacauuguucuaggcuucuacaauugugcugaugacgcuuuuucccauuggaaugacagggaugauaaggucggcuggcuagccuuuuuuuaaaauguagaaaaccacaacuuuaauuuauagcaucaucauuuuccuuauguauguaguauguuucaaaaauaauccaaugucagauucuugcuucugugaucaaggucuuguuuuugcccuuucuuugcucaccaccucccugccccugacgccgaguccucgccuuagaggagguggucagcuuauauugcaacauugaaaauguuauaccuuacaaagaaggugauaugccauuucuuaauuauaaugaugugcaacagugacuucugauguagaccuuuaacauugggccacgcagcuuuuucuuuggaggaggggcauuucaaauuggaugaugcucuuauaguuuaauaaagaaacaagcaaacaaaauaggcuauacagggcauguguucuuaaacucugugacaguggaggugaacccagggcccuuucauggccuugggaggguccucagcuuugggggcgaguuaucuggguggaaaagcaccaugggaggaagaagucagagaggcggguugcuggagcucagagaauaaaagcaagucucugcccugaaaauggcccugauuugcuucagauguacucugucugccaacauuuagugucugugacuuagccaaaggaaauguacauuaacuguucaguuucuauguaguuugugcucuaggauuuugccuccggaggauuucugugaaggaagcucuguucaaguggcucuguuccacuuggguuuggaaagaggccgggacaggugauuucgaaggaaggaugaggacaauggaggagaugggcuuggucauugcagugugugagguggcccagcuuaucuggcauuuugggguacuauaugugccauaugagguggguauggguguuugaagggaaaggggguggccugggcaacuuguguccuugccuagaaagaucaucacucuuuuuauuuaaaagaaacaugugaaagagccaucagggauaguuuuguccucccucuucuuacaagugaucauucccuugguagggcagugccagacccugcuugugagcacagaaaacgccauaagcuccucaugaaagcaugucuggggaagcuuaucucaaaugcaguuugcacuugcaaagguccugugguauagcgggggagcaggggagauggagucugggagcggugaaggcugggucacuagcuggcuuuguagccucugggcguguuguuuuuauccucagaggggccacugcaccugcuccauggucucuucccacagcagacccuucugucucugugccucgaggggcuauguggaaagcagagaaagacucaaccagagucuucccuuaaggaaaucggaaggaaaacaaaauuaacggcauuagaacugaguauguauuaaaacuucuacugucuuacaaaauuuaguuuucuuucuuauuuuucuuuccauguugacucaguagguaaauggacuaaacacacauucauuuagggcaggaagaacuucaucauuugauuaccuuuaguucauuuaccuuauaaugccuaaaacaaagcagaaagugacguugguuaaucaaaaagaucacuuucuuuuuuguguucuuuugugcuauugugagaugccucuucuccagcaagcuguaguuguucacaaaguaaagcuguuccuaagccuucauuagauugaagcuugucccagacuuucuuuaaagaaguuugcauagcuuaguucaugcucagaugauucagugaugaugauggguuguugguuagaaauuacuuaaaaaugccuaauacauuauugacugauaaauguuaagacauauucuuuaagggucuaaauccuauucuuguggagcugcaaagaucuugggggugugguugcccuugucuguugcaucaucuuucaaaugcaacagcuguaaugauauucuguaucuugaaaaacuuaaaaaagcaacaacuaacuuauuuguaucuuuuccucuaauauuuaguuuuuacuucacuuguaacuuauuacauguauuaaggaguuuauuuuuauaugacauuuuacucauaaaaggaugaaaccaagauuggugaucuguucacauagauuaaaauccuguuugugaccacuuagguguguaaugugugacuuguggacugugucagaggaagauuuuccaaccaaaaguacccauugguaucacagaugaaaaguccuuauaccaucugaaaaaaaguagaagguggggagaagcuugaaaaccuaaggaggccauuaggaaaggcuguauauuuucugauuccguuuaaaauuuuaaguuggugaaaauacuaugugaucgaaggaugaacauauuuuaguaaauagaguuauagugcuacaaugagauaaauuucacagguaaaugugacguagcuaaugcauaaucauucuuuguguugcauggcaauucuguacaaauggaagguagcauguuuaacguuccuguuauuucacauaaauacagacugagaguuucaguggucugguuugaaagggaagaaauagaagaaggaaggagagaaguuggcagaggagcaaucugcucuaauauccuccaguacacaaucuagcuauagguccucaccuggcaggguuugaggaucagaaugguggcucagguuuagacaauucucccuguuuguggggcccagcagcuaguuaagagaaaaaucuuuuuuccuucccuauuacccuauaagguccccaaauucauuguauguagaauacuugagucagaauaacuuuccuaacacuuagguuucagguuuguuagguaugccugacagcucucuuaucaacucccauuuauuugcuaaucuaaaugaaaguuugaugguagaguauuguaaauguagggaaggugaaguguucaccuucagaugguagcuauuuaucucagcaagaagagcagaugacuaacacccaaauacauaaccauuauuauauaacuuagcauuuauaaggcauuucuaugcauccugagagacuagagcacucucaaaugagguuucagaguaagauuaaucuuugcaaaugaagacaaauuagcaaaaucuuccuauuuuuaaagugugccuuuugauuugauaccuauuuauuuguuuggaaagaagcuuuuaaaaucaaaaccaugaaucugugguuaucuucaaaggauaaauuaugguaggugguuguuacccagguuaccauuuuaagaugauuauggcuggcccaaauuaggggaucuuuucauauauguauuauauauuuuaacuucagucuuuuaaaaaugaauauuccuagguggcaugggagggugggaaggucaaaagcccaaacuucucuuacuuauuggcugcuuccuugaacuuagcguuuuucuuuuggaaaagugagcuuuuguuuuuggauauuuuguacugauacucugugccuacacagauuuuguuuugguucaauaagaguugauauuuugccagggguugccucccaugagauuccaaauacagauguaaguuuaacaggcuucugaacuggauguuucuaugcgcugaaacucuguaaacgcguguagcuuugucuaccauuguauauugcuguauugauuuguuggguuguuuuuuuucuuccuccugaaaagcucuggucuguccucugcugauacaaagacugguccauuccccagggucacugcaagagaaccuccagggccuggccacuguuagauauuacuaaucugugaaguugcuccaaauucucuugccccgaucauaaaguuccauugaguucaauuuuaugugaagguucuuugucaaaaggaauaaauguuuauucaacagauccaguuguugucagcauugacagaugugaaaauuagcaaauagcaagaagucuccccuuuagaaaaggaaaacaaguacuuaaaaaaaaucuuguguugucaauaaacaaguccauuuuaaaagcaucuuugaagguguguaaugaaaauggaggccuuagguuguaucaggguuuaugaggagccagcuuauauguaaucagauguuccuguuacuguuaucacuguaguauagggcuuaguucugcccuuuaagucacagacucaaguuacuccugauuuuaccagcagucagaauacauuuuucuuuaaaaggaaaagagacgauaucccagugcuucucuauacuaaaacaggaagagaagcuuccuuguugaagugacaguuuagauguuguuauuuugacagaaauauuaguaaauaugucacauuaucccuugcuaaauauuuauagcauagaacguauacucugaugcauaauauuuuaugaaagaaauaucuuuugccucaaaucccuuucacuguuuugacaugaaucuauaauuuauacccagaggucugcaggaaaaagacuuuauuaagacccuuuuauuucagccaagauaaaacuccauccuaagagggaacacccuggaaucuuugagacccuuaaaggugggguauucugaaauaccuguguucguuccuuugcuagaauuuagauagcuucacuuuugcaaaaaggcacaaaaugagggcaauuuuugauggaaaauuuuaguuuuugagaugaagcagggggcacaguggcgaagcgcccuaucuuagcacuuagguagcagccguaacaaguguccuggguauuccucccuagaaaggaaauguuggucacaaauggcaguguccucugcauucaguucagcuaugugacugaaagacacuguucuucagcagcugugaguuuacaagaugucgcacauugaguauuuuucucuagcuuauuuagaaacgccagucuagacuuccgcaguuuuggauucguggccauaguuuuggccuuuauuagauggcccucaaagguacuuuucagguggacauugauuucaugccagcugucagagaugauuuucccuagaaauggcuggguauauggagacauucuguauuagaauggagguauacacccaucucuucuguauuagagagcagguguugccccccguggugcucagauugcuuagugugagaaggaaaagaccagugauaagaggaggaaaacugcgccuuccauguagcucaguuaacagcaucaugauucuccaggauggccccauuucuguuuuuauuuacaaaauggacuugagaauuaauuaguaagcaaacugucuccauuagguaaguggcauucugauuugucuguguaaaguuccauuucccaaguaauguguuccaaagcauuuuuauguacaacuacuggaaacugcuguacaaauguuugcugcuauuugguuguaacaaaaucaguaaugaguuucaaaauggaauaauuucagagcccuucaucuacaguaguuugggaaacacuugaaauaccaagugaucugaauucacuacaagcucuccaacuggaaaaugugccuggugucgucuucaagcaagaaucccccgccccuuaaccacugcugcuguggacuugagucuucaaccuuguuuuguagacuuuagcauuuguauugugucauccuugacaccuccccaaccccagccuucccagcuuugauugcuuaccuuagcaaugcucucagcuuggaccagaaggcacggauguuucccugaccuuaaccucacuguguaucagcucaaggaagaagccagauuugcugauguuguaagcacuaaauuauguucauaacauuuaacccucacauccauaagcaaacuaagugggaaaauauugacuauuguagcagucauagauuguuuaggaagcagcaaaaaggcaaauuuuucuuuaaaguucaaaauggggcgaaagaggguaggaaaggaaaaguuuauuaagaaaauuguauacuacauuaauuugacuuugccgucuagacuuaaauuaaauucauguauuuuuuuggucuuaacacauugacauguaucaguaaguuaaaaacuuaaaaauacacaaaugauuagauuagcauuauuauguguuucuuucuuguuuuuuguuuuguuuuguuuuguuuuguuuugagauggagucucacucuguugcccaggcuggagugcaguggcaugaucucggcucacugcaagcuccgccuccuggguucaugccauucuccugccucagccucccgagcagcugggacugcaggcacccgcaaccaccccugguuaauuuuuuuuguauuuuuaguagagacaggguuucacuguguuagccaggauggucuugaucuccugaccucgugauccaccugucucggccucccaacgugcugggauuacagucaugagccacugcgccuauuauguguuucuuauagaaaaucucucuaauuuuuuaauaagcauguuuuuacaaaugcuguuuccugagaacugucgcaccacaugcgacaugccaugcaugcgacuggaacaugccagauauuuguggguggucccuucgugucaccugugccuucuuaccaaguaauuugaaacacccguguaaacuaccuuuggcaaauaggauagcuaaaucaccgcuaagauuuauaauuuacuuuuuggauaucugaaacaucaacaauacagccauccauggcguguuccucuggagugugguccgugccgucucugccugcuccaucuggcugaucccaggcaggcagcucagcucucagcagacacagauccccagcacauaugaacgugaaagaggcuucuccgugggagcgaaguggccagcaggugucacaggcugugugggcccagcaucgugugggcacugugcugggggaaucccaucacagcaugugcuggcguuaguaguagacugugugugucucagaggguccagaaaguaauacaguaaaggcgccugggggugugugggggugguugguugggguuugcuuguuaguuuguuguaaaagcccagcuuuucauucuuggaaagauuucagccaacucgagaggguuaccugccaggaaugcugcagaagcaagaacucagugggugagcacuuccauuucuucaacaaaugcuucugagucccugaccugugccaggugcucuucuugagcugagaauccugcagggagaaaagagauaaagaccccauaguccugugguuuaccuucuaaugagcauacuuuugucgaucaaacagggugaccucucuggugucucugcacacuaccuguauggucuuugcguagcugauggggucuccugacuagugauuggugauuuuaaucuggauuuugccacagcacuuauuuucuaacauaugacuuaauuuacuuaauaauugugucuauugaauguauucuuauacauacacacaggcaugcacacacggacacgaauauaagcuuuacaaggacagaaaccuuaucuuuuauuuauuucuuccuuguguauccugagcacugagaacagccuggcacaaagcagggcucaggaaauguuugcugaaugcauguucacacuggauguguucgaaggcucucacucgcgacuccuguuggcuuguggagagugcaucuagcuguaaaagccauggugcuuggaugucuuggggugcugagccuguuccccccucauuuggggguguggugcuaugcuggcguuuggguccaugccccgcauuucugauggcugccccaucugcccugugugggguggcagaguucuguguacacagaguuacauuucguuguuccuggcuucucuauggaugacagcagcacugauaaaugccacaccugcuuucucagcagucuugcggggugauuuuuccucuuaaggaagucaccugauguccaugcugaguaggaaaugcauccaaagcuuugggagcucaguguuggccccugggcugcagcccgagccccguuuuagagcugugucucccaggcagcugugaugacugcucgaaagcccacucagggggaagguaaaccugaugcccggguguuuggacagugagcauggcgaguggaccguuaccugugcauagaguuguucauauguggugacagauguugggcuguuauuuaguaacuucaaauuguuuuucuuugcgucggagccaugucuagguucugagugcuucucccaggucagauggagagcucuucauuugggguugggggagcggggugguguuuucaggugcccaaggcauuccaugcacaugcaccugcaggguaugugucaucugggguaagacagagcccucccgguuccucuucuggaugugugcuuuuaguuuuuaaagaaugucaguauauacauugccauuuauucaacaaauacggacugagcauucuguugugcugacguagcuacuugggguuacagagacaaagccaacuccauucuccaaauggaaaacaaauggaaacauucuagugguagaaacagacaacaaacaaguagacagaaaauaaugucagacagugguaagugcuaugaaaaaaauacagacucacugauugugauggagacuuuuaaguuggauucucauagaaggccuuucugaagaggggacauuugcccugccacugugaaucagccaugagaagacguggagaggaacaugaggugguaggccccagcgagggaaagaucuccaugauggcaucgauuauucgcuccacaaauauuauugagcaccugcugugugccaggcacuguuccuggugucaggguuauagaaguggacaaaaugaggccucugccucuguggagcuuuuauuaaaguagggaaggggaugggagggcugggucacauguuaggugugggguacaggguacguggugccaggcagguauccggguaccuuuuuacguaggguauucagagaaggucucuagagaggugacauuuggacgaagaccuaaaggaaagggaagggaaaggcgaggagcuuggagagcuuggugcaucuuggugggggaugggguaaacugagucaguuauguagggcccuggaggccacggugaggacuucggcuuugacucugaaaggagauggcagaguuuggagcugguguguacguuaacaggaccaugcuggcagcugcguuaagagagacuguaagggcaaggacagaaguagagagaccaguaggaguaggcuguugccccaguguagggcagagaagaugaaccuuagaccaggaugguggagauggucaguggagagaaguagucagagucuggaagcaccagcaagacugucuggugcacacaggaugcacgugggauguccagugaggaggaugagaugagguuggguggcuggagccuggugagugacaggcagagagggcuauuagaucacaugggcccuggagccauggugaagaauuuggauuuuguucucuguguuggaaaguuagcagagagcuuauauggggggugagauggcauagggacaauguuaauaacagcaacgaauauuuauugagcacuuacuguguaccagcuguugcaacagccucucaaggguucguucugcuauuagagccauguuauaaaugaagaaacugaggcacagagagguuagcuaacuuguccaagaucacacaguuagggacaaacuugacagaauuauguguguccugguauguauuucaguuuucuuuagggaagguaccacaacuuuggguaacuaugccccuaccccaggauuuaagauguuuugaugguugaagggcgauguuuaagagugggaccagagaauauugagguauuaaaaucucacuaaaucuguauucauuauaucuguauucaugguauaauucaugugccucccccuuucgugagccccucaaacaugaucauggauauguuuucuccacccguaaaguacguucauauucauagaaaacccacagagaacugcagaccugaagguuucuuuguaagagcuuucauuggauagcuagaagggcugcaguaaguuuaaaaaaaaaaaaacccaaaccacccuggauuccaggcugcacagccucuaggagguguggguaaucccuuuauaaagcuuggcauaauuucuguuaagacuugcuuauuuugcucucagcuugcuaucuugauauguuugccuuugaggagguuagaguuauugugauuuaaucacagaccauguauuucgcaagauucauuugguaucuccagcuuguuuucuuguuuccucggcugucaguccacaggcagaggugggaggcggccggcaugggggaccgagugugguagaaaggaguguuuacuuagcggaggggagugcugagggcugcuguuaccuucccagaauggcugauccccagcagugaugagcaggcugggaucgugguguuaaauuugguauuuucuagaaauauauagcaggcuuuccccuccaccugccccccuucaagguuucgaagccuuguguuuugcaagaguugagaggggaacaguuaauagcuuggauuaucuugucucuggagagaauuuauguaucaauucaccggaagacugcucugguauuagggcaacaagaaugguuuuauuucucccuuccuuuccugcacucuguucuuauguaauucuuguauuaaaaccauuccugguaaauuagaacaugcucuuguauuugggcccugcuuugaagaaggcugcugagucuaaaaaguuugguagccucucguuucucauggugauuucugagauuucuagggacuugguguuuuacagagcuuguugaguugcacaaaccagccuccuuggcccuucuaggugauaaaagaugcugggcugggagggcagcuguggaaaagggugugggcgagggagacagugcuucauccugccuggaugaagcauguugguuguugguuuauucauaaauuagaaaaauauauuaagaauugaaguuguuccuuaucucauaagauuucuagcaggcugcauaaagucuguagaugguaauauccauuuaaaaguggacaaugaaaaaauuaccucuuugggaguuguguugcuaucucuaccccaauuuggcaaucuuuaauuaacuuggcaacccccguuuuaccaacaaagaacaaccuuugauuaaaaaaaaauaaaaugucagggagugaaagauacggagugugacucagcagaugggaauuccuuuaauaacacgcuggguguuagcguuagaaccgccacugaacagcucugcaggaugcccucccagcccucccuccaccuauuuggauuagaccaggagacugcagcaaacuucucaaggggaggcgaacuugguguugguaucugagcgauugucuguuucaauuguuucccucugucuuggaaaacaccggcacaaaacacaaauccagucccaguuccugcagcugcuggggcgaagcaggcuuuuuaugaaugaggcccagaagggggaggagagggcuuguguuacagcagcaguuggguaauacauuucauucacuugcagccaucuagcccaggcuucauuuuaaaggauauuguucauuuuuggcaauucagauuagacuuuuuuucuuccuugugcaacuguugguaaguuagaacacgaagcaugugugugcauucuuuuugcuugcuuuuuugaguguuugcuccuuuaguugggauaaaugguaggagagguaggaaggcuuugucauccccggggaccuugcuuacuucucccucccagcaccacuuaagagaagaggagguggccucccucuccccaaccucagagcccucaaagcccuugauagugagccugagcacuuguuaggaggugacuucuaccuggggugugcugggguccacaugugccagucucucugcccugcuccccgugagcggcucuuuauuuguggcccuugaggccccauuguuguggccaccaaaaccugaauuggaagcugugugacaaugcuggucccccucccugcacugcuuccugcugggggcagaacaaagagagcgggcauugucucuggcauaaaugaaccucuaucaaaacaaacacccagagagaggggcagccugguuacagcugccugugugagccucgacagugggccucauuccucacaaagggagcuuugaggcccggaagaggccuuuccuugaugaucgagcugugcacagggagcaaaccccaagccgacugcuugucugugccacccucaaacaaugauuuccccaaauuggacagccuggguuuguauccuugagcacgguuuugggaagagcauucugcaugaggcauuguagcuauguguauggaguauaauucuguuuucagguugcucugccacagagguuaagaacucccucuuccaagguagacauugagaacagagacgaccacacuggguuuucacugcagcuuuuaaacaggaugacucccagcccccauccccguggcuagcagcaagcagggacucugaaacacugcaagccaauggacugagcaucuuacuuuugcuguccguguuuugguguuuuguaaacccaucugguaaugacccugaugccccaugucccagcaagggcauagguaccugccauugugcaccaaagucccuuuccucauggcccuggcuguucuccugcauggggucaugugugucccguuaccaaguuguggccccuuuucaaccuugagugccacaucugggcuguuguaggcauggguaguacaagcuggguuuguuacucuaaaaaugaaagggaggaucaguuguuaauaccuuccuguaggugcgagagggaaugaguugaggauucgaucacuguuuauagccagucucggauccugauugugaagucauucuuucuggauaauaacuacuauauccagcaucuugagaguauaaaauaaaggcacauguuguacgucaucucugagauguagcgauggcuuggacuuuggaggcugaugagagaaaacucaugguggugagcuggagcaggguguggcuggcggauucugaaggugcuagcccuaguuuuacagcugaccagggaaggucauugaacccuacagucuuggcccugagagaaccuuggaggacuuaaggauggagaaaggugacaaaagagaugcaagccaacagcaauuuuguggaacaaaguguguacaggauuugaacuuaacucugcgaaagacagggguugcuuguaugcacgaauucacaucugaagaaugcaucugauuguggcugcaauuucuguggacgugcaaacaucuaccugugcauuuuauuugucuagcaucauugaaagaguuuuuugcuugaguugauuucccagguaauugaagcuuacuucucaaagcacaagauauuuuuucucauauauuagcggucuuaagugagugagaccccuaagaauucuuaauuccuuuaucuuacuuuuccuacaggaaacuuauuauguuuuccuagauaggaauugugcuaccaaaaaugaaaaguaaacguaauauguaauguucuacugguaauuguuuccauuuuagguugacaccgaacuaaugauauuuaaauuguagcugacuugaaacacagugaaaaaaugguuuccugcuguuuuuuuaaagcuggauucaguaacaugaagguaauuaaaaauguacagaucucaguaauagacagucauauguugcuuaaugacagggauauguucugagaaaugcauuguuagguaauuggauuuuaucauuaugccagcaucauacagcguacuuucacaaacuuaguugauacagccuacuacacaccuaggguccaugguauagccuguugcucguaggcugcaaacccguggagcauguugcuguucugaacgcuguaggcaaugguaacacagugguaaguauuucugaaucuaagcauagauaaggugcaguaaaaaauauaguguaaaagauaaaaaaaugguacaccuguauagggcacuuacuaggagucaggcuugcaggaccagaaguugcucugggugagucagugagucaguggugaguaauugugaaggccuggauaaauacuguacacuuaggcuacacuuagugaauauuacauuuuauuuauuuauuuauuuauuuaugagauagggucuugcucugucccccaggcuggagugcaguggugcaaucacagcucacugcagccucgaccgccaaggcucaagcgauccucuuaccucagccuccugaguagccgggacuagacgcacacaccaccauggcugacuaauuuuuguguuuguaguagggaugagguuucaccauguugcccaggcugaucucaaacuccugaccuuaagugauccacccgccucggccucccaaagcacugggauuacaggcaugagccacggcgccuggccacaguuaacuuuuuuaauaaguagaagguguacacucuuaaauaacuauaaaaaguauaguaaauacauaaaccaauaacauagucacuuauuaucauuaucacauauuauguacugugcacuguuguacgugcuguacuuuuauacagcuggcagcacggguuuguuugcaccagcauccccacaaacauaugaggaacauguacaucuuaccacgguugcaaugucacuaggcaauaggaauuuucuagcuauauucuauccuuacaggaccacuaucguauaugcacuucaucuuugaaacgcuguuagcugccucaugacuguauuucuauuccucagucaugggcucaccaugcaguacacauguguggucacuggagggaauggaagaacacugaggaaaugcauagccuguuucauauauuuauuacacuauuauuuauuuagaggaauguuaagaaaucuugcuuuuauguaguuuuagaaugccaugaaauaucuaguuggggcauuaucugccauuuugcaagguaaucuuccacuucugaauaacguuacaaguaacccgcguuuggaggacugauuugggacuaaggcaaggaauuuaggaggcacaaguagaggggaagaaauaaacacaugacuuuuguuuuuguuuuuguuuuuguuuuuugaaagaaggacagugguuugcuuguugauucugcuuugagaggauggggaugcacuccagagaaagugaaacggggcuaugggaggaagagagcagcgcacacacagcaccugcauuugauugugaaugcgauugugacuccuuaggcaggaaggagagugcuaagaccgucaucauggacacucagaaaauaccugcuaauccguuuacuggaagauacagggagcugcagauaauuauuguuuuuuaagauggaguuucgcuggagugcaauugugcaaucucggcucacugcaaccuccacauccccaguucaagcaauucugccucagccucccgaguagcuggaacugcaggcgugcaccaccacgccuggcuaauuuuuugaauuuuuaguagagacaggguuucaccauguuggccaggcuggucuugaacuccugaccucaggugauccuccugccuuggccucccaaagugcugggauuacaggcaugagccgccacucccggccgcugcagagaauuuuuaaaauaaaugauagauucucacagauaagaaguacaggauaauuauuugccaaaguuugaaacugccauuauauucaaaggcauucucuuuugggagugguuuuauauuuaagguuugaauuuagaugaccucaaucuugagguguuaucggagcauuacaggggagucuuauauacaugcaggugcgauuuaauuugaagauacuuccauuuaaacuuuaugcugccagaguuggccagcuaagcaaaaagaauucugauaggucuuauucuccuccccaucccacacgcugauuuuuuuuuucuuuguguuuggccgaaacauuuuacauuucucauuuuucacagagcuacuguuucucuaggauuguuuucccugaaguguguacccuguguuugggcagagcagcaagaccagacuuccaaauggcaugcugcguuuuaaugugcuuucauaauugucuguuccaaaagggugccuguguguguauggugugugugugugugugugauucagagcaccugagagcacacugcccguuguccccuccagcccuucugaaaugcaggccacccuuucuguuucaguugccccuuggguggcagucugugauaacucaaggucaggaggaaguauuuguuuugguugucuuguuuaacuaauuaaaucuuuaaucuugguccuuaaaagaaacuaaaauaaaaucguaaaguaguucugauaaguccuugccauaaauuauugcuuuuguaaacgcacauaaaggacucugaacuguugcuacucauaacauuucugacgccaaaugugugggguuuugccauaccaacaaccaguugucuaacucuccagacaccaacugggggccuuacaauucagugcaguucugacacucaccaccuggaguuagcacagacuccacagggaugaggguucagucccacgagucugcccuugcugcagaugcgaguagcagguauggggugcccacacuucugucugacuugccugaaagguugagaguuuguugccaggccccuugcuuucaggucugauaacuugcuagguuauuaaaccugaaacuugauaacuucuguagauguugaaauuagaacggccucacucaccugggcucacaaaauuccagaaaguaguugacguccuauuacugguuuaccgugaaggcucuauguccagaguggacaggacaaguggaagaguggcacagggcgaggugugggggguggcguggagcuccuuuucaggagucucuaagaaggugggacuccagcggcaaugccuuguccaugugcuaagccagccgagggcgcacgaagugcugugugguguccaagcugacuugggagggacaaguuuggggccagccccccagccucccuugucaugucccaccucugcuggcaucugugggcuuaaagugccuucacucccauccuuuucaacuauuucuugauuaaaaaaaaaaaacaaaaaacuguugaauaguaggagacucucucucucauugguauuugugggaauaaauauuaaauaaacacuuucuaauagguguuaccaggacgccuaaggaaauuaucucacagaguuuucaacacugugaaaagagaagcugacugccagggagagaucccuuuuuccuaguccuugugaacaugugcuggacagccaggaguggcacuguggcaagaaacacccguucucuggcauuaguaagagggauauagccaaggguaucuguauaccaguguuaggcccauacauccauaaaacauugaugugagagcuuuagggcacagcugacccuaagccuaacgugaucauuaaugucaugaaaauuggagaauuggucaggcgcgguggcucacaccuguaaucccagcacguugggaggccgagguggauagaucacuugaggucaggaguucaagaccaaccugggcaacauggugaaaccccgucucaaaagaaaaaaaagaaaagaaaauuggagaauuuauaacgucugaugugaccuguucuuuagguguugaaauuagaacggccucacucaccugggacauucuucagcucacgcccuguaccuggcuuacaguugcucagugaaaugcuuucuugauuguagcauggugggauuuuuauaaauccaaaugacuuagagguaggugucacauuuuuagcagcuaaaaucauacuaaucguaaagcucagauuccuguaaguagggcgcugagcacaggcugcauccuggauauaugaauagaugaaccagaucguguacaugugggacacguucuuuguccuuugggacuuucuuuugcuuggauguugguaguaaccauguaaguucgggcagcuuucuagaaacuuuccuuguugugcaacauuaugcaauaaaugcacugcuuugugauaucugagacguuuugguuuucuucagcuuguuugaguuaaauuuagacuccuggcauaguuuuagguuugaaugcauucucugagauaggauaaggaccaaaacauccacucagcagccagaugggauuuuauccuugugcugccauuuuugagacucaugccucuguuucacucucuguaagauggcauuaauagugagggauuguugugcugugagguuuaaaugagcuaaucccugugaggaguuuacagcagggccugggccauagugaaacacuguguauguggaagccacuucacuuuugucauagcuuuguugucauuaguguauacccugucuccuugccguuuauggguccuucuuucaagcagucggauuuucugucugacauaguauaaguuuagaggaaacaauagcagcuguaagauaauaguaauuuuccuucugaaaucauuuuggugaauuuagucagaauaucugauccauaaacucucauuauaaaacauugccuuaugauuggaguuuuuucugagaacaguuccaaugaacaugauuuuuugguggugagguacuauuucugugcaguaaugaaguugugaggacacacagauaccacauccauguuguuugggaauuguuugggaaagguacgugggauagccuggcauggggaagaaugauguuaggguauucuccuugaggagcucagaauaaccaaagguaaagcauuuggugguauaagauauauucaucuuaaaaauaaguugaaaauaauaagauacugggagauguuagccaccgaaguaaauaacuacagugaaauagcucuuuauuaauuuugaaaccuaaaguugaaagaguuccguauuauuugucaguaucuuuauccucuucaaaaauguuuccagcuuugggauaaauugugaauaauuguuucacuuuguuuuuuaauauuggcuauguagugauuuugcauugaacugugauauaagaaugaucaucagccccuugagauuacuguguguaccugugucaccaguggcauauaggggcuuaaaagcaaguaaguuuaauauauacauucauugagaacacacuguagacuguuaggauuuucggugcuggagccauagugaugaauaugacaaggcccucacccuugaggugccuauagucguguggaaccuagguccucgcagggacucuagggcagguauguucuugaaagauuuuuuuuuuuuucuuuuugaagagacagggucuugccuuauugccuacacuggagugcaguggugcggucauagcccacugcaagcucaaaguccugggcucaagaaaucguccugucucagccucccgaguagcuaggacuacaggugugcaccaccaugucuggcuaauuuuuauuuguauuuuauuuuuauagagucagagucuuacucuauugcccaggcugaucuugaacuccuaucucaagugauccuccugccucagccucccaaagugcugggauuacaggcaugagccacugugcccucuguaaaagauucuuaucaacaguuaaaauaagaagcugcucaagacauuuaccuauccugaauguuucaggcccucaaggugccagguagcugcaauauaguucuaguguagaaaagaaaacccugacgaggucuauauauuccaggacucugucugaggcccuuugacacuccgggggcacccugccgugacccugacucuuuccugcauguacugaggauggagguagccuauggguggcacagagauuugcugucuggcuagcaguacuucaggguacuggguggcuugaggaccuccuguuagaagcuuggauucacuuuucccaaggcaaccacgauuggauucuauuaguucugggucuugagagccugcaagggcuuccuucugcgaaggugagucugggagagacgccauggagucagugugaguucugcagccucccaaguuccgcuggcgugagaggcuugccuggugccagggcucugggcauugggaacauugccuggucuaccgggcaagaaacgugaaccaccgcagugaacuggcagcgcguuggcauuuuucccuccauguuuuuauaaaaccgcugaguagacaccagauuauaaauccuguguaaauagucuugaagaguuucuggguucagccccagagaagacugguuuggguuuugaggaauacuucaagaaaauguuuguugguucuguuuuccaacguaaagugcugcacaaggacugugcugugagauccaggagugucuuuucagcccucagugagugccugcaggggacacagcugcuuuggaggaacgugguuccggaggguuucccacucuccauccuaguugcuaaagucacguuccacguauuguguucugaugauagaaugaaagcccacuccccgcacccuggggucuagguggggaaaggagagguguauaugggauagccacgggguuuggcaugagcucaguagagacagcaaacugacccagacagacucccgcuuuagggaagcugggaugaacuaagugaaggugggucaugggagcaaugcugaaccacuuuggugguuacagugaaggcugcuacacacccagcuuugggagguggggcccaggguguccagcuuuguagaaaggcaugguguggggguggcuggcggaggggguggugggugguuuuccucuugaaucucugagaaacuugacugguguacugcucucugcuuuccuaagggguccguagcugugcuggugguuugcuugguaucuguauuacauccacucugugcuucagccuguuuguccaguuacugugucuagugaagcuagcauucacauauuuuagauuaaauuccacacuccacccccaaauuaaaacccugcuauuuaagguaaaaauaauuuuaaaauguuuuauuuuggucucuuuggauaaauuaaucuugaggaaagcaauacuuacugaauguugauguguguauaugucuuucucuuuguaccauacuuaacaggcaaguaacucucuuguaaaaucagauucuaaaugauuuucuuuucuuuucuuuuuuuuuuuuuuuugagacggagucucuguagcccaggcuggagugcgguggcgcgaucucugcucacugcaggcuccgccucccggcuucacgccauucuucugccucaaccucccaaguagcugggacuacaggcgcccgccaccacgcccggcuuauuuuucguauuuuuaguagagacgggguuucaccguguuagccaggauggucuugaucuccugaccucgugauccgcccgccucggccucccaaagggcugggauuacaggcgugagccaccacgcccagccucuaaaugauuuucuuaaguguaauucaggaguuggcaaacuacagcccaugcugccacaucuggccugccacaccuguuguugcacauaaaguuucauugagucacagucauacucauuugcuuucauauugucuguagacaaccuagaauguuagaaaauucuuucucuggcuggacgcgguggcucacgccuguaaucccagcacuuugagaggcugaggcggccggaucaccugaggucaggaguucgaaaccagccugaccaacauggagaaaccccaucucuacuaaaaauacaaaaauuaaccagaugugguggcacaugccuauaauaccagcuacucgagaggcugaggcaggagaaucacuugaacccaggaguuggagguugcggugagccauggcucaugcauguaauccuugcacuuugggaggcugagacgggcagaucacaaggucaggagaucgagaccauccuggcuaacacggugaaaccccgucuccacuaaaaauacaaaaaaaaaaaaaaaauuagccaggcgugguugcgggcgccuguagucccagcugcucgggaggcugaggcaggagaauggcuugaacccaggaggcagagcuugcagugagccgagaucacgccacugcacuccagccugggugacagagcgaaacuccaucucaaaaaaaaaaaaaaaguuauuucucuauguaaacaaagaaaacucuccuuccuuauaacuuguauguguugggucuauuuguauucugugaaccauaagaaauaagucaacuaucagcugggcgugguggcugacgccuguaaucccagcacuuugggaggccgaggcgggcggaucacgaggucaggagauccagaccauccuggcuaacacggugaaaccccguguccacuaaaaauacagaaaauucucugggcguguuggcgggcgccuguagucccagcuacuccggaggcugaggcaggagaauggcaugagcccgggaggcggagcuugcagugagagaucgcgccacugcaguccagccugggugacagagccagacucugucucaaaaaaaauaagucaacuaucucaagguaauuacccuuuugaauacuugaggacaucuuuucugugcccucugaauauuuccuuccccagauaaaauauuucuaguucuuuuacuuguucuuuguuucagaguuuuaagucuccauuugauaaaguauaguuuaauagccuucgaaaccacaucguugagauuuaaaaagcccuccuugagagacaugaccaguagaaaucauaccaggaccguuuagcacccuaacucugggagccauggcucuugggaugcggcugaagauuguguuaucguccugaagcucucuuggacagcugagucaaugacuggagguaggaaaguuccuugaacucuuucuugugcccuuccagcugugagcugugucaccauuguauuauuuuuacauuguuguuguucuugaaaaagcuuuuuuuuuuuuuucaaggcagagucuuacucugucgcccaggcuagaguacaauggugcgaucucaguucacugcaaucuccgccuccugguuucaagcauuuguccugucucagccuccccaguagcugggauuacagacgccugccaccaugcccggcuaauuuuuuuaauuuuuaguagagaugggguuuugccauauuggccaggcuggucucaaacugcugaccucaggugauccucccaccucagccucccaaagugcugggauuacaggcgugaaccaccgugcccggccaaaaaagcuuuugaaaacuucgucguauaauauuauggccauccuuccaaacgugaccuuuuuauguuguauuuuaucuaacuaauuugcccuugcccccaacuuuuaucuuggaauuucuuacguauuaauauacugucagggucccugcuuggggcauuguccuugggcuugucauuagauaacuccaaguuggcuugacuccagaggagcugccuucacacgugcugugaaauguacuguuguugaccagagaccaucguuaucauuaaguccacaaaccugcuuccugucucuuaggcuguuccagucuucuaucgaaaaacagugguuuaaguggcuucuccgauagugcuggugaauuggaagcuucucgucaucccccuuggcuggggcgaggcuuacuuccuggggccuuggcaguuuugaucuaacugacuuauguuaccuuucuguauuaaucaagccuuuuuauuuuccauacuucugaugcuuugacaucuuggggccuugcugacccugaagagaccagccccccuaggguuagccaguuccuagguagugaaugaguacaaugcucauaugcaaaauaaccaauccaaaggccacgccccucacucauaugcaaaauaaccaauccaaaggccaggccccuuaccaccuuuauugggauuucauacuccaggccaauauugcccuaccuuaaucacccuagggccagauaccaggcaagagacagccccuacaccccagagccugucagaauuacuccagccagcuaguccuaaaccugcuuaccuugugugauuuauuccuucccaaggaaaccacaauaaaggcucuccuccauguuuuccuaccauucccucugccucaggaccaaccuugguucuucuccguguggccccuuggcauggugcacuaccucuucuuggggacugugaguaacagacuuuuucaguggcaauugucuuuuaacuguuggccucaccguaccugaauagcaguaaacccuacaucuuaaaauacuuugagauugucacauacaguacccagaauaggugaggaugaaggcaauuuacuggaugcagagcggccccaguccauuccuuauguccgaaugcuaagacuugagaaagguggagaggagccugacuaucaagaguugccuucuuggaugaagugggcugaagacacacgaaccccuuccauuaauacaucuacauauuuuccaccauuguaauuguauuaauaauuggagaaaauaacaaugacugucaacaacaauagcuuaauccaguagagaugagguccggaauagguucuggccuaccucaguucauguuuuuuacuuucaaugcugaagcacaagcaaaugcaaaagcuucucuugaauguuuuguaaauugugggauaauugagguaugugacaugguuaauaacccagugucugcucauugagcacuggguuauuaaccauacauagcaaauggagcacaucaucguggguugcuugcgucacuagauccuguugcaaaaccaagauucaacuuuaaaauacauuuuaauuuaaguuacucuuucuggcaugaaugauacaucacuuuggagcaacacuuaccaggcagugaaagcuuuuuuuaaugcccuguguagcacugcuuucggugcccuuauaugauuuggauggauggauggauggauggauauagccacagggucuugcucuguugcccaggcuggagugcaguggcaccaucauagcucacugcaaccucaaacuccugggcuuaagcgauccucaaccuccugaguagcugggacuacuacagguaugugccacuaugcccagcuaauuuuuaaauuuuuuguagagaugggggucucaccguguugccgggguuagucucagacuucuggccucaagugauccucccaccuuggccuuccaaagugcugggauuacacgugugagccacugugcccagccuguuuauaugguuuuaaaaacaaaaauguauaugcucucaagauggcuuucagagagcuuauuagugucuuggccauuuggaauuccauuucacuuaaauuagaagagugaaagagaaaugaauggaagaccaaaaauggggagaagaaauuguaucugauauaagcguggcucuaccugggagaauggccauuccgaauuacuggaaacaggaagaagacuugcuaugaugcuuccuuauaucugugggggaaaaucaaacuuacauucugaaaggaaacuuaauacuucauguuuuuaaacacaaaaggauauuuuuucagaguagcaguuauaaaguuguuaguuuaaucuuuuaguucagcuuuuuuucuuaccagaaaaauaauuaguaguacaaaaauuuaugcguuuguuuuagcucuauucugauacuguuaagaagauacaugacauaaaaacaggaauauuuucagucagugauuacaauuuaaaaucauauucgaaauuuaauaaaaaguuuaaaagaaaucaccagcauaagauguugucauuuggcucuuggggcaaaccagcucucuucuggugaaagaacuuucuggaugaggucgaaaggcaacagaaaaccuggggaacaauggcugucuuuuuaaugggaguugcuccuauuccuggugguaacaaccucuuccuguugcuccuuuccgaauggaauugccucagugaaguuguugaagaagugaggagggcgaaauaugcccauccuucuacaguggggagaggccuggcgcaugaaagcaggccuuuguguaugccgggcugggcccaugcaaacagggcacaaucaggcuauuguuuguuugggaaaagcuauggcauccuauugcaauuauuuauggaagaaaauauuugauguuuuuggaagagguuagguguggggggugaugagggagggaggaaagagacugggcuuaccucuugucccauucacuccaaaucucucagugcguaggauaggguccaucugguccaaaggagaguuuugugugacucuguguguuggaguguuuucgaaaugcagagaaauucagagcuucucuagcuuuggcuagagaaggaacaauggaagugagucuuauucuaccuaaguuugauguggggcagccuguucuguaguugccuuccaagcccuucuucuuucugaugcuuucuugguaccauugcccacaugcugccuccacccuggaugaggucuagaccuguuacauugauucucaacuaauuaaaagucaauaugguaaaauauuugcagcauuccuucuccuucccuguguucauuucugaagcucaacagucuuccauacucaagcuguggggaggucccuuucuccuuugacaccagccauuuugugaucugcccuuucaggccaccccagccacccuacuuucccagucuugccucugccuacuucaccucuucucucgaaccucagaagcuucuggagucuucacaguggcccuaaucaugggucucauccuuguuuuccugucucuuugagguuccagcagccagcuuugccucaucaggccuuucucugaaauucccaucaauaacuacaagaucugcccaguaccuugugcauaucaggucucaggaaauugugaguuucuuguuucauuaaacauuuuucuuuccaggaaucaucauucaucgcauugccauauguguccagaucccccuuuucagggagccaguaauucgaaagcacuugccuguguugaauaugguggaaaaaacaaaugucaacccuagccggccaucacuccccaucggcccaccccauucucuugugccaguaggacuugccuguguuuucuuugggcaguucaaaguugggcucuugagaaguugccuguaaauucaauugaagugaccagaucucauccuuacccacucuguagcugcagauaauaaacacuggggacuucccuugugccuguguuuuaauguaaccuuaagacuugaugcucccuggaguguaagaauaugaauagcuacucgcuguggauauugcaguuaauuacuccuuccugucccaugugguccccagaggaauaugagauugccacaaacauggcagcuuucuuuggggaggugggagagggagaugaaucuuggggcaaggcacauucucauaaccauguggcuccagaaagcugccugacucagagaauggcuauaaaugcccgguuguauggaucugagauccucaaagccagguucauucacuuauuuauuaauuuaacaaacauuaggcagcuguggugcucugucugcuccagcagugaucaagacagaaaagauuucuucaaugcugcgugugguggcucacaccuguaaucccagcacuuugggaggccaagacaggcggaucaccugaggucaggaguucaagaacagccuggccaacauggugaaaccccgucucuacuaaaaauacaaaauuagcugggugugguggcccaugcuuguaaucccagcuacucgggagucugaagcaggagaauggcuugaacccgggaggcagagguugcagugaguggagaucaugccacugcacuccagacugggcagcagagcgagaaucugucucaaaaauaauaauaauaauaauaauaauaauaauaauaauaguaagaauacugggguggggaugguaggaugcacaguaaagagaauaauaagcuagugaugagcaucuaagaagaaaacacaaaacaguacugucaucacaaugcaggagugcuggguugggggccaggugugguugaggggugcuguauuacgcuggguagucauugaggccucugugaaaagguggcauuuagacuaagggagauuggaagguccagccaugggaaguucaggagaaaggauaagaagaaaaagcugucacaugggcacagacugaugaccagcaaggcuggaacuuggaagaugagggaaacugagagugauugucagcucaggcugcuuugacaaauuacuguagccuggguggcuuaaacaauagacauugcagcauucccucucccucucuguguucauuucugaaguugaauagucuuccauacucaagcucuggggagaucccuuucuccuuucacaccagacauuucgugauuugcccuuucugaccaccccagcccuacuuucccagucuugccucugccuacuucaccucuucucuccagcgucaugguuggagaagcauauucucaugguucuggaugcugaaaguccaaggucaggugucaacaaggucugguucuagugagggcucucuuccugguuugcaaacagcuaccuucucacuguauccucauauaguggugggagagagcaagcuguggugucucuucacugauuaaggacauuaauccaauuguaucagggucucacccuuaugaccucauuugaucuuaauugucuccuuaacagcccuaccuucaacagagucacaugagggguuaggguuccuacauaugaauuggcaggguggaggugggagguggccggggaugagacacaauugauuucauagcgucgaguuauaagaugggucacaguauuagaugggaccagagcagagagggucuguaggccauggcaagagugagaauuuacucaauacacaguggaaguuggggaugagugagaagcacaagaguggcacacugauuucuacaacagucagucuagcugcuggguggagaaggggagaaggaggaauaguggaaaaagcagggagaccgcuuaggaagcugcugggaccgugcauaugagagauguugguggcuugaaccagugcuggguuucucagcauuggcaguauugacauuuugggugaaauaauuaguuggggaguggcagggcgggggguaggggugcaguccugaaccagugccagguuucucagcauuggcacuguuggcauuuugggugagauaauuaguuguggggggcuguccuguguauugcaaaauguucagcagcuucacuagucucuaccugcuagaugccagaagcccacccaccccgcccccuagucaugacaaucaaaaauguaucuagacauugacagauguuaaccugggauuaggggguggggagaccaaaauuguacccuguugagaaccacuggaccagagucauagcaauuuguaguggauagauuuaggaauauuugaagacuuguaaaauauagccugaagggaauggagacugggagagugaaagauaccucugagacauuuuggcuuggacagaacaggggguggaggcuuccauuccugagcugcaaaggaguggggagggaggagcaguguaguuugggaagugugugguggagaaggcagauggggcaggagcucugucuugcaucucucaggucagaaaugccucagacauccagggggggcaagcuaagauggaguugaacacagcaguguagggcucaggggacaggccaggaauggagagaaacauuuggcacucaucuacuuguagcuucccugucgagaaaaaugaaaucauccagggguuuucaaauucaguggucucuggaccccuucacacuguuaaaaauggaaaacccugccacugucuacauguuuauguugccccaguaaucuaugcauugaaaccuaaucaccaugugaugauauuaggagcuggggccuuuaggaagggauuaaaucgugagggugggggaccuuuaugaaugagauugugccuuuauaaaagagagcugcuuugccucuucugcuagaaggugcccuccgugaaccagaaaguggagcccucacaagacacugaaucugccagugccuugaucuuggacuucccagacucuagaacuguaaggaauaaguuucuguuguuuaaaagcuaccuaguuuaagguguuuuguuauaggugcccagacaggcuaggacaaacgccaauaagcuuucguuuauguggguuguauccauugauacuugcuguaugaagaauuaaaauuaauaacuuuaaaaagauuuauugauucagaaacaguaacaaaacuuaauaugcguuaacguacuuuuauguuggauaaaaacuauaucccaccccaguauaugaauagaguggcauuguuuuauguguuuaaucucuggcuuaacagaaggcaauuggaugaucauaccugcuucuauguuuauucugcugccaauaucacacagcuucuggaaacuuccacggcacacauucaugagacaauaagaguuaaaaagguaaacagugucuuaguaguguaugaaaauaguuuaaucucauagacccccugaaaaagcugcagaauccuuacgcguucacaaaccacacuuugagaacuaaagaucaaggaguacaguuuucucauuuuuaugcuguucagagugugguugaaguucagccaucacuaguccuucacggauaguucauaccccaaguugauggccuuguggaauugcugaugcuauuuucauauauauauauauauauaauucuagccuuuuucucuggucuuauaagagucacauacguagguaauuucauauccuacaaauauguucuaaacagcagaauauuccaggaaaccuuaagugauaacugaguugaaagagucauauuuuuuaagcaauacaauuuaaauaauuuuuaaaggaaacauuucuaaaggacguuuuacauugcuugcauuaaaaagaauauaaugaacauaauccaacuuuuucucaauacucagggucaucacugugaaaguaacuucauucuaugauaagauaaugaugcucccaggugggcaaggcaguuuuucaucuaagguaauugagacaccuuuuaaaagcaaaagauaaauucacagacccucagugucauuauaaauuacuugguauaaagauacuuaaauaccuacagccuuauaaggccuaggugucaauuuuuuacgcuugcagaucuuuuacaacuguaaguuaaaugauuuuacacauuaagugcauauaaaacaaaaagauucaaacccaaauauuaauuuaaugacauggguaauauuuugcuaaaaguaaaccacugcucagaaugugaauaaacugaccucgaaggccugaguacguuugaauuacggaacaccucucuuugacaucacaauugaauuuuuucuuuaaguaucgcaaggccccaguucacggaaguaccacaacauaaauuggucuucacuugguaugugaacacauauuuauauguuaaaugugucuuuucuuuuugguguacaacagcuagaguaaugcaguuugcuugcaauguguuuuuuauguaaaugcugaugccgaauccacuuggcagcacugaguuacaagaagguuaaguagaugaacuagaagauggauaaacgaagauagauaaaaugaagaaaaacaaaaaucaaggagaacucaggcguccaagaguguguaaacaacuucuggugugagacgcgcuacauugcgcuaaauggccugugcgcuucugguuuuucccuuccucuguugauuuuuuauaguugucuuuuauuuuaaacacgccuccccccccccuuuuuaaacugauuuuaccaucacucucucuagcccugccucccuagaauuagcugcuucuuaccucccuuggaucuggaacuuaaauauuaacguguauauaaguuaauaguaaguagaccgugaauuuagaagaguaaaacagaaucaugaguacguagucacuguggccccuuuucugcuggauuucaaguucguaagcauuuuuggaagagagucgaaggggaagggguggcuugccagucaguugagugaugcgugagggaggcguuaaaugugcaugaugcacuaaaaugcauguuucgagauccaguaugacugcucuuccauagaugaugaaaccaaggcagagaaauaagauguaacucucuuaccuugauuagugaugagaaugggacagcuuuauucaugaaacccggaaaccacuagcccauucuugggaugauugauaucugcaaggaucuucaggaauagaguaccuggggcucaggagccaagacuagaaguguugaaaggugagcaggaauuagcugcuggccucagacguggagagacacacggguguaugugugcacacacacacacaggcacauguauauucaugauggcuucuuaauucccacuccaggccaacucauuucccuuucccuuccacagguacuuauaccauaaaagguauaugaagugcuaaaauacuuguagguauguugucaauaugagcuacucuguaaaugauaaauaauaauugacuggugagucuaggcaaggcaagucaaugagauuacaagaaaagagauguuaggccuucagaaagauggaaauuucucuuugucccugcagggacuguugcagagcauuagagccacccucaaacaguuacccagugagucuccucaaagcaaguggcacugagauacaaccuuccuacagguuuucaagucaucucguguggugcacaguccucgcccuaccucgaaggcccgggcgaaguuuuccugaguguguauacucaucucuuuguguugucucuggcagggagcaagugaguacaggauuggaguaauaggcauuuuuaggcuugagauggcuuuguguguuugguuaaugucacuacauuuccuaggggauaauaaaagucuagcaugauaaaagaucucgucuuacaaggucccgauguaaaguuuggagccuaacuuagaauuuaaaauaaaauacauuuugacccauuguauugagagcugguauaauuuaauauagugagccccucggcuucugguugguuggguuauaaagcuucuuauucauucgcucauccauuaaugcauuucuccuaugaggaagcuuuuuccuuugagcugaacacacaaaauuaaucgugcucgaacucuccaaauuuugugaguucccugguaacugacuguauggaagacagaaauaaaaaucagaauaaacuuuuauuuucugaaucagaaagcaguugcuccagcuuuugguggucacauugcuaagauguaaaaaacagaaguuaggugaaauaaauuaagaauaauuauuuuggagaaagagaggguaguguuugacuaaauuagaaacauucucugagucuuagaagcgugaaugauuuaaaugagguuccagcauaguauugcaugugguuucuauuuuagaguuuucccacuugaaaacaaacuuugaggauuuuuauugaaguccaucaguuuuaacuuacucaaagcuuagcagccaccuuuugcuuuucuucccguuccccccaccucaugcugugaagaaagucauacaccauugugguguugauugaaaccuuuauuucuccaggucuccucucauaaacugggcuaagaaacacaaaggacauuugacacuucaugacuacauaagaugugcuguuccucucucuuucuguuugaaagugacuuggcagggugaaguugagaaccccuuggaaaggaggaagccgaaaugcaaacaaaguugaaucaugaagugaugucacucugaaccaauuggagcaguggugucaugugccuggcagcuacuucaaaugcccacaaaacaggaguaaugguuuaagcuguuucccucuuccccucccaccaccaaucagcagcagacugcuagaggacagaugcaaaacaguuauuagaccaggcuuaguuagacauggaggaugcaucuuaacaaguuaguaccuuuuugcaaagcaugaagacuaauucaaagucuauuuucugguuuugcucuaccaguacggccaaaaccauuucuuuuuaagugagaaguggggauauggucagguuugauuccaguugaaguugugagcugcacagggcuggucugagcccaguggcaucuuuccaggugucagagccaugauuuuaagcuccuguuaaauucacagugcuuaguaaccauaacuucuugguuucaugaucauagggguuuuugcauagcugccacccccauuuucuguuugugauccaguaguuaaaacucccagaaaauauuucucacccugguuuaaauaaacaaaacagccaccacaaaaacaaacaaaaacuuggcuaaccacuauuuucaggcauauucugagagagaaagagggggaaaaaaagacuagacauccuaaaauuaagcaacauuauuuuuggaauuguguuguuucuuauacucagucauuugugaaugaugugguucaaacaaaacugaaacaaaaauaguuuuucucauuaaaaauauguuugucgcauagccagcacucggaacuagggaggguaacauggaaguauugucauucucggggcugacugguugacagcagccuauacaggaguggagaauauugacagggcugcccguucuccccaggucgaagagagcaaaugcacaucccugugugcacggccaccugguuccucuccucacuugcuggugaguauugaacggcucacauaauuaggcagaacucaggaacuuuccucccuaucucuuucacucuucugaaaugcccuuuauguuuuccucugcucuuucagucccagugccuuuucucuggugcagccucaugguucggucucaccuucagcuuuuccuucccuccaauacauccuguaaauuauugucagacuucuucuuaucuaaauaacucguuuagguaagguacucauauguucaaaauaccaugguggcucccuguucucugugaugugaaguccuaaccauuagacucagcuuucccccaggacaccuuggcuuaucuucuugcugcuuuccagaggcaugggccauuaggcugguuuucugaagguucugccaaaaggcugggcccuugucucccaccccacugcuguuacucauguguucucccacuugcucggcauucuuucccaugcuuuuuccuugaucaucacuuacuagcuaacaucuauuuuuuccuaaacacucuguugcaguuguagucugcagucacucuccuaagacuugaucaucuauuacgcuguuucguucuuuauuuuuuaacuuuucuucuucuuuuuuuuuuuugaaacggauucucgcucugucacccaugcuggaguguacuggcacaaucucggcucacugcaaccucugccuuccggguucaagcgauucuccugccucagccucccuaguagcugggauuacaggcacgcgccaucacaccuggcuaauuuuuguauuuuuaguagaaucggaguuucaccauguuggccaggaggucaggucgaacuccugaccucaagugauccaccugccuugaccucccaaagugcugggauuacaggcaugagccaccaugcccgguuguuuuguucuuuaauuuuacaaacuuggcauagcuuagaagaccauauacaguggcaccauauacaguggcaccauauuaguggcaccauauacaguuuucccugagaaaacugguaccucccaacagauaccaaaaucugggaccaccccaacagauaccaaaauccacagaugcucaagucccuuuuauaaaauggugugauauuuguguauagcccaugcucaucuuuccguauacuuuaaaccagggauccccaaccccugggccacagaccagucccgguccauggccuguuaggaaccaggcugcacagcaggaggugaguggcaggccaacuagcauuaacugcaugagcuccgccuccugucagaucagcagagguccuagauucucauaggagugagaacccuauugugaacugaacaugcagggaaucucaguaaugccugaugaucugagguggaacaguuucaucccaaaaccaucccucucccccacccaucuguggaaaaauugucuucuacggaaccgaucccuggugccaaaaagguuggggaccacuacguuagaccaucuguagauuacuuauaacaccuaauacaauguaaauaguuguuaucauguauuauuagggaauaaugacaaggagaaaaguccauacauguuuaauacacaagcauccuauuuuuuuuccugaauauuuuugaucugcaguugguugaauccauggguguggagcccucagauauggagggcaugcuauacugaucaccccuaugggugugaauguugggcagauccuccagugucaccagccauguggccuuggugaccuuuccauacuuuucaaucagaaugaugaucuccaccucucaggaaaguuguggggaugaaaugguauagucuguguguguagaguuguuaggcuggggccugccauguuaaaugcccaugaagcagguaauuaugguaguagugguugauaucuugaaaucagggggauucccaaauuucuaccccaaaucuggaugacugcauauugcgggaguucaguaaauauuuguugcacuaauacuuaugugcauacgcugaaauaaucuaaauauuuaaaaaccaaacuaacgguaggacuuuccucagggauuuaacguuugcuguagaagacugaaugauagaauauauaagcuguauuuuucuugugauucuacacauuguccauguugcaacuuaaauauuuuuggaaugcaauguaaaagugauuuacuguccuauaauuguuuuccugaaagcaaaaugauauuuaagugaacugcaaugaaaaaugcaacgacuguaauuuaucguugaagggcauuuucaaaguguauagaaugacuaaagcuuaaguguauuaaauauucuagaggaagacauauuuaggcuauaaaucuagacuuccuuuggaauuuguuuccuuuuucucagccagguguaugaagauuuuaaguucuuaggccucagugggaagaagauuuaagguuccaagaguacauuuguaucucuuuuaaauuuucuauuguuuaucagugacauauguaaauguuuuagggagcuguuuacuguaacauuaccuacuuuagcucugugcaguugucuggcaaccaaugugauaaagacagagggaagugcuguauuuuguugcugacaaguauaucuuaaaagugcaggugcaccugaauaggcaauaaaguauuaagagcugcuccuggagcaguuugcucucugugacgugugaaaagucuacgggguuuauaauuggucuggccauacggcugccuaggauuagacucuuuucauaucccacuaaacacucuccuuagaagcaagcacaaggagauaguuuauuuuaaaauguaauugcuauguuacuaagauuugaauuugaguaccgagaauaaaccauauuucuguuuagaggcugguuggcuuaaaauugugucuaauccuuccccugccccccaacuccgaaucagagaaugaauaacaaauaaacaugacaaugaagucucaugcuguuguuuucauauuuguauuuaggaguuucagagcaaaugacuuggaaaacaggcaaauccacugacauaggcauuuuuagccaccuuggaauccgaggagggauucugcacuaugcccuguaaccucguucacaugccguuugaauguauaccaugaagaccccuuagcucagggagcuuugcucuauuuaaguaauguuuauauucuuaaugaaccaaagaggaaguggucaugggaaaagagccaggacuagauuucauucuaaugcuuauaaggagaguucuaggaaacccucagacuugguaaaccaaggcauuuggagauacuaugaauugguuuaaaaggccauuuaccacuucuuuuguaauuggccuuuuaaaccaacucucacuuagcugauuaaauguggucauuuaaacugcuaguuaacaaucggaagugcaguggcgcaaucucagcucacugcaaccucugccuuccggguucaagcgauucuccugccucagccuccugaguagcugggauuacaugcgcacgccaccacacccggcuaauuuuuguauuuuuaguagagaugggguuucaccauguugguuaggcuggucucaaacuccugacgucaugauccaccugccucggccucccaaagugcugggauuacaggcaugagccaccgcgcccggccuaagauuucuuauugugguauucugcaguggagaaugggaguuggaaagaaauguuuucucccacaccugucccgcuccugucuacugaaagcugauuaaucagucagauagugaguuccuauugguaguacgccuccaaaauuuggaagaggggagguggcgugaugugaaaaagcaaggcuuuagggagagauucccgcugggggcauucacccucugguccagcgugccuguuacagugaucacuccauagugguuuugcaugaacaagacugcccaguuugcuuaggaagaaaacaaaggacauaagguaguucucaugucuucccagcacccuaaauacucgggcuaaacuuccacagucagaccgucagcuucaggaagggcugcuguugggaacuuuuuuuuuaguuugcaguuaguucagcuccagccaaaaaccuacaaaaagccacugcaagcccucugccugcucguauaagacaccuugguugggccccugugacuguccauccauaggaugguuggccauugacugcacagagagguagggcaagauaaaacgacucauuuguggaucugacuccuuguacuucuguuuggauucaaacagaggaagauagaguaguggccuugggaaaccguggagagagaaaaggcauagucagaauguuuucagaggagcgcagacuuuucaaaaccccucucaucacguucccacugaccuucaguuccagugcuguggccacagggugucugcaccccaacuucuuugccaagaaauuaaugaucugugaagacacacagacaugaggcggacuuacuauuuaaaggaauccugaaacgaauauuuuucugauacauauuuauccuaauauauuugcugagcaugguuuuuuuuuuuuuuuuuuuccuauuuuggaguuuuuggguuuuuuaagccuagggaaugccuaauauguacuguggagugcauuuguucauuuauaucccagugcauuguaaaaucgagcaauucagugccuuagaauccuuucugugaacuugaugcuacgugaacuacuugagaacaacuacuuucaagcccuccgaagcacucaguuacaacugucggucuaauugcacauuauucuaauucauuaaaaaaguccccaagggcuucuuaggauacugcucuauguuauuagaaguccuuccaaauagaaaaacuuuauuaauuuaaaaauaaccgccaauucagacuucgauucaaacaaggcauuuuaccaaguccggcugaaagagcuucuuaccacaucuggcauguagaauggcagaagacuauuuuugcuagauuccuuguugcugcagccguuucugauguccuuuuccccuucacaccuuucguguuacacaugucugagaugacaugaugcuaaguaaccaaaguacugcugcgauggaauugcucugauguuuuuuuccagagugaaagcugcuauuacuuuaaaaaaaaaaaaacuugagguuugguuucuuucccccucuauccggguguuauacaaauauguaauuaagauguuuggggguucagaugacaaacaaggagucuacuucuaagaaugcauuugcaagccaaaagaguggugaaccacuucagagugcgggucugugggggaugaugucugcuuugcuucguuuuguggaauaauuuuuaacauuucuauuuagcauucaugauacucuaaauagaagcaggagaacacuguggcucucggauccaggagaggcaggccacgagggcuccugcuguuuggggacagucuguaacucuaaaucuuuuuauaugcagcaauuaugaccuuaaaaaugggugacucuaauacuggcauucauugccuaaaaauaauuuuaaugugcaaaugccagagaccaggucaucucagaaauggacuagaauugaccacugcuauguuuuggugaaaccugauaaccuugcuuuucuccguguaccuuguuuuucauuguaaaacuauuuaauuaugaaaaugagagugugaaaggcaaaguaugauugaauuuagggggcaguuccauauaguuguaacaaacugauuaucaaauguccaccauuaguauguuaaaauacgguuuucuaauacugagacaacagggauggagcagccuauccacugaagucuuguuguuugucccugcugugucccaaccuggaaucucuuucuucuuccuucagcagacccuucgagaucagcuuaagcuucacugccuuagagaaacuuuccugucuaccuggacugucuucuagauuucuagagcaguguuccugcccuuuuccuuucuaaauggggugggaguucucagagaacucaucuccuuuauggcuuuauccaucacagccacacagauagguucugucuggaccauccuuuucccugagcuuucuucuccuuugccauguguuuucauuucugccagacacuggcacuggggaagccucccaucgucucagacucagggugugugaaaaacaaaccugcuuucuggacucuacaguuugugcacuagccuaagccgaaaaucuugaaaucugucaucagugacuauuguaguccauaggaauacccaagacuggguaauuuauaaagaaaagaggguuagcuuuuuuuuuuccggcucaugguucuucaggcuguucaagcaugguuccaacaucugaucaucaucuuuuuuuuuuuuuuuuuagauggagucucauucugucacccaggcuggaguacaguggcgccaucuuggcucacugcaaccucccacuucuggguucaagcaauucuccugcgucagccucccaaguagcuaggauuacaggugugcgccaccacacccagcuaauuuuuguauuuuuaguaaagaugggguuuugccauguuggccaggcugaucuugaacuccugaccucaggugauccccccacccuggcuucccaaagugcugggauuacaggugugaaccaccacgcccggccaggaucugaucauuuucuaggaggccucagggagcuuuuauucauggcagaaggugaagggggagcaguuguaucauggcaagaagagaaagagagacgccagaucuccugguagauaacuaacagagugagaacucacucuuuacuguggggagggcaccaagcccuucauaagggauccaccccaugacccaaacaccucccaccaggccccaccuccaacaaugggaaucacauuucaacaugagauuuggagggaacaaacauucaaacuauaucuacgaccaaauuuuccuaauuccuuucuacuuaaaugcuuucuuuuccauuuauuucacccacaucugacccuaggauuucaacguguucuaaaaugaauuucuugcacccauuuucacuuucucuccaccagaauccaucucaccacccaccugccaguggcauacuccuugcauagacccugcucuagcaugaauauagcccacuguuaucuguuguagaaccucacgcccagcuucccacccugugugacaucuucacccucuugcccuggcuugugccauccacauuccgaucuugaugacucugguucucuucucuuugacgguggaggguugaucccuuccuuccccaugaucauaaaaggucaugccaacacuccuaaaacaaaagauagauuaauaagagaaaaaccuaacaaauuuauuauaugugugcaugggagucauacaaaauaugaaaacucaagaaaauggccagaugguugauccuuaaaugcuuuauuuauuggugagaagguauuggggguguaggaguaaaugauuuucagggaaaaugaauauuucccugagacagcaauuuacuuguaaaugaugcucuuuagaauuugaacacgcuccagaggcagaaauugucuugugaaaaagucugucuggguaugguugcauuccucagucuugagcugguggauggcagggugcaauugcaggccguaguguuccucuuuggggaucugguuucuagguggguaagggaacuucagagaacagccuuguccugugcuuugcgagagacaaaggaugaggaaggggggucagggaccuugaggcugcuucagcaugucaagagugccauguuugggacgccucaacacuggaaauagccuucauuccucugcuucuugggucuggauccuuuucuuuagacuccaagaaauucuuccuuuugccccaaacucacauuguuuuugucuucugucccucuacuucuauguaauucuauuauuaugcacagauucugugugcccaaggagacuguaaacuccaggagggcaggaauuaugucuuaaaacacuagcgguuaaacaguuaagaggugucuuaaaacauuccuguagccccagcuacacucuugggugcaggaaucacaagugccuuauuccccacaggguccccagcauauuccaggagcucauuauguuuuuaaaugaaugaccuacugaaggcaagagaccaggaaggaaaguuuguaaaaguuuacauuauuagauuaccccugagauguguaaccuucucacgaguuagauuucuugaaccacugcccggguauuguauuccuacucuaggagcuugaaggauuaaugauaauccuuuuacagauauauucacaaguuucugugaaugugaauuaaguauguagaucuugauugccuuucuugagugcaugguuuuuuucuagaaaaacaaauuuaaguuaggugggacaccuaauaaagcucuaggcuccuuucuuuuccucuuuuaagacacaguuaauuaccuuaugcuaaguuggaauauaggaauuaucuuccaaaacuguguuugcuugcugugucuacauaaaaauugauacaagguaugccaugguuuauacaauuucuggcacauuuaccuggucucuguuacagguuugugaaaccaauuuuuuuauuguaaauaguacguuaccagcuuaauugcuuuagaaccuagacagucuaugucugugauaguaauuacauucuuucaugacuuuguuugguaaccugaauguugaacuagcucuacagauuuaggucaugucugaugcuagccauuccuaggaaaaaguggugaggacuacauuaugggccuuucccccuagacuuaaaacugugaagaagucauuuuggguugagguauccccugguacccucuccugaacuucaauagaauaacaugauguggugaaugaaccauauuagaaaaaccagccaaucagccaagauucuuguauugacucuucugaucucccucuaccucuccuuuccccaucugccaaacaaaggguuuggaacaguuaaauucuaaaguggugucauugauggcucucaguauucuguggacuuuccugguugauucaguacuugugauugaccuggacccccugguuugguccagccuuagagcggguuugcagguagacaccuuccuaauguuuguuccacguaagcccccggagcacaguauuuccaucagcuauuuuguggaagugagcgauucucuuuugguuguaaaccuucacuauuucaugugggugacuugacaauggcuccauuuuugaauggcccauugauaguuguagucuaaaaauuuccagagauuacacaaggguuuauuuaaagggaaugggaauagggagaagguauaaccuuuccaaaacaaucuuuaaggcaauuauaagcuguuaggaaaugucauguaauaauaacacagauacccaagcuuauaucacauaaaucauucauuuugcauguuuuugacagggagauuuauuuuccagguuaaaaacaaaaaagaaaaaucuuaaaagcuuaagcuuuuauuguuugcuuuuuuuauuaaaaaguaauuuggagccaguaacuuaaccuguuuuucauaaacaugcuaucuagaggcagccaaaaaaauauucaugcuugcauagucaggguccucaaaugaacuuauguguuggaucaugauaacucugguaauuacucgaauuacccuuguugaguaauaguauggacccugaauacaaggguuugauuuauguggccagcucugugcugcuggguuuaugaggacuugccagaugucaucuccuaauuaaaauccuucuuuacccuuaauauccucuccucuguccccaagaaauuaauccauucuauugcuggagcauguaacagcugauguugaaguuacaaguuuacagcuugaacuuugccuagacuguaccuuuuuugggaaagaguuugcaaagcuuuuaagccugacucuugucuuuagaucaccagcaucaccauggugccuggcaucaguggagccucagcaaguguuuaugguggaaaccucagaagcugucacuuucucuggcuguaacaguugucaucuuuguuuacagggaaaaugcucuugagaaaauggaggucauuaaacacuccagcuucagcaauaucaucagagcuuuccgucacgugaguuaucucaccaaagggucagauucugguaaaaacucuugccuucacacuuacuucuguuuuauuuugccuuauuugacauuucaccagaauugauccauagguucaauaaggcuccauucuguugggacaaaucaagcuagaaagacacugaacucuggggguuaccagaaauaucugaaagcaaagcagugacugugaggugggaaucucucugagaauccuuugcagaaccauguaacagcucugcaucacuagacgagccaagcgaagugguccuggaugguucaguaggcucaagcauugaggguccagagcauccuuugccccuggacauggaaggguuuucauugggagauggcauuuagggcauccuuauaaacgagcaggaguaaaccuagcaauaaaaaccaaaccucugccuucagagguauaugcuauuacuucugcuuaaaccguugucagagcuaacaguuuugguuagggauuuuuguggguccagggcacgcccagacacccagaugcuucucuauguuuguaagauggcgaguguugagaugucuuauaggcuuauauugagugaaaaggaauaggauccuuugucaguaguaacuuaggcuuuuuagguggccagggcaagagaacacccccccuacacacacacacacacacacacacacacaccccuacacccacacacacccaccccuacacccacacacacccaccccuacacccacacaccuucccacacaaaccuacacccacacaccuucccacacagaccuacacccacacaccaggauuugaaggcucugcuaagaggcuacaacaacuguagcauacaacuagcacacuuguugcuauuauguguaggggacuagauggaaagagugcagauaggacuaccuaccauucaccccuaccagcgaaguggaagcacucaucuucuuucccuucuuacccuuucaaagcaaguuguugagggaugaagaggagagugacuuuaaucguggcuuuaaguagagauuuucuuuaggaguaauuguuucucucgacagaguggauaggcuuccauaguugucuuaauaccuuuuguccaccccaaggauugacccaggcaaggaggaugaacccuccucaauuugggaaaguuaaauuuuaggcacagcaggucaaagaguagggaagagcugcaguuguuggaaccaagugacauugauuuagucuggaaaggagucacagaggaaucaaaagccagacccuccuggcagcuuuagaugugguuggggucugggaauaaugcuggucccaaaaucaccucuggaacuaacuccuguaaaaugaagccucugcauccuucaguaacuuacuuaaaauuuuguuagggcugcauuuucuucaaagccaaguucugaauaagaaguauuuguuuugggcucuagccagauuacugaaguauuguugagggagauuugcuguggaagguguuggggguacagggauugugaagauaauguaaaauauuuaacauuuuaaaaauuuucaguaaguucucuuuccccaaugucagcaugacuucuucauucauguucuuccaucacucuccauucaguuagaaucucaauuguguaauaucagugguagcgacaauuaugaaauucguccagugaggaaaauccgcagagcuagagcccaaaccagcaacuuuguagugaggaugaccccacuggccggggagaaacugaacugauuuuuuuuuuucucucucucucagcuuuuuauuuugaaauaauuuuagacuuacaaaaaaguugaaaaagcauccaggcaugguggcuuauaccuauaaucccagugcucugggaaaccaagacaaaucucuuaaagccaggaguuugagaccaagcugugagacuaucucuacaaaaaaaaagaaauuaaguagccagcagugguggcacguggcuguagucucagcuacuugggaggcugaggugggaggaucgcaugagccaggaguuccaggcugcagugaacuaugaucaugccacugcacaacagucuuggagacagauuaagacccugucucuuuaaaaaaaaaaaaaaaaaaaguuuguaaaauaucacccaguuuucccuaacguuagcauuuuacauaaucuauacaccaauucucacagccaagaaauuaacaaugacacaauacuguuaaccauggacuauuugaauuucaccaguuuucccacuaauauccuuuuucagucccaacauccuucauuguguuuacuuacuauaucuagucuucuccagucuguaaaaaugugucuaucuuugcuuguuuuucaugaccuugauauuuuugaauaguauggacagguuguugcauagaaugcuccaaauugguucuaauguuucucaucauuaaacucauuuuuauacauuuuggggaagacuacuacaagauugacauugcaucucagugcgucacaucugugugaugucagcaucuuaccacugaugaucucuuagccuugaacacuugauugagguggugccugccagguuucuccaguguaaauuuucugcuuuucgcauuguuacugauaucuuagggcugauacucacaguaugcagaugucucguuucucuuuuuucauauuucuuuucuuuuuucuuuuuuugagacagucuugcucuguugcccaggcaggggagugcagccucagacuucuggguuugagcaauccucccaucucaguuucccaaguagcuagugugcaccaucacuaauuagugccccaccaguuuuguuuguuuguuuuuuuguuugggcagaaucucgcucagucgccagacuggagugcaguggcgcaaucucggcucacugcaaccuccaacucccugguucaagcaguucuccugccucagccuccucccaaguagcugggauuacaggcaggcaccaccacacccagcuaauuuuuguauuuuuaguagagacgggguuucacauguuggccagguuggucuugaucuccugaccgcccaccucggccucccagagugcugggauuacaggcaugagcuaccaugccuggccuucaccaauuuuuaaauuuuuuguagaaacucacuauguugcccagucuggucucgaacuccuggccucccaccucagccucccaaccacaacuggccaagguccuguuucucaucacauugucacucacugaucuugucaugcuuugguggagcuuaucuacaauaauuauuacugccaugcuuuaauggcaauuuucuaucuuauugucauuuauucauuggaauuuuuacauaggaaagaccugcuccuucucaaacucuaaacaguuucauucaccauacuuuucuccagguaacuuucuggguggcugaaagugacuuucaaagaauggagauaucuuuucaauguugagagaguggcagucugcugguucccaagaugccuucuucaccuagcauugagacucugcagaaugccuugaccacaguugugauuuggaucuguuggcuugcaaagcccauuugagaauuuacaaaaucauuuucacggccugagagucuuuuagguacugauuuuuuucaucccuucuuuacuaacagacuuuauuuaguagaguauuauuggacagguuugggguucaccuuuaugagaaaaaacuuagauuuucuaauuucagcuuuuuuauuuucuuccaucagugggacaaaguugacaucauugccuaaaaguaauuucugugauuaucuguguauuucaguuaaccauguucuuuggacucacuguggucuucagcagggaugguggccaaacuauguuuagaaagauaaaaauuaaaaugacaucugcauccuucauguaaacccauaaaaaauagcacgugacccugaagauccucugccucucauuccaggcauuacaauugaaaaugcuaucugggauguuaaaaacuaaaacuauucuaggacuuaguggaauauugauaguuagggaaugcuguuugcuuucuugaauuuugaaccuguuauugagaagguagaugcgccuguuuaccccaggaaggcuccucuuugaagacagugccccuggagcacaugaccuuuucaugcccuugccugucaagacuuuuccaguacucuaaggucaaagggcguugggccaggcugaucuaaucaggguauuaaccuugccccacucaucuugauuuauuccuagaucccaguucccagagcaucccuuuagagccucagaaauggaacacaagacagcugaaauaagcccguggccaaaaggcacucugagcaugagggaaguaagcaggcuucccugucacugcugaggcucugucauccagccccagcuguccucuugugaucacucagcagacccgggaaaaauucaagaauuuguuuuuuagugucagugggagacguggggauccugcuuuugcugggagagcuucaguugucugaguccccacucaaccccaggcuccugccaaggccaccaagggcaggagcacuggaaggcugacuauggagugaagaggccacuggguuucacaaacagcacugucagccaaagcuguagcuuguuagccauccaaaagaaucuugcaccugcugccagugagcuuacaccuagaugacagcuggagcugacacucauucagcccuuacucuaugccagguacuauucuaaacacuugccauauacucaguugucccacagauacaacuauuuauccccacuuuagagacaaaaaauugaggcacagaaagguuaaguaauuuggccaaggaagugcagcuaguaaauggcagaccugggguuugaaccgaaaucagugugacucuagaguaccuacucuuagacccuacucucuacugccucucauuagaagucucccccaccucccuaccaccaccaucaccacccacccucccagccacauauaugcucacacugggugguucagauggcuagaaguggcagcucaaccuugugugccucggacacgaaaauauuagguucagacaccacucagacuucacauuuucauuaguuuuggguagaggaaugagaauaaauauucagcgagacagccuuuucuaacugcaagauugcauuccucuucuuucuagaugcaguggcaagaacaguacccuggaugguggagcugguagugguagaugagauagagcagucccuugauucugcuuuguccccauuaaugacagaucugagggcauccagaaggaaucuccacaagcccagccuccacaguggcugcuuccucuacaugguagaguggugcucaccuccacuccuccauagaugccaagucaucugugguauagauguggaugucuuuguucaaaugguccuugagucuuugcucagaugauccuugguucuucauuucaccugggaaagaaaauaauuugccuguugucauuuuauccauaauauuaagaaaacuuaauggcacaaucuaagcuuuuuaccauguuauuuaucaugggauuacuuuuuucaggugucuucugaacacgcaguugucccaccaaacuuugacacugcccuugugauuaauuuuugccuacauuaaucacucucccuuguuuuaauugcacauuacauucuuuucuguccuucccggacaucuuugcuagcacagugagugcagggaggacugucacggacucucuccccucuugaaugggggcauuccagcagaguguguuacaugagcucagagcacaugaugugagagccucgugaugaaagauacugcaaaaacagugcgcacuguuaucaaaccugacugccuucacaucuugcuuucuguggugcaaaauaagguuuuuauaguguccuguuucuucuguuaucaucuaaaccaauggggaacggugaguaaguaguaaucuucagaaaagaagaaaagacagggaggagaaaguguacuggaggccugcuuuaccauuaaguuguuaagauggagucucacucugucaccccggcuggagcgcaguagugcagucguggcucacugcaaccuccaacuccuggguucaugcaguccuccugccucagccucccaaguggcuggggacuacagguguaugccaccacaacuggcuaauuauuuauagagauggggucucauuuuguuguccaggcgggguuuuuguuuuuuguuuuguuuuuuuuuuuuuuuugagguggagucuugcucugucaccgagguuggagugcaguggugcaaucucagcucacugcagccucucccucccagguuccagcaauucuccugccucaaccucccgaguagacuagcugggauuacagcugcgugccaccacgccuggcuaacuuuuguauuuuuaguagagacgggguuucaccauguuggccaggcuggucucaaacuccugaccucaggugauccgcccgccucggccucccaaagugcugggauuacaggcgugagacacugcgccuggccguccaggcuggucuugacuuccuuucgcuuguagccucccgaagugcuggaauuacaggcgugagccaccgcaucuggucucuaaguuuuuuuugaaaguguguguguauguguugaaaaacaaucuuacugccaucauauugaaguuaccuagugcauuucuucuucaggguacgaagaaaaaagaaaaguauguccugugguugauagaaaucaguaaaauggagcccuguacgaggaagugcugaugagacuccaacuaacuccauggagaugagcuacaaaaaaaaauacugauuggguucaaauccuuggccugccauuuacuggcugugcuuccuuggucaaauuacuuaaccucucuaugccucaauguucucaucucuaaaguauggaaaauaauugcaucugugugaaaacugaguuacuauacguaaaguuuuuagaauaguaccugacauacaguaagugcugaauaaguaucagcuagagagagagagaguuaguuuccagcagccuguuucuguuuggggucacauguggucucuguccaccuggcuuuuuaggccucucuuaccuguucccuguuuauccuugccugccccagggaggaguuugaguugguacauccugacuggguacucugccugugguuagcaaauacucugcauguugagugcuuucaaaauacagaaacaaacaacuuguggaggcauuggaaaaguguguuugagaaacaagcagccucaccaugaaugggaguuuguuucccuuucucgucuuucuggucaucugcugcacgggcaggaggagcuguggguugcuuuucuuccuuggaacauggagcaccacucuccccugugcugauacacuuacaaagaaguucaccuacuccuuggaaaguucuggaaaaggggcuucuacacuguuggccucucgaggagaacgguuuuuguuucugucuuccuggaaaagaggugacugcuggcaucaucuuucuagauaaacuccuugcuaugaugccauuagaagcaguguucuuuuguguuuugcuuuuguuuuucccuguagacaggaauaacauuuugacuagaaacuucccugauguaauaacgaagauggccuccuuagaaaguuccagaacagaccccuucaccucuguccccagaagcagaaguaggugaugcacuuucuuggcaagccacauaacuaccauuucucuacaaucgaagcucaaaaaucugugcuuguauacguucauuuuuuguuuuuacuucuuuacuuccuuugauaagacagaaacuucuguauuaaaacugauuuaacucugaggggcuaagugaacaacaaucuguuguccuauagaggucaaggcagugcucacaacaggaucauugugcugcuguaguucaguuuaggggacggggaauguuuauaaaaacaaaguuuugaaaugaggacagggaaaggcuuuguuuaccuggggcucuagacuuaagguacucauuuugccugcagaauaaugaaaugcagaguuguaauuagaaaagguugauguaauugauguguuaacaauuuuugagguuuuucucuuuccacuuuaggacagucaugcaauuauuuuucugaaccaaaaucagaaccaucagucgaaggcuaaaacaggccuggggaaacacugucuuuuggcaaagaaagacaaagauccuuguucucuaggccagugugcauauguguguaaugcuuuaaagaacaauuuugacaagaacucuuaggaugcaacuuguagagugauuuuuaaggagaugcaguaggauuugugcaaguauucugcuaugagccuaagauuuucaacauggaaaucuagccaugcagugacucguucacuuuggcagugucuaucuuagucugggggugagcguuuguagaaaauauuuagagacucaaguacacucauuugaauuuuugcuguuagcaaauaaauggcaauauguguaacguggugaaugggauguaaagcugucuuuauauuaccacgguuagaauuuaauuuugaaaguugcaagucaaacugcuuccucuugcgucauuaaguugugccucuuguuugcucaccggcauguguguccuugugucauuuugguugcugugaaauugcucuuaccauucuuucauccuucaaccugcugugcuacaauccuaacaugcuguuuuuguugaaaaugcauucacucuuuuuggcaucuuuuuuccccagaaaguuagaauauugggaauucauugguauuagugaaauucccaccuaaugcagcaguuuuuuucucuuaccugcauaauagacgcagaacaaauuaacucuaaacggauuagagcugucaacugacagauacugugcgagauacugaggaagccucagagaugauaccaauaaacaggacagggccuucuggucguguuucuacuucucuuauugguuugucuuagcaauuuugaauugcacugaaaacgaaauuucauagguacacgauacaguaguuaguuuuaaaaguuuuuaaaauauuaaaaaauugaaaguauuuaaaauauuuuuaaaauauuuuaaaaucugcugugugagauagauaggagaccuagcuuuucuuccuucuuaccuugauccauagagaaagcaacccugaaagaagaaaaacucacccauuugagcuuucuuuuguuuccacugagcaauacggaagaaauucaccgcugguuauaggucuucagugcuuucuucagagugggauuguuuuuuguuucaccauaaguaguagucuauuaaauuaacaguugcuagagaagaagcugcaucuauauaugcaguucucuucuugucaagcaguauauuuucacgauagcaaugaaaaaauuccauccucaccagccgcugaaacauaguaauacugcagaaauuccugugaacuaugcguuugcugcuuccuuuuguuuguuuguuuucagagcagaugggcuuguuugcuuuuugcuuaaacauuaaucaaaaaucaauuuauggcuauguaaguggcauuagauaauucucauucugacuacaguaaauaauaucuauuuguucauguuagauaagucugggcggcaguggaauguaaaauagaauuacaugagauaugacauauggcuauguguuuuauaaauuaaugcuuuuaugcaugugggaggagaaguaauuuagcuuacugacaaaaagaaaagcaaaggaaauuccagagaaagaacaggauaccaagucuaaauaaauuuggaagacaaagagaauaucauaguuuaguucaaucuuuuaaacaaauugucacaauuuauacguugggauaagagaaccaugagaaaagguauauucuaaguccugaacaucuuucuauacccugaagauguuuuuauagcucuucugcugacucccugccaaaaaaacuauuuacgguuugggguagggggcgugucaugccauacagcuaaauacacuuuuuuccuaaucuaggaggcaugucuacuuacaaauaaauugcuuaaacuaguuaggcuuguguaaauguaacugacauuuccuugagaucagaaaaaguuuugcugauuaacuauauuuguguguguguguguguguguguauuuagagagaaggagggauuuuauaauuauuacaauuugauuugaaaugucuagagaaagugagagauuauggaaauuaccauaaaugcucccuuuuucauagauuuagaucuguuaauugcaagaaaucuuuuuuuaagugaaucaaugggaacuuuuuauuucuucccuaagauucauuuagccuugaaaaggccaaaaguugaaugaagcuucuaaaugccaaucuuucccuccuucuguuaaagaguaugcuucaacuauaauuacauuugcauuguuuaaaauauuaguaauucuacagccagaccucugagauagcugagaaaccaaaaagugaaguucaaagacaucaucaggcacccucuccacacacaacauaccaggcccaccaaggaguuuacaugaguguuuuugccuuguuagccguggaacgaccugggcaguacccaaaacuuagcaaacucuucuuguaccuuguauucaguagacggucaguagcaccgagaguagggagaagaguaaauauguuucuaauacuuuauucaauguauguuguuaacaguguagacacucugacuuuccuugugaauugcgccucaguauuuaguuuucauuuacccuggaucagauagggcaugauaaccuuugaggggcuuugugcauauguaauuuggaaucugagucagucgggcugugucucucccaacuucccuucucauauucuucucucuccuccuccuccccucccuccuccucgccucccuccuccucccccucccucuuccuccccucccuccuccuccuccccuccuuccuucuccugcccccuccuccucccuccuccuccuuccuucuccuccucccuccuccuccuuccuccucccccuccuuccuccuccucccccuccucucuccucuucucucguuucucuucucucucuucuuucucucuucucucucuaccauugcugucaguugagaugggccugugcggcacuuuguuugcaguugauuggcaaucuucuguucuacuacugcaucugaaucaucacuugcuuccaccaguucucugaaugucuuaccuagugauccugguggggaaauuacagugauuaguguuccaauucuuguuugcccauaaguguuucaaaguaguauuuuuaaaaacucuucuaagacauucucucuucucauaguagaugcagugaaucuuaaaggugcccuaacuaaaauuuuugugcuauaaaauuggcagcuuuacaaaauaaaagguucgagauaugagccugaucaaggcucugcauuugcaacaauauccuugguuugccuggcccuguuauauuuugcuguugugauaugacuccugccagugcuauuuccauuuaaccuuuguuuuucuaaaagacaguaauaauuuuucauuucuagggagucucugacaucagcuaaaggaaagacacuuuucuuugacuguauauacauuucuccccauuucauuaauaucaaaguugcucuuucaaauggcuuauaaaauuuuaaaauuacaccaguugcauaagccugcauaaaaagcagacuccuacauaagcugacaaugcauuuguaccgugguguugagcaguuuuaacauccuccgugccucugugcuucugcuagcuacugcucugauaaaguuaucaagguaucauuggaugcauugaccaggaugaagacacaacaguauggccuuauuaaauuuggaaauaaugaacagacgaguagagaauuuaggagcaauauaggcaagcuuaauaggucuuuacuuuggggccuguaacuccaacuacauauggaagaauuuaaguacaggaaaaguuaagcucuuuucccaguaguucugcugacaaguugggugacuucgggaugguuaccucuucaugauaccacacggugaugguaacagaggcacuguccagucucugguucaugcacacuggucuucucaggggucccuguauaggugacacaguggagaacagggcaguacugccagacucagggacccaguucaucgagaggggcaguguuucucuuaugcugccuuaaaggcauuggaugccuuuuggaaagccaguggacaacuccugcauccacccaagauuaauguuaacagcuuaaagaaucauugcaaucaagggaaauuuugcaacacuuuguugggauauuuuuaaauaaaugugugaacaccuuguuuuaggcuugcugaaaaugacccaggaauuccuugacccgggaauauaguguauggcugccaauuauuauauuccuucaucagacaaaggcggaacaguucacucuuuuucuuuuuuuuggacacaaauucucacucccucacccaggucagagugcaguagcaugaucucggcucacugcaaccucuaccuccuggguucaagugauucucaucccucaguuucccaaguagcugggauuucaggcacguaccaccaugccuggcuauuauuugcauuuuuaguaaagacaggguuuuaccauguuggcuaggcuggucucgaacuccugaccucaagugauccuucugccuuggacucccaaagugcugggauuaagguaugagccaccuugcccggcuaccggacaguccacucuuuacaggggggcgucuugguauaaguauggaaagcuccguagaugccgugucaguccauacccucaccaccuucuugacccugugccgauaaacuaagagaugugggcaguguaccaucuggaaaggaaaaggcuuuggagccagguaguccugccugcauuugaaucugcuuucuaccacuuacuuacaucagguuuuccuugucuauaaaauggaaguccuuguacccaccaccuagaauggaagugaggauuaauccagaccaacgaugaagaguccagcaugcaggaaaugcucguuuauaaccauggaaguuucgaggacuuuugaaauucgaugacauuaaccuuugaggugcauuuuaguuggcuugugugaugaggccuuucuacuucuaguuccagaaucgucuggaucuacauuaugugggaauguuuauuccccccuuuacuuucccaaaauuugcuaaacauuuucauugcuauuugaguuuuuuaggagacauacugagaugaaguuagggaugugaaagguuuacugaggauaacaccaaugaaaggaagagaggaggaagaugauggguguggggagcgguuugaccaggacucugauaggacagacacucugccagcccuccgggagcucauuugcagagcccccuguuagauggauauaaccgggcccugggaccauugcugggcucaguuacuggccaggagcugccuaggaagagugugaccuaggccaaaaguugaaguggacccuagaagagcuagcagcuggagggcaucugcuagugacacucuggagcuggacagcaaguccuuucugaaagaggaucugagcugaguaucccugugguccaguauuucaaguuggaaccucuagguuugaaaaauacauguuuugggugagaguuugauuauucuuaaagggacauaucuuucaaacauauggcuguggaagaggaaacuuguuuuugacuuguaaaauaccagcagagccuugcagugaucacaacuuaugugaaauacagaccaucacccacaguuuacguguucacacuaaagugccagucucucuauggguuuuagagcugauuuagauacaugcauugcuaauacagucagcccagccaagauagugccauccuccgcaagcauccacuaaggcauggagucagcuuccgucauuguuagaucaguacuuguuucuuucccuugcuuauuuuuccuaaccucucugaaccugcuguguuggaagcuuaaggaacaucauccucuguugggcagaauucuuccauggccaccccagcauuaugccccacaccauuugacuuacucauuugugaaugccaacucagaauguauugcuuugauucuugauuaggaucucaaccucuauuuauuguuaagacuaucacccuuugauucccccccaucccauuguguccuucuaaaggcacagaauagaacaucuucugccagaaauaacauacaaauuuaucaucauacaacuguacaauaugcaaauaacuugcuagaugauauuacugaagauucuacauccaauuaaaauaaaaagagaaaacaccuuaagauaaccauacuauuaaaagauacagaagacaacuggaauaaauggaaagacauaccacauuuauuagacaggaauaaucaucauuagcaagauggcaagaugucaguucuccguaaguuuuucaauuuaauauaaauccaaauacaacagauuuuuuucuuuuaguuagauucugagguuaucauuaaaacaaaaacaaacaaacaaaaaacugaacaagagcaaggaguccuuaccagguauuaaaaacuuccauagugccuaaauaauuaaaauagugagauaccaauagaugaagagacagaccaauggaacagaauagaaaguccaaauguagaugcaaguaccuguggaaauuuaguuauucgauaaagguagcuucacaaaucauugggacuaagauaaacucuugauuuacuggauuggggcauguaaauuauggcccaaucaugccauguuucuuuucucuggaaaagaaaguaaauuagguucauacauuauaccauguaccaggcuagacuccaagugaauccaagguaaaaguguaaacaaaacuaugaaaguccuggaagaacacauagcgaguuccuuuuuauaaccuuggagcagagaaagccuuucuaguuucaacucaaaauccagaagccagaaaagaaaacauucauaaaaauugaauuuaaauuacaaaaaaacuuucugcauggccaaaaaccauaagcaaagacagaugccaaacugagaaaaauaucugaaacuucuaucacaaagagcuaaucucccuuguuuaaaaaaacaaaguaaaacagagcuccuagaaauuguuaaggaagaggcuaacaguucaauaggauuugggaugaaguauugaacagauagcucacagaagaagaaacacaaauagcuaagcauagaaaaaaaguuugauuucacucauacgagaaaugcaaauuaaaacuacaccaagauaccauuuuuucacuucucauauuggaaaaaauccaaaauauuugauaacacacucuuuggaaaacaaccccacauggcugggaggacggcagaauagcacaucuauagaggagaauuuggcaauaucucucagguuauaaacacguauucuuugacccaccaaucuuagagggggcauuuaccccauagacuugcacacaugugaaaugacaguugugcaguuguucauuguaguguuucaaauggcaaaagaugaaaaugucccccaaauuccaucacugagggaauaaguaaguuagggugauagcucccaagcuuauuuucucuucagaaucaccucaugaagaaaaugaaggucugugugauaguagcuggcaggugggcaugguggugagggugguguuugagcggagaccugaaugaagguugagaaggagccagccacucacagacacagaggaggccuucaggcugagagagcagagaaggacccuguggcagagacaagcuggaaacagcacugcuuccauggucuggagacuggaauauguggguucugcagacaccuggggggggcaccaccugguaaaucugccuuucagcucuugguucuuccagcaaaccaugccagcuguggcucuguagccauguccucggaagauggcagagguugcaacgaggccucucugaggugcucugggagcacagaggagucagguggaacuuguggcauguugccaagggaagaagugauuuuuagacagaauaggaauuugccaagaagagaagucagaaaagcauaacuggcagaggaagcagcauacguuacaaguaacugcauguguacagggaaucacugagugauggacaagggcuuggcacuugguggggggggguaccauguuaacauguuagcaagaaacuagguagggguacuugacuugggggcagcagaagcaggugugaguguuggacaagacgagaacugagugcugcaaauguuuggcaagacuugauugagugcauauuguggaccugugucuccacuggagacacaaauuagaauauaacaccuugcccugguaugcucagggucuacugagguggagaaaccugcaaguagagucggaguacaguguugaaaacaccaucugcaaccuuaacacagugcuaccaaaaccgauuucggagcacuccugcaggaagugggcuggccagggcaagggaagccguggagaacaguggccucucccgggcaggcaggguaaggccuagaaagaauaagcugagugaagguuuguguguggcccauccagggaccugcgacaggaacacagcggcugaggaacggaugcuuggagaggagggggugcuuuacaugccaggcgggcagggccgggguggggccagaugcuggaggagagggcuggccaagggguggcagagaggccccccagguggcaaguuugcacccuguugcuuccugcaaggagcuuuuguuuacguuuucagcuuggacagucuggcugucuggccaagagugacaacgugacuuaccaucagagcgaagcaccaaagagcacauaaaugaaguggagaucccuccuguguccagccucccccuccccguggccuucuccuaccuucccaguccuccaucaguaccccggggccuugccagaaucucagaaagaaucucuggacucuggcucaggaccucugaggugauuaugcaucuagaggcauccccaggugcugcccaauuuggggaagcagcacuucccgcuggaagcugggaaguuuccccuggcuggggguccugugaggauggagaggccagaaugaggaauggguugugagucaagaccaaccagaaggggacuuagcaaugucagaugauagccugggugaacuacauccuguguggaaaaggcaagguguaacugcuuauuucuugucaagugagccuaauaucaucauguuucuuuuuaugccugcucccaaacucagccccucccagugagaucacagcuccaggaacuugcaaggaaagggacuaacggggcaucugauucacccgugugcccuuaauggcguauugugugaauaaagcaacaauuuuuaguacagggauuuaaaacaacuucugcaaagacagaacuaaaaauuaaucuuaaaagguggaggguugggguggagggcaggaaagaggaggaacuaaauugccauucucuuuggagacuuucuaaaaccuaagacgaagaagaggagccgaauuauggaaacaaaaccuuugcgguuuuccacagaacaaaaaugaugugaagcugcaagucagcaguucuggcgcaggggcuccgggggacgcccgcuccgccggcuguggugugcgcccuuccugcucuccccuccgaggggcugaggcuccuuuugucuggcgcgcgcgccccaccccgccccgggugagggaagagggagcgggcaccccgcgcccgcgccgccgccguggaccaagguuguuuacuacuuuccacuccgaauaacacgccaaucaccagggcccacccuccccgccggccaaucgcugcguugggaaauuccaccuuuccgcggggcccgggcagcgacuggcuggagugucugucagucaagugggcaucccgcaaggaugcagcaggaguauuagggaggcgaucaccagagcagaggaggaguaaccuuccccauaaacaagauguguuccccccacuaagaaagcggguggaggguggaggagccaaaacacaucccagccccggggccccaccggagcgaagcgggccgagcgcagagugcagagucggggaaucccucccuccgccucccgccgucgcugcaguuguaaacacguuucccuccaugucuguuuucccuucucucucaccguggccauuacgggcugcuguuuacaaaaauccugcaggccuuugacaccccguccucccuucccccggcaucccugcccuuauucuggcuuucuucucuuccaucuccuggugagcacagcauacuguucucaggcuuguuuuccuuuuauugcucuccaugugggacaggucaugcuuuaucaacauguaccauuuucuacaaaugccgcccuuccucuuuaaauugcuuggaugggcagaucgauuuugauuagcaacacugcagcagaaacaaggugcaucucuggaaggacugggugguuuucucguuauuguugcugguuugggucacaucggaugcuauuuuaaauucuguguuuuauuccacgaugggucuugaauccuuucccuauuccuagguuugaaauauguuuccucccuuuaaaaaaaagaaggggggcaguauuguguugaaccaaauguuuuucuaccuucuccugugaucugaaucagguuucccauuuccagcaguacaaugugguuguauucagugugauaggggcguaguggacaugaauuauuugcgacagggcugccuggaagaugcggagcggaguuugcguggcccggagcagcuccagugucugaggcuucucugugucacaggcuccaagcaggaagcgcaggcaaaauggcaaaauacagcauguggcauucaguucaaaaaugcccuuuuuuagaagucgguauucuaaaugacauccagucuugcuuaguuuuuuaagagaaaggaaaaauaaucuaugaagaugguuuggaauauuuugugaaaagccuuuucagcauaaaaaagaugaucuugagggucugguuugcggaguggaggauaagccucccuccugcgauucugaauugcuuuuugguuuguaggaauuucaggaacauguugcaaagccguggccgcuugaaagggucggugcccugcgccccgucucagccccugcggccccugaacuuuuucagugauggggcacuuggggagaagugcggggaguggaggaggaggggaaggugcauugcaaauagaaauguaaggcguggccuggguggccaggaugugccagagcagccuccagaccuacuuaaaucccaggaaaaguccugccucaaguuaggcacaacaucugacuuggauuucucucuguuuuuuucucuuccaguugucugucugugcgcccucucccacaaggaauaguuuuccacacugauggaauuaaugcauaucgugguauuauugguggaauauguuuaaccuuuguuucgugauuugagaggaaugguucuuguguaucguguggugacagcagguuaaggagagugucagagcuggugcagaguuuugccccggggccaugagguucugggcaucaugacucucuuaugaaguuacaaaacugggcaagugauugaaggcagaaagacacuguaauaaagugugcuccagugaugugugcuccggcuucucucccuuacucaucugggccaggugcuuucgccacagugagccuggguguccccugccugagaugagcacagugaugucuaugcgagguuguaggacucagugaagugccuuagggauuuugccuggcacucuccugggcucaugaggugccuagggcugagacuuccccuucucugucugguaaaucaucucucccauucuuucuucugcggcccuucauaugagcuuuguaauuuacucaggguggcagggugaauucaucuuuugcuggguuucugcaucaccugcuccuuucuggccaggucagccuguucauuuuuuccaugccaacagccucuaagugccaguaagucacgucugaacaaccaaagcauguuucccugcgggagaaugccagggcaggcgggucugggagccaagaggauuucuccuguucagauaagucgggggaauagaagagcccugugacuugagacaagcuuugagugacacccagugaaucucccaucacuacuuuaaucccugccccaguguucugguucccccuuuccugcaugaggcaguacgaguacccuggccuggcuuuggguucuacacggucugacuuuagccugccuuggucuuuguuccccucucacucccuccaccccugccccccccaacacauguggaguaccuuacccugccuuccuaguucuggaauggcugccccugugccaggccaccccauuuucuagaaccaccuucauacagccccugcgcaucccacuguacuauuuccuuguuuguuuuuccugucaaucuugccuuccgcgcuaaugggacacugaugcuguauggugauguguucucccacagucaucuuuuccuccugugguugggguggggagcuuucucuguguccccccaugagagugaggacagucucauuuaauggcaccauggucuguggagccaggcaggccugugugucugacuccacuucagcgcucucagccagcgugggcaccucggacccagacagacgccccgagccugucuuucuggagaaggaaguaguaauaccuuuuccuugagggaguuaugaggauuaacugugccuggcccugaauucgugccuugcagguacuuaggaagugaguuauuacaagcagugcuuuuuaucauccauagauggagauguuaucuaugcuauaggacugcagaaagaauuacagagaauuauguagaaucacuagggacuugauuaauauuuguuuaccuuucccccacauggauugauguccuuuauuauacuuuuguacccccgcuuggcaagcccuugacaaauauugauccaacaaaaaauuagcucuuuaauguauacguuuagaaccuguugcuuugucaguagugguuuuuaugaaaaugaaugcuuauaggucagacuucuggaaacccuaaucugagggaauugggccaaauaggaaagugagccccuuaaaggcaguugucugaccaguacuuggagcacaacagguucuugcuaaagcacuguguuuuuaaaacaguggaguuauuagguugaaauucugaauagcaagaaaaagaauaauggaagugcugccagccccgugaugcuggugcagcuggucaguuugcagaaggaggccaguuacuagagcagaguggccguagaggcugcaacacgguggccaaagcaugaagcugcuguauaguggcaaggucacagugauuuccccacagccucgguuuagagggagacggggugugcugagcugugccugcuucuguagaaggggccuucuccaagucugaguagccuuaagccauuaggacugcugagucuuucuccacaaaaauaugugggaggccugcagggcaggugcucaacuaagcucuggggcugcaaagauccagagccaugccccuccuuggaggcagguccuuguagacgaggacaaucguagccuuccugauuaaagcaggaauuguccaaucaggcuauaugacgggcaucguccauagucuucaccaggggagcuuuucugacuauacaucucuagcccuguggcuugagccagucacuuaauuuccccugagcuuugguuuccuccuccugguagcagagagacuaucagagugaggggcagaugcaauagcauauguaaaacacuuagcguugggccugguguuuaacugcaauaaauguuagcucauauuuuacugugacauagaugcuguaugccuuuugcugaguauuaaagauacugagcuguagcaugcauacuugcaugaaucagucugcuaaguuauuuuaaguuugcauuugaaaauaaaggguggauugcuauccaaauauaaagaauuggaaccaggcucuaaaaggauguuugcuguucuuuagcaaaauaccauucuucuuaaguuucauucaaucauuccacaaaaauuuaagcaucuguuuugucccaggcaggcacugugcuuguaauggaugugcaauagcaaacagaacacuugcuuucagcucacacagagcugacuccugggcagagaauuucgacaguaaagaaauacaagugugaugaaggagaaacccuuugguacuaccugcuacauguuuuaauauuuaaauguugacuuagggaggucuuuccaucuaaaaauaaugauuugcccuuucuccuguaaaugaccccuuucucuuaaguuuugggugagagauuuuuuuuuuuuaaggaagaaagauauucuacaaucgaauguacaacugagauaaugcuuaggagagaauguauacuggguuugugccuuggaaguugcuuaggggaaacaguugugugcaguuggaaagcugaugcuuuaaagaagcuucuauaaagugaccccacaauuaaacuguuuuguguacaucuuuauuuauuuauuuauuuauuuuuuaauugagacagagucucacccuuucgcccaagcuggagugcaguggugcgaucucggcucauugcaaccuccaccucccagguucgagcaauucuucugccucagcuuccugaguaucugagauuacaggcaugugccaccacacccggcuaauuuuuguauuuucaguagagacgggguuuugccauguuggccgggcuggucuugaacuccugaccucaagugauccacccaccucggcuuuccaaagugcugggauuacaggcgugagccaccacgcccagccuacgucuuuaaaaauaaauguaaauacccaaggcucacaguuccguucuuccaucuagucuagcaccguccaguggaaguuuccaccaugauggacuguucuguggaugcccuguccaguacaggagccgcuagccacauguggcuauggagcacuugaaauguggcuagugcuacggaggaacuggauuuuggauuuuuuuaaaguuuuaauuuaaauuugaauagcuacauguggcuaauggcuacuggacaucacagaucuaacacaggauuaacugacaaaauucuuuccucuuaaaaauauguguuuauuuugauaaggauaacugagaccuguacauuccauuuuuccugucauauuuagggcucauaaagggggugguaugcacguuuuaaaaaaugcaacacaaccaguuaaaccagcugucuaauuguacacauuuccuggagcuguugguguugauuauuagcaaauacuaaguacuuguaaugaccuaagaacuauaagacaagcaagucgucuucuguaacugaguaucagcggauucaagcguuaaggaaaaugauuaagagaaaacaaccaaaaaagucuuaaugguucugucaaucaaguggcuaucaauucauggcuauucaaaagcuuuuguggcuaugaaaauaaacuagauugaaaaaauucuaaaacaaaauugaaacacucauuugaguuuaaaauuuuaguugaguugauuuuuauuucuuguuuugguucauuuguaguuuccccccgcuucguuguuuccucagauauggagaauaaagccuggcuggucaguuucaguuuuuauuuaaauucauuuugucuucauuccuuuuaaucuagcacaguccugugauguauugggaucacagugcucuggggaaacauugaaauauaaaaacauuuuccugaaaacauuuccaguuauauuuaauuuuccuccuugaauagaaaaauauuuccaacuuaauccucccucuccccucuugaaaugaauugcaugcuuuggaaauaacaucaauccacccaaguacacaaggacaaucucagccauuuaaucgagauauaaaggcuuagagaacucugggcuucggaggcacagacuccaccuuucaggaugcuaauaaacguggacgaggucucgccugggcuuccuccuccauuguucagcgcagcaaaccagcacagcacuccguggccaggguuugcggggagaaaucucucacucuguuuuaguagcaucaucauccuuaucagcacccugcuuuuauuuuugaacagccaaacuuccucuuuccaaacuucgugugacaucugggaccagcuauguuugaaggagucugaacaugccacauaguggcucacgcuuuuaagggaggaaggccaguaagccuccucaauggcagaauucuacuuucagucuacccuuugguucuguugugguuguuccuuagaacuuuauucugcucauuaggaagcccagccuccggggaggguuuagcuucucaucuaagcaagaaguaaaaugucauaauggaggaaaaaaaaaaaaaaguccaaacuuuuuuuggacuuuuagaaacacauccaguuugagcuccacugagcuaucauugcaguuacaaagcccauguauauugagaucgguguaaaaauucagcauguccaccugcauaauuaugaccaguguauugaaagcacauuucauuuaguuuugcaacagccgaugagguagauucuaccaacauuguuuuacggaagaacaaauggaagccuggaaaaauaaauugucuaccucacacacuucgcaggugguaaacacaggauuugaacuaagacauacuugauuuuaaaguguuugcuuuuccuuugcacuacugcaucugcgauguuugcacucagacacucuagaauauuugguguugcauguuuuugccccaagaaagaacccauuaaaaugaaacuuuccaguucguaagcuuugcccucaagaagggaaagaacuucuugcaagguuucugaaacaaaaagaaaaugaaaaguaacuuuacuguaucuggguuuucugauuaaauuacgguuuuugcaagcuugugcauuucucaguguccagauagccaggauuuuuccuuuuaauaaauaucacuuuaaaaaacaaacacacacauucuuaaaugcaugauuaacuguauagauugauuuaguuauaagauguccuagccuaaauauaagaagguguauguguuagaauuaauuucuucaauaaagagaaagaaauucaggaauugugguucuguuggucuucuguacuguauauuuuugugcagccaaagcagcaugccuugcuucuugguuucaugaccacauggguaguuucuugaaguuuuuucuuuugagauggagucuugcucugucacccaggcuggagugcagugacgcgaucucggcucacugcaaccuucaccucccggguucaagcaauucuccugccucagccucccgaguagcuggaauuacaggcaugugccaccauaccuggcuaauuuuuguauuuuuaguagagacgggguuucgccauguuggccaggcuggaguuucuugaaguauugacugauccuugacucugaacuguaugaucaaagacuuuugaaauggcacaccguuucuuaacauuuaggccaauuucaguugcucauauccaaaaauaagucaugauuuucggagucagugcgcagcacuuaguacaacaauccaaacccuuguacagaccauccuaguagaaauguggaucuugaguaucucagcuucuuaguagauuuugaacuccgugaaagcaggagccaggccucucacagcaagucucuccaauaugcucaguaaauauuugucagaucgagcaaugaccagaugaugaaauacauuaaagccuuagggagaacugagacuacugcaccaguuuuugugcacuaucaugcuggaaaucuuuccaacauguauucuguacuucuuugcuucuuacuccagugaauauaauuuagucauuucuggccaacuugaggacaucagcgagcauaaauuguuguauuaugcauaauacagugauacccucaaggcugagugggaggcaguuugcccucugcugaagguuucuugugcuuauuguguucuuaugguuugguuuuaccauuuuuaugucuccauuucuguuuaauagacuuauuucaguaagaagagaaagccgucuccaucagccccucuguaggugauuauuugccacuuccuuuuugcugugagugcuuugaaaacagauuucuaagcuuguuagaguuauguguuaagaguaaauaggcaguaagugaaaccaagcuucuuccuggugcuugacuaccccagaaauguuuauuugcugaauaguugaguucuggaaaggugagguauaaaugugugauaaauuuauuccuuugcaugauuuuuuuuucuuuuucuucccucccucccucccuccaucuaugucucugucuuucucugaacaucucuccgucucagucugucucucucaugauaguugcuggaauaauuuaaaugaauguaacucauuuacccacaucgaagcccaacucaguagugaaaaaacaaaucuuccaaaugaaugcacuuuccccuugaugugcuauauacaagaccuuggcacaccuaguucaaugacauaguauuuuagaagggccuccuuacaccuuccucucagauaaauauacaugcagggacauucugaagaaguuuguuaucggucuucuccccuccuacuauuagcuccgcccuccuaguccuucucuuucaccaugcugacccgcguagggaggacccuuacacccucugcaugcagcgcuggugcuccuuaguguucauaaccccaaccuccauggccucucucgcaguucucagguuaggcccugcuucuaggggacauuagcuuuccacccucuacuacauacuuccuaguuguugcagccuuugcaagcaaaacuuguuuucauuugggagacagcauggucugacagagccuagauccuggggugaagacauucuggguuuguaucccgucuuuaccaccucugagccucugaugcuggacaagucagcaagucuuugcaccuuagucuccuuucuguaaaaaggagcuuauggggauguaaucagagaagccuuagcauggcucuugguacaaggcacggaccaaauccaugguacgcucacuccuuuccuuucaguaauacugccuaaauagggcacauguaccuaaaaggauuuuguacauuccuugacagcagaauucucaucuucuguugcauaucccauaaugcugggaacacaaaauaaaaaugguagcuuuucacauucacuuuuggccucaauuuuuuguuauuccccaaugaggaucauuucauuuggggcuggucuccggaaaaaaguagaucaagcuuuucagaugagauuugggugaaacccugacaaacucuuuuuauugccuucccuaccacauagugguggaucaggaaacuguagggcuuaugaugcugggaaauuucugcuaaugcaauaaagauuuuugcuguugaaagaauuugaucuguuuuauguauaacaugcagagagcagaagcauauauuaucuguagcagaugauagagcaggguauaugggcaaguuagaaaaacacaguucucacuacauuugaagaaaaaggacaaggaguugucacaaggauccaggagagucgcacauaauuuucugucgugcauuuuguugacuguuccucuuugcauccuucaaccaucuuaacuucccacuugcaccucgcuggaagacaaaucuaagcuaaauuaaaugcuaggcaauaugucagaauggaaagggcccucaacuugggaugcccgguucucuaccagccugaauaaacuccagcaacaguauuucucuaggaaucaucuguaaaaaguagagguuugucauaucucuaaacuagggauucaccuuauuuauuaagcuaucagugacuuuaucuugaggugcacggcuuuuaguaacucugguucaagugcaaggaaugcaaaguuaaguguaucauuggaggugggauuuuugaguuugucagucauuuauugauuugcauguauccuuauaguucaaaggucuuuuucucaacuuaguugaugaucaugcuguaaguuguuuucuuuugcuuuaucaacuuuuaaaaacguuuauuaacuuuuuaauuugaaauaauuucagacuugcauaaagguuacaaagaguaccaggaguucuggaacacccuccacccagcuuccacagauguuaacaucuuacauaaccguaauacgguuaucaaaacaguguucacuccauacuccagugcuguuaaucuccagacugaauucggauuucacuauuuucccacugaugucccuuuuuuugguuccagauccaagagacgauccuaccuggcauuuauuguguucaguuuuucuaauucugggacguuuuccuggguuuucuuuagucauucacgaaguucgcacuuuuggagaacauggggccaguuauuuuguagaauaucuuucuguuagaguuuguggauguuuccuccugauuaaauuugggggguacauuuuuaacuuggagaucacagaggugcugcuguuugugucuuugcgcauccugucaggagaugcgugauguuuccuuuccuggugcuguuagcuuugaucccuuaguuaagguggucucuguggcuuccuccauuaucauuacuauuuuucucuuuguaauuaggaagaaucuuuuggagguagauacuugagacuaucuaaacaagcauucuguuccucauuauucuuucacccacuaauuuuaacauccauuacugugauguuugccaaauggugauuuucuauuucuguuuucuacacuuaguaauuggauucuacucucaggauuuuauguauuuuuuaacagugagggacauaaacuuuuuaacuagcaguggcaaguccacuuuuauuugggaggacaauuacuagucacaugaagaagaaaaaauaugcagaagcuuaagaaaucccacauaugaauguuauuugaaauguucuugcccuuucucccuacaaaggaggugaagaagaugacaggagauguuaauugccaaaauagucucauaguuuugguccuggcugcaaaucucucguuuuugauacucaagagaaugcuauuggggaacugacucugaagcacagcccagaugcuugagauggguugggaagguuuacaucaacaccaugaauuuaauuuaucaugugacauuuuauuucugaguuuuuaaagcuguaauuaaaagaaguguucaaaguguugcuuuccucuuuuagaauaaacguggcuggguguggugccucaugccuguuaucccagcacuuugggaggccauaggcaagaggauugcuugagccaggaguuugggaccagcuugggcaacauagggaaaccacaucacuacaaaaaaaaaaauuagccugucaugguagcaugcaccuguggucccacuuacuugggaggcugaggugggaggaucaccugaguucaggaggucaaagcugcagugaggugugaucaugccccugcucuccagccuggacaacagagcaagacacugucucaaauaaauaggcaaacauuaccaacauggcaaacaaguuggaggaggcccccuauuuaauuaaauuucagcagucccaaaucuaauugguaugaagaaaucauuauucagaauuuuccaucacugaaauacuaaaaucacuuguuguuugagacaucuuggccugucacccaggcuggagugcaguguugcucucauagcucacuggagcaggagccucaaccucccagguuuaaguuaaugcucccaccucagccuccugaguaacugccacuacaggcgugugccaccaugcccagcuaauuuuuuaauuuuucguagagauggggucuguguugcccaggucccucuugaacuccuggccucaagcuaucuucuccagucggccucccaaagggcugugauuacaggcgggagccacagcgcucagccuaaaaauaacucuuuagccaaaagaaaguuuuaaaaaauugucuguuguauucuuugauuuuacucuauguggucuuuucuauuauuuuuaaaauaaaaaagauuuauacuccucaaguguaacauuuuaucaaaucucaugcuucuguuugaugaaaccgaauggcuaaauuuuuuaaauaucaugcaauccaucccaguuuguaauuuuauuauggcccucacacaagagcgugcaagcuauacuaagcuuccuguggcccucguuuuuccucacugauauuuguaacucauuccaaauuaaauuuuaggagucugaaauguagcuguuauauuugggagaugugaagaaaagaaucguaggcaucucaguaggcuagguaucagaucacacaugcuugcuggaccaaagaggacuccuuacaguaggauacaugauucugaguuaguuuguguacuaaguauauacuauauagcuuuugaaggggagacgggcacagaauucacaauaucaugcacuaaggguuauuuuguguuugcaguuuccagaugaauguuuuaaaguuggcugcagaauacagcgagauagguaaaaucuauuugaguauuacuuacagaccccaaaggauaucccaaaggauauguuggacuaauuccuaaaauauccuguaagucauugcagguacaggcguggaucuggguuuggaaacgccgccuggaucgcuggcugggcuccugcagccgccaaggaggggcuggcuggagguggggcucggcgugcauagcggccacgugacugcgccccggccacgcccaccgucccucacguggucccaggccacgcugggcuucggcaugugcuaaaguggauagaaaagggaguggggcccgggcguggcuuugugguuugggaagauaugaacuccuugggguuuuuuucucuuuuaauucuuuaauuuugauauuuggaaaugcguaaaagguuuuucauuuguccuugaccacgugguccaaaccucaauuucccuagcagaacgcgguuucgaucacugguggauccgucucacagcaccagucaugcugccucgcugggaaguggagggcucaggauucccgugguucacgauccauuuuauguuggaaggaaaucauuuugaacuaucucaguacacacccuaguguaucuuuaaaccuaauugaguguugauggaaaaucugcgguccgagaaccguaagaaaagggggcucccaccucccgcucuggggucgccacuugccucgcaggcaggaggaggcucccagaguagauacaacuugcccgucacccggauggguugguagugcacauaugcacggggcgcaguuuaaaaugaaaguaaaagaugcaaauguguuugcaaaagaaaaauuaacauaggauacgugcgggcguucucaguugaacucggucuuacuguuccacgcgagcaccccaugacucagagcccaaaucucagcggaacagcccaggacgcuccugccguccacaggaagacgccucugucucugucccccgccgccaccacacagaugcacguacucucuucacuuccguguacccaguaaaugcagauccugauuuaaaucugcagcacgcugcuuucuucccauugcaugugggaagcuucagguucucuucgguuuauuuucucaucaccuuuauuaaaaugcaguaaagcaaggaguauauuaaugcgggccucugcaaauagagggaauuuauugaaaagcagaauggcuugaaagauugaacuucaucuuaaaaaucagaaacagacucuuguuauuaauagcuuuagaaacgaaaaucuaacuucugauaaauuauuucagaggagugguucaaacguguaguagauagcucugccuggucaucaauuauagugacguccuugcaucagcuccagaaacucagaauauucaugagcuuuccagucugacucagaccuucaggagccaugaaauuuuccuguugggaugagaggaagcgcuggcggucguuucggcagcuuaaugaaaccagaaauagauaagcacgagugaggggugauguccgcuuguuugcucccaucauguuguuuuuaaugugugaaagugaaaguuuuaaaagucauacuaaaugugugauccuuuuuagaauucacuggguacggguacguggaggaaguguuuuuguuuuugugaauuuguuuaaacaaaugacugaggcuuuguuuuccacucugucuggccaagcaccauugcuacacuuuuuuaaauucaugacauccugagcagugaagcuguucuucagcccgccucuccauuugugacuggaagacaaggaggcagacaccaauggcgccucucacaauggagguuuauuuuuuuuuaaucuaacggagggauuguagaugguguaaaacuuccuugugccaggagagaaagggggagagagagagagagagagagagagagagaaauaacccauucuaaacaacuuuaggaauagaugauccguaggcaucaacuuugcgcagcaacaaaagccacuuucugaaccucguucugugaaguuuuaaaacaaauuggguuuguuuaauuaaaauauuucuuaaaggcaaaaagcacugagcuaauuuuuaagaauuuuaaguuauauauuaauaugaguagugauuuauaauuuucuguugaaauacauaaauucgagaagccccaccccuaccacuugccagucuugaguccccacggcuccuuugccuaggucuaaagucacugcuugcacacuccugccuugcauaugccuugccaucgugugggccucuuggcuggaaguguucuuguccucccguuagguaucuuuuaugacgugaauccuuaccucuaauuauuaucuguguguacaucucaucaccugcaucugacugugugccuuguguaugucucuuagcccucacaauugccugacaugccuuacaaacggguagaccaaguguuaaaugaacaaauauuuaauaagaacuuaaaagcuuuuugacuuuauauauuuuuaaagccauugugauuaaacacuauguuugauguggugcuaauucugugcuuuaucaacugugugaauuguaguauuuuuaaaguaggaauaauugagaaauauuuugaaguuagguuaagcauagcaguaaaguuuccacuuuuuaaaauagccaaauccaggccaggcgcaguggcucgugucuccaaugucagcacuuugggaggccagggcgggcagaucgcuugaggucgggaguucgagacuagccuggccaacgugacgaaaccccgucucugcuaaaaauacaaaaauuagaugguugugguggugcaugccuguaaucccagcuacucagagaaguguuugaacccgggaguuggggguugcagugaguugagauuucaccacugcacuccagcuggggcaaaagaaugagugaaacucugucuccaaaaaaaaaucagagcgugguggugcacaccuguagucccagauacuugggaggcugagauggaggucaaggcuucagugagccaugauggcaccacugcacuccagccuggacaacagaguaagaccuugucuccaaaaaaaaaaaaaaaaagccaaaucuguuggguuuuuuuuuuugggggggggguccuuuagaauggcccugacagaucuuuaaggcauggaaaugagccuuaugcaagcuccuggcaaucaguaugugaguucugucuccuuggcaagauacagccucuuagacccucagucuggggaaauaaugcugauuucuccuacgaguuacgagaauuacgcuagaaaacucuguggcgcauacaggugcccuguagccuguugguuagaagcacugacccugaagucaggucgcccagguuggaauuccagcucugccuucuucaagcugugugacucugggaagucacacacacucucucuuugugccucaggcucugguucugaagaugggaacggcaggcccucccucuuuggcuuguugcacagaugaaaucugacagcguaugccaagcgcuuagcacggguagcagugagugccccguaaauguuagguaccuuccuacuacuacuaaacauucauucuucccuucccugcuaguaccugcagcucugacucaucucacacccuugagagaggauuaucuucauuaaaaaguuuuuggucugcccagaagcaaguguuaccugugagagagcugggcuugugcauagguuagauuauuucuuuggguuauuccuggggaaaccugcaaagaaaugcagccagaggccucugguucauuuuacugcucaucuccuaaaagugguuucucagauuuuuauccuuuuuuucucuuuuucgaggaaggggcaaggaaauauuuuuucauauuauucuugucaucgucuauuuauuuaauaacaguugacuguugaaacauaggaaaguacuuauccgccaggaaacucccuucuauuauuggacuuacuugcuuuccauuuauauguugucuaauuccaaagagauuucgagacagcuuucaauuaaaaaaaacaaacaacaacaacaacaaaaaaaaacaccacauaccgcauggguauuacacaggaccuguauggucaaauuggcaacgaccacaccacaugagaaggaagauuauucuuccuggaaccuggcucccuugagauucuuuuuuuuuuuuuuuuuuagacggcguuucgcccuuguugcccaggcuggagugcaauggcacgaucuccggcucaccgcaaccuccaccucucggguucaagcgauucuccugccucagccucccgaguagcugggauuacaggcaugugccaccacacucggcuaauuuuguguuuuuaguagagaugggguuucuccauguuggucaggguggucucgaacucccauccucaggugauccacgcgccucacccucccaaagugcugggauuacaggcaugaaccaccgcacucccuugagauucuuguaagccaaggcagaagaagagacaucuuaaagucuguaugugcacaccugccuccccccauuuuauauacaauucaagggcuuugcuuuuggaaaguuugccuauguagucguccagggcuaaauuaacaccugucucuaucuguguguaaggcucucugggaggagcugugaggcaaauaaaaauaaggaauggugucccgcaaggagcuuacaaugugugcauuacaaguauauacugagcauggcccugggaacacagugaaaaaacaggauuccugcccuaguacaguguacacuaguggaagagagagaggcaguaaaccuaaaaguaagucuuuuaaaaacugugguaaaaugcacauaacauaaaauuuaccauccaaccguuuuuauguguacaguucagugacaguaagaacauucacauuguuuugcagccgugaccaucauuuauauucagaacucuuuucaucucgcacaacugaaguuguaccuauuaaacaguaacuccucauucucucuuccaccuaggcccuggccaaaaacaaaaauaagucuuugauuguaaacacgaucagugcuuugaaggagaugggaaggauguuaucauaaaaugauggggcugcaggaauggcaccuacucagagagggcggucaggagagaccucuugggaaugaugacauccagcaggcaggucauuaaggcaucucuaggcagguccagagugcaaggaggcauaagccaggcagguggaacagcgugugugaaggcccagagucaggaaauggucugcuuccuuccaaggaaaagaaaacagccagugugguuggagcaggggcuaggagagaaaagaugugcauguguguguguguuuguguauccccaucaugauuuaguacugucagcgcuucuguguucugaaccuggaguacaggcagacacagccgcaucccagaagcucaagagugcccauaccaggaaauuacagaaaucuuugccaaauggaugagugaaugcaacuuccuugauacagggucagagaggggaaaucugagaaaagcaggugggcaauguacuccugacauacucccuuccguugcaauggccuugagugauggagcaagagugaaggaauguucccauggcacuggcaccaggaugacuuuuugugaagcagagcaguuggucuuagauaguggaggugcgggaggcaugagaacugggcagucugacggcugcaccagccaguuggcuguccuuuccaccuccaugcccaggagcuggcccagggcgcgcaugcacaaagccagugcucuuuucaaucagaaaacagccugcguauguucuugcuugcaacucagauauccagcccacugauccaggaagagauuccuuugaccugggaagucauaauggcagauauuuagacccagcucucaagcaagcauccaaguuguuccggugaacccguaacuuugaguaaccucugauugaaccagagaguaggaacuaggugcagaaccuuguugaauagaauuguuuagcaucguccauuuguuagagcauuucaggaugccuguccuaaaauuugguaucauaaugguauuuaccucucacucaccuccaucucagcccaguaauuaauaacaagggacuugcuucuucaccuguuucuuuauugguuguaggaagucuuuuccuuaccacagaggaaggagcuucuggaucccuuugcuacguccagagaguuuucaucuaaucuggguguauuaguccauuuucacacugcugauaaagacauacucaagacugggcaauuuacaaaagaaagaaguuuauuggacucacaguuucaugugacuggagaggccucaaaaucauggcggaaagugaaagguacaucucacauggcagcagccaagagaagaagagcuugugcagggaaacuuccauuuuaaaaaccaucagaucuugugagacauauuaacuaauaacagcaagggaaaaacccaccccaugauucaguuagcucccggcgggucccucccacaacaugugggaauuauaggagcuacaagaugagauuuggguggggacacagagccaaaccauaucacuguguaaaaguugaauaaaguuauuuaggagcacauuguauugggaguuuguuuguuuguugaagagccaaguaaagucauuggaagcaugggaaacuuuuuucccugucuaaaaggaacuccuuccuaguggaaguugaaagcuuucuuggcagccucagcccccacccuaccuccaccaccccaguggguaccugcauccugaagacccuucacaauagcaucugaacuauacugggccuucaaaugaugucuuggguaaacccauguccaaccugcacuaaaugaagauuauuuucgagcgaauggauugaagaacagugcugaaaaacuagaauuuguaauauuuucauuugagcagaggugaaauuugaaauauuuuagaaucuugucuuaugauuuuuuuucuuucuuugccacauagcccuccccuggaaauuaaaucuguggauuacuaguauaugaacugaucagagacauggcuuggggucuccccauuuacccacuucccagcacguuauaauccacuggacaccuccaaggaugagagaccagcgggucauaaugcgagacuggacaucucuccuaccccauguacacuucagcugagcaggcagaauuagcagagucaggacuagaaguucagucuagggaucaaauaauaauaguagcuaauguuuaaagaguaccuaagauccgccaggagacauacucaguauaguuccgugguuugccacauuucaucuuauaccaguagcacaggugaaauuugucuuauguguauacugaggaaaacaagucccucugauacacagcagccaauaaaugacaaagcugggauagaaacuuacuucauucuaacccgagagucccuguucuugcaugggcacagccugccauccccaugcucugccuccuaagcagaggaugaacuuaagcaucuuaaaauuuuaaacauugacuuucccuaaaaccaauuaaaaaaaaaaacaaaacagacagacagacaugacuugugcccuuaaaaaugcagccaggcuggcauauaaaugggcguaggcuguuucuaaauuuuuugcuuuaaauuuugccagcauagcuucuggacugguaguuuuguuugcuuuuuaauauauuuuugacacuguguacagaggaaugcuaccucgcgucaucauguccuccucccugaaggcaagccaaggaugucaaggggccacuucaggggaugugcacccugaagguaaagcugcuccagugggagggguugggguaaaugacaauguuagcagcugguaaauuuuuuuacaugggauaucucacaagacuuauugaugcauguuauacguaauaaccugaggcacaucaacauuuuccacuuuuuccuauucuuucuguauuuucacugauacuuuuuuucaaaaaaaucuccaauaaguuuaggaucagcuucaagauuucucuuuagguaaauagauuuguauuuuugauggccauccuaguccaguguaaagauauggacaagaaaccccacauaaaggaagcaagaucgcuggcugcuuucucuagguagcuugaguuguauacuaauuuguagauuauuucucuucaucgaaaaaacaaaacauucugcagagggcagucauguguccgcugugccucugcuccugugugcaccauaaaacuugaaagugagccagaauuugaaaauaucggauugggaugugauuucuuuaagccucuggcuaauuuaauauaaaguguuuacacuucauuuuucuggcaguggauuuucuauguaggugguggaagauuuccuguaaguuuugcaaguuccagggcaaagagaguugcaauaugcaauaucuuucuguggucacaccaacagaaagggcgauuucuuaaccugcugcaguuaccauguguguagguggaugcuggcuauuacagaugguauccuuucaacccucaaaauuguugcaaguucacagguauguuaaugaaaaugaauaaguggcauuuuuaggaauuccaaauacugagucuuggaaguagauaaucuuuucccuaaauguaugcuccggucagaacugcugccuaccacaccucgugggugaaacagauauuucgagcaugacugagcuuauuaagagcccugcggcgcuuccucugccggggguuuagaaauuucaaaggauggggguugagggagggaggaguuaugggcaugugauguggacagggcgggcaggaggauggaaguaacagguccaaaauguaucuuugguggcccggcagagcucuugcauggggugagaaugguaauuuaggaagagcaagucuucccaucugugaagcagaagaaaaaaguggacuuaaggagaaguucgggugcuguuuauuuagauaggaguaaggagagugcaguuggggaaaagcacuucagaggcuuuacuuagacuagcagaagucuguuuggcagggugggaagcaagugcaguugggagaaaaacguuuucaauaggcaguuucagaauuggaaauuggaggagggcaguccauuucaacauuuccaacaguauuaaagaaaauuugcggguuguuugucaaaaggggucauaugcuuuaaagauugagagaucuuuucggugaaguaggggagcuggggacaucgugaugugacaagagccgugggcucagaggcuggggaccuggguguuuaacccaacucuugugagugguguggcuuucauagcuuugguucucuggucuucacuuuaucugccaagugaagacauuugacuggaugucgugaucuugaguugcuuucagcuccagaauucgaagaccccuuccauugggcauucaucuaauuucaaagaugcucccuggcuccagcucugcagugaagcagaacaaacugauacagccuagcuuggggguggggagucggcccuccuuuuccccucccuucccagguccucugggugauugggggaaacugagaagccguucucuucuccagagcacuccauuuaacaagcauugcagagccuggcucgugcugcagugaacaaaugcugacuucagccuuuacccuggguuucaggucacacugauuguuugcaaaacauguucuuuuuuugucacuugccaguacuuguucucugugaguaaaacacaaacacauccucagggauguugcacaccaguuugcagccugcagcuucugcccucuggccugcccagguccucggcuccgggacgaggaugcuccgggauuucgggagacagcaguuguuuugacaugaaucucaaaguuccuacaaagcuuauuucuuugaagaaggccaaaaaaaaaaaugaaacauuuucagaucuuuguuuucagauuauucaaguccagaauguuggauaagauuuuugaagaagagauuuaugcuugagauuccuuuuaguuucuuucuuucuuuucuuuucuuuucuuuuuuuuuuuuuuuuaggugacuuggccaguuuggguuuuuacgguguucagggaaaggguuaagaaguuaauuugggaaguacagucauguguuguacaaguugcugucuacugaucccuucauugagcaaguaaacuucacacauucucgugucugcaaagcauguggaugcaugggcaguuauguguaugaacuuuuuuuuuuuuugagaauggcuuuaguguucagaccaaggauggaaugaaagaucacgugugcuuuccacuguagagcugcccugcuuguuuugauuuuauaguuauucuaaguguuaaguuccuucaucuuucaaagcaaauuccuuugaucccugaaaaucagcuaauguuugggaggcaauuaaaagaugaggcugugggguuggggugaaggcuuccccagcaggaagagaggagaagcccacuggaucugggagcacggugcuaggacucucuaagcgugaccuccuucaguuuggcccagaguggucagauaguuugccggggcauaggauggaugacaggccucauacgcaucacgucugaagggaaagcccuugaauuuuccacgcuacuuuuuaguaacaguaggcuuugucauaauuggcuucauguuccagcuuuccuaaaacuguaagugauguugggugggccagcagcaaaauaauucacuuuacaauuugcaugauagucuggaaugaaccgaauaccuaaaaccaggaaauaauaguagauauuuaaugguuuggggaucaaauaagaauuuacucccagauguuuccuaauuaauuggaaaaagcagaagguugcuggaaggccaucuccauugggcauuuacaggugaaauucacucuucaacuaggauuuuacucaugggaugccuguguucuucauuugaacccaauuuuaccuaucaucuacaaaaaaagaaaacuauuaagaguuaaaaaaaaaaaaagagagagagagucuugaacuuugaaauccuucauccacguuuuauaaaguguggggucagauuuuuucccuaguugaaauugaggaaaugagaguugccaauaugauuggauuuguacugccaagaugggguuuuagcacuucuaaugcauucuggcaaggcugguauacuuguaucaagugcacagccccacuaccaccagcucuaccacccacaaaaauaaaaacuagcaaaauaaaauaugagccaacagaauucugugggaauggcaaguguuuuguuuuuguuuuuaguaguaaucuuugcgagaacauuccaaagaugauaguuuuacauuuguauguuuuuuuccgaggcacuuuugaaucaucagauagauuaaauauaaguuccauguauuuuugaaggugggaguguucuuugguacaguucccccaaaaaacugguucucaugaggcuuaugugguaauucuguuaacgagaauguaugauuaucugggauacucuguucugcucuccauccuggauaagaguuuacuuugaaagucuaguugaucuuuugugauuucugcacaauguaaaagguacuuuaacuucaggagauagggccagcaaucagauuugaugauggaaaagaguaguguagcauuuaagcauaauguauacucuauaauaaauguuuacaaguccaaaagugugccaucagaaaguaaccagaucaaaggagaggugaccagagaagcuggaaagauaagaaauaaacaaguuucaagguuacugaucuguagcuguugcuguccaugcuucuuggcagcuuuaauuaugacagggagagggacccagagggagagagagagacugacuuacacauaaaggcauuuuaucacaaagccaucuaaaacaaaaguguuaaaggcacaaugcuguguuuaaaaagcauguacuucuuuaagagcucaaauuuaaauauauaauacaaacuuaagauccaaggaagaaaauggacccaggacacgaagagaaguuaacgccacagguaaugcagauggccaagagaugugugaaaaagauaauccagccucaccaacagccacagaauugaaaugagauaccuguuucugcuucuggcauugggaaagaaagaaaaauggcacuagcagccuuuuuuuuuuuuuuuuuuuuuuuuccccaaaaaauuugcuacucuugagguucugucaaagaaugugcuguggccucuagaagcauuuuuaaaaagagacuuucacaagugauugugcaaaauugugaggucacugaauagguguguauccuccuaaggagguagcguuggaggagcuguucuuguucaauuuacucagcaccugugaagaggcuucacugugauuugccuguacaggugugcagguaaaaaucuaaguuccacagguagugcaaaaaaaucuaccucccuagguaccucguacauuuaucacaguuuccugguaaacaguucugcuguuguugacaaaauuuuaucagaaacauugcauacucuucucuaaauaguaguuucccuacaaguggcugucuucaguuuagucguuuaaguuauguugacauaaaugauuauguguguggcaggggcuuuugcguagguuguugaaacauugcaccuuuuggacuaacaguuuuuaccaaaauaggcagaagugacauuugcagccacagcuguguggcauugagcgucuaagguauguguaauaggcaguguaucgguagcauugauaccuuggucaacaccaguaagccauguaauugcccagaagugggcucuaacacuaguuuuaggagaugcagccaaaacgacaaagcuggaggccucucccucugagcuuggccuccacuuggucaaaacaguccccaguuugucccuacgggacacaggccugccuuguuaggaaaucagcaacauuuaggagcccacaauaccucacauaacucuguguacaguaacagagaauggaaauagggcuguaagcaugaacaaccagucaaguuacaaauauagaauacucucucaauuccacuuuaguuagucauggagggacagugugaguuuuauaaacuuauaaggaauauacaaacaguuccaaauuuaaaauaacuugaaguaacuuuuaagugugugaaaagaauauuuuuuuccacccuguccauuuaagcaucugugacaggcaguauuaagugaugggugucuuuacguacacaugccuguugcucacaguacuggggaagaguugcaaaauagucacccauucugcagugauuucucucuucuuauuugugaaagacucaaaaaaaaaaaaaaaaaaaaaaaaaaaaaaaacaacaacaaaaaaaaggccaggcacgguggcucagaccuauaaucccagcaccuugggaggccaagucagguggaucacaaggucaggagagcgagaccauccuggcuaacacggugaaaccaaccccgucucuacuaaaaauacaaaaaauuagcugggcgugguggugggcgccuauaaucccagcuacucgggaagcugaggcaggagaauugcuugaacccgggagguggagguugcagugagccgaaauugugccauugcacucuagccugggcgccagagcaagacucugacucaaagaaaaaaaaaauaggggggauguggguugugagagcgacacuguguguccaugcgugaagaaacccggcucaugaugaccucgccccagaacgccgaagcagggccgguccagccuggauuucacaguguucuucauugccuuuguccuugauuuuuugucguuaccauuauaacuuaucucucuuucccaaauguauaaguaggcuuugaauaugaguuuaaaagaaagaauucggggaugauuucagaguacacuagaauauuuuuuaaaagaauauuuuauaaaaauacagugauaguaaaagaaguagaaggccaaauuccgcccccagccccuucuuaauauuggacuuuauuccuuugcuuuuuucccuugcugccaucuaaggaggcuuucugugcuauagcauccaguuccucugccaggcauuucuguaaagaugaggcaccuuccacuguuuuauucuccaucauuagagcacguguccugcugacucggagcagaggggaggcacacgggggugaacauucccugacagauuggaugucucuuaacucuuuuuuccugguaucaaagaauggcacaauuuaguugauuugauagcguuaccaaaucguuuuuccuuuagaaugaaucuagaaugcagauagauucugagguccagaugggccucucuccaccaaccugugaccaguguaccugugauuuuaucacugcacauucauagaaagguuacagggcuaaucuucccgugauaugaaucaugaaagucaaaauuuaugaaugaaaauaaaaaggaaugaaguacugauauaugccacaccagagauaaauauugaaaacauuaccuaugcuaaguaaaagaagccagucacaaaagacacuaccuauugucugauuccauucauguaaaauauccagaauaggcaaaucuauagcgacgaaaaguguaauagugauugccugggaaaggggcgugggaagcauggcuaacggguauuggguuuuucuuuggggugaugaaaauauuguuaagauuaauuguggugguguuuguacaacucucuaaauauacuaaaagcuaccaaauuguacacucuaaaugggugaguuauaggguaugugaauuagaucucaauaaagcuauuguaaaaaaugugugaaggaaggggaagcauccuauaaccuauaccaucccaacagcccagcuagaggacgauuccugagccuccuucucagccuuuguguuaauucuuugcauugaugacuucucucucuuuacccuuacuaauuagcucucaaaaccucuauuuaauaaugaugcuauuuauaacuuuccuccuucugguuucuugcuugcccuuuuugugguguuugcuuguuuuucuuuuuucucaauacucugcccagcguugcguguugguuccggagacuuaagugauccagugggcacugucaggcaauuauuucuuuugcucauuaauuaaguguucacagauacauucagcagccaaaccuuguggcaugccuucugucccagacagugagaaucuacuuggaacuuggauauuucugugagccuugauuauauacaccaccaaggggauggcauagaacuaaguuuuuucuucuucuccacaacagacuuuguucuuuaauuucacaagcuugacauagccuauaagacaucauagugguaccauagacaguuuucccuugaugcccaugggggauuuguucugggaccucccacagauaccaaaauccacagguuuaucagcaagggucacugcucaauugcaacaacugaagcagaagcuccucucaucagaggcaguuacugcagcauguucuguagggcaaauauaaccauauguaagugacugugcuaucaggagacagaacaacaagacccagaaagacucagugacccacagagccaguuccacccaaacaagucuuaguaaugagauuagauaaugagaguguauuuucuucaucaauucauguagcucagcaaggcuggaaacugcuugcacacuucugcagagaaaaaaaaaaguuccauuugcuggaacucaauaaauaaagaaggccuuaguggguacguguuaucuccuuagcaucaccuggaugccugacccuuuuccagagugucauguugccuggguuuuguccuucagucuaagugauacaccucuuaguguggcggagaaaagggugcuguauuucuuccugauggauacaugcuuaaauggaaaaguagcaugagaugaacucccauagccccuuccuuuuauuauuuuuaaaauauucauucauuuauuuauuuauuuuugagauggagucucacucugucacccaggcuggagcgcaguggcgcgaucucagcucacugcaaccuccgccucccggguucaagcaauucuccugccucggccucccgaguagcuaggacuacaggugugcccaccaccacaccuagcuaauuuuuguauuuuuaguagagaucggcuuucaccauguugaccaggcuggucuugaacucuugaccucaggugauccacccgucucggccuuccaaagugcugggauuacaggcgugagccacugugccuggccggcccuuccuuuuagacaauagaaacaugcugcaaccacauaccaccauaaacacggugggggaagaggcugcaaucaacagucaggaggaucuggguuccaagcccagguuugcaguguaacagcugugugcucuuggugugaacauuuggucauguacaaaugaggauaaugauacugcccccuugugaucauuagggggauuaaauuaaaugcagaaauauaugugagaugcuuaauguguuguaaggcgcauggaauauauuuagugaauauuaacuguauauuaauacaaaguccuguauucagaaucuccaguauaaauuacauuuauauaguagagauaugaauaguuuuugugaacaagaagaccuggaacuucaggugacuagaagcucagagugagccagcuauguuugaugauaguuauucuuaagaucacacagagaaacggcaagcaagcugcuuugggcaaaaaagagcauuucuacacuguucagacugccucuguacuguuagaauaggucuagggcguguugcgugaguggugacugaguaagauguucagagggaagccgugaccgucaucuuggaauauuguuugaaagucugaccuguacaaagcagcacucacuuccccugcgugucagacaccugcaugagggcuggggaggguccaguacaggaaagcgcauuuuuaauauguguauggaggaaguucgucaagaugggugccaucuggcaguggaguagcacuuccuggaaaguaaugagcucccuuggacuuuguuugaagagucacccagguuuuuguaaagaaguguuucagaucaguaugcaauggaugacuguaaauuucucuucagaucuaagaaucugugauuggaugaaagggagaaaggacugcauaagugcuuguugcuuguaaacugggccagguggaugucauggcccuaggagcuucuugccugccuuugcaugccauaaagcaguccugcaacccagugucaccucagagggaugggaauguagaagaagagagugaauagggacagugaugaggggugaaaauauguaacuccuugccccuucuguauacccuaguacauuaggaaguucacccuugucuaggcuuccuguuaggaagacagcagacucaaaauggagucucaaccccuuucaaagacugcaagaucuccuuguacacacuggacuugggagaaaaugagagcuuucaggccugcuaucuuaacagguucagaaaggugugguccagcccccugacuaaccagcccugcugugcacacugagaauucugcucagguguaccuuucugugugcuccugggugcacccccaaagugcugguucucuugaaaaccuuuuuauuuagguucagacagacaaacugugguaucuuccauucugaccauaaaguguuucuucugggucuaacuacuauagugggauauuuucucuagaacaagagguuguuucuuuuuggcauugagaaauguugccgaugugauuuucuuuugugaacguuuaagacacagcgcuugccacuugaacuuucuuuugccgugcguagcugauuccacauaauggcugcagcuccaggcagaaaccuguuuggaaguuguuuuaaacucuuccuggaaucucuaggcaguggcucagugggguuuuuuuccaaccauuccuuaggaugaccagaagcuugacagaauccucuugucuucauuuugagaaaauaugucuuuacuguguguaugugcagcauuugguuuuaccucgugggucuaagcauuuucaacuaagcuuccuuuuccaaccuagcagacuuguuuaaagaacuucaaacuaauagccaagcuguaauacgguggcucucucagccugagaagccugugcucaccgucacucucuucuucccuggggugauagggauggggaguagugugugugagaggacagaagcgaggauugauugaagauuauuuuacgaggcgagagcaugguggcacaccugucagcugaguggacucagcgccugccccggcuaggcuguccuccuccugugccagccguggguucccugagucccucugcagucauucaugggugcugaaaauaaagauacccuuucugucgaaaguguucgccgggcugccucugccucccuggaaaagcagcagggcacacaggcuuccuaggcagccccugagggaggggcucuuuuuauugucacucugguuaguuugaagaccagacagaaggcagcaaaaaccaacccuuuguugaaaacucuuugccuuuaggcccuugguaccauguucaugaggcuccagauaauuccacaaauacauuauuauuguuaccuagacuuggggacagagaagggugaaacaugggucugggaauucacagaugaauauacuguaauccccucgagcacauuucuuuuaaaggaauggggguauucuaaaggagugaacacuccacuggggggcugcuaggccccugugaacgguggcagccuuggccacggugugugcugugaucucuccugggucccccgggcauccucagaccucccccacacccaacccacagucccuucuccauccaucugcugaccacaccccaggauguuuccagcucagaucacgccugauugcauccacacaaacugcacgccaggcauuuccguuuggauguguacacaaaaacaacacgucccagacugagcugaucuuucuguaccccucaaaagaaaaguucuguacccggccaggccugguggcucacaccuguaaucccagcacuuugggaggccaaggcaggaggaucacgaggucaggagauugagaccauccuggguaacacggugaaacccugucucugcuaaaaauacaaaaaauuagcugggcaugguggcgggcgccuguagucccagcuacaggagaauggcaagaauccggaaggcaaagcuggagcuugcagugagcugagauugagccacugcacuccagccuggugacagagugacacuccgucucaaaaaaaaaaaaaaaaaaaaagaaauucuguacccuuccagaugguccuggacauaucuugaaucuacccugcuuuuccucaucugcacugcuguccucuugaucugggcuacugaggcuagaaugcacaucugaucaugugccuccugcuuaaaauaguauuuuuccucuuaagaguaguccaaacuccuauugcuggauuaaaaggcuguuccaggcucucccuaccucagggcacaccaucuuuccucccagucuccccuccccucugucuccagugcuuccauccuucagucaugcugagguugucuuuguuaccuuugcuucucuuggcccgcacucucuguuggcucugccagcaucccuaugcaccugcuagcuccuacucacuuguccagcuuuggccuggaagucccuuccccuggcaggcagcccuaagcuacccuuugcuugcuacuggcucauauucucacugcuuguccucaggcugugagcccugggagggcugggcugaguccccgaaccugccacgucuauaggguguaaccuaccugaggccugacugcuaaaaucaaaagaagccuuucucauuugcuuagcugagcuaaguccuuucuggagaagaaugcccacguccuggguggacuucuguucggccuggggcaggacgcugcaugucaguucaccuagagccccucgcuugcccucaccccucucccuuuccuucuccuccccguguugucucauggucaguuccucuccuggcaaggcaagagaaucauaaaaucucuuuggaccaugugucucucugaugcacuuuggagguugaagcucacuuucgugaaguuaggagcgguuaauccuccugcacgaggaugcaugccugcuagggaaagccucccugcguuuauauggaacagugguguguaccuuagggcaacccagaaacagcugagauggcccuaaacucuuccguauuuugauucagaagcuuuaccuuauuugaacaucugcagaauaaguucuuuccuuuagaaaugauuggggauaaaauuguuugcauuaugaaauauuguauggccagguggccccucuuucauguuuuguuccuugugaagagguugagucuccuauuuuuuuuuuuuuuuuggagauagaguuuuguucuugucccucaggcuggaguaaaauggugcaaucuuggcucacugcaaccuccgccuccuggguucaaacgauucuccugccucagccucccaaguagcugggaucacaggcacgugccaccacaccuggcuaauuuuuguauuuuuaguaagagaugggguuucgccauguugggcaggcuggucuugaacuccugaccucaguugaucugcccgccucggccucccaaagugcugggaucacaggcgugagccaccacgcccagccuaugguaugcuuuuaaaaaugguuucucugcacuaaugauuauuuaaaaaaaaaacucuggcaagaacaaaaacaaaugguuuuuuaaaaacucuagaaauaauuugauacauucgaggacucuggagagggagagaguuaaaggcugaugugugugacucuuuuuccucuccccccaaggaaaaaaaaugaagagaaggagcuuuuaagugcagugccucguuuuuaugugauugcaaaccugaaccaauccuuuuagugguggaugugggacauguuagcuuuuccaacaguuuagaugggccuuuguuuuuauuguuggucacuguaagaauuccaaggaauagaaggaucucaugggcaaaaucaguuugcuuuuuucucuguauauuuguuaguuuauagcagcuucuauuuuccuccuauuuuuaaaagcugaaaugccuuuaaucgcacucaguguguuuauucauggaagccagagaagagggucccuuccuuucccccauagcgccguaauuggaaauuugguaguacuaggugaaauucucaguuuuggcgcucgcauggaacagccauccaucugcuggcgagacacacugcccggggcuuuucaagaaaucccuuaaugguccugaacacuaauaauauuuauauacauugagaugagacaaaauuuacagcgggcucuggggcuggcuccaggacucucuaaucccacacuugcucacguucucuugcuugccuccuagaauccuuucagguugugcuucagugaggggagcaugguguccgucucugcagcaaugcuuauuuaugcaguucguccucuaacaaacagagcaacuuuccuuuugaccuuccccucuucuccccaucacauuccauugcugcccccgcauagagcaugugcuuaugcauaguuugcaucauuuaacacgaaggaaccccuugauuugugaucccuuuaagaaguugcucuguauauaaagaaaaugauuuuuccugguugguuuuacugaaguuccuucagaaauagcucccaccaccgaaacacaccugacuuccccagccuguguaucgguuguggcacggacugacugacuggaugguauaauuucacucacuccuuugggaaguuucgggggacuacugcucagaugugugggaaaugcggaauauaucuacagguacuuugucaguuuuuuuuuuucuuuucuuucucauccuggaaaaucccggcauugauauuuagguauaacuauuugcaagcaagugcagagggacauuuuucuguucuuuucaacguucuuauuacuacugcauuaauagcuacuugaucuuaaugucuauuacacaucauuuuauauaauguuuucuuuaaauugucagggaaagggauucugcaaguagauguugguccccccaguuagugucugaugaugaugguaagauucucagaguuuccuuccucuaaugacaaagcauggugauggugaugucugaagagcagccucggugcuccaagauggguguaugcuuaauacugcuggcacacgccugacgagcgggaaugugagcguuguuucuguaaccaguuuuacugaaccucacagauccauuauacgacgugaauuuugugggaauaacauaggcugggagucugcucucuuccagccuggucccucucuucuuucagcccuacccucucugaucaucaugucccuugcacugcggccagguaaccuuucugauacgaaggucugggcauguuguucccuugccuaaaacuuuccaugguuucguauuauccacaguugggcuaaacccucugggacaggccuucagugccuccccgggcaguggucccuggccuucuucaguaacacccaagcccuugcacccacagugaccucguugcuuuuacaagcauuuacaugugauguucuuuauuccucccuugcucaucuuuccacuuucaacuccacaaaaccguccucggcacccagaagcccaggaaacaccaggcagcuccacucacucccguacuugcugugucguccguucccuggggacaggauugucgcugauccugcgugcaucugucuggcacacaggugcagcacacauuaaauagcugcuaaaugaauaaaugaagaauagauggaauuauauucuguugugaccaguuuaaaaacaugaaauuggaauacccaauugcaguguuucuuuagaucuuggaccuugaggugaccucuguaauggauauauuugaaauuauuaacugucuucaaguggggguuugaugagagagagagagaguguguguguguguguguguguguguguuuacagaaaauaugcuagguuuguacauucaaauuuguguuauccucuucaagaaagucaccuugguagacagcauauauaucccaacauuuuaggaacucauaaaaugcauacuuuuuuggugugaucagagauggguaacuccuuauuacuuguggguuagauuaguuuuuggaaauagccuggagucauugagagccaauccuuaucaacaaaauggcauaaauggacaggaauggguuucuucuucacuuuagagauagcucugaagacaugucucaguugggauuaguucaguugcauauaugaauagcagucauugaaacaagauaaaaguguaugucucucacaucuaaagaagucuggaguaagcaguccaggguuagccuagcggccccacucucauaagggacuaaguuccuuuuaucucgcuucaccauucuugauguuucgccuugugguccaagguugguacuugagcuccaagcauuacuacugcauuccagccagcaaggaggaggauggccaugcccucuuuguucucaggagucuuccaggaaguuccagucacaacguuuguuuauaucucacuggccagaacuuaagucauauggccaccucuagcuacaaggaaggcugggagauguagucuguaacuggauggccauauuaucaacuaaaaauuacugaaaaugacaagaagaauaaauaauggaaggcaaccuguuguuucugucaaaggaugacuucaaaagagaaaguugcaaaaguauuucaagcuugacaguaucaugacaguuuucuucagaggugacgcuauucauuugcauguccaaguucugauaucuguuuucaaguucaccuauuugcagcgaaauaggaacucuuggaggcaacuaguggguguguaaaccgguacaaacuuucuagaggacaguuuaacccaacaagaugaauucuggaaauugauccuaaugaaauguuaagggugcucaugaagauugcuuugccgauugcaauaauaaaaaguaaagaaaauaucuuauaauuggggacagguguaacuuaugauacauuccacaauggaguguaauacugcuguuaaauguuuguggaauucacaaucuuuuaugccaaaagaaagcuuucagaauggcuugucuuuuuuguagauacuuguauuuauauguccaugcacauacauaagaaaggaccagggaaggucugcuugaagauauuaauaaaggggucacuuguggguagguggacuuacuuguucucuauauucucuuuacuuguuugugaucucugguuuuuuuaaucauguauuuuuauuacaagaaaaaacaaauucuagaaucuccacucaauauugcaugucagagucaaaaagauacacauuuaaauaauuuuguauuguuuuccaauuugaggauaaaguaggaaauguauaaugcaaaccagauuucauauuuuguugauuuagacuuaauuuacaaguaaggcugacagcccacagagugugaucacgacagcauuguuauggaaauaaaugccagcucaugcauuugggauguacaccauggaucugugguuauuagauacugauuucacuuuagcacacgaagaggcuuagcggagguggcuucuaauauccuaugguucugugggcucggagaugcuacucacccacuugucagaggcauugaaaccagagcaacugcaucuugaauaggagcuagguaaaaugaggccgaauucccagacaguuaagacauucugagucacaggaugagguuaaaggucagcacaaaauacaggucauaaagaccuugcugaucuagcagaugcaguuaaagaagccggcgcaaacccaccaaaaccaagaugguaacgagagugaccugugaucguccucacugcugcacucccaccagcgccaugaguguuuacaugucauagcaacaucaggaaguuacccuauauggucuaaaauggagagguaugaauaauccaccccuuguuuagcgugucauaaaaaugggcaaccagcagccuuccaggcugcucuguguauggaguagccauucuucuguuccuuuacuuuccuaaucagcuugcuuucaguuuacagacucacccugaauuauucuugcguaagaucuaagaacccucucuuggggucuggaucaggacuccuuuccuguaacacaccuauguucuuggacuuaagaaugacccucagacauggugacuucuuugucaucuaacagcuuuggcuuauuugagguaaaaccuuugauaucuaaggcagcagaaauuucccugaagucauuuugaaugguaucaucuuuacuauaguguaguuuaaucauuuucaaaguaagcauuucugcacacuaaggcuuuaaaagaguuuucaguaaggaacauauuugaaauggaaagugagcagagcacaaugccuuuuaaauuacugauaaaccauagaguuccuguagggcuuccacuggcugacccacgccugaggcaacccucaaauguggguauuaucccccucauuuuacagaugggaagagagaggaucaagaucacagaagcuaaugguuugucccagaccaaacaaggaguuccuaggagagacugaacuuuaaagauaucgacucucugcaggucuaaguggaugaaaggacaguggugggggugaggauuucguaguguguuuuugcauugucuccucaaugagugaucuggugcuggugguagcagugaaugacccagaaggaugcuggccaggcccagagaaggcggugccuccccugcccggucucaucuccgucucuccucucucuccacagugugcccaagcacgugugggaagcgggcgugcaccgagaacaaugagugcugccaccccgagugccugggcagcugcagcgcgccugacaacgacacggccuguguagcuugccgccacuacuacuaugccggugucugugugccugccugcccgcccaacaccuacagguuugagggcuggcgcuguguggaccgugacuucugcgccaacauccucagcgccgagagcagcgacuccgagggguuugugauccacgacggcgagugcaugcaggagugccccucgggcuucauccgcaacggcagccagaggucagucgcggccacacguguggucacuacccgccccaccucacccgccacccuagcacacaaagguagacucugucgguuguuucauccgggugcagcccucaggaaguucacugaggugggucauuuugagagggcuggcuuaccuuaaauguuuggugagauucuaggaacaauuggcauggcuuaccgccccccucaccaguuuguuuuauauuuuaagugcauacugccuggccauuugaaauuaaguacuugcuugcugguuucgauacccagaguucauagucucucuggguacuugccaagcugccaucuaagagacagggaacuguaguuuuggauuuuccuagucugggugcugcuagccaggugaggcuuuggaagugcaaaagaaaagacaugcuaagcccccaccaccauccuugagaccagcaagcggaccuaaacaucuuagugcaagagcuagcagcagcucagaguaggcaguagcuuaaaauaagggacauuuuuccaucagcacuuccuuccucucaucccccucuaccuugacccucccucagugcucaucauguccuucauuuuccuuccugaacuuugagacuucacuugggaagcaaagaaguuccuuauggccaggcauguggcucacaccuguaaucccaauacuuugggaggcugaggugcuuggaucacuugaggucagaguuugagaccagccuggccaacgugaugaaacccugucucuacuaaaaauacaaaaauuagcaccuguaguccuagcuacuccgaggcaggagaauugcuugaaccugggaggcagagguugcagugagccaagaucacacuacuucauuccauccugggagacagagucucacucugucuccaaaaaaaaaaaaaaaaaagagaaguucguuauaacaaaugccauaugcccuuuuguacaugucaacuggacuucuauaaauuugucauugguuuaugcuuuugaaaauaagauguuagcauuguuuaaaaaugugauaacuauaacuuugaaagcaaaagaagauuggagauuugggguugcuguucccuuuccuggagcagaguaaagaacuuuuaggggcucacgccuguaaucccaacacuuugggaggccaaggugggcagaucccuugaggccauggguucaagaccagccugggcaacaugcaaaccccaucuguacaaaagauuaaaaaaaaauuaguuuggcuugguggcacacaccuguagucucagcuccuugggaguugcaagugggaggaucaccugagcccuugaggucaaggccgaaauaagccaaaaucgccucacugcacuccagcacaggcaacagagacccugucucaaaaaaaagaacuuuuaggaaaguucuguuuuaguggacuaaaugccuccuucaugauuagcaccagggggccugucuuucugagucugucaaaaucuauucuacaaauauaaaaauaucguuagaaaaguagguguuaauuuuaaauauaauuuuugcugcagcuuaugaaguacauugaggaaguguuuauaaaggggauucuuuuucuaguguauuauuuggagacgcagcuucuacuguaggcuuaccuucaaaucaaagauaauacauucuuuuauaguauuagauguagagcaacuuucucccucuuauaaucuguauaaccauuagcauacuaacaacaagaagaaaauuacucugaauacuuuaaaaugauaaauaggccaaggacuucaaugagcuguagaggauacauauuacauccaaaaucagucuaccacauuguacucacauuuuguuggcagccuucgaguguaaaagggcuuuuacuggugcacaccucgggcccaggggcagugccuggaaccaaguugaggcucagacacuauucagacgucaccuuccuccuuggggugggguuaggggagugguagcuuguccaugaacucagugugcuaucgucuuuguuuugugaauacauuuucuuaaugacauuuggaggccuucagucguucugcagccaccagaguuguggcaaagugggaaugcuguccauuugacaguguuguuucuuccgcucuagugcacucuucagagaauugagccauuauuuccccuauucauucuuacaguccguuaaaaacuauacaucuaccuuuuuguuuaaaaauaaaacaccauaaagaauaauaaauucccuucucucagccuuugaggcuuauuuaacaauuacuuugaaauauuuaauuuuuucaucuuguuuauaccuucucuauaccauaguggauuugaggaagcuuaaucuauaaacauguuaucaaaacacuuccuuagaaaaacauuuuuuaagugcuugaugacuccuagacuuuuuaccaaagaugauugguuccauuuuuuuuuucuuuucuuuucucuuugauagacucuggcugugucacccaggcuggagugcaguggcacaaucauagcucacugcagccucaaacuccugggcucaagugauccuccugccucagccucccaaagugcugggauuacagaugugagccacuguacccagcuucagauuuuucuauuugagugaaagauggagagaaacuaaacauacacuuaugguacaacccagcaguuguaacccuggauauuuaucacagagaaaugaaauuuaugucaacacaaaaauauguacaccaucguccauagcagcuuuauuuguaauaaccccaaauuggaaauuacucagauguccuaugauagauaguuaguuaaacugugggacauccacaccauggaauauuauuacucagcaauaaaaaggaacaaaccauugaaguacacuacuuggauggaucucaaggacauuaugcucugugaaaaagccaaccucaaaagaucacauacuguauaauuccauuuaugcaacauccucaaaaugacagauuauagccaggcacggcggcucacgccugugaucccagcaauuugggaggcugagguggguggaucaccugaggucaagaguuugagaccagccuggccaacauggugaaaccgugucucuacuaaaauuacaaaguuuggccagucacaguggcucauaccuaucucagcaccuugggaggcugaggcaggcagauugcuugaggucaggaggccaacauggugaaaccccaucucuacuaaaaauacaaaaauuagccgggccuggugaugggugccuguauuuccagcuacucaggaggcugaggcaggagaaucacuugaacccaggagguggagguugcagugagcugagaucaugccgcugcacuguagccugggcgacagagugagacccugucucaaaaaaaaaaaaaaagacagauuguagacauggaaaacagauuagugguugccagguguuagggacauuggggacuagguugggcagggcagugaguaugaacagguggcauuagggagagcuugguggugacggaacaguucuguaucuugauuguaguugugauuacacaaaucuacacaagugaucagugacacagcaccacacacacacacacacacacacacacacacacacacacacacacagaguuaauuuccagguuugauacuuauaucauguaagauguaguaaacauuggaggaaguuggaugaaggcuaugugggaucucucuguaacuuucucguaaaucuuugcagcuuuuugugacucuauaauuauuuuaaaauaaaauuuuuuuuuuuaaauggaaaguuuauaggguauguagauaaauuagaaacaacagaaggccaaguaaaaaagugcugaaggaagccucuacccaggcuggaaaugagaauguugaaugcaaugguagaggaaggacucuccccaucuguggguggguccaguuccuguaggacccuuggggaagccaugacccccauucucccaaacacacaauaggaaaauaccagagaaguuuuguuuaccuguuagcuuuuaaacaaaacagaacccugcaucuuugucuuagauacaaaauaaccuucauggguagggggaagggacauuaauaaaaagagcuauaauuuacauuguuuuucuugaauguuuuuacuucacgaaauuugagagaugauuuaagaacaauaauguacauauaauggcuccccagcuuaccauccuauuacacacacaucgcauaaguucguauuauuugucuuguuuggaaaucaguccaacuuucugacccuuguucuauauauaacuauagaucccaaagguucagcugcugggcuagcauuuugucugcuauuuccuaaauaaugguagguaagcaggaaaagugccagucuuacuugucccugacucuuggugguucguggcauguucaggauaguauuugaaacaagagcucauuacaaaguaauggaaaccccuugcuuuuauuguguaugcagcaaaagcaacauuuggaucaauuuacaaguuucugcaaaacaccgucaagaaauaauuucgguugugcuuuagcaagaaaauaauggaucugugcuauaccacaugccuuuugguaucccucacugggcuuugccaaaacacugacugcaggagcuagacuacuguuaggcagagacacugcacucccuuugcugucccugccuucucuccuagcgacuccuccagguacacaggccagggucacaguaucagaaagcagcucuguuuuccuccagaaccccccaagcuuccuuucugcagcacugucucucccacauggaaccagcuggcucaccagucaacagccuaugacacacaaaugccuugaggaugcagcauguauuuugucuggaagcaagcaacacgcucuuccuuuguaggcuguuucuccuuuugcuugcaaugugaguggcuuaucuugggugggcuugggggugagauaccaugugaccacaugaacacuucaaaacaguugcuuuuucuaaugcaugcuguaauaacaaugaaaagcauauccuuaugguuuuuuuaaugcaagaagacagacucaauuauguguguuuuugauuuuuuuuuucuucuucaacagcauguacugcaucccuugugaagguccuugcccgaaggucugugaggaagaaaagaaaacaaagaccauugauucuguuacuucugcucagaugcuccaaggaugcaccaucuucaagggcaauuugcucauuaacauccgacgggggaguaaguauuccaucccccuggaaaaacggcuagaucucaugguuuucuuuuguugaugcuuuucaugcucccgucccugagucaccacuaaaauaugggcuuagauaaacaacaugguguguaagccucacgcaugacgucucuucuuugaguuucccugaaagauaaagaacagauugaaaggcaaucugucuuuuagccauuggcacgucauuuauuccuguaaagagggucaucgcucaucuuuuuguuagucacaucuugcauaggagaggcaagcccugacacauacaaaccccagaagagaccauuggaucagacgugugacucagcagacuccagcuguagccaaauccacacaucuuucaagucuaaagaguuuugguuacuugaauuuacugagaagacugagcaaagggaaguuuagugauaucacguuaaaauuuuaugaaguccaaaagaaugcuagauuuccaaauuuacuugugagagacaaaaggauacaagugugugucauuguguacauaaaguuucggucucaccccuguacaaugaccuuuauuugcaauagauggcauuccugguaaguugcuucugaguuggauuugugcaaaggauuucccacugacuuagccuaugaucucuucacuucuuugguuuuuuguguguuuguuuuuugguuuuguuuugagacagggucucacuguaucacccaggcuggagugcaauggcauaaucauagcucacuguaaccuggaacuccuagucucaaacaauccuucugcucagccucccacguugcugggaccacaggcacacacuaccaugucuggauaauuuuaaaaaucuuuucacuucugauuuuucauugccaagggcuucuaguaauggugccuuaaauucucugccacugggaccacuuggucaagguacugauaguuuuauaagcuagaauaaauaucguaaaauggcuuugaaguugaaaggaauuuuggggggggaauccuuuuaugaagaauuuuuuuuuuuuuuuacaguuugagaggaaaaauaauguauuuugagaauguguuuuccuuaauauuuguuaaaugaguagacuguauucuuaagguuuagaaaggacagaaacaaguuugugcuuaguucuucugaauuaguugauaucccuuguugcuguucacaauacacccacucccagcccuccgugauggagauaacucuguuccccacaacuagggcuugcccacucucaugguacuucugauguuuaauucuuuuggcugugucugcauuuccucauuuacuuuuaauuugcuuaucccuagaacauaccuuuugagugccuaaacuuuuuuaucuuccuguccugaagacaaaaauuuaaucugugaauuaaacccauggagaaguaucauuuaugaagggauugguacauauugaugcaugaugaugaaaugugucuucugguuuauguccauugcaggaaauagauuggauuuaggaugaugggacaucucauuagaggggaaauuuccugaucuugacuaaggcaugcuuccugccccacguuuaaaauucaggaucucuuccuuaaaacaucaacugcacgcaaccucucaucuuuccaacuugaacuucccuuuaauuuuucuuggaaagcuauuaaauuaaauuagauguagggcuuuauccuuuaguacccuuauuauuuuauuuguaucaacucaaagcaaaauagagcauuuuauuaaauaugucuucauaaauuacgcacaguaaaaucccauuaauuggaccacacccaguucauuauaguguuuauuauaauuuuagcauuaguugaacugaaaauugguuuuuguuuacuaugagaaaaagguagacuaaacaagaugaaaccuguuguuugcauauuauguuuguacaucuuuauuagcaacuauuuuuccaacuauuuucaacuauuuuuccaacuauuuucuaguuauaaaagcaauacauaaauacuauagaaaauuuagcaaugcagaaaugaauuuuuaaaaaucccucauagauagccauuguuaacauuuugguguauuuucuucaagucuuaguaaaauggaaccuuuaaauauagaucccuguaucuuaggaauuagaaaggcagcaaaggcaguuccuaaugagauggagaaaauguugauuuagucaugcccuuguacugugggggccauacugucuguugacagagcauauuaaaagacguucccuacauucgucagccuuagcuaauuggcagucugguauuuaugauuuuauauuuuguuaaucagcuugggagcugcaguaccccccagccuccuagaaacuuggcuuccccugccugggaggccucguuccaggagucguuguugagagucaagccagggaaguguguuuuugucagggagcagccaguccugugcugggagcaucucagggggcaccugccguugaauuguucucacuuguguuuguaagaauccaaguaugucacccuuacaccaagugagcacacagugacacaauccccuuucaauguagauaacauugcuucagagcuggagaacuucauggggcucaucgagguggugacgggcuacgugaagauccgccauucucaugccuuggucuccuuguccuuccuaaaaaaccuucgccucauccuaggagaggagcagcuagaaggguaagugccccaaauuucaugagcugacguucuauuacaaaauaagcagcgugcuuaugaaacuguguugcugagguaagagcccucccugccuuguuaaagagaagaaaggaggaagccgcaguauugccugugcugcucgaguaggucuuggguggagucaugguucuccauucuuaggagguugcuguuuggaaaacagagauguuaucacccuuacuggauuuugccucaucagucaaggguugcgugucugacugugaccagugagacggcagacgggggugcgcuuagggcuuuucugccaagaaugacagcaguuggucuggagugcucaccucccugugaaaucauuguucgcgcgacccucaucugccucaggaugcuguacucuacuacgcacaacugcuccaucuuuuaagauauuggaagugagagcacgggaggagcaugggcgguucguuuuguuagaaagaaacccggauucacgagaugguuuuuauugauuaguuuacaggauuugcacuauugauagaguuuuugccuuggcacaggccugcuuugugauagggguuuuaaaauaaccgugggcuuuucacuggaggauaaaagccggugcuuauugcaugcacaauugcuuuccagccgucagccuguguguaccuuugcauauguacuuuucucuuuaaacucucccuuuuaaauacgacucuugccaggcuuuaagugaaugcuucaaaauaaaaggaguuaucaauuaaagagugaauuccuuccaaagagaauuugggaaaauaauuuaggaaaagaagaggcgagaaggucaugggaaagguugucuuugcugauuuaucugccccaacuggauaaaguuacugcauaaggguuucuuuacagccucccuguuuuucucagacuaacucuuggucagucuuaaauucuuaaaauuccaucaucugauagagcuaacgagagcgggcagcucuucauuccauccuugaaaagcacaguguccuccccacuggggaacaccaauccuuaaaaaacuucuuucucauugcaaaucgaaggaggcugccgcugcacccagccccagacuccucagucacuuaccuggcaagcugaggcccuaccaguuuaaggugaugauuauuguuucuuguauuaaauuuuaaaaugaauuuuucuccgcuuuuuuuuuuucuaaguagguuuguguuucuggaaucucgggugucugugagcauuucuucuucagcagagcaguagcugucaaauuuucuuguugcuuaaugauauacuuuuuuguuucuagacuaagcaaaugauagacauagaggugaaugcugagaggagaguuuaauuaauuuccauuaggaauuauuaugugguuaccuuuucauggaguguuaacuaaguauugugcacuuaaauguaguuagaaauuaaagccugauuuuuauuugcaagaauauuuaugaugucuuucucauuaucugaaacuugcauaaaaccugaagcaucagcaaaaucuuuuuaagguugcgugcucagguguuugggaggcuuuccagguaagcccgggccccuggccugcucuuaccauuuuagaugcaggggagggcaagugggccuuggguuuucccugcugcugcugcuccccaguaguccugcagcuccaaggaugcuggcuccagccuuucauuccugcgugcagcuucuaagaggcucuuucuugagcuugggcucuuaagaaucuuuuaccucccgaugggaaguuuucucucacccugucuuccuggcccaugaccacaaagguauagcccauccucacgaugaugagcuccccaagagcucuguuugcuucagguguugagaccgcuagcaacaccucagcuguucauuucuccuuagacucagggacagaguuaggucuggccccuucacuagcugcccucacuucugcaagaagggaagagucagagcgagaaagagaaggacaggauacgauagucagauaaacaucagcagugcaaagcagaacucgcacagugauacaagggaaagaaagaaaugugcccuaggcauggagaagagccagauaccugagaagaucagacaggcuucugacaagagguggcauuugagaugggccuugaaggcuuucgggaaaaacuugaggaaagcagaggauugaagugaagaaaggcaauucaagguaggguggcaggagcaaaggcaacgaguuggggcauccuggggccuguugggcaacuaacacuggagaggugggugguacuagaguuauguaagauguuuugcacgcagguauaaaggguuauaauuuaggaagaccauggaacguauucaaggcuuuugaauagaggaguguuagcagagcugucugaaauuuuuauuucggugugcuuuugguuuaagccaagauagcuuucaucccaguguuucucaaacuuugcuacacauuauggaaucauugggggugggggcagggguggaguugagaaauccugauguccaaguugcacccccaccccaauucaauaggagcguuugggguuaggauccaggaaucagugcuugucuaaagaucccuaggcacuucagcaggcagcaaagauuggaaaccacugcuuuaucccuucauuucuucccaugugcauaucacaaagcacuuugacgguuuuuuuuccuaaauauuuuccccucacacugcugccuaauguuuuagagguucacccauguuguuaacacgugucacacuauuuucuugaacuuuuuuuuuuuuuuuuuuuugagauggaaucuugcugugucgcccaggcuggaguguaguggcgcugucucggcucacugcacccucugccuccuggguucaagcgauucuccugccucagccuccugaauagcugggauuacuggcacgcaccaccacgcccggcuuauuuuugcuuuuaguagagacggacuuucaccguguuguucaggcuggucucaaacuccugaccuugugauccgcccgccucagccucccaaugugcugggauuacaggcuugagccaccacgcccggccuucuugaacuucuuuuauagccagugauaacauaaauguuuccauuugguucaauaggaugaaaguucuguucuguagccuuuuguuuuugauggagaacagaacaauucaagguacagagauccuucaacucugacaaccuuggcuuuccaaaaugucacugagaucccccucaaaaagucuccugagccauccagaacagaaaauucaagcauuuuacauagaguagagcucuuauuccucacucagagccuguugacuuuuauaucgcacucggcgugagcugauuuuguaacccaguuacaaaagccauagccaugguuuccucaaggacaccauaggguguauuucuagaguaaugaccuuagacauuaagaaaaucaagaccgcucugcuguuuacaaaggaaacagguuuuguaauccacauguacacaauuuuuauaaaauagcuaauuuuuaagcucuugaguaagagaauauuuucacuaucuggaaaauccccuuguuuggacaaccuuguuuccugauggcaucagauaaauaaggaguuaaaguuucacauuauuuggugcuaccaaggauuguugccuugaaaagaagaaggaaaaaguagauggaggguggugaguuaaaagaauugaaauucgcggauaggcauuucuaugcuuuuguuccuaccacucgacugugcaacacgcagugcuuuguaauaccuucuuggagcucaaaggucaggcugaaacauggccgcuuuuucacauuucccugggacuuuuggaaaauauacaccaacccugugaccuagcaauuccgggauccacccaagagaaaugaaaacaugcccacacaagacuuguguaugaaugcugguagcaguauuacucauaauagccucccgggauucccccgacccccagcccaaaagaaagacccacuggaaaccauucagauguucaucagcagaugaguggauagaaagauaaauggauaaaugaaauguggcacaaaggacaacugacuacucaacaauaaaaagacgugaaguaugacacguguuacaacaugggugaaccucuaaaacauuaggcuaagugaaaagaaaaaauccagacacaaaagacuacauauuauaugacucauucguauguaauuugcagaaaaggcaaaacuauagagacagaaagcagaccagggauggcugcaaggaagagguggagauugaccaccaaugggaaugagggaacucuuggaugauggaaguguucuggaacugaguaguggugaugguuggacaguuguguaaauuuacggaagcucauggaaugaugggugaauuuuuuuuuuuuuuuuuuuuugagauggagucucacucugucacccaggcugcagugcaguggcgcugucucggaucacugcaagcuccgccuccggguucacaccauuccccugccucagccucccgaguagccgggacuacaggcgcucaccaccacgcccgacuaauuuuuuuguauuuuuaguagagacgggguuucaccauguuagccaguauggucucgaucaucugaccucgugaucugccugccucggccucugaaagugcugggauuacaggugugagccaccgugccuggccugaugggugaauauuugauaggcagguuauacuucagaaguaaagcuauuuuuaagaaacaccuaaacaaagaggaaacauugucugaauaucuguauggugccugguuccaccuagauagacauauccacccuugcugaaccccuaagguugauguaaauauuggauuugggggagaguggacaugauauaaaccagccuguuugcagauggauuggugggagcaucugcagaaaggcaaaaaaggccaaauacucuuaucaguugcagauggcucuguugcugaugacagccuguguccuggguucugaugcccccuagagacagccgugaagaggcaauuuucuccucgaaggaaggaacuggaaugauugguuguauaauugcagaauuguuuucaguaugucagcaagcacugaaaauggggaaacugucccuuccuaccucuguaggcuggagaccucggguucagcuccauuuaucagggcacaggaccuuccuguucugagacuuuguuccaggggacuuucacacuucagagaauagcacaugucauccugcacuuuuguggggugauuaaaagcucacgguauccuuuuauguuuagcccauccaauucuuccaacuggccucagccagaaaagcagggaaggcacccccaguuugcagcugagagacuccagccugggagagcugaauaaaucuuuugcccagagggguuccucaguaaaugcuggagaugaggcucagaccugaccuuuggauucccagauggagugcucugaaccguguaccuggggcugucuucaccacucaaauaucgauagagauaacauagagauguccucaggaagauaaccaacuguucccauccuguguggucuacagauugggagauagggccuacccaaguguagaaauaaacauuuuuuacaacauagagaaggcugagaaccaggauaccaauaucaauaaaaucuggauaucauagagcacauggaagcuaaagaaaaauaaguaacuggucaggugugguggcucacaccuguaaucccagcacuuuggaagaccauggcaaggcauugcuugagcccaggaguuugagaccagccagggcaacauagugagauaccagcuguuaaaaaaaaaaaagaaaagaaaaauuaaccaagcaugguggggcauaccuauggucccagcuacuugggaggcugagguaggaggguagcuugagccugggaaguugaggcugcagugcucugucauugcaccacugcaccccaaccuggauuacagagugagacccugucucaaggggaaaaaaaaaaaaaaaccuaauuuuuaaaagcauucuuugaauguaaaggcaguaagcuaagaaacaauuaggaaaucacauuuacugaauaauuuacuuaaguaaucuuuuucuucaggaaacaaugauaacuuuagcguaugcauauuuuaaagaugugcagacaggucucugccuuuuaccuucucuuaauucucaccuaaucauggaaggaauuuagcggggagccuugccccaagcuguggcucgaaaaacaagcaugguauugacaggcagcucaugaauggcuugauuauuauuuugacaaggguuuuauuuuuauuuuucuuuagcuuccacaggcuccauaaugccuggguuuuauugauauugguauccuggcucccagccucuucaaugauuguaaaaaauguuuguguuuacuguaaaaagauaaucuugcuuuucaaagugauuagucaaauacacagaauuucagugugccugccauucauuugucaaauuccugguuuauaauucaugcuuccucccgugggggagaagaauguuuuguucagaagguauuuuuggugugguuccguucccugcuagugaaauuaguuuaugaaaagaggccugguucuggguguagauggaaguuuggccugauuaauugguccuuaccggcagcccagagguuucuucaucaacaaggagauuuuguccuguaacuaacucagguaccuggaagcagcccgacauuugggggugcaucgcugcagucuccuuuggagcuggagaaaccuaugagcaagaaugggcuuaugacacauccauuuccacuccaucccuccuuccguuguaugacugcauggagccccucugaccuccagcagugucaccugcagccugguagugagaaacagcagguauggauggggucuacccccagcaacaguagcgccagcugggccauauccuggcacugcuccccaggaaacacaccuuguguugcauugaccagaucugggaucauuuggacaaugucuuaugcugcuuuuccaggauagcuguguguucaggagggagcccuuacugaaaggaaagaacuguugacuuacaaguuuuugcuaccgguuugguggucacuaauguguccagaggccugaagaugggcgugugaggagccugacuuagcuucagaggcucugucuuucgacucacuugugugcucacugcaccccugugcuggcaggacuccaaccuccacccccagcacuuguguggacagagagcccagugcucaggaaaggguugggcuucaggcuugugaugcagauuccgugguggcucugugacuccuucuggucguucuuaaaguagacagggagcuuagaugucaccugugcauuccccuuguuguccuacgagugaguaaacagggcuacagauagcacuaagggaucugcgcauggcugugcagcucauucauggcauuucugguccugggucccagucucugaacuccuuccuggucugacgucccuuugugaauguucaggaaaaugucacagggcugcuuggcagcauuguaaccauaauuugugcuuuacuguaaaugagaaucaggcugaggauugaccagcugguuagagguccugguuuggguguaaaugaagacccucaccagaugcagagagauccccaauggacauagccuccagggcagacgaagccuuagggguucuguuuuguccuggcuacgcuggcucugcagggagggcugggguucuuucuccuuuguguguuuauacauuagaucugugaguggaucuuagaagucacucaaaguacugcacugauucccaaacuuaguaagaagcagagcaggaagaggagaagaaggauucacgguccauggggaucaggcccaucagcacagaggacucagaagucaacccuggcauugucugcugccuuccuggggaagccagagagaaaggcccacugcggggaucuuucucuagaccuaagccguagcugucugcuuucuugccucuccagggauggacuuguccugccaccuggguagccagauagaacggcuuccugugcugguuggaucugcuacucgugugcacacccucuggggcagaagccacgucugguuuggugggcuuugguccuccaccaccucacuggaacucagccucuccuagauugcugguucuccacgugugguccagggaccacagcaggggucagcaccaccugggauuugugauaaaugcagauucuuugcccaccccagcugaaucagaagcucuggggguggggcccagcccuuugcaaacaagcuuugugcacacugaacuuggagaaccacuguguuggacuccgaguccucuugccuggaugagaggcccaagagcacugcauguuaguggcucuuccuccucccccacaccuccagggacuggagcuggggcugcucagaaugaaagaugaaugggggagggagaaggcccaggguugaccccccacaagcuugucucccugucucaugcugucuccuaucccaucaugcugcugauugggcaggauuuacuuccauggauaaugggagacuuuagagcaaaguguacgcuguuccgauuggguagcagagcaugucuguucucucauggacugcuuucaagcacguuguacauacuuggcugagaaaaauaaccaaaggcauuucuugggaaugauucuaguaacauccucugguacaagaagcauuauuugaugguaauaguggucauagaauuaauuagcaucuuaccgauuuugauauguuauccuugaaucauguugcugccauuguuaacagcaacugucuguucuccuauaguguuaauaacuaaaucucuuauuggcaaaggaaauguauuguggagcagguggcaaagaggaccuguguuacguggccagcaggcuagaggggacuguggccaagggcaggugcgcuaacaucgauuucugugcuucuaggaauuacuccuucuacguccucgacaaccagaacuugcagcaacugugggacugggaccaccgcaaccugaccaucaaagcagggaaaauguacuuugcuuucaaucccaaauuauguguuuccgaaauuuaccgcauggaggaagugacggggacuaaagggcgccaaagcaaaggggacauaaacaccaggaacaacggggagagagccuccugugagugacagcauccaaaacaccgugggcccaaccaucaugauaacagcagacccuccucccaugugugauggcagcuuuccucugcggccccuccugguuucacaugggggaccacuagaccaucuuaacuagcacuuugcuccuacuuauaugucaucacaaucaguagugggcagauacgugauguauucguauuuauaaauucuguacaucucugugagugugugaaacacuuauaaguagguucucaaacuuuaaagugcugcuuacagaaugcacaguuaaauguccuuuuauacacaggugcacaguuagauauuucucuuucuuuuuucuuuucuuuuuuuucuuuuuuuuucuuuuuuuuuuuuuuuuuugagauggagucucacucugucacccaggcuggggugcaguggcaugaucuuggcucacuguaaccuccaccucgguucaagcgguucucaugccucagccucccgagcagcugagauuacagacaccugccaccaugcccagcuaauuuuuggauuuuuaguagagacgggauuucaucauguuggccaggcuggccucaaacuccugaccucaaaugauccacgugccucagccucccaaagugcugggauuacaggcuugagccaccaugcccuguccgauuauuuuucagggaagagccagugugcuucagcccuaugagcucuacccuucugcucccacagaagggaagcacaggccugugggguggagggggcucugcccuaagcgcagccccugugggccacggguuuccugucccuuacacucggccgccuuguuucucccaccccaacaugaaaaagauggagugagccugcagcccugaguugauauugcuuuuuaaauugagaacaauauaauuacagccuuguacuguuuauaaaacuuuaaggucucauaucagagauacagcagugccuuucucaucuaacccuguguagaauacggcuguugagaauggcguggcucucuggcuggauaggguuauaaaaguaaaucgucuuuucaccuuuggcuuuuaauaagggaaggguauuagaaaaaaaguaauuuguaugaugaagggugauuugugcgugugugcagacagacacacaugcagggaggcaaaucagaaccgaugcguguuuggcuuuggcuuguuucgcuggugucuggauuuaccuggcgacacuuguugcucugggggaucuuagagggaagcacgcugacugaccuagggcugaacagcaggcugacgaccagcgccgccucccgcccccugcucacucuaucccugcaaagccccugccuugcucccuguucagaucauaguaaaaucggauguauccgaguauuucagagugcuugucuccuuagagucagccagucugaccugucagaucauaauacauaguagccguuuauuuucuuuugaaagcaaaaucaugguuuccucucuaaauaacacuucagcaggaacugugacauuucccaaucucaguugcgcacauuuuguccuaaagacuucuuagcucuuuuacugucuucagucccucugcuucaccucuugaguguguagugggauucaggcagauaagagggcgaaaggacaauucgucagagagcucugggucuccaugagggugggcagucaucagucuuucccugguccuuaucguaguuugaauuugguccaaggaauaagagagacacuuggcacagcuucccugccauacccgccagccaggcuacuucccauagagcacguuaggcuuggccaagugagaucuucuugucagugcuuaauccagccucccguuguuugucagcccuagcuggaggccucacaggaguuccuguguccuuccaguuugauaccaaguuuagaccaagaaaaguuccuuucuguggcacaccuguagucucuuaccugucuuuggugguuguacacgaacaggcagauauccacaacugcagaacaagugucaucgucucucuuaagaaguuucagggcagccuaaaggcucaccuucacccuaccaggcccccuuucauagccaggaucuuagggauggagaagaaagauaaguucaccucguucacugaagucgccccuuguuuucagguuaggaaacccagguucauguccaagucccugggcaaguagccagcguaacugauugaccuaaaacaaaggauggagcccuuggagcucugcauagugaaauguaugauuucuuaguggaaaacgagaaagccacugaggaagcccagaagggaacuuagcauauacagccagcuuuggggaagggggaagcagugccaagcaagacaggugcuuuucagagacacaugaaucucugucacucacggauguacucuuugccccaggugaaagugacguccugcauuucaccuccaccaccacgucgaagaaucgcaucaucauaaccuggcaccgguaccggcccccugacuacagggaucucaucagcuucaccguuuacuacaaggaagcgugaguuucugcuuugggugaugccauucuguugacagggcuacgaaugggagaggccagucuuucgauccuugaaugggcuggcugaauacagggggucagcagaguccccagggagagccacgccaaacaucccuacuucauccucaugcacccucucgggcugucccugugaugucagucacagccagugacagccaugauugggaaaguguuagcucgaggccugucauucuuuagugagugauuagagguguuugaauaaaauaaacccaaaauggggaaagcuugcuuuuuccagaauuaggucaguccagacucaugaacgaugaugggggacuucacugaaauaucguuucagccuccuuaccuacuaggccuacuccaggaacacccugcaggcacguggcucuuuuguaucaucuuauuccugucucucucucugugugccucucccaagcuguggcccucugcucuaggucaugagccuuccaaacaagcgaagaaaaguggagagagaacaaccuucaugucuugagccuuuugugacuucuccuagacucuguugggagcuuuuccugugugaucacaugacauucccccaucuaagcagccgaggcuuauuccucccgacugcagcccucuuugaucucccucuuccuuccuuugccuucuauauccagguggcuaccccggucuacuuagccaucccccuuacccaggucccauguuaaucccauaguucucucucccagauguguggcuuccaaagagcagcaaccagaggcaccuuaugacagcaucuuguacucuuuccuccugccagagcugggguccuaugaaugagaaauuggguacuuaggauuacuaggcuuucagaguuuguacacaggggagccccucaugaucucccaucccaugacagcagacgguguuuuguucauguuuguuucagaagccagcggccagcagcuguccagcccuuuuagcugauaaauauaaaauaccuacccaaccaugcaucugugcgaaguacuauauucucugauagucacaccagugcuuuggcaaugucagcugguaauuucacugaggacuugaugcugguuucuaaggcaaucuggaaacuaaauauuugaauauuauaagaugcuuaagcaucagaauuguuuaugagcaaucugaauuuuagaagcuacuucuguuugucuguaggaaagucauuuuucuccaacaguuaccuucuuucaauaucugauauuugcauuaacugacuaugcuuguuuuuuucuugaugaaaaaaugcugcaaucagaagagagaaaaauaguuuuugcauauguucuuaaggaauaguaacuauugaaucccaguaacuguugaaguggcucuuccugaggcagaccauucaauucuguaaugcccgacuggggaagcccagaguccagucacuucauuucuucuucuauaaaagucuaauugauuauuuguuuauuuagaccucccauuauagaaagugugacaugcugggccucuggggaagauuuuugaggguuuugaugucagagccccgaacuuucucugaacuuaauugucuuucagacccuuuaagaaugucacagaguaugaugggcaggaugccugcggcuccaacagcuggaacaugguggacguggaccucccgcccaacaaggacguggagcccggcaucuuacuacaugggcugaagcccuggacucaguacgccguuuacgucaaggcugugacccucaccaugguggagaacgaccauauccguggggccaagagugagaucuuguacauucgcaccaaugcuucagguauccaugccuagacaagcccccagcauccacacuucuucgcaagcucacuggccuugcuuguaccaggugucauuguaggguuagcagugagcuaugccuguugucuuucuugucaauagguaauacugugucauauucauuuccccacugcuaacacauuaggcucuucugugccauuuucuggccucgguacuaucuuccaucaucuccugcuuugugccugugagcccagguccuccagggugcugggcugguuucauuggaaggcccagccuggaaacagccgucuucagcugcccuuguuucuuguuuguuuugauguucaauccuccaggaacugaaaccaugcugaucuguguuccacuuaauucauguagcucacugguuuuccaucuucauucuggagcuuauagaguuccaaagaggucaacaaaaguugaaagccugcagauguaguauguuguggauauucagaguauucacugaugaugagguuccuccuuccuuuaucuuuagguucuaaaccaucucauuucucaacuccagaucuggaaacaguaaaagcaaacguuaauaguuuccaguauauaaaaacuaguuuagaaguaggaaaauccacuucaguuuuaaagacacugauuguuuuaguguauuggagcuucuaucacaaaaaaacaguguagccuggguggcuuauaagcaauagaaauguauuucucacaguuccagaagccacaaagugcaagaucaaggcgcuggcagauuuggugucuggugagggcccacucccuggcucauagauggcugucuuuucauuguguccuugcaugguggcagggaugcgggagcacucuccggggccucucauagaagggccuggauuccauucaugagggcuucacucccaugacccaaucaccucccaaaggccaugccuccuaauuccauccccuuagggguuaggauuuugacaugugaguuuugguaggggacacaggcauucacucuauagcacugauaaacauucuuugauaauagccauuauuuuaguggguaagguguuuuuaaauacccauaagcgagcacaaaaucaguuuaaauggcagagaggagggugagaagaaaaugcugguggggaaaaccuuuugcugugcacgccugcuccuuccuccacuccuaccccaucuccaugacccuguaaguggccacagucaugucacuggguaaagugcuuauugaaacaaaauuggcacaggcuucugauccugcguguggguugguguagcagagguucagugcaacagaagaaguuuuucaucuuaaaauuuggaaguaaccccuggccagcaauucacuguaguguuugggaaacauaggaauaucugcuuauugugacagauucucaagaaaccuguuuccuuuccacaaagauggaaaccaggcacuguaccaaugagucaguucacuacguuuuguccucuguccuuacacgcagcggagacagacgagaacuugguccucugccucugcuguuuggugacaccuaucguaagaauguaucuaggaaugagcuguuuguuuuugaaguacuuauuuuuggaaacccuaaaguggcugagcaucaagugguuguguuuucucugaaaacgccaguauuagucauaaccuuuuuccaaaguaucaucccuuaaagauguucagaaccuuguguguaucguauaaccuggagcacccucaagcuguccgcccuuuucaaguuuuaaaaauggcuuaggcaaacauauugcuuaagugauauccagugaaggugucuccugugcuuugaaaaaccaucaacauugaugcuuuuuugugacccaauaaggacaagauuucagugguucugggaugcauuugaucuuuaugcacacuucagcucuggguuucaguucaggggucagcauaaguaaagcuugaucagauaacuaugcuuugccuauaaucggcauucauucugcuggugacagaguccuuugcucaaaaugaggcuuccaugcguuugcaguucuaaacugcuuuucagagucaugccucagucauuguacugaaggaugccuguggaaaugguggacuuccguguucuuugcauugccucucccccaucccucuuacacacagcugugacaugggcaugcacacuccuucacacacacagacucuccaggccccuuuccacuuccucuuuccauuuggcuucaugacauuuuuaucagagauucaaaaucucagaugaaauccaagucagccuguuuuaccaguugucgaaauugccggagugcagcacuguggagaauggcaguuguaauaaaugagaaauaccagguguuugaauuagcuguagauuuucacauugucucuucuaacccugcuugugcccccgcagccuuuuuccauuuacaacucaguaauguuuguuuucacagagauuaccggaggaaauagauuauaaagggaaauguuggcauuuauaguaguacuauuucaaaauaagguucacuuuucacuuuguauuucauuguucauuguuauuuucuuauccaggucaaacuggcaguuuccuguuggcuugccagaguaucugauagccugacucuuaaguucauuucauuuucuagaauguucuuuguuccccucuccaguuccuuccauucccuuggacguucuuucagcaucgaacuccucuucucaguuaaucgugaaguggaacccucccucucugcccaacggcaaccugaguuacuacauugugcgcuggcagcggcagccucaggacggcuaccuuuaccggcacaauuacugcuccaaagguaagggugcagcagcggccuggacggagggugugaccguucauuccugugguuguaaugugccugagcccuaauauuacacguaucagacaacaguguaguucuccauuggaaaccagcuaucuucugguuuuuuuuuuuuuuuuuugagacagagucucacucuguugcccaggcuggagugcaguggcacgaucauggcucacugcaauuucugccucccagguucaagcauuucucauuccccagcauuccgaguagcugggauuacaggcaugcaccaccaugcccagcuaauuuuuguauuuuuaguagagacgggguuucaccauguugcccaggcuggucugaaacuccuaaccucaggugauuugcccgccucggccucccaaagugcugggauuauagccuugagccaccacaucuggccgagaccagcuaucuucuugauuaaagguacugagagcuauuauuuuuccuuacaagcauguauaacggcuuucauucccacucuuguuuuggcuuuucuuuuccgagaagacaaaauccccaucaggaaguaugccgacggcaccaucgacauugaggaggucacagagaaccccaagacugaggugugugguggggagaaagggccuugcugcgccugccccaaaacugaagccgagaagcaggccgagaaggaggaggcugaauaccgcaaagucuuugagaauuuccugcacaacuccaucuucgugcccagguacccagcucaugugaaauuucaguuggcaaaacccacugcucaggccgguucuguugccuuucuccccaccagguaguguguaagucagcagcugggggguacaauacaguagccacugagacggagccgaaaaagaugacagguucggugaagugagucccugcggaagccagucagcccugaagggaacagggaccagggcuuggguugcuggggccaccggugugacagguacugcugucucagccacaaccccccacagagagcaggugggcacccugugguagaggcagggaggggaaacucaaagaguauugacagcugcugccuggugagaggaaaggccaggauuuggguccaucucugcccuuccuaauuaucuuuacugccucucucagccucacagaggaggagugaagcaagagggaaaaaagucagagucugugcuggaaagggccugacuucaaaacauagccaggugccacaggcauccuguacaaguaaguuugggaagcaguguagggcgacagccugcauuggcuguuuauuccgugguuacucugucuuucaaagcaacacagccccugccccagggacucugcuccucugcuguggucuugguuucuggggaguggggacaaaagcagaggaaaguaaacguucauagcaggacuguucauaguagccaaaucuggaaacccaguguacaucaacaggugaguggcucaauaaaaugggcucgaaccuuacaguagaauauuauucagccauaaaaagggaggaaauuuugauccaugucacaacacagaugaaccuugaagacaccaugccaagugaaacaaggccagacacaaaaggacagauaguguaugauuuuauguugugugaaauauauggaaugggcaaauguauggugacagaaaguagauuugaauuuaccaggggauggggauagaguguggaggggaaugggaauuauuccauaaucgauagguuuucuauuuggagugaugaaaauuuuuggaaauagauaaugaugauagcuguaccauucugugaaugcaauuaaugccacugaauuguacccuuaaaaugauuaaaauggcaacuuuuuaucuuacauauauuuuguuuuguuuuaaaauuuuauuuuaacacaauaaaaaauguuaaacaauuuuuuuuuccuuucaaaaaaggauuagcccaguagugugugggaaaggagauggaagcacaguggugcucccuggcccccucuuccuguaagauuauagugcagauuuuggaaacgaccucaugccugaaaacuaggccaaggaguuggauuuaaaucagcauggcacccaugagcugcccauccgcaguccccacagcacccgcugccagcaccccacccagcacguucccuuccccucacugcccccgacccugagaggagccuguagcggcuauuuauuccacagugacucugcucuuacaggcuuucuuaggcuguaacaacaaaugguuuuuaaagugauuuuuuuuuucugccaagugaccuuuuugauauuugcaaaaugguugaaauagcuaucucacuucgagaaaucaguaaagugggaaauaaagacugguuagaacuggaggcauuauuuccuuuugagagugcgccucuucauugcuugguggcuuuuuucuccuccccuccucucucgaaguucaaaccaccagagcagccaggcgcgguggcucacgccuguaaucccagcacuuugggaggcugagguggguggaucacaagaucaggcguucgagaccagccgggcaucauggugaaacccugucucuacuaaagauacaaaaaauuagccaagcgugguggugcacaccuguaaucccagcuacuugggaagcugaggcaggauaaucgcuugaacccgggagguggagguugcagugagcugagaucgcaccguugcacuccagccuggacaacagaacgagacuccaucucaagaaaaaaaaaacaccagagcugugagaagggccugcgaggcccucauggccucuccuagccugccccgcugggggagucuucugccugcugguguguggcagggcuuugaaugugaaccuugagguucagugcccaaggccauuuucuuauccaggauaucuuuguaucacuggugguuccuagaaagcagaaaguuugaggacuagaaagauugcaaagagguuuggaaacuggaacucaaugagguuuggugacuucucugacauccuaauuaauuaagaauccguuugggaccugguccucauucccacacaccgacucuuuucccccucuucuccuccauugcguugcuucucgugguccuuuccaccuagaccagcagaggcuuagcucguggcagcuccugcugcccgccacacggaaggauggauuuagagugucccaaagcaggcugggcgggaaguuuguuuuucucuaucaugggcccuugguuacguugcugucuuguuccaccaaccagcaggagguucggguugugagucaagguuuuggaaagauuuugcugaaaggccccuugcuuucaguuguaguuacgaggcaagaccuguuuuuuucucaucagauguggagcacaaggugaagugacgugaaggcagagcugugauugacauguuauuaaugcacagcauuggugguguuggguucaaaacaaguuuccuguguucuacuggagaaguguguuuaucugucccccgaguccuuccuuucucucuccuaagacaaguccaacuugugauucucuguuuucauggauguauaugaagacaauauuuuguccguggugagaggccauaauuuuuaagaaguuaauauuuguuuuuuugccuccuacugaguucuggcagaguccaggugaaggaguguccagcagagagaaugacugaaucacagaggcuggcuuucuguuuuacacguggauuguccgaaaauggauuugauuucuuucaguucauucugagaacaauguauuugugggauaaaaccaguuaaguaagauuuaguuccuuauaaauuguccagaauauccuguauguuuugaaguacaguggaagcuagaguuuguaaaacuuacuaguuucugaagucaauauucgcaguaaaugccuuucuuugacuacugucuuuauuuuguaaaucacauaguuugguuuaacuagcuaaaauguugacagauguuggaaaguaaaagguuuuccaauagggcuagguuguauuaugggauggaguggggaaaguuggcaguaauguuugcuuuugggcguacgauuuggaaauguaguuguuuaccaaaaaaaaugauguaugggccauugugcuuccccuguuccugccuuccagauaauguucugugucaccucccuccccuugucacugccuugaugucaucagcauugagagcugugcagucccuaaaagugugauguugauaaacaaguaaacuacugaguauacuucaugaaguaaucccaguuaaaugggggugggcugagccgggagagggguuuugacagaauuauuuugcgguacaucaaaccuaagcaacuucugacagacacaaguguauguuguguugguuuugaagguaggcaggaaauuuguugaugauguguugacaaagauuucccugacaguaaaugugguuucuuguguuuuucccuuccgggaagcuugguuagcuaguugguugguuugcagagugugaggauuguggaugaucagccucauguccuuacccuuccucccccaguauugugaaagcaaauguacacgcccugaccuugugguuuucugcuuguuggaacgagcauaucuguguugggcaguucaugccuucgguaggacccccgugugccacuacacaaagaaggaccguguuuuccucaggggaauccaugggcugagaagacuggggagccucagaggcccuuucccaaagcccucugcucuccccuuccagguucugaccuaaggaccagccagaagccugccgagcgucagccgaaccugcaaguggcuucugggcuguuccguucccugcgugagcuuucccucucugcugcugcugccgcgcucuccccuccauggcacugaugagcuucccacauucuggacuuucucauuucccugggcagauagaauucaucccauuugcccccugccuuuugccuauuccuaagaccggugaccccagccgaaggccucagcccuguuuucucaccauucguccauggcugaccugaggguugcccuuucuccaucugggugcuccucucguauucuguuuguuuuuguugguuccuguaaacauuagaauucuguuuuaagguuucuagggggagccacaaagcccauuucuucauauuugaccaaagcagcaauuagagggucgcacccucaugccucaucugcccuuuuuggugagaauguccuuuuugugaugacuuuaugcacucccuuuugcuuuucgguuguuccaagccccauucaaauccaugacgaggacucugcucucugaugggcaggaccuugaugaggccacaggugcucacugcugagugggaggaagccugggugggcuccagggaccugcagaguguagcaagcacagacgcuugggguugggggugggcucgcagcaggagcccccaagaagagagagcccugggguccguggaacugcuugcugcuagacuccaggcaucuuuauuuccacagucagagcaaauccaaggagccaccaccacaggcuuucauaucccucugccccaggucucuggggccucugccacacaccucaccucuccccuccugcccuaauaaaucuuaaccacagcugauagguuugccaccuuuaaggcuuaaccauaaggucugugaccagauggccugaguguucugaugacacagccaggacugccuggccaagaguggcagagacacuauuugccucuagguaaaaucgaagaaccacucugagagccggggggugggggugagaguuugugugcccauucugacacuugcagaguagagaaagcaagauaaugaggaaggacaucccuguguuauucaugaguucuuaccuaagggggcucaauagcuccuucuauuccacgguuaagauucuucuguuacucuuacucaagucauagaaaagacaaaagagguaaaaguacuuaaaagccacauuucucuccuccuugcagaccugaaaggaagcggagagaugucaugcaaguggccaacaccaccauguccagccgaagcaggaacaccacggccgcagacaccuacaacaucaccgacccggaagagcuggagacagaguacccuuucuuugagagcagaguggauaacaaggagagaacugucauuucuaaccuucggccuuucacauuguaccgcaucgauauccacagcugcaaccacgaggcugagaagcugggcugcagcgccuccaacuucgucuuugcaaggacuaugcccgcagguaugguaugauccagcuggccccauugccaccuuccucacaaccuaguggagaagauguguuuuauggacacagggucugacacccagggccaugacccuuagacccaggccugccugcuaaauaacgugcagucauuggcagguggcguguagaccagcugcccagggaacagagcccacgcucuccuagugacaccacucccagcuuggucucuccauagaacgugcugggagcagggagcugucugcaggguccacccuccaccugcuacuuggugcacaucgugcauuccugcuguccuuugcccccucuugcgcacaaaucggguugcccccuccugagcucucacauguccagagaugucuccaguuaguugccuugauccagaguaaacauugccccucaagaucaacuccuggagcagccucuggucuugcuuauuuagucuuuggcuuucccuuguuguuagacacugccugucacucgggcauucauccaucuuugaaggugggugccuucaaagacagaacaagagcugcccuguccuuuaguaggccucaggugguagaaagagcacggaggugaccagagucuggggugugggguccuccugggugcaguucuggcacugaaguccauuguagcgugccuugaggcagucgucaggcucccugccucaguuuccuuagcccuccugggagagacauagccagcuaaccccucaagugccuuuuccggcuguaacuuuccaugaccuuugcuuaucacaacuuuguuuacugcuucaagaagcaaaagcaagaaaggaaccacugcaaggucagccagccgcuggaggaguuggugccggcagggagggcuugcccugcucuuagcaccagccuccuagcagcuuccucacaggccgggcucggggccauccuucgugccugcauaaaaauugcaguugccgcguguagacgcgggccacggagggucccugucacagccggcaggccccguguccugcuucugcuuacucagcaucuuuccagggcugcuuguguuugauggcuucacaaagcuuucuuuuuucaagugguaggcacaggguagaagaaaguuacuuagguugccaagauuuuccugcugugcuuggcagcaggcuuuuuuuguugagggacuggggagaaaggaggaucuuguggcaucuugagacgugcaaguuuugugguugguguauucugaacccuccgcugugugagcagcccgcucaggggcaguguacguggcugaucuccacuguccugcccgcguggaugggggcguuauucucaguguacguggcugaucuccacuguccugcccguguggauggggggguuauucucaggucagcccaguguuggccucccucccugggaacccaaauccaacuuugucaccuguuuaaauuguacagaaggagcagaugacauuccugggccagugaccugggagccaaggccugaaaacuccaucuuuuuaaaguggccggaaccugagaaucccaauggauugauucuaauguaugaaauaaaauacggaucacaaguugagguaggacuggggcaguggcccgugccugcauguacuuccauccauugacagcauaugcuaccugacugcacagguuaccuccugguuagcauaggacuuaaaacaauaaaauccaugccaaguuggugaggauuugggucuuucuacccacucuguacucuccaaggaguacugcauagugugcaaagagcuaggcugcuuuuugcccucaagaaacgauuucauuguguaagauaaccuuguggcauaggccaggucaguucuaauaacuuuuaauccuucuggaguucuugguuacaaaaauguuugguuaaagcuuuugggugugcuuaaagcuacuugaagacgaccuuuuaagauuugauuucuuugucuuuacugacacucaggaucauuguuaggugggaggucagaucaggcagcuggaguccccaguguggugaguuuaguuggcaggccccagauuucuccugcauucaugggaaauugacauguauguuuuauuuccccaggaucagcgagaauguguguccagacaggaauacaggaaguauggaggggccaagcuaaaccggcuaaacccggggaacuacacagcccggauucaggccacaucucucucugggaaugggucguggacagauccuguguucuucuauguccaggccaaaaguaaggcuuguggagggagaagaaacgugguaaaacugaaagcagggugguccaggaucaggacagcccgaguguucauggcugucuuauuuucuguuaaaauggaguuggccagcuuccagaagggucaugcuaaggugccggcacauaccggcacugugugugaaagguugggcagggcagaugccgagcuuugggcuccuaccucauguggcaggaagggagaggauccgagccucuccuuugagguuguguaaccacuggagagccagaggagacaguugcuuucaaccuggcuuacauucaaagacuuuuuuuuuuuuuuaaacaaaagacauuuuauaaagcauugaauugaccauuccaccuccuacuuggucaguaaagcuagauagggcucggauucagggcuugaaauccuaagggguguaaggaacuccagaggucaucugguucagccugcuacagggcaggaaucuccacgguagcaucgcagacccuccacuguccuuuuaaaguccccacaugcauuggaaauguacggugcucacccuuugguacagagacugaggaaugugaguuuaugcucaagucauuaacaagacagaauucuuaggcuguucugugugaugacuucagauuuuaaaacaaauuauaagauguauaagcgcaacaagggccacauacuuguuguuugaccaacaaaacuuaguauuuuggugaaauuaguucuguguugaguuucuguuauuucuuauuucaaacccaguuuuuaagauuauuucauguucauggaaugggaucaaauuuggcauaacacauaaaauagcaaugcagccucacuuagugguaacacuuuugggucuagugggcugaucuuuccugguguccacauuucugcuacucacaucuggaguuacguuaaaacaugcacuccgccgggugcaguggcucacgccugugaucccaacacuuugggaggccaagguggguggaucucuugaggucaggaguuugagacuagccuggccaacaugggugaaaccccgucucuacuaaaaauaaaaaaauuaguuggggguggugguacacgccuguaaucccagcuacuugggagguugaggcaagagaaucucuugaaccugggaggcagagguugcagugagccaagauaugucacugcacuccagccugggugacagagcagaacuccaucucaagaaaaaaggaaaaaaaacaaaaaacagcgcacucaauagguccagcaaucucacuucuaguauauuuccaaaggcaaugaaauagguaugucaaacagcucucugcacucccauguucacugcagcacuauucacaguggccaagacauggaauccaccugauguccaucacuauguauaugaauggauaaagaaaaccugguacauauacauuauagaauacuauucuaccauaaauuagaaaagaaaaaugucguuuguggcaaccuggaugaaccuggaggacaugauguuaaguuaaauaagccagacacagaaagagaaauaccacaugaucuuucugauaaugcggaaucuaagaaguuaagcucauggagaguagaauggagguuaccaggggcugagggugagggagcagauuuggggagauguuagucaaaggauacaaaauuucaguuagauaggaggaauaaguucaauagauauauuguacaugaugacaguaauaaugauguauucuuaaaaauugcugagacaauagauuuuaaguguucucaccacacacaaaaaaaugugauguaauacauauguuaauuaggcucauucagcuguucuacaauguaugcauauuucaaaacaauauguuguacaugauaaauauacaauuuuuauuuguauauuaaaauuaauuaauuuuaaaaaagaucuccaguagucaccuggucagcaccagauauucuaaucuguuugugauaucugaaaauccuaauacagacagcaaaagcaggauggggugaauagaacugcaaaucuugagccaacauuuuaugugccuggcacuguuccuggguucagguuuuuagggguaaauggauguuuaggcagauaauuuugucaauuaaaauagucugaauuguuccaucuaguccaguuaaccuagucucaccaguuagucuaugccaccuuugcagcacccagaagcuucauaauauuccugcagccuuguccaggguaguggcuugcuugcuuucuaucuuuccccagccuccuucccuccucuuuuuccuccccuccaucuccuagaaacagauccuaguuugggggucugugaucugugaaacagcaaccuuggcuucugggguugagugaacucagcuuguuuuggugacaugacauguuccugucuggcuuugcugcuccauuuuuaaccuuguaagugccaggaugccagugggaaaucgggaguccuucugauagaauuuuuccagcagauguuaucacguacugcagggaaauuggaucugcgugcuggccuuacuguugagaaauuuuuccuuaugucagacaagacucuguccugcuacaguuuagucucauuuccucuuauuuaauccucagaggagauggaagguuuggaagcuuucaggcaacugccuuccuuuuaggaacuccuugugugccugaauacuauuaaauuacuccucagacuucucuuuuccagaugaaauaaucucaggucuuuuggccuuuucuuguagcccaauaucauacaccaguuuccuagccauuuaaucauuuuuguuauucucuggauguguuccauuuucuccaugucccuguugaaaugugaaacucaaaaagaacacaguacagccugaccaguaguauaagugauauaaacagugauauaagggccuugggggaagaaagaaaaaucugccagcuuuccguugguaaugaucaccucugaguguuuuuaggaauugcaaaaugcuggagccugcauccauuuugagagcuacaauaucaauaaaaauauuucuuucuucgauuaaaauacuucuaauuuuaaaaauuaaaauagcuguaguagucuuuaaagaguaaccaugaucacaguuuuccauggcaaaauaaucauugauaggggacuuacgauuaauguuuacuugauccccagugauuccaggcccauuuccacauagacaucuguauuuggacgucccagagaggucucagauuccuugugccaaaaccaaaaucacaguuguugcccucgaaaggccucuucucuccuuugcuccuuagcucagucaguggucuuguaauccauuuguuacccaagccaggaaccucacagcauccuucacucuucuuucuguucagccaccccuuuuucauuccaacccaagccucauggauucugccucuuaaaugucucuggaauccagcccucugucaccaccagcaccgccacagcucagacuccaggucacucgccuuggggggaugguaugagcugucauacuguaugagccucauccuggggccaugacuuaccaagccagaucaucucugugagucugccugguguaaagacaaggaucagugacuucuuuguaggucugaacuggguaaugcagagcaugcccuggagacauggcauguccccccaauucuccaagacaugacagugccuucucuuacugccaggucccuccgucuguccucagcacagccauuucccuggaacgcgaaucugaucaguucacugcugggccugaaagcuuucgcugacuccuuuuaaucugcagaaugagggugaaacugcuuagcuugggcugggucccuugugagcuggcccugacuucucuccaguaucaucauuuucuaggaaagccauuuccccacaacccccaaggaaagcauaucauaaacaaguuuucccuuggggagguucccucgacucccuucucuccucucccuuccucucugaauuguugccauaugugaaguccacuuuucuaguugucaugcuaccuguugacacuaauuucccaugucccacagaauguuccaggguauggguccaugugccuggugcccagccuagcaucugccauacaagugcugguucugaugaucaguggcuucuguggucuuagacuuguagcaggacucaaaugucugcagcggcauuggaaaggggugccguccagugugugcauguguguguguguuuauuuuaaauugucuguggaacuaucucaaagauugaggccagcaggacuugaccuauacauagauguagacuguacauagauguaagaauuucuauucauuuuaugaaaaugaauagaaauuuucauucuauuuauuagaaauagaaugcuugcugcugcaagcauuugaguccuuuuacaggugugagaucacaaagaccgcuuaccaacagaaccaacacuuguauggcagaugcuaggcuggguaccggggacauggaccaaacccuggaacauucuguggaaugugggaaauuagugucaaauguaugcauuuucacuaacagucauuaaacugcguacaaagauuauuuuucuucagucuaucauugaaacuauugcaccagaauauacuguacuuuaaaaaaugaguauaugccucagucugcacauauuuacucuuuuuucaaauaauuguuuguuugccguguucuauuucugacaccauuuaccuucaggaauucuuacuguaugauggggaguaaacgaauauacagguauuuuuuucauacuuccaacugaaugugaagaaaugaaaugagcaaauuguucaccuggugauauuuuaucauuuccuccucuuugcugcagcaggauaugaaaacuucauccaucugaucaucgcucugcccgucgcuguccuguugaucgugggaggguuggugauuaugcuguacgucuuccauagaaagaggucagugaugugcaaaguuaugacacuuucuguggcugagugguuugaugauuugaaugugagugaaggugauauuuuugaagauuucaaggaaauauuuuauggacuggaaaaccugauuuucccaucaaauguucuuccaggaaaagagaaccuuuucuaaugauuuuaacaacagccaaaauaauuuuucgaugguacagaccuuccccuggcuggcuuuucugguauacagauacugcugcuggugcauacuuuuccaaacgcgaugcgcuagccuucccaaucaaauaagccuuuuuauuuccaaugaaguaaagaaacagauguuucuuaaaaagcgcuaaucucaggcuacugaggaagccagaagauguguuagcaaaugucugcuggcucacccaggccugaauugggaguguagacaagagcugcuguagacaguaagcucuccccauucuguucugauaccgugugagagaggauaaaugaaacuguuguagcgaagaugaaaguauauacaggaauguauggaggugggguuuuguuaacgugaauuuaaucuuuuugacagaaauaacagcaggcuggggaauggagugcuguaugccucugugaacccggaguacuucagcgcugcugaugguaagaguccgggccaccagcacugccagcgugcagggcagguagaucgggagcuuucaggaggguugcuaauuugggaaaggaaggagguuugcauuauuuugagcuaccuuuggccuuggaucugucuucauuaauauuucuuucuuucuuuuuuuuuuuaaucaaaguuuuuagcaguucagugaauaugucaaaacuugugggacuguauggggugccccaaggaaacacaggcuuuagagaugaauguggccagcgcaguaaucaauuuauuuaauugcuugagauguuaugcuagaaugaaaacagcuuuuuaauuguuaacaucuagucagaggauaugcugcagcugacaaaacaguccuuuuaaacuaguuucagcuugaguaucaucucauuauaauugucuuugaugaauuacagcucugcuuuuuuuuuuaucauggaauuuuucugucauucccuuccgacuagggucauacgcucguggcucauucacauuccccuugguaauaacuaaugagggccauucaguuaaguggcugggaaggucugacauggaaguugggugauccucaaugguuauuuccuuuuuugcucuuucuagcauuuuuauauccagaccuuuugagugagucggauuagggugagggguuggucacugaguccagugauacuaggacccuuaacuggcacuuugcuaggggcuuuuacaaacaccaucccauuuguuucuuaaaccccugcaaugugcguuuucuuaaugcccaucugcaggugaggaaaugaacucugggaaaaaacuugugcaggcucacaugguuagacaguugagaagucaggaggagaauggaaucacuguggaaagggcugugaggucccccgggcaggcaaggaaacagcccucaggaggggcuggaccggauucaucaaaugaauaauaaauaagugcaugauguugagugaguacauuuagaaaaaguguuugcugucuucuugccucgggagaagugaaaguagaugcaggagaugugaaauaaagagacaugauuauucuaauuauugugaucaaauaagaaaacauaagaaaauacuuuaauaaugugaaaacaccguuauacuauguaggguuuuacuaugguuucuuuaauaauuucuaauucaguuuauaguaaagucaaucaaaagcagccuccucugaaugggaaucaggugcagaauaaugacuuuauuucuaucuacauaaaggucucacaaaguugguuuuuuaauaguaauauauauauacauacuucuguaguguguguauauaaggcagagagaacauucuggacggaugcacaccacacuuacaagaguuguuacuuguggagaggaucuuucccuuuaaaaaaaaaaaaaaaaaaaaagccagauguggucgaaggcaccuguagucccagcuacucgggagacugaggugaaaggauuaccugagcccaagagcugcagugagcuagaaucccaccacugcacuacagccuauagagcgagacuggcucuuaaaauccagcaagaagauagauaugcauuguuuguaugaauaauagcuucuaaaaagaaaaucaguaaggaagggagucaucccagaugauggaauugauagaacaaggcaagaccacuuucucccucugugaggguggacugugacucuacgagagaagcuauucugcuuugaaaugcggcacuagagguugguguguguagcuuuugacugugaaguguccaggaagagaaagcaucaauacaacaaauucagauucucagggcucucauggugacuugaauucacauuuuguguccuucuagaaugcuuucaugauacgucuugguacuucauuacaacaaaaacaaacuuauugccacccaggucgacaggugggaacagugucaccuuauuugaacuuaauuuauucggccuuugagaagcacuuauagccaguuuccucgaggggcaacaaaaugacauugcaguucaaaagugcuuuaaaaacuucuuuuucccaaagcuauaaucugcaugucaccauucuccagaguacauugaaaauccccuacaggaaagugcugauaacauugugcacagaaaccgcuccuggcugguggcacuggggacgccugcuuaaagucggagccguuggguugaaucgagagaaaaggauugagcguauugacuucagggaccucccagggaaugaaugugauugguuucaacuccauguuuuauggcaggcuaaacaguuaauucugauuaaaagcaagccuggauucucagagauaaauggcuggagacagugaacucuuuacacuuucugaggcgcauugugaagagccuuaucuccuggguugucuugcauacuuacucuccucugacaagcacccgccucuucuucaggggugcaagccaccuaugccagcuggagggcagaguuccauucgugaaacccuugaaacauacguacuaugaaauacaaaaauguguaggaaagaaaacaagauuauuaaugaaguucauauuggacaccccucagaggucuaaaaugauggugccccuccugggccuaauuuauaauaaacaucucuccuuugagacaucacuuaaagguugauaguugggauauggagauguuaggauacaguugucagccucucacauccagccacaggcccagggucagcaucugaaagcaugaaagcaaaaacaggcaccuucuccaccuccuuucugagccaggaccaccuccuucccacagucagugugugguagagccugguggcaggucccgucaggcaaggacauuagcacacagcgucagaggaauuacugacauuucauauggaucuuauggaacagguugauuuuauuuucguuuuuacccuacccauuuggagguguagaauugagccuguguuugguuuuguuuucuuucuuuccaaccuuuuuccuuucuuucucuuuguuuugccuuccuuccugcauagaaauauuuauuuauucauucauucauuuuuuugagacagguucucacucuguugcccaggcuggagugcaguggugcagucucagcucccaguagccucaaccuccugggcucaggcgauucuccugccucagcccccugaguagcugggauuccaggugugugccaucacaccuggcuaauuuuuuaauagagacaguguuuugccauguugcccaggcuggucucaaauuccugggcucaagcgauccucccaacuuggccuacgauuacaggcaugagccaccgcacacggcccauuuauuuucuuaaaccagaucgaaucuaaacagaaacagaaacuggagaagaaauccuauucaggcuugguaucuacugugcauuccucccaaaucucuacccauuggucaaggucccugaguucacagagcccaggccagagcccuggaaacgccucugcccguccgcugccuaauugccuguccacgcugggcaccaccgggucucucccucagucucagagcucaguugcuucugcaccucaucagggauccagccaucaaagccaaggcugggggacacuuggacuagaguaauccuaccaauaaugcaguucagcuuuguaaccgcaaauuuucuaguagccguauuuuuuaaaaguaaaaagaaacagaucaaaugcauuuuaauaguuuuuuaguuccaauaauacguuucguguaacccaguauauccaaaauauccauuuuaacauggagucaguauuaaaguuaccuaaauauuucacuuuuuuuuuuuuuuuugucuaaucuuugaaaucccaugugcaugucucaaauuggacuggccacauggaaugcucaggagucccauguagggaccagcugccauguuagauagcccaggcauagcaucuguguugagggcccugacaccucuuuuggauucauccaagaaguaggaccuuacgugcaccaucaucaccucucauaugugacucuggccuuuuucccgacccagcauaagaacucuucccucucccuacuacucuccuccuuuuuacauuugcguuuuaaucuguuggugaagauggguaaaauccugcuugaccauuucauucaguuucucaauccccugugguuaauuuguuuuuuucaaaaauguguuuuuaugugaugaaaagaaauuuuuaaaaaccaacugcuuucuuuccuauacuagacuuccuugcuuuguucugguccuucuaucuguuaguauccucaaauuaucuugaaauccucagagaucugaaauacuaguacugacuguacaguuuucuuacucaaaucuauagcauguggaaaguugacaucaagccaugccaucgccuccugguauucucuguggguuuaaggaagcagcaucuuauauucuuuggcuuagaguucccccaaagcacguucugucuaagggcuuguuucuguaccugcuuuaauuacgguuucuucuccaguguacguuccugaugagugggagguggcucgggagaagaucaccaugagccgggaacuugggcaggggucguuugggauggucuaugaaggaguugccaaggguguggugaaagaugaaccugaaaccagaguggccauuaaaacagugaacgaggccgcaagcaugcgugagaggauugaguuucucaacgaagcuucugugaugaaggaguucaauugucaccaugugguaagagaaaguuccugaaaagccaaaaugcagcacagggagaggguaucacacaagccucccaguauguucuuggcugcauguacccguggguuuggugucuugccuuugccuucuggauaguuaccccauuaccucacugcuaccuucagaccccugugcucagaccaggccgcagcaccacagagacaguuccagacaacacaggcaucagcaagggccaccugacccucugagucuuucucuuuuugauuccucccaggugcgauugcuggguguggugucccaaggccagccaacacuggucaucauggaacugaugacacggggcgaucucaaaaguuaucuccggucucugaggccagaaauggaggucaguuuucauuuccaccgguauugcauguugccuggccugcucucuuuuccuuuauaaucucccugcaaggaaaugcugugucuuuaaaucaguuuacuuuccagcauccaguguuucuuacugcaugcucaguuguaggucauuuaugcaaaggauuuccccaacuagagucagacucugaucuucgugaggggaacuuccuguuccuuggauccccucugcuaagccccucugugccuuuguuccugcauucccuccacccccaguccccuccccacaucaguguccaccugccaagccaggccagcgccacucccuccccgaagcuuuccugccccacuccaguagcuaucuucucugcuaacuucucgaugcgcuugacucacauccucguauguguucucucucguuauguuguguugugcuguuguuggaguguguccccccuccaccccguuguguuuagcuuuucaucucaguccaaguguguggcucagggccgcauuuguggcaggcacucugucaauaaauguauguuacaguucaagguuaagcugccuggauucuugcccuugcaucugggaaguugcugggugauuucccacccagcuccgugcgcaagaugugcacucauucauaaacccccuccccacacacaguccccuuccccggcauuguuggcgguccuugucuuugccacugggaaucugguuuccucagacucuacguccacguuucaggauugauccagagucaguguccugcuuacgcuuuugaaugaaugaucccaccucagcugcaggauuucugcuuaguuuccuaaaaauuucacuuuggguuaugagcuuccaauucuaaaccugcuaaaguccuaugcaauuuuucauuaaaagucaccguggugucuccccccucuguaguauuaacccacaggccagcuuuuuaacauaugcgggcaugacuuuugaguaauuaauucuacaaauaaacugggagauaaaugcugagacauaaagccagcaagaacugaguuuucauuugguugccuccgugggucugaagucuuugacccuuacuuugcugcuuacuggguaagcagugugucugcuuuuauuccuuagaagcagugacuuccccuucucggccccuuuggaaauucuuuugcuguucuucauuugggcuuaauuuuuuuuuuuuuuuaauguucuuugaaucggcaacuuaaucaucucccaagugacaguuucuuaauuuuaguuccaaacaccuguucacauaugacuucauguauuugcagcacaugguguuuggggccaaguguggacuggggcuucaagcaggaugguuuacaaaacucccacccucuguucugccaagcauugguccccagcaccccuggguguuagugccucuuccugguucacucacucacuuucucuggcccucucugugucucugucacucucuuucuuucgagauggaguuuugcucuguugcccaggcuggggugcaguggcaugaucucagcucacugcaaccuccaccaccuggguucaagcgauucuccugccucagucucccaaguagcugggauuacagguguguaccaccacgcccaccuaauuuuuguauuuuuaguagagacgggguuucaccauguuggccaggcuggucuugaacuccugaccucaggugauccacccaccucagccucccaaagugcugggauuacaggugugagccgcugcgccuggcccuugguucacuuuaauacacaaaacagcaugaaggagaaaagcuugaugaaauaggugacuggagaucuggcagaguauuucuugccagcaucgauugaggcaccucugaaaaguccaaaacucacucccuuccuccccaguuucaggcacagaauaaaaauucagaacacauggccuugguccuggcucugcggcuggcugccugugguccucagacagccgcugcagguuccugggccucaguguccucaauauaaaauaagagggugggacaagauuacugaagucccuuucagaacuaaaauucaccuuuagauuggucagauuuaaacuuuuucuuucuagcucaugucaaguauuaaaaugugugcacuuacccugcaguuucauuauauucaaccugcucccccgaccaaguuucacuuacguaucucacuacgaguagguguauauguauacuugucuuaaauagcucuaaccaaauuaaaggaaagaauggcaguguaacaccaugaacugacaaaauuucagcccucugucuuucuccaugcuuaaaguugagugcuuuuguugauucuguugcucacggcaauuauaaaugaccacuucauaacacauauaggucauacuguaauauuuaagaauugugagcauaaacuuuacauuucaugugcauauuuccucaugcaucacacguaucuaaagcccugaaaaguagugauuuggacuuacccccagugacuuaauguugcuuccccagauaaccacgugauaaguguuuuaagucaccaagagacagcuuugacagccuguucagaauucaaagguuugugucaccaaguguagagaaccaacccagaaguaccgaggaguuguuauaaugauuccaaauacuagcuuucaguagaaacuagcaccucacagggcagcagccagcauccacugggcauugacuaugugccacgcaccacugggcacuuucugugcguggccccaggucaucuucucgucagugaaaccacugugauaccccauguggaaaagccugggcaugcucagcugguggccggccugcaagugugggaccugucagagcccuauggcuuugcagugcugugugagaugcuuuguggucaagaaaaccaagguguagagucuguugcacuuguauaugcaaaaguaaaagguaacauuaaaauuagggacuagugauuguuuuaggauggagagacuugggcauguguuuuauauaaaacuuuuuucuaaauggauguauuauuuaaggguaauucuuuuuaauuccaaagccagcacguugcuguccucugcaaagaggaaugcuuaucccuguuacuuauuccugguuuccuccaagacuaguuucagcuggacuucaguugccaaggacuugucuuccguaaugccgacagaaaauaauaaugccacauuguaaggugaaaacaguaauccugguauuuuuguauuuuagaagaagguugaagggaaagaaaaggauuaaauaauuuauaacgaugcucuuaugggaaauaaaauauaccauguccauuuggaaacacauuugcuuacuuccacacagccuuuguaacgugcucuccuuccucuuaccuguacuucggugauggaaauaaaaggaacauauaaacaaauaggaauuugaguaacugagaauccuuacuaccaaaaauggcuuguuucacuuuaaaaaaauguugcccuacccaaaauagaaaauguugguccuaaagagugcaaauugguguuucccucaccagcucugauguggucagggagcaagugcaaauaagcuugcggggagcaagcaggugccaugcucuccaugaugguuuguuccuuccgagcaaguccugguuucuuagcauaaacaacccacggugcccagauugaacaaagaugauaugcaaaccucgaaagaaauuggcauggaaaaaaaaaauccaaaauucucaugugaauuuuuuuaaaucuccaacagaauaauccaguccuagcaccuccaagccugagcaagaugauucagauggccggagagauugcagacggcauggcauaccucaacgccaauaaguucguccacagagaccuugcugcccggaauugcaugguagccgaagauuucacagucaaaaucggagguguguccuuagcuuuccaggucugggcaagaacuaaacucagguguuuugaggacuuuguuggcauuagucugccccuggagagguuuucuagugugucccuugagugcacggacuccuucuugggaaugaugugauugucuccaguugauggucacaaaccuggcacggucggucccaaugcugauagcucauggacauggugguucagauacugggcacggucccugaggcuggcucuccagacguuugaggcauuucuugguagaacaccucuuagcauugguuacagaaauaauuaagacaaugucuucaggagauuuugacuugggaauaaaacucacuguccaaccuugcauucaucccuccaauuuuccuagcuuuuaaggagcauugcuccccuuccagggacccacauugguuucuaagaggcaagcugcccuaaugacgaagccucugcacggagcaggagcaguggcaggagcuggcauggcagucccuuaggugagggacgaucacugcucacuggguuucacggcuggggcuggccagccuccaagcucucgaccacucucucacaacacuuacuguccugcucuuagcucaccagccuacugguuagacucccuuguugccaccacccacugucacaccagaaaaaaggguuggauugaauuucugagcaaugguuaaaacccacuucagccuuuagguuuguguuuuuacuucggucuuuuaaucugccuaauaaaaacacacauaacaucagggcugcucaggaaaccaccugcuuuuaccaggauucucaucuucccacuaugauacaaugauaguuuagaaaaauaccaaauauuuauccugagaaacugcaggggagauuuaacacccaaaagaagcuauuucaaauggaccucugugucuaguucuugaacugccuuuucuggaaguguucaccuuccuuuaguaacauauuuuuuuccuuuaguagugauguuuuaaugaaauguuuuagccccuuuggugaacaaugagaaucuuuuagagaacgguuucuuuuuuugagacagaguuuugcucuuguuuuccaagcuggagugcaguggcacaaucuuggcucaccacaaccuccaccucccagguucaagugauucuccugccucagccuccugacuaguugggauuacaggcgcgugccaccacacccagcugauuuuuuauauuuuuaguagaaacagguuuucaucauguuagccaggauggucuugaacuccugaccucaggugauccacgcaccucggccucccaaagugcugagauuacaggcgugagccaccacacccagcugagaaugguuucuaaaguaggggugagugucuuucuuuuuacucuguaggagcuagagguauugaaauggaaccauaucccagagcccacaucccuccgucaucagaguuccucauucaggauccaccagugugucccuagguuuggcacguugagacguccucacguuuggugcucugugaagcugggcagcccucagagaggcaaagaagucccaagaggccguccugccucagggcucucaggaaagagccgcccgcgucccuggcugggcuuccuuggugcacccagcucauuucuccuucccucucuguagaacucacauuguccccguggaaaugccagccagcuccccuuucccagugcaggggggagccaggugggccugaggugggccaguucugccgcuaaugggugagagacuugggccaggugccuuacauccgggagccucaguuuccucaccucggaaauagggugauaauguaacagaccccaugggguuaugagaaggacuuggugcaggaaagcagcagcacgugccuggcacagggcagggccucuccagauggcaguuccugucugugucuuauucccacccuccgggcacauggggggaacucaguuucuccccacugcgcgucacccugggagagguguuuuuugugccaauugccauuuuaaauccaaaucagcagggaucauguuugcuguucaaccauguggcauauuuauagugauuuuuuuuguaaucaugguuuuucuuucuggaauuucaaguuuuucauuugugcugaggaaggucguuuguguuuuuuaauaggauuccuucuuuuccaccuugugcaaguaaaggcaaauccccuauuugcaugucacuguauuaauucacagauaacacuuucacacuucauuuuuauucuucucaagggcucaagauguuuucccaaugcccagcgucucauggaugacaaauaugacaaguaauuuuaccagaggcaguuugagggcucuuagcauagcacaaguaaauuauguugguucaaguccaaggaacuuuguucucuuuguguuugcuuuuguagccuuaccucuuuggggcaugaguuagagacauacaugagcauuuuaaaguggagcagcccuuucuccugggaaggagaacggaagaguccacuuaagaaaagguuguaugauugagugcaaaaucaaaaucugacaaagcagcaauaauuuaggauuauaaagcgagccugccaucaaacauaauuauguggcaucuucuggagacauggaaaauggaagaaauuuucaaaaaugagugggaggauuauguugaaaaacaguauugaguaauagcuucaggggccucguaaauagcaucuuuucggcaucuuacuggguacuuuugucaucaugaauuguuacccugaauauuuucccccuuauuaagcagugaaauuauuuacuuuucuccagugguggggcagugcuaccaaguuaaguaagcaucuguacucuccuguuuauuuggucagguuuuaaaaccauguguaaaugaccaguggucucugcaguacuauauauuuucuuaaauugugggacucuaauuuuuacaccgcuuccuuuuuucuuauuuuuauuuucaagacagguucucacucugucacccaagcuggagugcaguguugugaucauggcucacugcagccucaaccuccagggcucaagugauucuuccaccuuagccucccaaguaccuaggaacacaggcgcacaccaccacucacaacugacuaauuuuuaaaauuuuuuauacagacagggucuugcuguguugcccaggcugaucuugaauuccugggcacaggcgaucuuccugucguggccucccaaagugcugggauuacaggcguugagucacugcgcucagccugccucucauuuaaaugcaauaagggcauuaacuuccuaagggaaucaaauuguaaauauauuaaaaguggagauugcuugguauuugcucaucaugugauuaaucaucccuuacugucuccaccuuauaaaauugcaaacccuaauauuuggccaccuuaaagugggacgugucugugucuugccuugcgucucuccacacauaaugaguguaggguccucugcugugacagcaguggugccugcuccagcgugugacucugcgcccucucuucccuuacagauuuugguaugacgcgagauaucuaugagacagacuauuaccggaaaggagggaaagggcugcugcccgugcgcuggaugucuccugagucccucaaggauggagucuucaccacuuacucggacgucugguaugagaaccuuuacugcauugccagccuggagcccccagccucugcacuuuccaccagcucagucucuagggcuuuaucuuucucuguucauuguuacccguugccagcuuuagcucaguguugugugagccacacuucuucaucauugagguguuccuguugucagugggcuagcuaagggcagaagggcauucgugggauuuuaaagaauuuaugggaccaacauucuuuccgccuucagcagauaccgauuauguuuccaggaggugggaugugccagaagccgucaccucuuuuuguuucuccccugccugccuucuuucucuuuuccucuuucucaauaaacagauacugucugugugucugccucaccuaaucuaacccucagauugcagacagugcuuuauuuagacccaaagcuuaugaguccugauuguguuuuccugcuggucccaucugcugucugucuuucagugggcauccaccguuguggacccagggaugguuaugggaagcaaaacgucucccuuaaucauaaacagugucuaccaguggaagcccaucgaccgagggaucagaggccucucaguaguauuguuuauugcaguuccuuggcaacauugcagagaggcagucagguucugaaauacaacugagguuauuggcaggcugaggcccuggcacaggcaccuucuagaauaucagcuagugucuuggcuuuccucuggggggaucccguugcuguuguguuacagaaaugguaguuguuuacuccaacagucuggaugaccgcauagaggaacuauuucaauagugacugacaucauuuuuuuuuuaaccucguaaaccuuucacaguucaggggccuuggaucuuauuuugaagacaggugcaaauuggaaauagcauuugaauaugacccggcaaagcaugauugcuucuuaagcucaaguaugagaucuguuuugcaaucagcuuguccaagaugguuaucucuucacugucaaaucaaagugcucugcaugguguuuagagauugggauggugaggagagagcaagccuggguaugugcaugcaucuguuuauucuaggcuucgugccuccaggagcuuggaggucagcuuguaguauaauaaaauagaaaacuauacagccggggagaacagaagcagaauagaaggauaaaguguuguucauaucucucgggcaaauuuuacccaaauucugacgagcaguuacugcacaagcaacaacaaagggaccuagaguguguucauugccaauucuguccauuuggcuacauaacuacugugaaccaauacaaaaagauauguauaaacaugaauaggcguuugguauucauuccaugaaaugcucaggcauugacagcgcuucagguuuuguuugcuuuuuaacacaggcuuugaggauagcacaggucaggaaggcuagggcguuggagcagguuucucagcgguccaggcucuaaacuaaagcugucccucucaaaagaauggaaaugauuucagauuguauucagcagcacgaagcaaugauuccuaaauaguuaaaaaucuagaaagaaacacuaagaauuguauugggcuuuguagaagagaccccagaauuuuaggauuugggauguaucccugcagucaggcccaguccccagugcaccugcagaucuuugacagcugcugguugagcuucugcuaagagguuuccuuccagggacuccauguucacugccucacaaaggcaggccagccucaugcuuuagacauccuugcucuuagcaaaucuuucguguucugcuacgucagccucugugugacacccauuggaccuucucucuguagcacaauugcauaccuugcucuguucuugauaagauaggucuaggagucaucgaagaggugugucuguucuagccagaacaccuccaaguuuccugcugucuuccaggacuucauucccaggcccuugggcacuguggcugcucucccugcagcucccuguagcaccaugucccucugaaaugacaagggugcccucuaggcauggaggaaaccagacgaaggacuggggagcugcaccccacagccuagagcugugcuucuucccgagcaucuggaucacccaacacauaaucuuuauuuuuuauuaagaagcuuuccaaauagucacaaauagccaagguuauuugcuucuuucaugacuaauuaccaucuguggggaauguggauuucucuguagguuuuaauuugcuggugagugggccauugcuaccauccccuccugguguggggaaguauaguuacugaaugcugccuccagccagcacgggcauugcagggggacucacagccgccggucuucccccuggggaaacaacgucaagguuccuaauuagaaagggcuuuacacagagacauguaucuacuguuugaagauuaaaucuguccaugaaauggaagacuugauuuuauaugaagucaugaagagccaacaccacauaguaaaauaccggcuuugaaaaacacagagguguugcauauuucucggugcuucugacuggcuguguggccuugguuaaaccucagagcuucucuggccuucgguugcuccaucuguaaggcaaggucugucucgagaagucugcgguaccugaauagauguugaaauggcuccuguggcaacugguauuguguagagaugguucaguguccacaccuugcaguugucacauuaagcugugaaggacgacugacucuagcacucagugguccucaguggcaggugauguugaccucagacaagaguugcucaggagauaggcuuugcaguucaccucgacaagcguuuguggagagcuaggucugcuaccuccuguaucguugccugugggugaugguaaggcucuuggggguguggaagaugcggggaugaugaugaugacgaugaugacgaugacgacgaugacagcgucgucgucguccugguccuggaaggauaaagucuuguggagaagaggaggcaauucugacaguuugggguugcaucaucuucuucacagaagagaugaaguuguguaggcacccuaaguauggauugucacaaaaagagcacuaggaagcggggcggggcggggcaggggugggggguuccuggcagugggaaugcugggcaggcauggcaguagggagcaccugcugcaggugggguuggugagguuuccucgugggacuuaggcugcagagagaucaagacaggccucagcuguuguauuaggcauccuggacuaauucuuuaagcccuguuaagguuucugaaccagagggugauuagagcugugcuugaaguucuuguuagccggaguauacagcugcauugagcaagauguuguaaccaaaggagaggugguggugggccaggcaagcaggauccugcacacucagggagcucugagggacggaaggagggugccagaccuuggacagaugugagccuggguggacaguucgcagugggacuccgaggaggccaagggcaugggugacagcaggcagacugcucggguggaaugggcaucagcugcagggaagccgggggaagaacagggcacaaaucggaguucagugugagacgcagugaguuuguggguagcccaguaacugggaacuuggaauggagcaguugggccgggagggccagggugggagccgugccgugagaacuggcugccugcaagccgcugacacagccaggaagggcacguggggcaagaggagaagugggucugggagggagccacauccucaggccauuucccagaccagccugcagucagcaaaagcagagagcuagucauuucuucuuauuuuauuuuuaauuuuuuguuguuggagagcuagucauuucuuguaccaagcugcauuucagauguguggguacuacugccacuggcaucugaggcaugcugccuguauggcugggcugguuguggaaggcagagcuucccgcacaaagcugauggagagccccuucuccccugggcccaggccucucuaaacugcacuuuuggccucugggugucuuguacaacaugaagacgacagcauuucuuggucacuuguaauuaaaaaggaccuuggguuggucuguccucugauugcuaagauucuauuucugucuaacaucuacuuuuaguaucaauuuguacaaaaaucuuugauucaccgaaaguagcugaagcagcgaauaaaacguucucauacagucaggagcacugugggcuugggcacaaggucaaggucccaagagcucuugguuggaaaucuccugccccagguuuuuccauguggcuugaccagcaccugcagcccaggacagguccagcuagaaucccugcuccccacccugcucccgccccuacuuggugaugaguagccuauuuuacuccaccaaagugaaccacauggaaaggcacacaggucagggagaauuugugaauuacggaauuugcccugggagggcacauuuguuuugcagauuccagcauugucuuuuuuaacauucugucugaaaguuguguguguacucucuguuuuguuuuccagugguuugaucuucuaaacuggcaaagcugcaugcauauggcagaauugcucacuacaaaguuauuccucagccaacuucucugcuuaaggauucuuuguccaugauacccccucccagccagugcagcccacccugguccccccaccugugacacagaggcccugcaggccagcagcuccccagcucuguugugggugggggagcagcaggaguucucuucucccuuggcccaacuggaccucaagaucccuauagaucuucuaaacauuccaggucccaggcccucaccccagaccaaucaaaucagaguuucuauugggugcccagcccucuguuuaaaaaccuccccaggagauucuccugugcagccggcagugagaaccaccuggguagagguuuccaaaauugucugauuguaaaaaucaccugaggagcuugguaaagcuugacugucccaggccucauuugaggcuacuaagucaauguccaggcuggggcuuggacaagaaugucauucuuuuugggucaaagccagguuaggugauaccgccuugccagauaaauggccgggacuagguagaugcugaacccaguaugcucugcguucaaagcacagaucaggggcuuccugaccgugcaagggaugccggaagcgcccucaccaccuuccuuagcuccaccaccggggcugaauuuaguuuacggggaacauuagcagcaacagagggaggaugauaucccgcacuuagcccagggccuggcucgcugucugacaagcacugucaccauaguaaggacaguuuaucugcucgggauguaagaagugcuggaaaggagggggcagcauuguucaguccaucccuuuccaagcuccucacaguuuuuuucucccuguagguccuucggggucguccucugggagaucgccacacuggccgagcagcccuaccagggcuuguccaacgagcaaguccuucgcuucgucauggagggcggccuucuggacaagccagacaacuguccugacaugcuguacguacuuccugggcccuccgugcucuucugaguucucuucucaaauaccuguuuucuugggucacaggagauuaggagauuaaagccauucucucugguccugcgccucccuugccaggcguggcuaagagguuuguccuuguggaaggagcugaguggguuggucgaccugugcuuuuccguggguaccuuaauucuaccccauauuccguaaugcuuucguuccgauuugcaguucacacuguaguuucucaggccaaaugucucugugaaauguuuggccagaguaauccauccuuacucauccucuccaugugagguuuuuguuucuuuuuaaagaaggcuacaacacaacacauacuacucugaagucgaauucaagagccccgcgccccaccuguggcaggccugagggagccgccgcagugagugugcacacagcugcauggccaggacuccggcaugcaccacguagggucagcuuggugucuucugaacccugccccacaugucuucucuguuaaguguuuacaaaagucauaaaccaucuaaguaacaugcucuccggagcuucauccgcugaccaauguggaccuggagcgugugugagcugacaucccugcggacagaaggaugccagugcuggugaauuugucuucucacugcacuuuuuuuuuuuuuuuuugagauggagucucgcucugucgcccaggcuggagugcauuggcgugaucuuggcucacugcaaccucugccucccggguucaagcaauucuccugccucacccuccaaaauagcuaggauuacaggcacccaccaccacucccagcuaauuuuuaguagagaugggguuuuaccauauuggccaggcuggucuugaacuccugaccucagaugaucuccccgccucagccucccaaagugcugggauuacaggcaugagccaucgcaccuggcaaccccacuuauuuugaaaaaacacuuugcagcuuuuaguccuaaguuuugucagaugacgagagagaguuugugaugccucacaguguuggugaggccucucugcucagcgcccccuggagaagccccccuuuugguggaggacuugcucuguguccguggacggugcuguuuuguggcucaguggaggucagagcugcuggagcagggaggccuuguuguccuuccuggaaugaguuugaggagggggugaagguguuccaguucagucaucaggcgcacaacagguacagguugggagcaguggccuugcuuuugacaugcacuuuaaggcaggcuucagagauugaucuggaucuccauagcugaacaggaaggugggcucccacuaguaucucaagaccaauucaggagauuuccagaaaugcuuuucaggacagguuuggcuucauuuuggaaaggauccugaggaauugcugggcuguuaugucugcaugaaggcacccagcuccuaucucucacccauccaccccccuggagccagcacagacucaggcugggcccacaguggcgggauaauagauagauaugaaccagacaugugucagguggacaggagggaaugagggcuccagcagccacaaaaguuuugcucauuuggucuccuacagugucugugggccaggaauccagaugcagguguucuugcucucagcucagagucacaggaggcagaaaucaagaugucaguggggcugcagucucaccugaggcucagggacaucuucaggcuccuucaggguucugcacuugcaggacugagguccccauauucuuggcaccugucagcuggggacugcuuucaacucuuggaggccaaggccacucacaguccuugccauauacagccuccauaggcccucucauaacagcagccuauuucuucaagacugauaagaggacagcucucuacugcuucuacugguuuuuuaccugauaaagucagaucuacccaggauacucucucccuuuuaagugauucacagucaauugaugagaagccugauuagaggagugaaguauccucucauguucacaagucccacccguacucaagugaggggauuauaugggauauuuacaccaggggcaacgaucuuggggggcaucuuagaauuccauagucucagaaaucauugucccuaaucaaacaaucaaggugcuauuuuuguuucaaagcacuuugaguguugcuacaaauacugaaucccuaagcuccuuguaaauggccggccagcggagggcaugggguggggaagacuggauacacaccccugugcucugggaguacguuggcugggcggcaugcucauuagcugcugcuuccgaacauagguucagcugaaguguaucccaggcaguggacacuucguguggaauucagaaagguggcgcaggaaggauaccagggaaagccagagugaaggcaucacccuugcacagcuagcacaugugggggcucccauugucccaucaaggcagggccagaaccagaaagucggcuggugcccugggccugggccagugaugggaggcuccucuucucugaggguggcaccuacagaugcaguggcacuggguuuccuggagcccucaucaaggaaacuucccagcauggccucuucagaacuccacaauccaaacuuggaagagacucgaaagaccacuuaguaccuuuucuugcccaguauagaaauucuucuucuccccuucuguguuaguuuuuuaucgcaguauaacaaacuacccaaaaccuacuaguuaagagcaacaguaaacauguauuaucucucagagguuucugaaggcgaggaacgcaggagcggcauagcuggcuggcucuggcuuggagcccuucucgcgguugcagcccagcuguccgccggggcugcagucaucugaaggcuugccugggggaggcagacccacuuccaagguguugcugcauagguaguaugcccugcaugaaucgcccuguucuacgugggccucuccguagcacugcccaagugucucaggauguguagcuggcuucucugagugcagaguucggcacacucuuucucuaaaaggccggcuaaaaaaauguuuuuggcucugugggcccauacgaccuugacugugacuacuggacucugccacuguggagcaaacacagcugugggcgucacauaagcuagcguggcuguguuccaauacagcuuuauuuuuaauacuggaauuugaauuccacaucaucccuguguugucacaaaauauucuuauuuugaauuucuuuuagccauuuacaugaaaaccauucuuagcucauagaccuuggaaaacuaggcagcaggccagauuuuacccacagguacauaguuugccugcugugcccuagaguaaaagauccaggaccugagcagaaggcacgacguccuuucugaccaaaccucagaagucacacugaggcucucaccuucuccuucagguuacaccaugugagagucaaucacguggggaugugagcuccaggacacaggggagaggaccacuggggauccgggagccuggcuaccccccaguaccccaccaacacacacacacacacacacacacacacugccccucacaggugaccaucugcuccacacuuugagcagcgcagccacuguuuucuugccagccauuaugagaaaaaucaugcuuucaagucugaauauaagccauggaguaagaggucugaugaccacugaaucugcauaaagguacagugcuagaaucuaggcuaauacuagaacuggugguauuuuagcaagcuuagaaacagcccaugaaagcaggugugaguucugcuucugugguuuagggugggugagggagagcgguauuguucugugcuuucucuuugacucggguaaacguuuaucuacaagagacuugugggauucuuacuugguccaccuccaggugacugggcuuuuacuauuaauguaaacugccugggacgcagccccugccaugggaaacgcagggcacuuccuguucucagcauagagugacaaggaaauuuacucagagcgguuacucugacauucaauguuuaguucaggaggcauuucugcuuugccaucgagaauuuuucucccuucuaagaaaauguuuucuccugagaaaauuuuucucccuuccaagaaaagaguagaaugaaaggaggcaacuugguuucauagggagugucauguuguccuucugaguuuacugaugagcuuaccugagaaaggaggguucuagcaugggaguucuguugcuacaagacaugaaagaauggccuccguuuaucccggagaggagagucccugagcccuugggaguugccuugaaaccucugccgggucccaggugagaaagugugugaguugugugguucugagaucugaacaggcaccaucuggugacacuaggggcugaaggagcucgguggcugcagguggacuggagcucaccaucaggaaguagccagauucucaccccucagugucaccgaguguucuggcuuuagaggaaggacuccgugguccccaagccacaaggugucgaggucugagucucaacgccaugacucagugugaauuaacuuagcagguaucacaacaucagauuuggguugugguucccugcugggucuguacuuuagauugaugacaaagcccguccucagccuuauuucagcccagaucucgguauuuaugccacagauacuguugagcuccucugggugcgugcugacccugaggucacacagaugagccaggaguggcccuggcuuucaggaaacguagugacguaaaaggucccggcugcugcgggauaagggccagggcagaggugugaacgcagccguggaagacuugggccaggaagccauuuguucugcugcuaacacuuccacagcuccacguguccagacuguugccagagacgucuuuggucuacaggauucaggagggaaucugaacuuuagccuggagcauuaucaacucauagaugagucugaaacaaacuuagugaaaucugauguuuuuuguaguuuuccaguacaguuuuucccaucgcuggaauccugguuugguucugcgggaaucgagugcuugagugggacccagacagacaggaagggcgcuccugcucaguuagccccaguaagcucacugaggcacacaggccccauguccacagccgcuccuggcugaggcgugguuccuaagacgacccuuacuguugagggcugccaggagggagagacacauucagccccgcagguccucugggaauccggugagcgucggcaccgggcuggggccgugcugauucccggcagcgugugggaaugugcgggugccucguggccugcugacaucgcacacaggucacagccuguccaguucaggacaucagggccaagagugaagugagaauacggaggcaccucugugugcucacccugcugaccgucacccagccuccggggggggucacagcuggcccccaggaagcugcuucccagcagggcaggaauuccauuugagucuugucccuguuccaggagaagggcuggguaugugucccccaaaggggagagcauucgagaaggauggcgccagccuccccagaacugaccugugguuaaaaaaaaaaaaaaaauugugcuuuuuaaaagaugaguuuuaucagcucacacauccuucuagagucuaauggagauuuuuuguguguguggaaauaguaaacaaggucuugaaucccacagagcaaaaaagacuuccuuucaugggcagcacuggaaggguuguuacucuggaaugguuuaaaagaggcgucacauggcuuguuugugcugaugucacugccucgcugcucuccuguggcaccuccucggucccuggccacagggcacagagccaagcacaucucaugcucuuggcccaguuacgcuucugcccagggguaagucagcuggagaggaauucacagcccaggcauuucaugucguuauggccuauuuuaauuuuuuuaaccccaaucauuuuucuuaggaagugauggggaguuuggaaaggcaggcuuauuugucaucaagcugccagcuuuuaucaaugcaaaccacaucccugugacaucugugacuguuccuuggacaguuaggugagggagggucuccugguggccccaggguuacucuuauuuagguugagaaaaauuccuuuuuccaggaucguuggugaucaaaguguagucauucuguugcgcagagaacuccaucccagcuccacccucaugaauuuuguaaucuuggacaaauuauuuaguaucuuagugcuucuguucccucaucuguaacauggggguauauuauagucaguagcaccugcuucacaaacucgugaggacuucagcaguucacacacauaacugccucgcugccuggcaccuagcgugcacauggcauucuaccgugggguagacuuuuaaaauucuggcuacagagauacuuuuccauaaaaguggccacauggaacucuccaaaucuaagaagcauacugugggggccuucauauuuugucuaauucuuuucuccccagaacaggaaccugcacccuuccuucuuuuaaagggcgacgugguaaauaaacauuuuuagacuugcaggccacagucucuguccuaauguccucagcugguaguuguagcuggaaagcagcugcagcccacauggaaaugagggagcguggccccaugccagugcagcugauguagaggcgggcagccccggguuaggcccuguggagacgcaggcccccgggcucuagaacgcugaauucuagugaauucuggauggcucucccucacacccaggcccacccucccucaagguugcaccuucuccaccugaaggaagcugccagguggccauaggagcccuucucuuggcaggccagcuuccaggcccaguggcuucucuuacaucaggggccuccccuuggaauguucccugaaggccagacacgggcagguagucuguggucaagcagccacccugacaggaggcuagaugccacugggugugcuuugaguuuccuagauguggagaguucuguguggccacuuuuauggaaaagcaucucuuuagccagaauuuuaaaauaaagaggauaacuuccuggugagaacagacguggaaaggaaggcacuuugguuucacgcucauguaagagagggcuguuggcggucacuccucagaacuauggccagcccuggaugguagccagcugcuuuuugccccaaaagucuguuuagcugggucucugcauucuggaagcuugucaaagcccgggccuuuccugggucagggcagccggcuuuccuuguccacguguggccggcuguuuucuuggggagccccggccacagccggcaggacucccuuugcuccaugugacucugagggccucacagguauuugcagcccaggugcugucggagcccagccgaugcgaccgacacacagcacaagcgucauccuguucugccugucccuugcguguggaggggacucgugcccagggcucuccuugcuggcuuguuggaaucuggcuucaggucuacacggggccucucguuugguccagaacagccuggcucaucggcuggggcuugcuugugcagggcuggagcgagcacgugcuagauggagacagcagacucggagugugcauuucuucguguugcaagccuggccucacagugccuucuuccuuugguugucugccagggguagcccugcaccaggaggaagcuuagaaauagcacaggugggaaccggagagagagcacuguuggggaagcugcggucacucaucagccuuccuggugagaaaccagggguuuccugcuaauucuggaaaggauguuucagcagugccugcaugagacgccucagauagaaaacugguuauuuuuguuucuuagcacugccaccauagauaacagcugucacgauggacaguguggaccuggauuaguccuucuugggaaaggagaguuuggguuuuguaccguggugguucuggguucugggggaagagaauggaaccguacgagguaaaacaggagacucugaaggccacuuggccauccaggcagaaagccagggauggagaggggcagcagggcuguguucagugcucccgccguacgcuuguaugcgggaaaccacugcaggcggcccaugaagccuccuggccaugugcgcccucccgguuuggacccccucccgugugucuuggcugcagguuugaacugaugcgcaugugcuggcaguauaaccccaagaugaggccuuccuuccuggagaucaucagcagcaucaaagaggagauggagccuggcuuccgggaggucuccuucuacuacagcgaggagaacaagcugcccgagccggaggagcuggaccuggagccagagaacauggagagcgucccccuggaccccucggccuccucguccucccugccacugcccgacagacacucaggacacaaggccgagaacggccccggcccuggggugcugguccuccgcgccagcuucgacgagagacagccuuacgcccacaugaacgggggccgcaagaacgagcgggccuugccgcugccccagucuucgaccugcugauccuuggauccugaaucugugcaaacaguaacgugugcgcacgcgcagcgggguggggggggagagagaguuuuaacaauccauucacaagccuccuguaccucaguggaucuucagaacugcccuugcugcccgcgggagacagcuucucugcaguaaaacacauuugggauguuccuuuuuucaauaugcaagcagcuuuuuauucccugcccaaacccuuaacugacaugggccuuuaagaaccuuaaugacaacacuuaauagcaacagagcacuugagaaccagucuccucacucugucccuguccuucccuguucucccuuucucucuccucucugcuucauaacggaaaaauaauugccacaaguccagcugggaagcccuuuuuaucaguuugaggaaguggcugucccuguggccccauccaaccacuguacacacccgccugacaccgugggucauuacaaaaaaacacguggagauggaaauuuuuaccuuuaucuuucaccuuucuagggacaugaaauuuacaaagggccaucguucauccaaggcuguuaccauuuuaacgcugccuaauuuugccaaaauccugaacuuucucccucaucggcccggcgcugauuccucguguccggaggcaugggugagcauggcagcugguugcuccauuugagagacacgcuggcgacacacuccguccauccgacugccccugcugugcugcucaaggccacaggcacacaggucucauugcuucugacuagauuauuauuugggggaacuggacacaauaggucuuucucucagugaagguggggagaagcugaaccggcuucccugcccugccuccccagcccccugcccaacccccaagaaucugguggccaugggccccgaagcagccuggcggacaggcuuggagucaaggggccccaugccugcuucucucccagccccagcucccccgcccgcccccaaggacacagaugggaagggguuuccagggacucagccccacuguugaugcagguuugcaaggaaagaaauucaaacaccacaacagcaguaagaagaaaagcagucaauggauucaagcauucuaagcuuuguugacauuuucucuguuccuaggacuucuucaugggucuuacaguucuauguuagaccaugaaacauuugcauacacaucgucuuuaaugucacuuuuauaacuuuuuuacgguucagauauucaucuauacgucuguacagaaaaaaaaaagcugcuauuuuuuuuguucuugaucuuuguggauuuaaucuaugaaaaccuucagguccacccucuccccuuucugcucacuccaagaaacuucuuaugcuuuguacuagagugcgugacuuucuuccucuuuucccgguaauggauacuucuaucacauaauuugccaugaacuguuggaugccuuuuuauaaauacaucccccaucccugcucccaccugccccuuuaguuguuuucuaacccguaggcucucugggcacgaggcagaaagcaggccgggcacccauccugagagggccgcgcuccucuccccagccugcccucacagcauuggagccuguuacagugcaagacaugauacaaacucaggucagaaaaacaaagguuaaauauuucacacgucuuuguucaguguuuccacucaccgugguugagaagccucacccucucuuucccuugccuuugcuuagguugugacacacauauauauauauuuuuuuaauucuuggguacaacagcaguguuaaccgcagacacuaggcauuuggauuacuauuuuucuuaauggcuauuuaauccuuccaucccacgaaaaacagcugcugaguccaagggagcagcagagcgugguccggcagggccuguuguggcccucgccaccccccucaccggaccgacugaccugucuuuggaaccagaacaucccaagggaacuccuucgcacuggcguugagugggaccccgggauccaggcuggcccagggcggcacccucagggcugugcccgcuggagugcuagguggaggcagcacagacgccacgguggcccaagagccccuuugcuucuugcugggggaccagggcuguggugcuggcccacuuucccucggccaggaauccagguccuuggggcccaggggucuugucuuguuucauuuuuagcacuucucaccagagagaugacagcacaagaguugcuucugggauagaaauguuuaggaguaagaacaaagcugggauacggugauugcuaguugugacugaagauucaacacagaaaagaaaguuuauacggcuuuuuugcuggucagcaguuugucccacugcuuucucuagucucuaucccauagcguguucccuuuaaaaaaaaaaaaaagguauuauauguaggaguuuucuuuuaauuuauuuugugauaaauuaccaguuucaaucacuguagaaaagccccauuaugaauuuaaauuucaaggaaaggguguguguguguguauguguggggugugugugugugagagugaugggacaguucuugauuuuuuggguuuuuuuucccccaaacauuuaucuaccucacucuuauuuuuuauauguguauauagacaaaagaauacaucucaccuuucucagcaccugacaauaggccguugauacugguaaccucauccacgccacaggcgccacacccaggugaugcagggggaagccaggcuguauuccggggucaaagcaacacuaacucaccucucugcucauuucagacagcuugccuuuuucugagauguccuguuuuguguugcuuuuuuuguuuuguuuucuaucuugguuuccaccaagguguuagauuucuccuccuccuagccagguggcccugugaggccaacgagggcaccagagcacaccugggggagccaccaggcugucccuggcugguugucuuuggaacaaacugcuucugugcagauggaaugaccaacacauuucguccuuaagagagcagugguuccucagguucugaggagaggaagguguccaggcagcaccaucucugugcgaauccccaggguaaaggcguggggcauuggguuugcuccccuugcugcugcuccaucccugcaggaggcucgcgcugaggcaggaccgugcggccauggcugcugcauucauugagcacaaaggugcagcugcagcagcagcuggagagcaagagucacccagccugugcgccagaaugcagaggcuccugaccucacagccagucccugauagaacacacgcaggagcagaguccccucccccuccaggcugcccucucaacuucucccucaccuccuucccuagggguagacagagauguaccaaaccuuccggcuggaaagcccaguggccggcgccgaggcucguggcgucacgccccccccgccagggcuguaccuccgucucccugguccugcugcucacaggacagacggcucgcuccccucuuccagcagcugcucuuacaggcacugaugauuucgcugggaaguguggcgggcagcuuugccuaagcguggauggcuccucggcaauuccagccuaagugaaggcgcucaggagccuccugcuggaacgcgacccaucucucccaggaccccggggaucuuaaggucauugagaaauacuguuggaucaggguuuuguucuuccacacuguaggugaccccuuggaauaacggccucuccucucgugcacauaccuaccgguuuccacaacuggauuucuacagaucauucagcugguuauaaggguuuuguuuaaacuguccgaguuacugaugucauuuuguuuuuguuuuauguagguagcuuuuaaguagaaaacacuaacaguguagugcccaucauagcaaaugcuucagaaacaccucaauaaaagagaaaacuuggcuugugugauggugcagucacuuuacuggaccaacccacccaccuugacuauaccaaggcaucaucuauccacaguucuagccuaacuucaugcugauuucucugccucuugauuuuucucuguguguuccaaauaaucuuaagcugaguuguggcauuuuccaugcaaccuccuucugccagcagcucacacugcuugaagucauaugaaccacugaggcacaucauggaauugaugugagcauuaagacguucucccacacagcccuucccugaggcagcaggagcugguguguacuggagacacuguugaacuugaucaagacccagaccaccccaggucuccuucgugggaugucaugacguuugacauaccuuuggaacgagccuccuccuuggaagauggaagaccguguucguggccgaccuggccucuccuggccuguuucuuaagaugcggagucacauuucaaugguacgaaaaguggcuucguaaaauagaagagcagucacuguggaacuaccaaauggcgagaugcucggugcacauuggggugcuuugggauaaaagauuuaugagccaacuauucucuggcaccagauucuaggccaguuuguuccacugaagcuuuucccacagcaguccaccucugcaggcuggcagccgaauggcuugccaguggcucuguggcaagaucacacugagaucgaugggugagaaggcuaggaugcuugucuaguguucuuagcugucacguuggcuccuuccaggguggccagacgguguuggccacucccuucuaaaacacaggcgcccuccuggugacagugacccgccgugguaugccuuggcccauuccagcagucccaguuaugcauuucaaguuugggguuuguucuuuucguuaauguuccucuguguugucagcugucuucauuuccugggcuaagcagcauugggagauguggaccagagauccacuccuuaagaaccaguggcgaaagacacuuucuuucuucacucugaaguagcuggugguacaaaugagaacuucaagagaggauguuauuuagacugaaccucuguugccagagaugcugaagauacagaccuuggacaggucagaggguuucauuuuuggccuucaucuuagaugacugguugcgucauuuggagaagugagugcuccuugaugguggaaugaccgggugguggguacagaaccauugucacagggauccuggcacagagaagaguuacgagcagcagggugcagggcuuggaaggaaugugggcaagguuuugaacuugauuguucuugaagcuaucagaccacaucgaggcucagcagucauccgugggcauuugguuucaacaaagaaaccuaacauccuacucuggaaacugaucucggaguuaaggcgaauuguucaagaacacaaacuacaucgcacucgucaguugucaguucuggggcaugacuuuagcguuuuguuucugcgagaacauaacgaucacucauuuuuaugucccacguguguguguccgcaucuuucuggucaacauuguuuuaacuagucacucauuagcguuuucaauagggcucuuaaguccaguagauuacggguagucaguugacgaagaucugguuuacaagaacuaauuaaauguuucauugcauuuuuguaagaacagaauaauuuuauaaaauguuuguaguuuauaauugccgaaaauaauuuaaagacacuuuuuuuuucucugugugugcaaauguguguuugugauccauuuuuuuuuuuuuuuuuuaggacaccuguuuacuagcuagcuuuacaauaugccaaaaaaggauuucucccugaccccauccgugguucacccucuuuuccccccaugcuuuuugcccuaguuuauaacaaaggaaugaugaugauuuaaaaaguaguucuguaucuucaguaucuuggucuuccagaacccucugguugggaaggggaucauuuuuuacuggucauuucccuuuggaguguagcuacuuuaacagauggaaagaaccucauuggccauggaaacagccgagguguuggagcccagcagugcauggcaccguucggcaucuggcuugauuggucuggcugccgucauugucagcacagugccauggacaugggaagacuugacugcacagccaaugguuuucaugaugauuacagcauacacagugaucacauaaacgaugacagcuauggggcacacaggccauuugcuuacaugccucguaucaugacugauuacugcuuuguuagaacacagaagagacccuauuuuauuuaaggcagaaccccgaagauacguauuuccaauacagaaaagaauuuuuaauaaaaacuauaacauacacaaaaauugguuuuaaaguugacuccacuuccucuaacuccaguggauuguuggccaugucuccccaacuccacaauaucucuaucaugggaaacaccugggguuuuugcgcuacauaggagaaagaucuggaaacuauuuggguuuuguuuucaacuuuucauuuggauguuuggcguugcacacacacauccaccgguggaagagacgcccggugaaaacaccugucugcuuucuaagccagugagguugaggugagagguuugccagaguuugucuaccucuggguaucccuuugucugggauaaaaaaaaucaaaccagaaggcgggauggaauggaugcaccgcaaauaaugcauuuucugaguuuucuuguuaaaaaaaaauuuuuuuaaguaagaaaaaaaaagguaauaacauggccaauuuguuacauaaaaugacuuucuguguauaaauuauuccuaaaaaauccuguuuauauaaaaaaucaguagaugaaaaaaauuucaaaauguuuuuguauauucuguuguaagaauuuauuccuguuauugcgauauacucuggauucuuuacauaauggaaaaaagaaacugucuauuuugaauggcugaagcuaaggcaacguuaguuucucuuacucugcuuuuuucuaguaaaguacuacaugguuuaaguuaaauaaaauaauucuguaugcau

SEQ ID NO: 15215 - RNA, 882 nt, Homo sapiens
uauuuuugauggccauccuaguccaguguaaagauauggacaagaaaccccacauaaaggaagcaagaucgcuggcugcuuucucuagguagcuugaguuguauacuaauuuguagauuauuucucuucaucgaaaaaacaaaacauucugcagagggcagucauguguccgcugugccucugcuccugugugcaccauaaaacuugaaagugagccagaauuugaaaauaucggauugggaugugauuucuuuaagccucuggcuaauuuaauauaaaguguuuacacuucauuuuucuggcaguggauuuucuauguaggugguggaagauuuccuguaaguuuugcaaguuccagggcaaagagaguugcaauaugcaauaucuuucuguggucacaccaacagaaagggcgauuucuuaaccugcugcaguuaccauguguguagguggaugcuggcuauuacagaugguauccuuucaacccucaaaauuguugcaaguucacagguauguuaaugaaaaugaauaaguggcauuuuuaggaauuccaaauacugagucuuggaaguagauaaucuuuucccuaaauguaugcuccggucagaacugcugccuaccacaccucgugggugaaacagauauuucgagcaugacugagcuuauuaagagcccugcggcgcuuccucugccggggguuuagaaauuucaaaggauggggguugagggagggaggaguuaugggcaugugauguggacagggcgggcaggaggauggaaguaacagguccaaaauguaucuuugguggcccggcagagcucuugcauggggugagaaugguaauuuaggaagagcaagucuucccaucugugaagcagaag

SEQ ID NO: 15216 - RNA, 882 nt, Homo sapiens
cuucugcuucacagaugggaagacuugcucuuccuaaauuaccauucucaccccaugcaagagcucugccgggccaccaaagauacauuuuggaccuguuacuuccauccuccugcccgcccuguccacaucacaugcccauaacuccucccucccucaacccccauccuuugaaauuucuaaacccccggcagaggaagcgccgcagggcucuuaauaagcucagucaugcucgaaauaucuguuucacccacgaggugugguaggcagcaguucugaccggagcauacauuuagggaaaagauuaucuacuuccaagacucaguauuuggaauuccuaaaaaugccacuuauucauuuucauuaacauaccugugaacuugcaacaauuuugaggguugaaaggauaccaucuguaauagccagcauccaccuacacacaugguaacugcagcagguuaagaaaucgcccuuucuguuggugugaccacagaaagauauugcauauugcaacucucuuugcccuggaacuugcaaaacuuacaggaaaucuuccaccaccuacauagaaaauccacugccagaaaaaugaaguguaaacacuuuauauuaaauuagccagaggcuuaaagaaaucacaucccaauccgauauuuucaaauucuggcucacuuucaaguuuuauggugcacacaggagcagaggcacagcggacacaugacugcccucugcagaauguuuuguuuuuucgaugaagagaaauaaucuacaaauuaguauacaacucaagcuaccuagagaaagcagccagcgaucuugcuuccuuuaugugggguuucuuguccauaucuuuacacuggacuaggauggccaucaaaaaua

SEQ ID NO: 15217 - RNA, 13155 nt, Homo sapiens
agcauuaguguaauaauuuuauuaauaaaacgaacccauaggguucaaacaagcauacaaaguaauuuuuuuuccuguggguuaaauuguuacauuuuuaauaauaaaaauaagaaagcuuucauaguuaacuuaccaaaaacauaacgcuugccuauuguuucuuacugugcaaaacaaaaacaaaguuuugcccacagaaggauuuugugcaccaaaacaugcacauuuucaauuucaaaauuucugcaucaaaaugaaaauuccaaggccacguuuuuguuuuuucaaacuaaagaagagcaagaggggaauaaccaagcaaauaacagcagcuacauuuuuaaucuucauucccagguauuuucuguuucaauguagaauucuccacauucauaaaaugauaucuucaaccuacugcuuacagucagauaugccaguaucauuucaauaaggcaagucacaccuuuuagcuauucucuuaaguccuacagagauaguuucacuucaauuucacagggacacuucaugauuuaucuaauaaaggugauaagacaauccuagugaaggauuccuuuaaguuguugcuuuucuagauggaaccaaauaauuaaacuuucucuucuccauacuggaguuuguuucuuucauuauguuuuaguaucauggagucgaacaaugccuuggcagggcaugaacuauauaacucagaagucaauaaacaguugaagaugaucuuuucuaaaguaaaaaucaacuguuuagacaacacuuaaauacacauuaccuguuuaaagacacacacacgaaagcaaaauuuaaaaaccaaaucaaggaauaacguuuugugacaauuucaguagcacaauuacuggucuaacaguuuugcauugugggaauuuaaauagcggcuuacaaugaaagaacuaugcacgaugcuuccaggauugcagaggagagagguaagcccagaggaugaaaagcauacauuugccuaauguguguagaaaauucccugaucaaauggccaacuaacuuuuaaauacaaaauuuaaccuuagaagaacuuuucuauuuuuggugaacaugcugauugaaagaaaaaucaaucauucuguuaaaugaaguacaguauucugcaggggaagcaccaggguuucuggaucaaacccuuaggacaugaagaaaaccaaaguacucugcugguucaaaaucuguaucacaggaaucccuggcucccuuccauguguccagagaugcucucagcucacaaaaccaacagauggaaggaaaagcaagugaacaugugaccaugugggaggggggcuggggacgguaaaacacugcucagacuuucagcagcaacacaauccuguuggucugaauauccugagguuaaaugauaauaaaauauugcaccaacacaauaaagaaaaucacaguuuaaacagaauuacugaagaacuggaauaauguacaaugcagugacugccaucaguagaccuaggucucuugacaggaauuaaaguugugucuuuucuaaaaauggcacuccuaccuucuuuugguuugguguuuauuuugacauucucuuagguauacauauauuuacuuccauuuaacgcuaacuuacugaauuuuccccuuggcccaguuucauauuuagugauagaugagacuguggcuguaaacagcagcaacucccaagaagaguacucagggcgagagauuuaaaaacauaucugauaaccccauuagagguagguuagaaaaaggccuuuuauuugggacuguguaguuaucaaggcauccugcagaugcaaccuuuucucucccuucuuucucuuacaugcuccuagguaaauaagauaugaggaaaaucaaacguauauccuguuaaagcacuuaaaggggguaaaaaguacagcccucaacaaaacguguuuucacauugaaauucaucuuuccucuuugaaccgacaagcuuuucaagaaacccuuucuugguuucauaauaccguacugccgauuuauaaacuauauuuuagucuacccuugaaagaaugaaaacuguaguacuucauuaggaccucauaugaccaugaucucaagaaaagaugcuuuuucaaugucuuuaggccugaauaugguaggaaaucaugaagcacccaaagacucaggaucucacuucguauuuggagugggccauucuccuaugcacacacacccuuguuuuguugcccucuccaaaaucaagucuucaccccuucaguucauaucgccuucguuccacucuucaccaugggaaacucccacaguguuuccacuguuuacagauuccuuucucucacgucagcgcaggcacccuuucacuuacucuguaaccaucaggacuuccauuacauucugugacuuugcacaucuucaucccaguuuuuaacagggauauauauacgaccaucauauaaacuugugcggcaauccugccggcccaccagaacuuucucacauucuuuaauuucuauugccuucagucuugacguucauuuauguuuucaagugaaucuuuccugucucuuucccaaaaaggcagaaggaaaagaaccaacauucuaauuugaugaugaacacagugauuucugaaauacguucagagaaugaaggaaacaggcuggcucucuucuacgucgcuaggaugugggucaaccugcaaaaaaagagcggacugagauuaguguuguagcauuauuuaaaacgauucuaguaccuauuuguaauuauaugaugguuauaugccaagcuggucagagccuguguaagucccagaaggugcuuaaguucucuauauuccauggccaaauaacacaccuuaaaggcaauccacaauacuguaucugaugccauagaucacaaggacaauaguaaaaaaaucuggcaaaugaaucagcgauaaucuauuaccacuguauaaacaaauuuaaauguaucccuuacuaauuaugagucagcaacagacacucuaaugaacggaugacaaaaaaugauuauuugaaaauaauacaguaaaagucuaauuuucuuuugcuuugcuuaccucugaauaaagagguggggguugaaaccggaauucuuguauacaggcaaacacaggacagcacacuucucccucacaguuaggggguugaggguaaggaggaaugugucuagagaauucuuccucugauaccacaucugcauaauuugguggugcugaaauagaaaugaaguuggaguuaagaaauccacucaaaaauuaaucucgauucuuaacugcuacaaaaacaagaaacagcuaaacuugaagauaaaaaauauggcauucuuucccucuaaucagcaagguuuuaugcauauuacaauaaaaaauagauucuccuuuuauuaaacuacuacuaauagcuucuauucuagucucuugagauauagguaaacaaauaucacugaaauaugacuauagaaaagacauaacacaccauacauuugacuguuuuucauuguuuuccuauuacaaauaggaauuaggaaauguacaucuuauuccugaaucugcuaucagcagcuuugcguccuagauaaagcuaaacuuucaaagucccucccaggacuaaugcuuucugauuuuuuaguaguaggaauaaagauaccuauaguagcaguacucaucaacaucugagcacuuaauaguguauauauucuguuccuagguauuuucuagguaaagcuucguuaugaaagaacgccaacauauuuuaccuucaggcugcucuggcagggucagugucaaccagcucauauccauacugaacuggcuggcaaugcuggaguuucugcugccaaaaccauuauauggaauuguaccgaucacuaauggcaguucgagcaucaauuuuuuagcaccaggaaugugaauguauaccuaauaagccaaaaaaaaaaaaaaaagagaaaggaacaaauguaagcuacaccuccaguagguagcccaauuaauuucuuuuuuucauagaaacaaaugcuuuugucggcugccaccacccccaucacaauucucaauugucuugauuaaacaaaaugaagaguacacaaaacauagugaaugcucugugacagagaacuguguccuuaacaugcaucauuguagguuugcauggcuuauauaauaauuauagaaaauuaaggcuaugucuucaauauaacaaacaccccuuaaugcaccucaauucuuuuauggcauucuauuaaauccccuguggggaauagguuuuauuaaaaacaagggccaaucuucauacaguccccaauugguguuaaugcugaaauaaaaugacauuuuuauaggcaacucuacauacccacaguaacaugacaucaguuauuguccaucauacacauuuuuuuuuaaaaaagagcuuugcuuacagcuaaggaauaguccacucugauaaugcagcaauccaggauggauggaguaacaggugggauuuuuagcguuuucccauuccaugugucugugcucccagaagcgaugugguuuccucgcacauuggcgaccaugugucgaauggucuuuguuuuuccacuagccaaauaugucugcguuuggaaaauagcagccuuuggaacaaucagacgagaggaacaauuuucuauuucugcauagauuggaauagcuucuccuaaaaagaaaacaaaaccagggaggauucagagacucuugaaaaaguucucaccacaauggauuagggccguauagcugaaauguuccaacaucacuuuaacaaauugagaagcuuugauggaaaacauauuguaaauucaagccagagaaauaaaaauucacugcagguugugguagaucuuauuuucuaauuauugcauuauugacuuuucuaaaguagcaauauugcauuagcaauucuaaagauauguaaaugaccagugucuauauaaauuaggauaagacauacaaauaaaugauucaggacuauguuaaguauaaaagaucacuaacaaacucauuagugcuuaucaaauuaaaaucugccuaacaggagaacaaagccuuugcuuuuaaggaauuaauaauguuaaggcacagaaagaaucaacggauggauuaggcaaguuuuauaacauuauggcugcacaucauaccauuccauacugaauuccuuucuaacaagucagaauccuggagcaggggccaaauccacugcuggaaaugggcccuucacuaauggcaauuccaguaacaaucugauuguuaaguuuguuaauacacuacauuccagucccaugcauuugcauauaucaagccagcauggaaucagaaugucuaauagcauuucauacuccaguaguucucuuuuuagcaauacaacccuggagauucuuuugcaacauuaaaaucagaugcuggcauuuucucauuccucuaguuauacucuuuguuacuaaaguaacaggauugaagucagaaaaaaaacaggaguuugacuggaaacaauuccuccuuuuaaaaauacuuaaauaucaauuauuuauauaaaaaauguaucacuauucauguuuuaaaauacuauacacgucauauaauuacaaaaaacacuauuuaaaaucacuuaaaauuagcuaagaaaaugaaugaaaucuuucauuuggacuuucaagcauuuugcuuaccauuacaguaucccuuucuuucaauuuuggcacucagcgagacuggaccagaagugaaaaaccaacagccaaccauuuucucuugaguuuucaauacaggggucuugaaaauuucaaacaauaaaacaaccuuaauuaagccacucuagagaacucauagaacuuaaaauuauaucuaucuucacagaaugguuguaaggaaauaccaaaaaaaugaaucaaacuuucuuauccucauguaacauauuaggccaaauaugcacaaaaacacaggguguuaagacuccccuuuuaggaaaacuacagugaauuuucagauucaaaaauuagcaugacaccaucuuauuuuacccugaagucauuauguuuccaggaaauaauauaccauuuuuuuaaaaaaaaaucaaaagcuguauuaggacuuauaaacaugacagaauuauuuuuaagacuuuauauauaaaagucagguggaaggauaaaugauauaaaaauaaaaaauaaucagaacauuauauuuauuuuggcauuuaauaaaguggaauaaacaaacagccuuuucccaccacuuacuucaaaaugcauuaucaagcagaaauuucauguguucuuaauuuggagugguuuugggguuuuguguaauagugcaauaacauguguaguguuaaccgaucugaaaagcuuauuaaacauacccucucacugcaguauucuauucuauaguggcaagagaaguuacuacaagauuuacaauguucaguuuacgaguuacacacaccaaagcuuucuguaaaacccaguuacuugcaauauuuuuuuuuuauuuauauaaagaaucguaagggaucaacagugucuguuuuuggcaaagacaaaucccuuuaaaucaauucccacaauggucauaaaaacuuuaaaaauauucagccucccaauucuaaguaguuuuuaaaaauacaagcuacuuggcaucaccaauuuuucaaaaaugguuuucaagcggcuguuaaagucccagcuauaagccaggccagcugggugccggcuguuuuaugauucugaccacaagaggccauggaaccacagcauaucugcuaucuuuucauaaucuaaaggugaacauuaaauucuauuucuuucucaugcgaaaauaagacuuaaacaacaacuucuaacugcuagcuuuuuccuugucuuuaaaaacacaggcuagaaaaaccuccaacaugaaaaauacaucuuugucacaucaguaucgugauggaaaguuuaaauuaucucaguauuuucuaugaaguaaaaaaaaucauucauucauauuuaaaugaagaaccauuagguccuaguagcuaucaugaaaguacaagguauaauuuuauauuauuuugauaauauggguuuagauaaaagaaucuagcucauuagcucccaucuugccuauucuguuguuacuuauagccugaucuuucuuaucagucuacaguauuucuggugauuauuagaaguucaaugcuuuaauguggccaaaucugucauaaggaaaugauaagugaaaggaucucggcggcagcugcaugcacuuacuuaauguuagaaaaugacaugcaaaauggaaggauacauagcauaauggccugagcuucaauaacaggcugagcaugauuaauacucuuccauaauuacuguuccucaaccugcuauuauugaggaguuuagaauaccccaguccuguaaauguggccacucugguaaaaguaacuacucucugugugugcauuauuguuauuaagccuuauuaaugcauuucaagccuguguaacuuuuuggcaaaagaagcccugaacagcagggacauaaucaauaguauuaacacacacaauuuguaauuuguccaaccuagaaucauauauuuauagugaaugccuuuggguuacaagauuguguuuuccaagccaucagaaagugacaggacagacuaccaguaaacuggcuaaauauagaucccacuguugaaaggaaggaggaagggagggaaggaggaaaaggaggaggaagagaaaaaggaagaacuuacuaauaaugcugguguguugacaucgacaugacuaacaaccuggaguucccgcuuuacacucugaucagguaccuugggucguuccaacacugcccgcacacaguacugaaugcuuccauauuucccaguaaacgaggugaccaaaggucugaaaccaaccaaagacauuaauuaugaguuuacuuuucaguuaaacaaagccaaaaaaagcaugguuuaaaauguuuuagguuggaaauaaaaaaagaguaagucuauuuagggacuauucaguguaaacaugcauacuugagaaucagaagagaccuagcagugauaaacuugaauggacauacugcagagaaggauaaccacaaaauuguaguguuucacuuacucagauggaaguugaaagcgaaauggaaauucauguuuuccaggcuguaauaaaaugaugccuucaccuauaagagauuguauuuuauuuuaaugaaggauaguuaguauuagaucaagaguuuucacaauguaaauaauuuuuugaaggaaguuuuucucgcuacaaaaugcagcauacuccaaaaguucauuaaacaaauguagagaauuaaguuugaaggggggugugugugcgugugucuauguguuuuagagacagggucucgcucuauugcccaggccagagugcuacggccuugaacuccugggcucaagcaaucuuccugccucagacucccaaggagcugggacuauaugcaugugccaugguucuugacuaauuuuuaauaauucuuuccagagacgagggucuugcuauauugcccaagcuggucucgaacuccuggccucaaacgauucucccaccuuggacucccaaagcacuaagcuuauaggggugagcuacugcacuuggccaguuuuuaccaaguaccauaacacucacacauacauacacacauauauuccauucucaaauagaccaauuacuaaagugcuaagguucagaacuccaacauacauauauauguguauauggauauguauauguguguguguguguguguguauguaaaaaucacaacugcuuacccccauucuauuauacuaacgggaaauaccaauauuaaauuggaccaaaaacuaauuuagcaaaagacagauuuauuuuggguauaccagaaacaucacacugaguauucuuugagcagaaauggaaaagggagugaaaacuuuaugaauaucauuaauacuggguauaacacaaaacagccaaacccacaagacaagcuauuaagcaagucauguauguauccuugagcucuccugacuaacacagaguuucuugguggcuaacuuggaauacagaaagggcuuuaccaagcauggccagggcccuuuucucagcuuuggguuaccagcuccauuuuauuucaggcagaagcuuaucacuagauugugagaaggccaaaaugcaggguguggagggacuuuguaaggccagaggcaccacugaaaccucugaugaaggcaccaagacaaucuguuuaauucagauccaaaguagacuucauggcuuucacgguuggucaggaggcucucuugagagacuuauacacuguccuuucauuucaugcucagauuuaauauugaauucccuuauuguggauaggauaaauaagaugaagaaaucggaacacagagacagaacucugagauuugccuggucaucugacacuaaaaugaagauuucuacuuuauccauucacuaaaaaaaaaaauuuaaagaaaucaguagugaaaugggaauuuuuuaucccuuaaauaaaaaaauagaguuuuauuuuaugaccuuaaccaagucagcugacauuucaacuucguacuuuuagaaaauaggaacacauuacugaccuauuaggucuucugaaucuauccccaauuuuuaauguguuaacaucaagggggauaaaaaagugacacaccugccacuuaagucaauuugaauacuccacaguugggugacuggaggcaaagugaagaacaagucacaggggcaugagaucauguuaaauucaguggcagggcgggucccaguggcugacgugugcucaggaagguagcagcagagcagggaccagggaagcaucucgaccugacagcuguggagugaaaggcucaaggcaaucccagugcuccuaaaagagcugggcuaaaguucuaauuugaaauuacuagauuacagaacaugacgaaguauuuacaaauguuuugaaauguguauuucauuugaguuuaaaauguguagugcuuagauuucaggcaccgcagauaauccucaaagagaccgggggaggaaaggagauuacaugcuuguacacaagcaaugaccauggagugcuagaaccuagagcacccacauaggaacaugggugggcccgacaucuucaggaccugagggcuggaauggagacagauaggaagggaaauuuagauaagggaauagcaugaggaagagcauggcaggcauuuguggggaacacaguugcccaggauacugaagagaaugagagacaugaaguuccccuuucauuaagcaacaaaucgacaucggaucuauaucauuuaaaaugagacuuucaacuaucucaaaacauaaacaggaaaaagaaauggaaaaacugauaaaaauggguuauaauauuuggaauucaaucuuuguuuucuuuuccucuuucucaaguuuuguuuuuaauguaaaagguucacaagcugaaccaugugcccauuucugcuucugcaccaaccgcucauuauuucugucuuguauacugagcacuacaaagucacaggaagauguuucaaucacuaauggccuuacagccaaagcucauaauuaaagguuuugaugagccgugggaugcagaagaccauuacagaggcagagacuggggcucaggaagggugagggacuugcauaaggucacacugcuggugggugaccaagaacugagaccaacucucugauucuggcuuguuuucuacuacaguuucucaauaaaaauaugaagaaaaucaaucacaaugacagcaaguaguugaauuagauuaaggaugucaaagaauuaucuggagagcauuugugaaaacagaucccagugcuacauaauauggauuucuaaaaaucuccuuaggugauugaaacacagccagguuuuguaauuaaauuacccccagaaucuagacuguguaaagaugcuaaguucuuccaagcuauagauauuaggggugacuuauuuuuuuuccccaacuaaaagagacuaugauuuuaagcaaaauguaauugugccaauaugugcuaugauacauucuaaaacaaguuuaagauuuucaaauugucuaguuuuuacauucuguuccacauguguauauaugugugugugugacgaauaaacaucugacuugugaauuaaaaaaaauguuagcccagauuuuaccaaagcaguuuuuuauugcuaaucccagguucaacugcuuuuaauuuuacaucuauugacucagcaguuauaggcccagagauacaguccaaaguccuggacaaaaaucaauguaugucucacucccaagguccuugacuccauucggccaucuugcaaauuguauugucugcuuccacuggggccuggguugauccuggaagccauacugaggaaagugcaugaaggaguaagaacuaucacuaacacacuguucccauugauccaaaaggcaguuuugguuccaaauauaguuuuccucacuacaauuuugggaugacucagaugaucacuuaccucgaggaguucacuguguccacaguaggauagggcaaaaccacauauucuauuauauuuuguauaagacauagcacauagauauaaugcguuuacucuucaaggagaggaggugcauaccauuguuuuauuugauagauaaaagcucauggcaaaaacguaaaaguuuaaacuaguuuccauccaugaaaugaguaagacucaugguucuuaguauuuucgugacuaaagggauccaauuuugguaucuaauauuaaugaaacgcucauguaguguguccccacauggguacuucuggaaaagucuacacugugaacuggacuucaccaaagugagcaggaagggaaaucccgacacgcccugaugcucuugucucuaaaggcauuuugaguggagagaagugggggagaggggaagaagcggguaggaggggaggaggaggauggggaggaagaggaugcggaggaaacagcagcaguaucagguagagguacaacucuuacuaaguugcccugcuccccagaagagggaaaccaagcaugaugaucaagucuggaaaacacuuccuuugaacuccuaccccucagaaacuacuucccuauuccccaaaccaaauuucugcuaauucaucaugaaccaagaacguaugcaggauagggaggaguggaggccauaggacacgggcaccgcagaauggaaccucauagccgccgguuccaccgucccuuucuuggaccagaaggaacaggaccuagauuucuggaucccccauuguccaaucacagguucccaccgcacccaauggcccccucccgucgcgguccuagaaaaucccgagccacuggucccggucaggcccggcgggccaggggcggggcgccaggaagagcugcgcacccaggacuugcggucucuccuuacccgcgaggguaggccggaccccacccccggaagcccgcccugaucucaccugccaggugggcaucccgagggugcgcggccucccagccccuccccggccccgcagccuggcgggggaaccccaggcgcucgccugcgcuuaccggccgggggcucccgcaggcugaggcgcacguucagguacuccaccuccgagaagacagccagggccgcggugcuggccgaggcgcgggggcaggugcucgggccccaggcggcgguggcgcgccccugggccuccaggcgcagcgcgcgcagggccaccggcucggacgccuccagcagcacgugcccggccacugucucgccgcuggaauagcagcccuugcgcucguccucgaacaccagacccaggcucuucacgcggcccucggcacccacggccgccgcgcacccagccuccccgcccaucccgccgggcgacucuuuccugccccugaggucggcagaggcccggagccggggucgcgagcacagcggcgccgcugucacaggcgcucgcggcaggguaaggccgccgcggcagccgugcgguacccgauggggcaccggcucgccgagaggccugucgcuuuaacaaacccaguugg

SEQ ID NO: 15218 - RNA, 13155 nt, Homo sapiens
ccaacuggguuuguuaaagcgacaggccucucggcgagccggugccccaucggguaccgcacggcugccgcggcggccuuacccugccgcgagcgccugugacagcggcgccgcugugcucgcgaccccggcuccgggccucugccgaccucaggggcaggaaagagucgcccggcgggaugggcggggaggcugggugcgcggcggccgugggugccgagggccgcgugaagagccugggucugguguucgaggacgagcgcaagggcugcuauuccagcggcgagacaguggccgggcacgugcugcuggaggcguccgagccgguggcccugcgcgcgcugcgccuggaggcccaggggcgcgccaccgccgccuggggcccgagcaccugcccccgcgccucggccagcaccgcggcccuggcugucuucucggagguggaguaccugaacgugcgccucagccugcgggagcccccggccgguaagcgcaggcgagcgccugggguucccccgccaggcugcggggccggggaggggcugggaggccgcgcacccucgggaugcccaccuggcaggugagaucagggcgggcuuccgggggugggguccggccuacccucgcggguaaggagagaccgcaaguccugggugcgcagcucuuccuggcgccccgccccuggcccgccgggccugaccgggaccaguggcucgggauuuucuaggaccgcgacgggagggggccauugggugcggugggaaccugugauuggacaaugggggauccagaaaucuagguccuguuccuucugguccaagaaagggacgguggaaccggcggcuaugagguuccauucugcggugcccguguccuauggccuccacuccucccuauccugcauacguucuugguucaugaugaauuagcagaaauuugguuuggggaauagggaaguaguuucugagggguaggaguucaaaggaaguguuuuccagacuugaucaucaugcuugguuucccucuucuggggagcagggcaacuuaguaagaguuguaccucuaccugauacugcugcuguuuccuccgcauccucuuccuccccauccuccuccuccccuccuacccgcuucuuccccucucccccacuucucuccacucaaaaugccuuuagagacaagagcaucagggcgugucgggauuucccuuccugcucacuuuggugaaguccaguucacaguguagacuuuuccagaaguacccauguggggacacacuacaugagcguuucauuaauauuagauaccaaaauuggaucccuuuagucacgaaaauacuaagaaccaugagucuuacucauuucauggauggaaacuaguuuaaacuuuuacguuuuugccaugagcuuuuaucuaucaaauaaaacaaugguaugcaccuccucuccuugaagaguaaacgcauuauaucuaugugcuaugucuuauacaaaauauaauagaauaugugguuuugcccuauccuacuguggacacagugaacuccucgagguaagugaucaucugagucaucccaaaauuguagugaggaaaacuauauuuggaaccaaaacugccuuuuggaucaaugggaacaguguguuagugauaguucuuacuccuucaugcacuuuccucaguauggcuuccaggaucaacccaggccccaguggaagcagacaauacaauuugcaagauggccgaauggagucaaggaccuugggagugagacauacauugauuuuuguccaggacuuuggacuguaucucugggccuauaacugcugagucaauagauguaaaauuaaaagcaguugaaccugggauuagcaauaaaaaacugcuuugguaaaaucugggcuaacauuuuuuuuaauucacaagucagauguuuauucgucacacacacacauauauacacauguggaacagaauguaaaaacuagacaauuugaaaaucuuaaacuuguuuuagaauguaucauagcacauauuggcacaauuacauuuugcuuaaaaucauagucucuuuuaguuggggaaaaaaaauaagucaccccuaauaucuauagcuuggaagaacuuagcaucuuuacacagucuagauucuggggguaauuuaauuacaaaaccuggcuguguuucaaucaccuaaggagauuuuuagaaauccauauuauguagcacugggaucuguuuucacaaaugcucuccagauaauucuuugacauccuuaaucuaauucaacuacuugcugucauugugauugauuuucuucauauuuuuauugagaaacuguaguagaaaacaagccagaaucagagaguuggucucaguucuuggucacccaccagcagugugaccuuaugcaagucccucacccuuccugagccccagucucugccucuguaauggucuucugcaucccacggcucaucaaaaccuuuaauuaugagcuuuggcuguaaggccauuagugauugaaacaucuuccugugacuuuguagugcucaguauacaagacagaaauaaugagcgguuggugcagaagcagaaaugggcacaugguucagcuugugaaccuuuuacauuaaaaacaaaacuugagaaagaggaaaagaaaacaaagauugaauuccaaauauuauaacccauuuuuaucaguuuuuccauuucuuuuuccuguuuauguuuugagauaguugaaagucucauuuuaaaugauauagauccgaugucgauuuguugcuuaaugaaaggggaacuucaugucucucauucucuucaguauccugggcaacuguguuccccacaaaugccugccaugcucuuccucaugcuauucccuuaucuaaauuucccuuccuaucugucuccauuccagcccucagguccugaagaugucgggcccacccauguuccuaugugggugcucuagguucuagcacuccauggucauugcuuguguacaagcauguaaucuccuuuccucccccggucucuuugaggauuaucugcggugccugaaaucuaagcacuacacauuuuaaacucaaaugaaauacacauuucaaaacauuuguaaauacuucgucauguucuguaaucuaguaauuucaaauuagaacuuuagcccagcucuuuuaggagcacugggauugccuugagccuuucacuccacagcugucaggucgagaugcuucccuggucccugcucugcugcuaccuuccugagcacacgucagccacugggacccgcccugccacugaauuuaacaugaucucaugccccugugacuuguucuucacuuugccuccagucacccaacuguggaguauucaaauugacuuaaguggcaggugugucacuuuuuuaucccccuugauguuaacacauuaaaaauuggggauagauucagaagaccuaauaggucaguaauguguuccuauuuucuaaaaguacgaaguugaaaugucagcugacuugguuaaggucauaaaauaaaacucuauuuuuuuauuuaagggauaaaaaauucccauuucacuacugauuucuuuaaauuuuuuuuuuuagugaauggauaaaguagaaaucuucauuuuagugucagaugaccaggcaaaucucagaguucugucucuguguuccgauuucuucaucuuauuuauccuauccacaauaagggaauucaauauuaaaucugagcaugaaaugaaaggacaguguauaagucucucaagagagccuccugaccaaccgugaaagccaugaagucuacuuuggaucugaauuaaacagauugucuuggugccuucaucagagguuucaguggugccucuggccuuacaaagucccuccacacccugcauuuuggccuucucacaaucuagugauaagcuucugccugaaauaaaauggagcugguaacccaaagcugagaaaagggcccuggccaugcuugguaaagcccuuucuguauuccaaguuagccaccaagaaacucuguguuagucaggagagcucaaggauacauacaugacuugcuuaauagcuugucuuguggguuuggcuguuuuguguuauacccaguauuaaugauauucauaaaguuuucacucccuuuuccauuucugcucaaagaauacucagugugauguuucugguauacccaaaauaaaucugucuuuugcuaaauuaguuuuugguccaauuuaauauugguauuucccguuaguauaauagaauggggguaagcaguugugauuuuuacauacacacacacacacacacacauauacauauccauauacacauauauauguauguuggaguucugaaccuuagcacuuuaguaauuggucuauuugagaauggaauauauguguguauguaugugugaguguuaugguacuugguaaaaacuggccaagugcaguagcucaccccuauaagcuuagugcuuugggaguccaaggugggagaaucguuugaggccaggaguucgagaccagcuugggcaauauagcaagacccucgucucuggaaagaauuauuaaaaauuagucaagaaccauggcacaugcauauagucccagcuccuugggagucugaggcaggaagauugcuugagcccaggaguucaaggccguagcacucuggccugggcaauagagcgagacccugucucuaaaacacauagacacacgcacacacaccccccuucaaacuuaauucucuacauuuguuuaaugaacuuuuggaguaugcugcauuuuguagcgagaaaaacuuccuucaaaaaauuauuuacauugugaaaacucuugaucuaauacuaacuauccuucauuaaaauaaaauacaaucucuuauaggugaaggcaucauuuuauuacagccuggaaaacaugaauuuccauuucgcuuucaacuuccaucugaguaagugaaacacuacaauuuugugguuauccuucucugcaguauguccauucaaguuuaucacugcuaggucucuucugauucucaaguaugcauguuuacacugaauagucccuaaauagacuuacucuuuuuuuauuuccaaccuaaaacauuuuaaaccaugcuuuuuuuggcuuuguuuaacugaaaaguaaacucauaauuaaugucuuugguugguuucagaccuuuggucaccucguuuacugggaaauauggaagcauucaguacugugugcgggcaguguuggaacgacccaagguaccugaucagaguguaaagcgggaacuccagguuguuagucaugucgaugucaacacaccagcauuauuaguaaguucuuccuuuuucucuuccuccuccuuuuccuccuucccucccuuccuccuuccuuucaacagugggaucuauauuuagccaguuuacugguagucuguccugucacuuucugauggcuuggaaaacacaaucuuguaacccaaaggcauucacuauaaauauaugauucuagguuggacaaauuacaaauuguguguguuaauacuauugauuaugucccugcuguucagggcuucuuuugccaaaaaguuacacaggcuugaaaugcauuaauaaggcuuaauaacaauaaugcacacacagagaguaguuacuuuuaccagaguggccacauuuacaggacugggguauucuaaacuccucaauaauagcagguugaggaacaguaauuauggaagaguauuaaucaugcucagccuguuauugaagcucaggccauuaugcuauguauccuuccauuuugcaugucauuuucuaacauuaaguaagugcaugcagcugccgccgagauccuuucacuuaucauuuccuuaugacagauuuggccacauuaaagcauugaacuucuaauaaucaccagaaauacuguagacugauaagaaagaucaggcuauaaguaacaacagaauaggcaagaugggagcuaaugagcuagauucuuuuaucuaaacccauauuaucaaaauaauauaaaauuauaccuuguacuuucaugauagcuacuaggaccuaaugguucuucauuuaaauaugaaugaaugauuuuuuuuacuucauagaaaauacugagauaauuuaaacuuuccaucacgauacugaugugacaaagauguauuuuucauguuggagguuuuucuagccuguguuuuuaaagacaaggaaaaagcuagcaguuagaaguuguuguuuaagucuuauuuucgcaugagaaagaaauagaauuuaauguucaccuuuagauuaugaaaagauagcagauaugcugugguuccauggccucuuguggucagaaucauaaaacagccggcacccagcuggccuggcuuauagcugggacuuuaacagccgcuugaaaaccauuuuugaaaaauuggugaugccaaguagcuuguauuuuuaaaaacuacuuagaauugggaggcugaauauuuuuaaaguuuuuaugaccauugugggaauugauuuaaagggauuugucuuugccaaaaacagacacuguugaucccuuacgauucuuuauauaaauaaaaaaaaaauauugcaaguaacuggguuuuacagaaagcuuugguguguguaacucguaaacugaacauuguaaaucuuguaguaacuucucuugccacuauagaauagaauacugcagugagaggguauguuuaauaagcuuuucagaucgguuaacacuacacauguuauugcacuauuacacaaaaccccaaaaccacuccaaauuaagaacacaugaaauuucugcuugauaaugcauuuugaaguaaguggugggaaaaggcuguuuguuuauuccacuuuauuaaaugccaaaauaaauauaauguucugauuauuuuuuauuuuuauaucauuuauccuuccaccugacuuuuauauauaaagucuuaaaaauaauucugucauguuuauaaguccuaauacagcuuuugauuuuuuuuuaaaaaaaugguauauuauuuccuggaaacauaaugacuucaggguaaaauaagauggugucaugcuaauuuuugaaucugaaaauucacuguaguuuuccuaaaaggggagucuuaacacccuguguuuuugugcauauuuggccuaauauguuacaugaggauaagaaaguuugauucauuuuuuugguauuuccuuacaaccauucugugaagauagauauaauuuuaaguucuaugaguucucuagaguggcuuaauuaagguuguuuuauuguuugaaauuuucaagaccccuguauugaaaacucaagagaaaaugguuggcuguugguuuuucacuucugguccagucucgcugagugccaaaauugaaagaaagggauacuguaaugguaagcaaaaugcuugaaaguccaaaugaaagauuucauucauuuucuuagcuaauuuuaagugauuuuaaauaguguuuuuuguaauuauaugacguguauaguauuuuaaaacaugaauagugauacauuuuuuauauaaauaauugauauuuaaguauuuuuaaaaggaggaauuguuuccagucaaacuccuguuuuuuuucugacuucaauccuguuacuuuaguaacaaagaguauaacuagaggaaugagaaaaugccagcaucugauuuuaauguugcaaaagaaucuccaggguuguauugcuaaaaagagaacuacuggaguaugaaaugcuauuagacauucugauuccaugcuggcuugauauaugcaaaugcaugggacuggaauguaguguauuaacaaacuuaacaaucagauuguuacuggaauugccauuagugaagggcccauuuccagcaguggauuuggccccugcuccaggauucugacuuguuagaaaggaauucaguauggaaugguaugaugugcagccauaauguuauaaaacuugccuaauccauccguugauucuuucugugccuuaacauuauuaauuccuuaaaagcaaaggcuuuguucuccuguuaggcagauuuuaauuugauaagcacuaaugaguuuguuagugaucuuuuauacuuaacauaguccugaaucauuuauuuguaugucuuauccuaauuuauauagacacuggucauuuacauaucuuuagaauugcuaaugcaauauugcuacuuuagaaaagucaauaaugcaauaauuagaaaauaagaucuaccacaaccugcagugaauuuuuauuucucuggcuugaauuuacaauauguuuuccaucaaagcuucucaauuuguuaaagugauguuggaacauuucagcuauacggcccuaauccauuguggugagaacuuuuucaagagucucugaauccucccugguuuuguuuucuuuuuaggagaagcuauuccaaucuaugcagaaauagaaaauuguuccucucgucugauuguuccaaaggcugcuauuuuccaaacgcagacauauuuggcuaguggaaaaacaaagaccauucgacacauggucgccaaugugcgaggaaaccacaucgcuucugggagcacagacacauggaaugggaaaacgcuaaaaaucccaccuguuacuccauccauccuggauugcugcauuaucagaguggacuauuccuuagcuguaagcaaagcucuuuuuuaaaaaaaaauguguaugauggacaauaacugaugucauguuacuguggguauguagaguugccuauaaaaaugucauuuuauuucagcauuaacaccaauuggggacuguaugaagauuggcccuuguuuuuaauaaaaccuauuccccacaggggauuuaauagaaugccauaaaagaauugaggugcauuaagggguguuuguuauauugaagacauagccuuaauuuucuauaauuauuauauaagccaugcaaaccuacaaugaugcauguuaaggacacaguucucugucacagagcauucacuauguuuuguguacucuucauuuuguuuaaucaagacaauugagaauugugaugggggugguggcagccgacaaaagcauuuguuucuaugaaaaaaagaaauuaauugggcuaccuacuggagguguagcuuacauuuguuccuuucucuuuuuuuuuuuuuuuuggcuuauuagguauacauucacauuccuggugcuaaaaaauugaugcucgaacugccauuagugaucgguacaauuccauauaaugguuuuggcagcagaaacuccagcauugccagccaguucaguauggauaugagcugguugacacugacccugccagagcagccugaagguaaaauauguuggcguucuuucauaacgaagcuuuaccuagaaaauaccuaggaacagaauauauacacuauuaagugcucagauguugaugaguacugcuacuauagguaucuuuauuccuacuacuaaaaaaucagaaagcauuaguccugggagggacuuugaaaguuuagcuuuaucuaggacgcaaagcugcugauagcagauucaggaauaagauguacauuuccuaauuccuauuuguaauaggaaaacaaugaaaaacagucaaauguaugguguguuaugucuuuucuauagucauauuucagugauauuuguuuaccuauaucucaagagacuagaauagaagcuauuaguaguaguuuaauaaaaggagaaucuauuuuuuauuguaauaugcauaaaaccuugcugauuagagggaaagaaugccauauuuuuuaucuucaaguuuagcuguuucuuguuuuuguagcaguuaagaaucgagauuaauuuuugaguggauuucuuaacuccaacuucauuucuauuucagcaccaccaaauuaugcagaugugguaucagaggaagaauucucuagacacauuccuccuuacccucaacccccuaacugugagggagaagugugcuguccuguguuugccuguauacaagaauuccgguuucaacccccaccucuuuauucagagguaagcaaagcaaaagaaaauuagacuuuuacuguauuauuuucaaauaaucauuuuuugucauccguucauuagagugucuguugcugacucauaauuaguaagggauacauuuaaauuuguuuauacagugguaauagauuaucgcugauucauuugccagauuuuuuuacuauuguccuugugaucuauggcaucagauacaguauuguggauugccuuuaagguguguuauuuggccauggaauauagagaacuuaagcaccuucugggacuuacacaggcucugaccagcuuggcauauaaccaucauauaauuacaaauagguacuagaaucguuuuaaauaaugcuacaacacuaaucucaguccgcucuuuuuuugcagguugacccacauccuagcgacguagaagagagccagccuguuuccuucauucucugaacguauuucagaaaucacuguguucaucaucaaauuagaauguugguucuuuuccuucugccuuuuugggaaagagacaggaaagauucacuugaaaacauaaaugaacgucaagacugaaggcaauagaaauuaaagaaugugagaaaguucuggugggccggcaggauugccgcacaaguuuauaugauggucguauauauaucccuguuaaaaacugggaugaagaugugcaaagucacagaauguaauggaaguccugaugguuacagaguaagugaaagggugccugcgcugacgugagagaaaggaaucuguaaacaguggaaacacugugggaguuucccauggugaagaguggaacgaaggcgauaugaacugaaggggugaagacuugauuuuggagagggcaacaaaacaagggugugugugcauaggagaauggcccacuccaaauacgaagugagauccugagucuuugggugcuucaugauuuccuaccauauucaggccuaaagacauugaaaaagcaucuuuucuugagaucauggucauaugagguccuaaugaaguacuacaguuuucauucuuucaaggguagacuaaaauauaguuuauaaaucggcaguacgguauuaugaaaccaagaaaggguuucuugaaaagcuugucgguucaaagaggaaagaugaauuucaaugugaaaacacguuuuguugagggcuguacuuuuuacccccuuuaagugcuuuaacaggauauacguuugauuuuccucauaucuuauuuaccuaggagcauguaagagaaagaagggagagaaaagguugcaucugcaggaugccuugauaacuacacagucccaaauaaaaggccuuuuucuaaccuaccucuaaugggguuaucagauauguuuuuaaaucucucgcccugaguacucuucuugggaguugcugcuguuuacagccacagucucaucuaucacuaaauaugaaacugggccaaggggaaaauucaguaaguuagcguuaaauggaaguaaauauauguauaccuaagagaaugucaaaauaaacaccaaaccaaaagaagguaggagugccauuuuuagaaaagacacaacuuuaauuccugucaagagaccuaggucuacugauggcagucacugcauuguacauuauuccaguucuucaguaauucuguuuaaacugugauuuucuuuauuguguuggugcaauauuuuauuaucauuuaaccucaggauauucagaccaacaggauuguguugcugcugaaagucugagcaguguuuuaccguccccagccccccucccacauggucacauguucacuugcuuuuccuuccaucuguugguuuugugagcugagagcaucucuggacacauggaagggagccagggauuccugugauacagauuuugaaccagcagaguacuuugguuuucuucauguccuaaggguuugauccagaaacccuggugcuuccccugcagaauacuguacuucauuuaacagaaugauugauuuuucuuucaaucagcauguucaccaaaaauagaaaaguucuucuaagguuaaauuuuguauuuaaaaguuaguuggccauuugaucagggaauuuucuacacacauuaggcaaauguaugcuuuucauccucugggcuuaccucucuccucugcaauccuggaagcaucgugcauaguucuuucauuguaagccgcuauuuaaauucccacaaugcaaaacuguuagaccaguaauugugcuacugaaauugucacaaaacguuauuccuugauuugguuuuuaaauuuugcuuucgugugugugucuuuaaacagguaauguguauuuaaguguugucuaaacaguugauuuuuacuuuagaaaagaucaucuucaacuguuuauugacuucugaguuauauaguucaugcccugccaaggcauuguucgacuccaugauacuaaaacauaaugaaagaaacaaacuccaguauggagaagagaaaguuuaauuauuugguuccaucuagaaaagcaacaacuuaaaggaauccuucacuaggauugucuuaucaccuuuauuagauaaaucaugaagugucccugugaaauugaagugaaacuaucucuguaggacuuaagagaauagcuaaaaggugugacuugccuuauugaaaugauacuggcauaucugacuguaagcaguagguugaagauaucauuuuaugaauguggagaauucuacauugaaacagaaaauaccugggaaugaagauuaaaaauguagcugcuguuauuugcuugguuauuccccucuugcucuucuuuaguuugaaaaaacaaaaacguggccuuggaauuuucauuuugaugcagaaauuuugaaauugaaaaugugcauguuuuggugcacaaaauccuucugugggcaaaacuuuguuuuuguuuugcacaguaagaaacaauaggcaagcguuauguuuuugguaaguuaacuaugaaagcuuucuuauuuuuauuauuaaaaauguaacaauuuaacccacaggaaaaaaaauuacuuuguaugcuuguuugaacccuauggguucguuuuauuaauaaaauuauuacacuaaugcu

SEQ ID NO: 15219 - RNA, 1609 nt, Homo sapiens
gcuggaaucaugagggagccauggccacucuugggcugaaagggcgaauggggaaugguuauuggaacugaaagagaccagccuggcugggggagaggguggccugcagugagggagccaaaggcaacaggaagccaggggucagaagagcccaccccagcccaggaagaccagcugcuagggcacagagaaggaggaggguggaagguaggcaucaaaggaaucaaagaaaaauauccaagauacugcuugcgggagggagaaagauagagagggcgagagaccuagaaguagugccuucccuuccuuuagcacuugucaugggagaccugaggacugaugauaccuuggaggggauuuuguaccuaugcggggaagguggagaaaaucucgagcaaguccaccugaggcugcugggcucugagaccaucuccucuguccucugagaccaucuccucuguccucaggcuacgugaaccacauaaguuccuguuguuuaaaccucauucaguuagggguguacuugcugccaaaagcaucuuaacugauguaaucuucuaaaaagaaauaaggaauacaucuuauguacuagagccucuucucauauauuugauuuagcucuuucaacaaguccaucagcugacaaugaugauuuauuuauuuauuuacuuauuauuauuauuuuuuuuggugacagagucuugcucugucacccaggcuggaguccaguggugggaucucggcucacugcaaccccugccuccuggguucaagcaagucucccugccuuagccuccccaguaucucagauuacagacaccugccacuaugccaggcuauuuuuauuuuuuauuuuuguauuuuuuaguagagacaggguucaccguguuagccaggcuggucuugaacuccugacuucaggugaucugcccaccucggccucccaaaguguugggauuacaggcauaagcuaccacgccuggccucuuuucuguuuguuuguuuuuuguuuuugagacagggucucacucugucgcccaggcuggagugcaguggcacuaucucagcucaaugcaacauccaccucccagguucaagugauucucccaccucagccucccaaguagcugggauuacagacauucaccacuacgcccagcuaauuuuugguauuuuuaguagagacaggguuuugccauguuacccaggcuggucccgaauuccugggcucaagcaauccaccugccucggccucccaaagugcugggauuacaggcgugagccaccacgcccagcccaugauuguuauuauucccauuucagagaugaggaagccaaggcugagagaguccaucgagagguggagggcuaagcugggucacaccugugacucucucaugauuucucuugauucucacuguccggauucuuugagugcuugagucuuuccuuuccguguggcugagaaaucucuccaacauugaaugguuuguguguugaccuuagugaagucuaccuggaccccacuucuguagcucagaacauucuggagucuuugcucacuuuaugaggcagaacuagcuaguguuacuauuucacuuuauuguuc

SEQ ID NO: 15220 - RNA, 28221 nt, Homo sapiens
uuugauauuuucauaacauuuucuuuaacauuuaauagaaacuauauacaauaaauuuuuacuauauuuuacauaagauagcaaccacagaaauuuacauagguuaaaagcaagacggauaaggaggacccaguccugugggcuguuuucucagaggauaaaaagccagaguucaccagggaaagggguuaaagacugcccaauuaaguagaggugaagaaaagcuaaacugcaggucuucagauagagauaaccgauauuagggccaucaguaucucaaagacaccacucacaaagacagcucccaccuagcuacuuaaguggauuucuauccaugacuugggaaaucccauuacaaagaugucacuuuccuuuuagguauagucccaaauaaucccagaagcuuugauagggauuaucucucuuucucuuccuugcccugagugggaagaaacccacgguccacguccucaaaauuuggcuuuacguuugacuauaauacucaauccagaagaaaaacaagguagucuggguugccuguguuuugugagagaugaucagaaauacuucuuugaagaacgagaaauuuaaauccaccaaaguaaaaugguuccccaaacuaucaacuaauagaaguggguucuggcuucccauuugcaguagccaauccacucugagacaauggugcagaggcuuucucagaauuucgagaucccugggaucugcacccaucuccagccaucugcaucuggcccuguuaaaagaaauaaaggcacuucaguuaguaauucauucacuguggucugaaguaugaaucugacuuaucaguggccacuuaaacuagcaauaagaacaauacaacagaaauuaauucuggacagaugcucuucccauauuagcuauccuagucccuuggaagagccuauuccugagccucuuccaaugggauggugagcuguagguuguuucuuccaaaugaaauagccauucccuacugaggucccagaacagccaacagaccacaggaagacaguccuuuaggccucugcuugaaaccaacagccacaguacaacugcuggucuucagucagggccacuggaauucuacccaaggcucacggacagaacucaaaucacauuacuuuacugguccuucuacaaugagaacaauuucagugaugaacucucccucagaagguaugauuucccuagauuccuugucucaagcuuuuauuuaaauaaauguauguccuacucugggauaugaggaucacgggccauuagguguucuaagagcccaucuggagaacuacagcaacaaggguacacaggagcagaguagggcauuuuuaaaagugcuuugcuuauaugguauucaauaagugagagacauguggagcaucuuuauacuagugaugacaccccacuccccuccaggagcacaugcuaucuagcagggaacccucugccuggccaggucacuacaugagggaaacaggugggacuguucuucacuugccaaaauauccacugggucuucagcaauuucuuugacuaaaugaucuucaaggguuagugaaggaucaaaaagcaaaggugaaggaggacacugcauaccaucacccacaacauccaaguccuagaaaaaagagaaaagcccaucagcaauaccaagggaaacaguaauaaaguuggcauguuuuucagcaaacuuuaaagcaauacucugcugucucccucaacccuagccuaccuuuaauaaaaaaaaaauuuuacaagagcguccaacaaaugaaacaagauccaaaagcacugagagcuuuugcugccaaguguaaaacauagaccaauacaguagauuaaaaaacaaaauucuggccaccacaccucuaaucccagcacuuugggaggccaagguaggcauaucacuugagcccaggaguucaagaccagccugggcaacauggugaaaccccgucucuacaaaaacugcaaaaauaagccaggcgcgguggcacacaccuguagucccagcuacucuggagguugaggugggaggaucccucaagcuugggacgcagaggcugcagugagccgagacugcaccucugcacucuaaccuggguggcagagccagacccugucucaaaaaaaaaaaaaauucuaggaaaauucacagaaacacaaaguagaaacggagaauaguagggaacaggggaaagggaaaggagagaguuacuguuuaaaaaguacaaaguuucuguuuggguugaugaaaaaguucuggaacagaaaauggugauagcuguacaacaugguaaauguucauaacaccacugacuuguacacuuaaaaacggccaggugcaguggcucaugccuaugauaacaacaccuugggaagccgaagugggaggaucacuugaggccaggaauucaagaccagccugggugacacagcaagacuccaucucuaccuacccaccuacuuacacacauacauacauagguuaaaagaguaaaauuuuguuauguauguuuuacuacaauuaaaaaaauauuuuuuaaaaaagcauauucucugaggcuaccuguaaugaacauguaaguucaccagugauuaauuuaaauaugaacaaugcuacguuaaaauuaaauauugcuggguaauacaagauugccugauuaauauccuaacagccacaaagcaagcaaacaagcuccaacaagggaaagggagaagguaggaagaaaggaaggacaacagaaaacucacaguuccucugaauggcuaggaaauauuauuuugguuaagucccuaucccgacagagcaacaaccugguuuuuuuuguuuuguuuuuuuuuuuuuugagacagagucucgcucugucgcccaggcuggagugcagugacgugaucucggcucacugcaaccuccgccuccuggguucaagugauucuccugccucagccuccccaguagcugggacuaugggcgugugccaccacgcccagcuaauuuuuuguauuuuuaguagagacaggguuucaccauguuagccaggauggccuugaucucccgaccagugauuggcccaccucagccucccaaagugcugggauuacaggcaugagccaccacgcccggccaacucccugguucuuaagccuaacauaguuuugcucuguaaaaaaaaaaaaaaaaaaaaugacauuacauucuagacuauguuucuuccaacugaauuggcaauucgcacuggaauacugaauagccaacagaccacaaggaagacaucacucuuagcuccuguuugaaaccaacagcuacagcaaaccauuggucuugauucagggccuaaggcaauacaaacucaaacaauauaucaaacuaacuuucaugccacugcuuuucaagagucuggugcuaaauucuccuucuuccuaagaauuaaaaauauccaggagguuuguaccccccuauguuuaauccaguuuauagaugcuccguguuucuauucaucuagcuucacgagaagcuuaguucuacgcuuuuaaauaaaucuaagaauuugcaauccuuucccauuuguuggugugcuaaucaccaaaaaugagaaucacaacaucuucacauuaaagaauauauauaauuuuaaaaucuacuuaaagcugcucaggccgggugcaguggcucacgccugcaauccuaacacuuugggaggccaaggugggcggaucaugaggucaagagauugagaccauccuggcuaacauggugaaacccagucuccacaaaaaauuaccagccuggccaacauggugaaaccccaucucuacuaaaaauacaaaaauuagccaggcgucuuggcacauaccuguagucccagcuacucaggacacugaggcaggagaauugcuugaacccaggaggcagagguugcagugagccgagacugcaccacugcacuccagucugggcaacagagcaagacucugucucaaaaaaaaauaauaaaauaaagcugcucaauuuaagcagaaacauagggcacaggauacacucaaccuaccauucauuuucaggugaguuggaaacuucuguacuacccacagaaaccaguguucucacaccauuaagacuauaaaucuguuuucucccauucuuuuacuaugugcaauuugugugugugugugugcgugcgugugugugagacagaguuucacucuuguuacccaggcuggagugcaauggcaagaucuuggcucacugcaaccuccaccuccuggguucaagcgauucuccugccucagccuccccaguagcugggauuacaggcgcgugccaccacauccagcuaauuguuguauuuuugguagagacggaguuucaccauguuggccaggcuagucuagaacuccugaccucaggugaucuacccgucucggacucccaaagugcuaggauuacaagcgucagccaccgcacccggcccaugugcaauucuuacauaaacaauuagcuuggaaugggcacgguggcucacgccuguaauccuagcacuuugggaggccaaggugggcgaaacacuugaggccaggagcuugagaccagccuggccaacauggugaaacccugucucuacuaaaaauacaaaaauuagccaagcacaguggggcgcaccuguaaucccaacuacucggaaggcuuagaccggagaaucgcuugaacccaggaggcagacagugcagugagccgagaucacgccaaugcacuccagccuaggugacagagcgagacucugucaaaaauaauaaugacuagcuuggaauuauuuaaacacugaaucaaaaggcaucuaaaucucaagauaauaauggaauguguauguuuucagaaaaggcuuuucucauauauacaaaggguugucuuuuauaagauuuuaaacugggaaaaggauccuaaaauaagaaaaucagcaaaaaugccuauuaaaacaggaguguuuuaaaaauugaaguaucaggauauaaagagaauccauguuuucagcugggcgcgaugucucaugucuauaaucucagcacuuuggggaagcugaggggaguggaucaccugagguuaggagaucgagaccagccuggccaacauggcgaaaccccaucucuacuaaaaaauacaaaaauuagccagacaugguggcacacaccuguaaucccagcuacucgggaggcaggaacaggagaauugcuugaacccagauggugaagguugcagugagccgagaucgugccacugcacuccagucugggcgacagaccaagacuccgucucaaaaaauaaauaaagauaaaauaagagaauccacguuuuguuacuaucuccaaaaccagcaauagagaaugagagagaaggaacucaaaaguaguaagauuaagguguuaaguuacuacuugccaaccauccuugcaucaaagcacagaaaacaagcaaauauccagaaugaacggcuguguuuuuacucauauuaauaucugaugccuagucuucccgcaaguaaaaucaccaaaguuaucauuaacaguuauacgccaggaauggugaaucaugccuauaaucccagcacuuugggaggccaaggugggugggucacuugaggccaggaguuagagaccagccuggccaacauggugaaacccugucucuacaaaaaauacaaaaaucagcaaggccugcuggcgcacaccuguagucccagcuacccaggagggugaagcacaagaaucacuugaacccugaaggcagaggcugcagugagcugagaucacaucacugcacuccagcuugaacaacagaacaagacucagucuaaaaaaaaaaaagccaaguuauaguggccaggcacagugguucacacuuguaaucccagcacuuugggaggccaagguaagaggaucacuugaggccaagguaagaggaucacuugagccuaggaguugaagaccagcccaugcaacauagggagaucucaucuauacaaaaaauaaaaaauuggcugggcaugguggcauaaaccuauagucccagcuacuugggaggcugagacaggaggaucacuuaagcccaggaguucgaggcugcacggagccaugaucaugccacugcacuccagccugagcaacagagcaagaccccaauuuaaaaaaaaaaaaguuauaaaaaugauaacuaagcugggcgugguggcucaugccaccgacagaaacucugucucaaaaguucuuaacaguauauuccuuaauagccagaaaguagaaacagcacaaauauccaucaacugauauauuuuuaaagcgugguauuuccaaacaauggaauauuaauucagucacaaaaaggaaugaaguauugauacauauuauaguauggauaaaccuugaaaacauuaugcuaagugaaacaagcaagacacaaaaggauacauauacuauuacauugauaugaaauguccagaauaagcaaaaucagagacaaaaaguagauucaucguggccaggggcugaggggagaagaaaaugaagagugucauaauagguacugaguuucuuuuggagauggugaaaaccuucugaaauuagauaguggugguaguugcguaacuuugcgaauauacuaaaaaucacucaauuauacacuuucaaagagugcaauuuauaguauguaaauuguaucccuaaaaagguaugggaagagucuggaaaaaaauauaagguaggguagauuucucuaaaugaauaugcuaacauauaaauacaacuauacguauauaucacuucaaaaacuuugucgauucuccuaaccacaaagacuaaccuauucucaccauuaauaaauaaggcuuugucucaagggccugaaccaaagcagagcuucucuaacuuacaucacugaacuccagagguaaacucucagugggcugaagcucagcagcacucaaguacagauccauggggccggcuuccagaucgucuggcacagacaguaccugcucgggcuuauacaucugaggaggcaacuggaaaugcagugggcagcagggauccucagagaggcuuacaggaacagguuuguugcaggguaccucuucagaucccuggcagcacuugaagagaaccugauucguauccugacaaauaucuguagaaaaauggucaagggaaauaaaacacaaucuaucgaaagcauaaaauacaaauagcauugucugccacauaaaacucaagguguggacuauauaagauaaauuacaacuacauuugauacagaauaccaaaugcaguuagcaauuuuuaaaguuacuucucaaaauaaaugucauuuacuagcaucaaauucuagcucuaccaguaauuuaaaacuuguccccaaccuccuuuucaggauccuggucauuuaaacuagacaccaucccauucucccuuaagcaaguagcaguaacacuccuaggaacacacacauauucagaagaaacauguaguggcaaaugcaaauagccuugaaaaugccccuaaacagcccuuccaaaagagucaagcgauacaaugucucugcucccuuagcagacuggcaaaguuugcaacaauuucuuggaccucguuuccaaagaugauuacaugauaaauucauuuaaagcaccacuggaauagggggaaacagagcucuaguaaaagucacuagguaucauauccuaacaagaaauuaaauauacaugccuuuuuuuuuuaggggagugugcuaguacagaggaauccuuuuaugauccuaaaggaagaagaaaauuuuguguaugaaggcccauugaaaaaaaaaaguauucuagaaacauuccaaggacucuauuaacaacuuuuguuaaagguagaagaagaaaagggcuauauuuccaaguuagcaaagaagcucuguaggaugaaccaaaauugagaugauuagauacaauaaaauucaaguuacuuuacaaaacacauuuuaugcaagugcuaccauuucuugaaaucuguuaacuaccugguuaucuuccuagauuaauaaacauuauuuuaaaauuugacuuauuuuuaaccagaaaacacaauuuuucuuaaacugauaguaccugaauuauggaguuauaauuuucaacucaaaacuuuuaugguaauuuuuuuaaauaaaaaaacuaacauacauuauaauuuuuaaaaccauaugaacuuccuugaauaaagcuauuucuuucaaugcauacuuggaaauaacuaaacucucaagcagggugugacaacuguggcacuaccaacacuguaggccagguacaucuuuguuggaagaaggauguauagcagcauuccuggccucuauccacuagcugucaguagcaccuccaucugaguuguaacaaccaaaaauuucuccacacauugccaacuggaaaacaaaauggcccccaguugaaaaccacuacucuaaagaaacagaagauaguacaaggcaaacaaauauuuauugaaugaucaaaugaauaaacauaugaaucuaaugggaaucaucagauuugcacuaugcgcuuaagaaaaucuaagcaauaucuaaugugcuuaagaagcccacucuuaauauuuaaaauauuauccauuaaauguuucaaccagaaauuuuuuuuacacgaagucucgcucugucacccaggcuagaaugcaguggcgugaucucggcucacugcaaccucugccuccuggguucaagagauucuccugccgcagacuccaaaguagcugggauuacaggcaccugccaucacacccggcugauuuuuauacuucuaguagagacaggguuucgccauguuggccaggcuggucucuaacuccugaccucaggugaucagcccgccucagccucccaaaguguugggauuacaggcgugagccaccacgccuggccaagaacuuuuuuuuauuggaauucaaaggacuuucacaagucucuuauguauuuaauaccacaauauccuaaaaaaggacuccccccaucauccuccacccgcuuuccuuucagauggggcaaaagagguaaaaagaagggaaugguuaaccuacaacuagagucuggguccuucacuuucagucgagugcugucuccauuagaccacaguaaagaguuaacaggucaccaauggcagucgcaucuuucucugggauaaggacuuaaggaaggguaagugacuuaggcaacuauggaguggaaaggaaagagcauaaaaggaaaaaaaauacuucccuucucuuuucaaauacauuuucaauuuugcuuuauauuuauauuuuaauaagcuauuugacuacaguauuauaauaucuaaaauaguccuuaguaucuguaaacugaguuuuuucccuuauaaaaguaauucaugcucgccuuaaaaaaacaaaaaauaaaagaacagugaaaaaagggcauucacaaccacaccaugcacaaauuaucacauuucuguauuguucccuuccaguauuugguuucaugcaauuucagacaccguacagaauuccauauccuggaaugucacuaucauuuugcugucauucauaaauucuguuaaauauauuuaaugccugaaaauauuccacacuauguugugucauuaauuuaucuaccuauucuccagcucuaaaaauguuaaggcugucucaaguuggaagaauauuucauguaaaaauauuggucugcauuugauuaucuccuuaaaauaaauucccagagguaaaaauuaccauaugaggaaauaugaauuacugucagauugcuuuccaaaaagcuuuuaucuauuuauauucccacuggcaauauuuagaagggucaauuucaccauacucucaccuacuuuugaaauucacugacucauuuuugaaaaauuguauauuuuaaauuuuauuuuaaaacaaauauauguacaaauaucaauuuuauagauuuuuaauuuuccuuauuuccuauuuacaguugaccuuuaacaacacaagcuugaacugcacgggucuacuuacacgugcauuuucuucugccucugucaucccacagacaauaacacuucccccuccacuuaacaaaaagaccaugagaauaaggaccucuaugauaauccacuuccauuuaauaaacaguaaauauauuuucucuuaugauuuucuuaguaacacuuuuuccuaguuuauuuuaagaacacaauauauaagacauauaaacauauaaaauauguguuaggaagcuauguuguugauaaggcuucugaucaacaguaagccauaaggcuauuagcaguuaaauuuugggagaaucaaaaauuauauacaaauuuucaacuguguagggggucagcacccuaaccccaugaauuguucaaaggccaacuguauuuauagugaagauacacacuuuuaacuauuagccuuuuuuuuuuuuuuuuuuuuuugagacagagucucacucugucgcccaggcuggagugcaauggcacgauaucggcucaccgccuccgccuuccggguucaagcgauucuccugccucagccucccgaguagcugggauuacgggugcccaucaccacgccuggcuaauuuuuguauauuuaguagagaugggguuucaccauauuggcaaagcuggucucgaaccccugaccucaggugauccacccaccucagccucccaaagugcugagauuacaggugagagccacuuugcccggcccuauuagccuuuucuaucuucuuuuaaaucugcccauagccucugcccaauuauguuuuaagcaauuuuuuuuuuuuuuugacacagagucucacaucugucgcccaggcuggagugcaguggcgcaaaaccucagcucacugcaagcuccgccucccaaguucaugccauucucccaccucagccucuucaguagcugggacuacaggcgcccaccaccgcacccggcuaauuuuuguauuuuuaguagagaugggguuuugccguguuagccaggauggucucgaccuccugaccucgugaucugcccgccucggccucccaaagugccgggauuacaggcgugagccaccgcaccuggccuuuuuuuuuuuuuuuuuuuuuugagauggagucucacucuguugcccaggcuggagugcaguggcgugaacuccucccacugcaaccuccaccucccagguucaagcaauucucugccucagccucccaaguagcaaggauuacaggaacccgccaccaugccuggcuaguuuuuuuuguauuuuuaguagagaugagguuucaccaucuuggccaggcuggucuugaacuccugaccucgugauccacccaucuuggccucccaaagugcuggaauuacaggugugagccacugcgcccgcuuuuuuuuuuuuuuuuuuuuuuuuagagacaggguuuuccucugucacccaaaguagaaugcaguggcaugauccucacuucagcuucaaacuccuaggcucaaaaaauccucccagguagcuaggacuacagucacaugccaucgugaccagauaauuuuucuuucuucuuuuucuuuagagaugaggucuuacuguauuguccaggcuguaagcauuuaucuuuagaguuuuucauuacuuugcacaaccauuuuauauauuaagaacaauaaucucuuaucagacaucuguuguaauuaauaaauuaguaaaauauuuaauaagcaaaauaaaaaucagcuuccugucaaaagacuaagaagagguucuccuucuccucucccuauuaaagaaaauaaguggccgggcgcuguggcucaugccuguaaucccagcacuuugggaggccaaggcaggcagaucacaaggucaggagaucgagaccauccuggcuaacacggugaaaccccaucucuacuaaaaauacaaaaauuagcugggcacgguggcaggcaccugcaaucccagcuacuugggaggcugaggcaggagaaucgcuuguacccaggggaguggaggaugcagcaagcugagaucacgguacugcacuccagccugggugacagagucagauucugucucaaaaaaaacaaauaaagaaaauaaguuuuaauuuccaaauauuuggcauuucuugccaagcaaaugaaauccagcaauccuauuuaauuaacaagugcuuuuacugcgaaauuuuucucaaugccuauaauaaauaagcacuuucacaauucaaucaacaacucaaaaaaguuugaaggcccaaugccaaauguaguccuuuaacagaaucaagagacauuaugaugguucaaaggcaaauuaauugaaaagaagaaaaaaagcaucucauuuuuggaaauagcaaacuucuaauuugaaugauguuuaaaguaugcaaguuagaggccaggcacagugacuaaguguuaucacaaaagagucaagagacugggcaugguggcucacaacuguaauccuagcacuuugggaggcugaggcgggaggaucacaugagcucagaaguucgagaccagccugggaaacauagugacacaaccucucuacaaaaauuaaauaaaauuagcuggacgugguagcacaugccuguagucccagcuacucugguggcugaggugggaagaucguuuaagcccagcagaucacggcaguaagccaucaucaugccacugcacuccaacuugggcaacagaguaagacucugucucaaaaaaauuaaaaaaagaaaacuuuuuaaagagccaaguuucuuuuuuaaguuuauaaaggccagguacaguggcugaugacuguaagcccagcauuuggggaggaaaggacuggcagacugcuuaagcccagcaguuugagaccagccugggcaacauauugaaaauugacucuacaaaaaauaaaaaaaaaaaaaauaggccaggugcaguggcucaugccuguaaucccaacacuuugggaggccgaggcaggcagaucacuugaggucaggaauuugagaccaaccuggccaacauggugaaaccccaucucuacuaaaaauacaaaaauuagccaggcgugguggcacgugccuguaaucccagcuacucaggaggaugacacacaagaauugcuugaacccaggagguggaaguugcagugagccgagaucacaccacugcacuccagccugggcgacacagcgagacucugccucaaaaaauauaauuaauaauaaaauaaaauaaauaauuagccaggcaugguggcacacauacauagucccagcuauucagaaggcugagguaggagaauugcuugacccaggaguuaaggcugcagugagcuaugacugagccacugcacuccagccuggauaacagugugagacccugucucaaaaaacacaaauaaaaaaauaaaagccgggcacaguggcuuacuccuguaaucccagcauucugggaagccaaggcggguggaucaccugaggucaggagcucgagaccagccuggccaacauggugaaaccccaucucuacuaauaauacaaacauuagccagguauugugguacgugccuauaaucccagcuacucggagaaucgcuugaacucgggaggcggagggugcagugagguggagguugcagugagccgagaucacgccauugcacuccagccugggagacuagagcaaaacuccaucuccaaaaaauaaaaaauaaaauaaaauacagaagugagggcccuaaccacacaaaaggauaauacuagaaguucacagugcaaaaucauccuuucaacugggguggaaaacccacaguaauuuuuuaaguuuauaauuagauuuaacagcauuaggauccuaauaagcaaguuaaaucagaaaccuugagacaauuacaaauauuuuauguauauuuugggacccaaguauuaaggcuauaaauaaauauuagcccacaucuaugaaaaacgacucauguuucuuucuaaugaauugaccauuacauuuccaaaguuaugaaauggccaacagaccauagaaagacaauucuuuaggcuccugcuugaaaccaacagcuucagcaaacugcuggccuugauucagggccaaaggaaaacaaaauccuucaauuaagcaaacuagcacagagauucccacuagucuucaaacuagcaaaccacagccuuaacaggcagaguaaaaagauacggguaaggcagugucuggucauuggaagagacugauuggaacaacgaacaucauccacaaaggccaagcaccucugacuggaacgagugguaugggccugaaauggaaaaagacagauaaaauagacccacaaaagaacacacaaacaauuacgaugaaaauaguuauauaagaaaagcacauccuaaaggcuagaaauucaacauuuaacaaaaauagauucaccaauauuaugcaaaagacaaaaaacuuuaaaaccuagugcauaaagaaugagucaaccucaaucccaaauacaccucuccauauucuaaaagugugauauagccuauuuaacacaaauuuugucuuuuaccaacagaacucugaaauugcagccuuaaguggaaucucaacaaaugaaacaaaauuacucuuacugaaacagagaccaagggucugaaaaacaaauuuaagaaugaucacuuaauucuucuuccuauuaaccuuacuuccugacauucaauugcuccuauucuaccuucccaccuuuuaaaacaagauucccaagcaauuuaggauuaaccugugcuuauuucugaacugaagaauaucugaaccaaggacuuagaaacuuuucccaacuacucaauaugcagaugagaauacugaggcccagaaaauuuaagcuaacugugcagacacagagcuggucaguggggacucacacuagaauccaugucuccugacuucaagcuaagugcuuucacuauaacccaugugcaaaaagucagauuucagauccaagacuggacauagggaguucaagaccagccugaccaacauggagaaaccccgucucuacuaaaaauacaaaaucagccagacaugguggcacaugccuguaauccuagcuacucaggaggcugagggaggagaaucacuugaacccaggagguggaugcugcggugagccaagacggcgccauugcacuccagccugggcaacaagauugaaacucugucucaaaaaaagacuggacauaguguuuugacaauuacucuaacuuuguaaauaaagugaacaugaacaggcacgguggcucaugucugcaaucccaacacuuugggaggccgagguggguagaucacgaggucaggcauuggagaccagccuggccaacauagugaaaccccaaaaaauacaaaaacauuagcugggcgcaugguggugggcaccuguaaucccagcuacucgggaggcugaggcaggagaauugcuugaaacugggaggcagagguugagagaucucagugagccgacaucgcaccacugcacuccagcccgagugacagugcgagacuccgucucgaaaaaauaaaaacaauaaauaaagugaacguauauaccuuaaagguauacacacaaauuaccuguugggcagcaccaucuguggccagcauucuccguuccuucaacugccuaugcaguaaggcuuccacuccauagcgcuggcgguaucgucgcagacauuuuaaucgcuuuaaguucucucguucuuuggccaaaagucccucugggccagucaggagacuacugccuagaguuacaagagucaagauguuauuugccaagcaauccaucaagguuacgucuccaagucaacaaguaaacaggaaaauccuugggcauaagauaggcaguuucaaaagcaaaugacccccaauccagguaccaagacagaaauaaaucuaauuauagucaugcacuauauaaccacuuuuuaaucaaucauugaccauacauacuaugguggucccauaagauuauaacaaagcuggaaaaaaaauuuuuuuuuuuuuugaggcacagucucgcucuguuguccaggcuggagugcaguggcgcaaucuuggcucacugcaagcuccgccccccagguucacgccauucuccugccucagccuccugaguagcugggacuacaggugcccgccaccacgcccggcuaauuuuuuuuuuguauuuuuaguagagacaggguuucauuguggucucgaucuccugaccucaugauccgccugccuuggccucccaaagugcugggauuacaggcaugagccaccgcacccggccaaagcugaaaaauucuuauugccuagugacaucauaguucaacccacacauuuguggugaugcuggugaccaaaccuacugcacugccaguuauauacaagucuagcacaggcuggacacaguggcucacaccuguaaucccagcacuuuuugggagcccaaggcgggcagaucaccagaucaggagauugagaacauccuggccaacauggugaaaccccaucucuacuaaaaauacaaaaauuagcugggcgugguggcaugcgccuauagucccaguuacucaggaggcugaggcaggagaaucgcuugaacccgggagguggagguugcagugagccaagaucacacacugcacuccagccuggcgacagagugagacuauaucacaaaaaaaaaaaaaaaaaucuagcaccuacaauuaugcacaguaccuaauacucgauaauaaacaacuauguuacugguuuauauauuuacuauauuuauccuuagaauguacuccacucuauuuauuaaaaaaaaaaaguuaaauguaaaacagccucaggcaguucucucagaaaguauugcagaagacauuguuaucaugagaugacaguucgcugcaugagauuguccccgaagaccuuccacugggacaagauguggaggugaaagacagugacacuaggcccauguaggccuaggcuaauguacguguuugcaucuuaguuuuuaacagaaguuuaaaaggauuuuuuuuuaauuaaaacuagaaaagcuuauagggauauaaaaaaaauuuuuguacagcuguacaguguuuguguuuuaagcuaaguguuauuacagaguccagaaguuuuucuuaaaaauuuuuuuaaguuuauaaaggccaggugcaguggcucaugccuguaaucaaucccagcacuuugggaagccacggucggaggaucacuugagcccaggaguucaagacuaaccugggcaacauagcgagacccugucucuacaaaaauuuaaaaauuagcugagugugguggugcaucuguaguccuaguuacucaggaggcugaggcaggauagccugaguccaggaguugaaggcugcagugagugaggacuacgcuacugcacucuggccucagugacacagcaagauucugucucuuuaaaaaaaagcuuauaggccaggcgcaguggcucaugccugaaaucccagcacuuugggaggccaagguagggggaucacuugaagucaggaguuccgagagcagccuggccaacauggcaaaacccccccucuacuaaaaauaaaaaaauuagccgggcaugguggaaugugccuguaaucccagcuacuugggaggcugaggugggagaacugcuugaaccuaggaagcagagguugcagugagcugagaucaugccacugcacuccagccugggcaacagagugagacuccauguccgucucaauuaaaaaaaaaaaaaaaugaaaguaaaaaaguuacaguaagcuaaggguuaauuuauuauugaagaaacuuuuuuuauaaauuuaguacagcuuaaguguacaguacuuauaacgucuaaaguaguaaauaauaaugugcuaggccuucccauugacucaccacucacucacucgcccaaaauaacuuccaguccuacaagcuccauucaugcuaagugcccauuuuuaaaaucuuuuaugccauaauuuaacuguaccuuuucucuguuuagauguguuuagguacacaaauaccacuguuacaacugcccacaguauucaguacaguaacaugcuuguacagguuugcagccuagguauguugcaggcuauaccaccuacguuagcgugagucacuccaugaaguuugaaugacaaaaaucaccuaacaaaguauguauccccaucauuaagugacacaugacuguacuaccaaauucacauguuaaacccacaacagcuuguuggaacuggcauaaaacuugccuagagcuucauguuccacuuugcgauuauguaaguaucggcgcuucuucuccuugagcagaugcugaagucguuuaaacugaucaauauacaacgacugcaaacgaauuagcuuuucacgcauaaucagggccacuucuucugcuguguagacaccagcaugucuggaauaaaacagaauucagcaaagcauaagaaaacaauaauaauaaaacccaaguuugaaagaguagagaugucagacuaaguuuguuauuuaacaaguggugacauaaucaccuuaauguuuuugcaaaacauuguaccauucaaguuguuauuaaauaaaacaaaagagaaaaucuccaagaaagaauacuaaucugugauuucccaaaaugggggaaggagaaaugucuuauuuuucccagcuauuugcauuauguugaaaagaaagugaacaugcggaacacuuuaaacuuuuauuaaucuacauucuuaauguuuugauaugaaaucaucacuuaccagucaagacagcuuuaaaguguucaauuaacauguaucuuucacauauacauauauacauguauauauacguauauauauauacauguauauauauauauacguauauauauauauauauauauauauuuuuuuuuugagauaaggucucacucuugucacccaggauggagugcaguggugcaaucaaucacagcucacuauaaccuuugcuuccugggcucaagcgauccucccacgucagccugccgaguagcugggacuacaggugugcaccaccccacuugguuaauuuuuguauuuuuuguagagaugggauuucaccauguuguccaggcuugaaccccuggguuuaagcgaugcucccgccucagccucacaaagugcuggaauuaaacgcauaagcuacugcaccuggcaauauauuuuaauuaaagcacuaaagauaccaacaucaaauaauuuuuuuuuuugagacagucuugcucugucacccaggcuggagugcaguggcacaaccuuggcucacugcaaccuccgcuucccagguucaagugauucuccugucucagccucccaaguagcuggcauuacaggcaccuaccaccacgcccagcuaauuuuuauauuuucaguagagaugggguuucuccauguuggucaggcuggucuuaacuccugaccucagaucgaucuuccagccucggccucccaaaguggugggauuacaggcaugagccacugugcccagccaaaauuuguaauuguuuaaaaaauauaggccuauauuggagcucauauggacccucaaauaacuagucaaaaugggcuauacccuguccucagcuaauuuucuugacaauauucucaaaauucaguacccuagguuaacccuuaauugccaaagaucuggcacggauccauaucaacuugauuaagcuuugcugccaauuauaaacuaaaagaauaucuggccaggcacgguggcucacaccuguaauccuagcaccuugggaggccaaggcaggcgaaucaccugaggucagguguucaagaccagccuggccaacauggcgaaaccccgucucuacugaaaauacgaaaaucaaccagguaugguggugggcgccuauaaucccagcuacucgggaggcuggggcaggagaauugcuugaacccgggaggcagagguugcagugagcugagaucgugccacugcauuccagccugggugacagagcaagacuccaucucaaaaaaagaaaaaaaaaaaaaaagaacuucuaaaaguuuugcuagugauuaauauaugguagacuguucucuggcucugauuuaugcaaucaaaauuaagagaugaggccaggugugauagcucacgccuguaaucccagcacuuugggaggccgaggcaggcagauugcuugagccugggaguucaagaccagccugggcuguaacaugauaaaacccugucaauacaaaaaauacaaaaguuagcugggcacggugguguauaccuguagucccagauacucaggagacugaggugaaaggaucacuucagccugggagugggaggcugcagugagcugagauggcgccacugcacuccaaccugggugacagagcaagaccaugucucaaaaauaaauaaauaaauaaauaaauaagugaauaacuuugaauuuuaaaaauuuuguuucacucaccgucugaucauuacauaaauacaaagaacaagcuauauaccuuaaguuucauacugaguaaaaauuuuauugaaaaggcaaaacacauaaauuauacuaauuuuaagucaaaaaauuaugcuuuauuacuuuuucguuuuuaagacagagucuugcucuguuucccaggcugcacugaaguggcacaauguuggcucacugcaaccuccgccucccggguucaagcaauucucgugccucagccuccacaguaguugagauugcaggcgugugccaccacaccuggcuaauuuuuuuauuuuuuguauuuuuaguagagaugggguuucaccauguuucccaggcuggucucaaacuccugaguucaggcauuccacccgacucggccucccaaagugcuaggauuacaggcgugagccacuguggccagccucugcuuuauuuuuaaaaacuagcuguuaaggcacugaaauacacagaauauacaaaauuaacuuuaggacugagagcaaguaauuucugccaaaauuucuucauaaauauaaacaaaagccaauauuaccuguguauaagagguacuuaacuauauucugaaguaaaagugaaaagaaauuaagaaaaaucaaaacaugguuaauaaaaccagcaaagggccagguguggugcacaaggccaagguggguggaucacuugaggucaggaguucgagaccagccuggccaacauggcaaaacagccucucuacuaaaaauacaaaaauuagccagguaugguggcaagcaccuauaaucccagcuacucgggaggcugaggcaggagaaucacuugaaccugguaggcagagauuacagugagccgagaucgcaccaccgcgcuccagccugggcgacagaacgagacucugucuccaaaaauaaaaaauuaaauaaaauaaacaaauuaaauaaauaaauaaaaauaauauauaauaaaauaaaauuaauaaaaaauaaauuuaaaaauaaauaaaauaaaauaaaaccagcaaauuacagaaaugacaaaagcuaacagacuaucagaaaaugugaaaaggcuuuaaaaauauguaacaguuggcugggcacgguggcucaagccuguaauucuagcacuuugggagaccgaggugggcauacugccugagcucuggaguuugagaccagccugggcaacauggugaaaccccaucucuacuaaaauacaaaaaaaagaaagaaauuagccgggcacagcggcgugcgccuguagucccagcuacuagggaggcugaggcagaagaauugcuugaacccaggaggcaaagguugcagugagcugagaucgugccacugcgcuccagccuggcaacagagugagaguccgucucaaaaauaaauacauaacgguuucacaaggugacuaaguuacaucuucagaaaaauggguuaugccuacauuaaccugucuguaaccuaaaauacugaggccuuaaccuaauauagaguuuguuaaaaugaaauucacuuuuugaauacugaaaaugagaaaaauaaaaauuguuuuaaaaaauuaauuucacugcacccugucagaagagaauuuaaccaauggucuggaacugaaauguaccuaucugaagccauuacuauuagaaguuauuagaaaucauuuggugggggcaguaagcaaccuacuaaaugaaugccggcugguucauguaacagauggcucauuuacuuaaagaugaaugcgccagacuuucagagccggacauuaaaauuauguacuaauuccccuugcucugguaugcacaaauuaaagucaagguuuuauuauuagcauucaucuucaaaaaagagggucucaccuuauauucuacuaaauagucucucuuauaaagggcauucuccaaauuuauuuggaaaacaaugaugaagauucaauaaugugaaauaaccuucagccaaacaaguuauagauguuuauagaggucauaugauacaauuauuauuuaaaaaagggaaaugaaaauuuaacaauuaccuuaaggauaaaauuucuuaaguauuagauguuguagacaagcuuuuauuuauuuuuucuguguguaugagauagggucucccucuguugcccagacuggaaugcaguggcacgaucacagagccucaaccucccaggcucaagccauccuccuacuugagccucucgaguaguuaagacuacagaccacgugcaccaccacgucuggcuaauuuuuaaaucuuucguagagacggugucucccuauguugcccaggcuggucucgaacuccugggcucaagcaauccucccaccucgaccucccaaagugcuaggaucacugggcgcacugguucgucccuguaaucccagcacuuugggaggcugacgggcagaucaccucagaucaggaguucaagaccagccugccaacauggagaaaccccgucucuacuaaaaacacaaaaaucagcugggugugguggcgggcaccuguaaucccagcuacucgggaggcugaggcaggaaaaucauuugaacccgggaggcggagguugcagugagcugagaucgcaccauugcacuccagccugggugacaagagugaaacuucgugucaaaaaaaaaaagugcgaggauuacaugcguaagucacuacgccuggccauaaacaagcuuuacuuuuaacaaaacaauuaaguaagugguuacuuugagggaaaucauauauauacuaacaggaaguuuaaaaaaucuaugccaacaauauucuaguuaggaucaagucucuagcaacaucauaaacaauauaaaauugcccuuuguguaacaagcaauugaagauaaaugugguuaaacuauuagaugauucaaaaagugauccuauugaugacaaagacacuggugcccuaagauaaaaauucuuaaugaaaagaauuuuacucaguggacauacuacuaaauuacuauauuauuaaauauaagaagauaguaauauguaaucauaaggagacacugaacaacucuauuuacaugccuaaaaaugcauaaauuuagugggucuaaauuuuuuuaaaaaauaaucucacugaggaaaauuaacgaaagccuuauacuuaguugccuaauagcugaccauauuuggggcuuuauuuucucuucugaacauguuuccucuaggagagagugacaucaacugccuaguacuuuccacauuuguauuucucauaaaaugaccugguauuuugguuuauacagcagccuccuguaaguuaaaucagcauccaugugccuccuagagacugauccacucuagauuacuaacaaaaucaaguuucucgaccuuaagcugaguguuuaccacaccaaacgacacucccuuuguaacccuagagagcauacaucucuucaaagcagcaaguuuggccaucuagaaccacaauggaaaaaaaaggaaugaagcugggccugauggcucaugccuguaaucccagcacuuugggaggccgaggcaggugaaucacgaggucaggaauucgagaccagccuggccaacauggugaaaccccaucucuacuaaaaauacaaaaaauuaccugggugugguggugggugccuauaaucccagcuacuugggagggaggcugaggcaggagaauugcuugaaccugggaggcggagguugcagugaacugagaucaugccacugcacuccagccugggugacagugcaagacuccaucucaaaaaaaaaaaaaaaaaaaaaaaaaaggaaugaauauguugguuuaaguuacuauuugugagagaauccugcaagagaacagucauucccuuuccaacuacuuagauggguuuucuaaacuaguacuuccugaauaguugaccacagugagauuacucaauagaaauggaugaaauuauucuacucagaaaacguaacccuaacauacggccauacuauccggaacaugcccaaccuccucugaucucagaagcuaagcagggucaggagaaaauguaacccuaaaugacuucuuauaaaccaaagaauccaaaguaaugaagaaaaugcuauugcaagaacaaaagcccaauagucaaucuagaaauuaccccuuccacuauuuacagucccuuuacauaaacugucaguacaaaguguuaagacacagaagucagcaggcaaacauuuuuaaaaacuacacccagaccuugagacacagaaauaugagacuccagagugguaauguuuuuaugcuucuacaacuccuacggugaugauggguuaagugaagagcagaagcuuacuaagauauaaaccugauuaagauauaaucacuuuuggguuucuaaaucgguuucucuuucuuaggcaugaaaccaaacucuugaauaccuuuuuauucuucuuuuuaaaaaaaaaauccacacacaaaaaaacacuaaaugcuugagcugaugaauaugcuaauuacccugauuugaucaugacacaagguuuacaaguauccaaacaucacacuguaccccauacauuguacaauugucaauuuaaaacaauauauaacuuuaaaaaauuuauaaaucccauaaacacgacauuuugcagaaguauucaacuacaaucacauuauuccugagguuuaggccaagcacccauucacaaccauuuucucuucucuaaacuggucugaccauuucucaauccaccucccacacucccaugucuaaauuuccuguuuucuccccuauacuuucucauacguagaauuugguguucaaacuuuuuuuaaauuacaaggcuucuaaaaaagaaucauccugccuugaagcaagacgacaaugaaccaugccacuuuuauauacagaaccucuuacugcugacaaauagcugucuucaacccuccuagguuacuaauuuauuaacagcaugcagcacuacauuccacauacuaacuacauuucaaaugccuuauguggaguuacaacuuacuuuaggggaucuucuugaucacugucuaugcuaucagcuucacugucagggucaccucuccaugucugauccacaguaauggguuccugcuccccaucacuccagcugucuucaucugaggcaaggaagggagagcagccauuaagacuucccaccucuguaacuccaccacacaaaacuagauuacuuuuaucaacccaaaccuugaaauuuuaaaaacaaaacaaaaaaaaaaacacuuaguacaaagguacuggcaaauaaaaacgcuuuaagaaaauacaacccaaguaagauuacuuacaacauaaaugaguaaaccaugcccucucaaacagaaaaaucaacuuaaaauuacuguuuccugaaauuaccuaacaaagcugcugagcauuaaaaaagcaaugaaagaaauggucaccaacucaggaaaguaaaccuaggcaaacacaacuucaaauucaaaagaacugguaaacaacaaagcaaucccagcauucucaccaaauuccugaugaauuaacaauauugccaaauagaucaaggcauugugcuaacccaaaauaguucccccuuaacuuucuuccuccuuuuucauuccaggagagaagguccuuaccuaguauucggcuggcuucacugcgacuacuuucuggagucugagaccccagcucugucuuagcauaugagcucagcuggcacaggaguguuucacccacaggcccuggguuggucuucuucauuugagcaugaagugccagggcauuccuacggacauguucagcacagaaggacacccugaagagacaaaacauuaauauuuuauaaguuccuucuugaaagcguucaauaauguucacagucccuaaucuuuaaaucauuuuuagggaauuaaaaugacuauuacauucauuucuaaaaaugcaagucagaggaauuuaacuggcccaaggucaacucauuugacuuuauuaaagggaaauaacaggacggaugaagugguucacccuuguaaucccagcacuuugggaggcugaggcaagggauugggucuugcucuguugcccaggcuaaagugcaguggugcaaucauaguucacuguagccuuaaacugcuugguucaagcgauccuccugccucagccucaaaguagcuagaacuauaggcaugcaccacugugcccagcaaauuuuuuuuaguuuuuuguagaaacgaagucuauguugccaagucuggucuggaacucccaggcucaagugauccucccaccucagccucccaaguaguggggacuacauguccacgccacuaugcccagcgaguuuuuuaaucuucuguagagacggggucucacuguauugccuggguuggucuccaacuccuggccucaagugauccuccucccguggccucccaaagugcugggauuacaggcaugagccacugcgaccagccagggacacaauuuuaaaacuauaagauacguaaaaaauuaucuagucagguuauguuuuugcauggauaccuuugcauacaugaugaaaacuaugaagccucuuacagaagaauacacacauauauaacuuugcauguuauuuaacaaaauucauggacagccaaauagagccacacaccccuccauuaagaagaauuuuaggggccaggugcgguggcucacuccuguaaucccaacacucugggaggccgaggcggauggaucaccugaggucagcaguucaaaacaagccuggccaacauggugaaaccccgucucuacuaaaaaguacaaaaauuagccgggcauaguggcgcacgccuuaagucccaacuacuuaggaggcaggagaaucgcuugaaccuggaaggaggagguugcagugagccgagaucuccacugcacuccagccuggggaauaaagcaagaaucugugcgccgcccccccgccaaaaaauuaacuuuagggccgggcgcggucgcucacgccuguaaucccagcacucugggaggccgagaugggaggauaccuugaggccaggaguuugagaccggccuggucaaaauagcaagaccccaucucucuuaaaaaaaaaaaaaaaaaaaaaaagacuaauuuagaauaugccuuuauuuuacagauaagggaaaagaaccaaagaggugaacuaaguaauccaacucaagggucuuuccagucuucaccguuuuuucaguuuuccaaggauacaaccauaaccccaaauuuacaaggacaaaaucucaaacgcggcagcuaugcugaagcccgcaucauaucacauacccccucgcuuuaagaaaaacgacauauauaucuauacauauauacccaucuuucuucucuggcuuuggggcagcauugggacaucuuuuuccauucuucgucgauauauaacuacacugcuugaagggugcauucuugucuucaaggauaugcuuaaugcaaaacuccugccccuccagacgagggugagagcauggacgaugagugaaugcacaagacagagguuccugagaccugggcacuggagugauccucccccgauugguuggcaagacgugaauccgaauccuguucauaaccaaaacc

SEQ ID NO: 15221 - RNA, 142284 nt, Homo sapiens
ggcggaaggggugguguugaaauuaaccaauagaauggaagaaguuguuguugggagggaggaagacgccagcuaacgugcgugaggccgcucccggauaggggaugcaggaagcucguggagccaauggccgcggcgggcgggcggcggcgcgcgugcgcguuggcccccgggccugcgggcgggaggcggggauggugggggaggggagcgggcuggagcgcggcggagcuccugccgccgccgcagccgcugccgccgcagcgaagaggccauguugugugguguguggggcggggggaggaggaggagggaguaaagccuagagaggagacgggagagagacaccacacacacggcacaagauggccggagaggcagcagcaccccgagcugucaggcguuccgccgcggccgcgaggcccgccggccggcggggagcuacgcccggacggccagcaggcccgcgggaguggggcugccgcggcugaggcgaggcgggccgcgcgcgucggcgucacagcccgcggcagaggcgcccagggcggccgggcccacgacgccgaaagcgccgcugcgguugccgccucggaggcucccccgggccccggcggcuggacccggcgcgggcgggaggcucgggcgggcgguccggcccgggacucggguuugggcgaccaggaggugccgguggccgcgcucggacccggugaguggcucccuagcuccuuuuauuguccuuuguccuugggaggaaaagcaaaauguccuugagcgcgcgagcaggagggggcggcgggccgggccucgccgcucggcucuucucgcacugccccuccguggucgggggccggcucucgccggcgggaugcgccucggugcccugggcccgagucguaggguccugggguagggggcacgcggggccccgcugcagagcccgcgggcggcaggugggcggggggcagccucgucgccgggacuggauccgccgggaaaggggcggcgggugaaugccggcgagagcccgaaggggaucgggcguggagagccccuuucuguccuggugaguuauuuugauauuuaggguaaaaaaaucccuuucagguucuccaacggaggagcuuuuuaaccucuuuccggugaggugggaacucaucuucaugaucgaauuuaaaagaacaauggaacccugacuacguuucaacaaaaauaaaacuuguuuuuuucccuccuauuggguguuggcuuuuaacucuuucaaagccgauuuugaaacggcugcagugauacaugcgaagguacuugcugcuuauuaaaccuuuaugacguuaagguugucuuugaaaaaugcaaguuggaggagugcuucugguauuucagaauuacgaagacaaguuuacugugucgucaaggcuguuuaauggaaauagauuugauaauuacggugcuagcuagcugaugacguuugguuaauguaguuuauuuuaccgaguaaugacgccaagaucauuugaucuccugauauuuaaauaugauuaaauacacuguuugguacuuuuuaaaaaggucucaaggagccguuaucugcaacuucucacaccugaauguuagaacguacuugggucaauuccuagucuuuaaaaguucauaauuuaauuauuuuuaagaauuuauauuaucacaagccaugaucgaaaaacuuucacaaaagaacauucugacaccaaaucucuuccugaaguuacuuucucguaauguaaauaugaauaaaguaggacugcucucgguaaugggcgaugaagaggagccauauuuguugcauuuguugcauguauaaaaaucuagauaugcuuaaaacggaacaguauuuuaaaaguacagguuucauaaaauuuaguagaguucucuguauagucucuaaucuuagaaaaauguuggaaggguaauuuuuaaguguagugguuugaagaacaaaccagaagcgcacaaaccuuuguguauuuuagaauauauuugucuucauucugcggagcucuuguguuguaaaggugcagaacuacguaaaaauaguguugggcagacuuacauaguacaucugaaaucagauacugguuuauucgaccauauuucuaagggcauuuuuccaguaaaauuguuuuauuuuuugaguagccuuccuauagugguacauguuacaucaguugcgcauaucuugauuuuacagaaucugucuuaaguaccaauuuugguuuuucaaaucaauguuucugaaauuuuugaacacugaaagugguuuuaaaugaauauucugaaucuaguucuuuagaauccucuuugaauugugaaaugcaaaauaauuguuagcaguuuaaccugaaagaucuuuuuacaugauaaaugggggaggagaaagacugaaaugaaaauguugaagacccugauuugaaauugaguguaaaggucuagauacuguaaguuuuagaguagcuuuagagacaaagcuaguaucccacuuggugagaucaaguaacuugugguuuaaaauuuaaaguaaccaguggccauuuuaacuucacuaauuucucuuggaggagcuaauuuuuaauugcucaugauuguaaaacauacuuccggaugguaagggagauguuaagaugauuugucuugaagaaugguaaacuuuuucuuuguuuauugccugucauaaaaagagggaaaguaaaaaaaaaaagguucauaaucuuaaaucaguccaaaaauuugaauuuucuguauuucuguuuaauucaaugcguuaaucuuuagcauuggucaauacagccaaaagaugaggaaaacaaagacugauagauacuaagauaagaaauaacugcaaccauaaauguauacagguuauguguccaugagccaucucuucaguuugcccauagauuuuugucuguggaauauuuucuuguuucaucacacugaaucguuggccaagaaaugcuugaaaaucaaaacauuaauaucaucuuucuucuuuuuuuuaaaggugacuuaagagauuaaaauuaauuugguugcuguugguucugaacaaauaaugaguucuuuuauuugagguaagaguggguuaauuuuuauuguuuugacaaaaauuagcuuauuaggcuuuuguuuuaucuuuaauaauuuacauuucaauuaaugaauggguaucauuuuuaaaaguugugauuaugaauaugaguaaacuaucaaauaauuugacaaaagccuuuaagccuuuucacugcaggaaagauuaaaaguauauacgcauagccauuguaacuuaauguacccuuugaauaguuuaaaauacugaagguccuuuaagccuuuguuuaauuuugggaacaagagaagacugauuagauuuugaggaaaaccaugaaccaaagauagcuuuuuuuuucuguuuaacucuguauauugugcaaacaauuuuaaucuuuuaaguauuuaaagaaauaagcuuauuggagaauuugaacuaguuugcuauucauacugauagauuuuagggaagaacauuuaaaaaaucagguuuugagcauagauuuuaguuucuuuuuuguaauuaaaaaguuuaaaaacacuuauuuuuacuugcuauuguuugcuucauaauuaaguuuagaaucuuauuuguuuucaccaaaagguaugccauuuugaagacugagacguuggaguuuuauccuagaggauaaaggaaaucuuugggaaagucaguauuuuauauagcaaguaaguaaauguuuuuacccaacaucugcaauugaauaguuaccaacauuuaaguagaaaaauaccauuaaaguuuguuaaugaaacaaacuguagacuacuuaucacugaaaggaugagaaaaccaucaaauuucuuugccugacauugaaaacacuucuauuacuaucaagacagucgaugcauguaauuuauauuggagcaggaagacauuuaguacuucuuaauaaaauggugcuuuaggauugugguuaaaucugcaguaaagucaucaagauuauguuuuuacaaaucugguauauacagucuuaagccuuuuuuuuuuuuuuuuuuugauuguacaaaucacauuuuaggaauggucuggaauuuugcauuugcugaucguaggauucuuaacaacauuucaaaaacuaaauagacacuuucauaucuuaggcauuuaauagauuuaaaauacucauuuuaauuguuuucaugaguuuucaaacagguccaaaaauguguuguuuucuaggaaaugagaguuaaugcaucuaaagaguccucuaauuuaauugcuuaguaauugcuuuuaaagcaugaaagauagagauaauuuucacgcgcaguagguauugggcccccagcauaccauguauaucacacuuuaaaaucuuaaagcuagauacgugaauuuaaaagaauguccacugauguuuuuaaggaaauaugccuuuuuuguaaguuaacguugaaucugaaaauuaaugucaagcuguuauuagcgauugacuagaggaaauacgcgguauaauaauggguaucuugggaaaauuuaagaaucgccaaaugaccaauuaaaauaagggcaaguuuaccuuuucuucaaaauuuauguggaaaauaaaauacagucuuucaauacuugguguuggcuuauuccauugauugaaauaggugguaagaggaauauuuuuauugccuuugcuucagcuuaacuucuuuuuaauccuuuuuugcaguucgaucaaacuuggguguauuacagugugcaagagaaaacuaaauguuugacuuuuaacuguaguguuuuaaagauacaacauuuacaagaauaguugaaacaucccucacuucaaaacuucuuuaacacaaaugccgagauuaggguuuccucugugcaauugaugugauauuaaauuggcauuccugucauugggcacuguuaaggaaauugagaaaugggucucuuaugugaagcauaaucuguguuuaaguauaaacaggcaauacauuuauaauggccuacggaagguguaauuugauucauaaaaaagaaaacagcuggaaagggcuagaaauguuaaaucaaagauucacauguacuuagaucuuuguuacugcauauauucaguguuuugauacuuaacugcuugagccaaucuuguauaaugaaccuaauugauuggcacaugagggcaaaugugaauguagauaacuauuauagauagauaauauuauauaagauaaauauaguggaucauguagauaugauauuaaaguacuauauuuuauaaggaagguggauuauuguauauuuaccacuguuuucugcuuaagaaccaaggugauacuuauauaauuguuuuuacccuagcauuuugggauaauucuugagucauaaaaaucuccugaucaacuuggugauugaauuggauugcauuaguucugauagaaacuguuuaaaaaauuaccugacauucuauagaaaugaaaggagccaugcuguguaaucacaaggcuuucaugacaugacauuuauagauuauaugaaauagguaauuucaaauguaaauuuuaaguuuuauuuacuauuagucaucguuuuuugauuauuuaaaaauuuguacuauggacaacuaauuaauuuuacuuuuuauccucugagauuugauuguggagcggcauaagggggagaaagauaaguugaggacgucucuuuaucuuuuguuaaucagagguggugauagaguggaaaauauaacacguuucggcauucaggagaccuaccuuccaauguaaauaagcccuugcggucuugauauuuuauuccuuuuguaccuucaucucauaaucuguaugaagacuuuagaguuccaagcucuuaagaucccuauuagcucucaaauugugggauaaaaauaauuguuaaggcaugccuaauacucuuauacagacuuuguaaacugauuucagagaagcgauuaaggaauuguacugucuuuaaacaauauuuagaaugcuucaguaaaagcauuuuuaaaaaauuuuucuaaugauguaguaaauguaccuaauauaaaguuaagugguuuuauuuaauacuuuucaccugaccaugauuauguuauaaauaagaggauuuauaguuugcaugccugauauaaucuauuuaauuuccuuuacaaaauuuuuguacaugaaagauaaaugucuucauuuuaccagcuaccuccuuccagauugaaugcuucagugcacuuugauuuucaaauuggcuauuauuuuuuaauguaauuaaccuucacaauuuaaauugaaggauauucugauccuuagguuauaaauaugugacuugaugguuuauguaacauucaaguagcauguuuucuauaacaauaugauaaaaguuuugauacauaccuuguauguugcuugacagaucuguuuuagaaaacauuccucugccuuuugaaaugaagccauguauuugaaauuauuucccaaacaauuauaucuuaagcgugugcuacauaguaaucauagucauuuuaauuuagauuauaaagcuauauuuuaacuuugagguuugugaauuuucuuagacauauuaaugacuuuauaguuaauggugcucucagauuuuauuuuuaaguuaaaaauuugccaggcgcgguggcucacgccuguaaucuuagcacucugggaggccgaggcagguggaucacgugaggucagcaguuugagaccagcccagccaacauagugaaacccccaucucuacuaaaaauuaaaaaaaaaaaaaaaaauuuagcuggaugugguggcacgcgccuguagucacagcuacuugggaggcugaggcaggagaaucgcuugaaccugggaggcagagguugcagugagcuaagauccacaccacugcacuccagcuugggcaacagagcgagacuucaucucaaaaaaaaaaaaaaaaaaagaaaaaguaaaaaaugguuuuaaaaaccaaguuuucuaagaaaagcauaaaugacuaaugauaauaugacaauugacuaaagcuguccuuacuguuugaaagaacaacaaccaaaauauguauauuauaccuguaaguuauuaaaucugaaacuaugauauuaugaaauaggguagguggaaauacgagcaaaaucauuaacuuucauagucugccuaagcugaauuuugcucccuucuccugucuuuccaaggauggcaaagugauuuuagacuuugucaauuuuggugguuaguaauuuuugugagugaugcauggggaaggagaugcuaugguagauuacauuagugucuaauucuugugaugaugcaaagugagauacauuuucugucuuugguggugugagaacccuaucuacugguagauaacuuacuuauaagcacauuaucagagcagugugagggauuucccuuagacauuucuuuuaccgagauuccuuaagucacuucugcccuucucuuaaggguuuacuugguuuacgauuugucugucuucacaaaacccucuguuacuuauaaggucagauuaaauuuggaagaucagaaauauguuguguuccuuuuaaauugcuucauuugucaauuucuugggaagauaauuuagcaccuacucuuagagcaauuuugaagcagaucuuugcuauauuucuuuuuuuuuuguuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccugcuauauuucuugauuaugaucuguccgaaugacuaaaggaauuuagauuugggaagauaaacagggacuugcucuauaauuugaaaauuaguccuaaagaagcauuuggguagcauaguuuuaacuaaaauccuaaacuucguugccuucuaaaaaccuuaaauugcuacauuuuguuuuuguuuuuguuuuuggagauugagucuugcucuguugcccaggcugcuggagugcaguggugugaucucaacucacugccaccuccgccucccguuuuuaagugauuauccugccuuagccuccugaguagcugggauuacaggcgugcaccaccacacuuggcugaguuuuguauuuuuaguagagcugggguuucaccauguuggucaggucucgaacuccugacuucaggugacccacccagcuuggacucccaaaaguauuggaauuacaggugugagccacugcgcccugccuauuuucauauugaacuuuuaaauaaguuuucuuugugguggugggaugauuauuguaaucauacuugggaacagaagugaugaaaaagguauguuacuugagauaugggaaacgcuauuuuccauguuuaguuaugggguauucaagucuaacuaguggaaaguauggauacauuuuauuuauuuuuugagacggagucucgcucuguugcucaggcuagagugcagcgaugcgaucucagcucacugcaacuucugccuccuggguucaagcaauuucuggcuaauuuuuguauuuuuaguagagacgggguuugaccauguuggccaggcuggucucaaacaccugaccucaagugaucugccugccuccaccuccccaagugcugggauuauagguguaagccaccgggccuggccggauacauuuuuauuaucaaguauauauuuuaggaaugauuaguguugguuuaguugaauagauugguacaauuaguaguaauuugaaaugaugccuaugguuuccuaacauuuugucuuaguguugauuaaagacauaauaaugugaaauaauaugguaauacuaaggaaugagaaaguggccuuacaggugggcaauguaaacuuuccuguagaaggauugaaaguaaauagauguaagacuagaaagugaaacaauucuguacuguaagagcaauguuggcuguguuaaauaacucguucccaaacaucagauccaccuggggagcccaaauauuuaccuacauuuuuggaguucuuaggggcugaaacuuacgcuugugauuuuguaguaaccuauucuagagaggagccaaauuugugauacucaagagcuuguaugauuucugcuuggacuguauuguuaauacauacauacaucuuuuggucuauuggcaaaugacccuugcaagauguugacauuuuggguauaaaucauggugcuuaauaaucuguuuucauuuuuuauguauaaaauuaaauucuuuuuguccucugcagaaauaugaaccucaaacugaauccucuaaaggccccauacaaugaaguagacauugguggaaacauuuaguaaguauuauucaauuuacauguuuaaucuguuuagaaauuuuaaauacuacuuuggaaauuuugaaaauucgagucagaauuguaaagagggauuuagugaaacucaacacaguacaagaaaaucaacauggaaauuucgcuuauuaauuuacuccaaucuauuauuuucugcuuucuucacuuaggcaaguuaaaaugcaaacaaacccacauuugaacauaccucuaacacuauuauaaacauggauguugcuaaaugguuccucuuuguuuuuguaaauaaaguuuuauugcagcacagcuauacgcuuucauuuaguuauuguuugccgcugcuuucucaguauauagcagcagcaagcagaggaguucuauugaauggccuacaaagccuaaaauauuuccugucucaucuguagggaaaguuuauccuagguccuacagcuuuuccuuuugucagcauugccuuaaccuguauagaacucagaagcccuucgguucucuuuugguaauagaacauaauuuuuaaugauuuccaauauuauaauuacuuuuaauuaauuaauuuugaaguuaaacuugaaagcccaacaaaaaguucuuuagccugauugucccugaaguuaugcuuugauguuagaagacaugguuagcaccucugaaauaguuuuucuaacagccugaaaaauaguuggaaagaguugaugggaagguuguauaaaugaauuuuggugaauucucaacaugauuuauuuauuuuuauuuuauuuuucgagacagaguuccacugucacccaugcuggagugcagugucaugaucuugacucaucgcaaccuccgccucuggggcucaagcgauucuccugcuucagccuccaguguagcugggauuacagucacgcaccaccauucccagcuaauuuuuguauuuuuaguagagaugggguuuccccauguuggccaggcuggucucgaacuccugaccucaggugauccacacgccucagccucccaaagugcuaggauuacaggugugagccaccgcaccuggccaacaugauuuauuauugacaaccuuuuugguaauuauauauuagcuacuucauaaaaauaauuuuuuugaaucauauuugggaaucuagauuuuagaugauaauuuuugccuauggcuacuuuagcuugcguuguguaaauggcugcuagggccugcgaaauagauuuuauuuuuggagggggauuuguuuuucaauacaggaugaugaaagagaugaaaacuuuucuaauauaguacaauaauuggcuguggucauuuuaaagggaucaguugcauagcauauaguagaugcucaauaaauacuuaguguaucaauauggcuucuguuaaacauuguuuaucagcuaguguuuuggauuuaauuuaaaaacagugacauugacuauuaaaacauguuuuaaugaauuaaauauaaaauuguagguaugccugaaagccaaaguuuugaccaaguaaaaauuaaaagugacaagauuucauuuuuucucugcaauucucaaucucuuaguuugcauauauagucaacuuuuaaaccauugaggacgguaccggaauauuugauuugauuguaaaccuuaaauaagaugacuccuuuucuuaguugucacaauugacauuaauuuuauaguuaguuuuuaugcccauaagacccagacuuguuaauauauauucuacugaagauucaagguaucuugguaauaagucaacauaugugaauuuacuucucagggcuuccuuuuuuuuuuuuuuuccccugagacggaguuucacucuuguugcacaggauggagugugguggcgcgaucucagcucacugcaaccccugccucccggguucaauugauucuccugccucagccuccccaguagcugggauuacaggcaugugccaccacgcccagcuaauuuuuguauuuuuaguagagaugggguuucaccauguugaccagguuggucucgaacuccugaccucaggggaugugcuggccuuggccucccuaagugauaggauuacaggugugagccaccgcacccagccucucagggcuuucuugcauaaauauuuccacauuuaaagacaguagacgaagauugaaaucaucauaagcaccaagaauguuaauuacaugaugagaaggaugaauuuuugcucuagguaauuuuacaccuguuugucccaucauugacuuugaaauaaguguuuuaaguuuuaaaauaauuuguugcauuaauaauaguagcuuuaugauagccauccauuaagacaauuaggaaucacuaauuucuuuuuccuuauacuacucucugccccugccccccgccccauuuuucuuugcuauuaaaaaugggaaaaguugcugagaaguagaggaaaggagaugguuuauuuuaggagagcccuuguaaacucaauccagauggugaaucacuuaccuguguauccaccaacaauguauuuuaucaugucccaguguuuuuggaacaaauuuacuaaaguagaauuuaaaaagaauaccaggccaggugcaguggcucaggccuguagucccagcacuuuggggaggcugagggcaggugcaucacaaggucaggaguucgagaccagccuggcccacauagugaaaccccgucucuacuaaaauuacaaaaauuagccaggcauggugauaugcgccuacagucccagcuacuugggaggcugaggcaggagaaucgcuugaccugggaggugcagguuguggugagccgagguugcgccacugcacuccagccugaggaacagagagagacuccgucucaaaaaaaaaaaaaaaaaaccuuaguugggugcagaggcauguacuuguguucucagcuacugggaaagcugaggugggaggaucucuuccacccagaaguuugaaaccagccugggcaacguagugagaccuccaucuuaaaaaauaauuaaaaauacaaugaagagaauaccuccauguucaacuuuauguucuucuggauguaugauaaugcgggaauuuuaagggguaguaguuacucauugaagcuuuguugccauuuaaguuuuuaccuuugcugugggaaugguacucuuagaacaugcacauuauuuugaaaaggaaguauaaacuagugaauaucaaaggggaaaaauuuuguuaaccauuuauauuaugagcuugaagguuauaugugaaauacagaaaagaucuagguuugucugauuauggaauucuagaucaaaacaugucuuccaugucugcaguaauucacaaguuacuggaaaggaacauguagaggguuuugauaucuaaacccuacccaguuuucuguaggaucuugauuuuauuuuaaugcaagacugcugaccccaugauccuguguguucuucagagauacucuuacugaugauguauaaaugaacuuugauucaguaaggucaguuuguaggucucaaaguacuuugguuauugugguacaucagaaugauagcuaguauuuacugagaucuuucuauaugucagguaauaaaaauccuauaaaaguauucuuucuacagccacaggagguagguacuauuuuuauuuuacagaugaagaacuguggauuuuguuucuaagaaaauuuccaggcucacagaacuaagccuaauuucuuuuuauuuuuuagcaaauacaguuuuuauaagaauuugaauucuaugaaaauaaauggauuacuccuaaaucucugaugccucagugaacacuuuuuccuuauuaacaaaauucucacuuuuggcuuuggauuggcuuugcaggagugcagauugaucauagcuuuuuucauguccuaagaguugucagaguuuucucuuguagcauuuuuuucuuuacuuuuuuuuuuuacuaucuuuaaauauaugacuguaagaguaugauaaauaugcuguuuucuaaucucugcuguugucacauaaacuaauauauuuugaguaauuuugaaaugauauuaauaaugucauuagauuuucuuuggauuuuuugaaaaaaauaaugguuuuagaaggaaaucuggauaaauuuuaucucuguccugugucagaaaaauauaaaacuugaguuuuuuaaauuaagguacuaagauaaauaaauugcaucuauagauauugaaauaugacuguaauuugauaaugcauuuucauucucagugucauuguucaucauaauaguauuuacaucaccaacuucauuuagagcuugaaucuuguaacaauagagauugaaaauaaauugguuuauaauuaacucugacagagaaugauguuuuuacuuuuauacuucucuauagaaguacaugucccuuaauuuuaaggaaugaacaagucagauggaagauuuuuacugagaucaggaaugaauugaguaauuuaguuuucuuuuuaaagcuggggagaaaugagcaaaaucaaggagaaauaucuugcuuuugauauuuauuacugaugcugugacacucccuuuaaucaauguuuuuuaauauggguggcaguaucucaguuaaccaaauaguuaaguaaguagauuuuuguauuguauauaguaaacaguauccuaauuguugccaaggagacaaggaauuaccuaaugggcaaaaaugcccuuauauuuauuuaccucaaauucagucacacuugacuguaucuccacaaauucagauggagagcuggaaaauuuauagagaagaccaggguuuaaaucuuguuuuuucaaauuauguuuggucaugaugaaucugaaucauuuauuuaaugauaaaaucaucugacuucucacuucucacuucucccuucaguuaaaauuauuuaaguaauggauuuguuuuucuaugagagacauuugguauuuugguaaugaaaguguauuauuuuaguugcauauaauuugaaaacagcauuuuauggcaaaucuaucaagccaggcagauacuuugcauuuuugaucuuuuuuuuuuuuuuuuuuuuuugguggcuacaucuuuucuguauucucagauaugucguuaaagauggugccaccuauaguggccauuuucguuaucuaaacaaaaccaacaucuguuggauugaaaaacuaugcuaugaucgacugcuuuauguguguauguuuuuuuuuuuuuucaaaucccuuaagauucuuuucuauaauuaguuuucuuugaagaagcuuggaaaguuuucugcauugagauuuagaauccacaguguuucuguaauuuagcuuuccaggaauuuugaauuuuaauuuuuguuuuuacuuuuuauguacacaguauaaugauguuaguguuaaauauuaaaaaucugacucuucacugggacuuuuuuauagauacaaauguaucugugguaguacaaggacuuuguuacuuuggcgugcagucuuaucaaggaguuguguguguguuuugcauacaacuuuacaauuucauaguugaaagcuguuacaaaaugaaaguuuuguguaugguaggauaucuucaagguggguggauguuuucuguuuaaaagauuaagaugccaacagcguuuuuuucuuuuaauuuuuucaucaagcacccagucagcuugaagaguuucaaauggacccuaccacugagaaaucaagauggcagucuacuauggggaauugaggaaaaauggauuaauacaagaguccugugauaauauacaaccaagacaggguucuuuuaacauggauuccaugcagugaaugaagacauagguuucuuacccaacacaaauggacaguggauuugacuuucuaaagacuuuuuuuguggacauuuugacauuuggagaagaaagauggcacacuaacccagauaauaguuuuuaugccuggaauuuuuugcaguuugauuuguaugcguaugaccucuugaaauguuaauuuuuaauaaaauuuguaacacuuaaaaauuucucaguuuggguuuuuuuuuuuaaguggaaguuuaauuaaauguuuaguuuuauuuuaguaauacuuuggccuuuguaguugccgagugguaaaguguacugaauaugaauaaagcugguaaauuggaaaugguguaaucgaaaacauuuuacuugguuuaugaagauuuacguuuuucacaaaguugugcucuuagauggucauuugguuuaaauacuguuuuguuugugcuuucaugaaacaccuuucaaaacaacucaauggguaauaauagaaucugauuuuaaucugccacaagauuuuaaugaacuugaaacaaacugcuuguugcucgaaaauucaggaugagugauacacauauacuucugaauuauuuuguguugauugaaaugguuucuuaagcuuuuuaauacuauaaauacaucuugcuauagaauauucaucugaauauuuaaauuaaugucuccuauugucuuacuauuagaggaagaaguguuggauuuauggguuaggguccuuggaguauucacaauuuuuuaaauuugaaauuauguguguaauccauuuuauauaacuuugaaguaggauuaauaucuuguaucgucuuuauuuuguacaauuggggauuuagaauaaaugaauugcacccugccauagauuacuuacguuugauuuuuaaaugccagguuuucauuuauuacuaaucaacugauaccaguuuugguaacuauuacaaaggugguaggcauuauuuugguagacaaaaugaguucuugauucuguuuucccauuuuacaugagaagaauaaauaguucagguuaaauuguuuuguguuaaucauacuguuugugauucaugucaaauacugcagcauacacauccaugguuaauacacgagcaccauuuguuauugacugaugugaggugguuggucuuuguuaaauucaaaaauggaauuuuggauauuguucuugcuacgaaauuuaucuuuguguguagaguauggaauugaaacaguuuggauuauggauuuuaccuagauuggacauuguugauuuuguuugguguaaaucuaaaguggauuucuucagugagggagagacaugguucuggcagauuauguugaauaaggaaaguugauuggauuuuuuugggugugugaauaugcuugucugaauggagugcuugguaggauauuguuucuggaauuaguaauuuguuucuguggaucucaugguuuugauauuuaggagaauuugcuuugugacauuacuuugauaauuugcaaucacguauguccuauuguuaauaacauuguugaaauggguguauacuuacuugauuugaaauauaagggaaguguugggauauguguuuucuguuggauuuggacguggaguuucuuggguuacugauuuaaaggugaucguguuuggaccauacucuugaauuuuugccugaaucaguaugggaaguaaauauauugugauuaugagaaguuucuuuggggggaggaguguaauauuuucaagguuauauaauggguuaaagaauuuugugaaagaacaaagaaaaauggauauucuugaauaaaaauugguugcauuaacuuuugcuccagugcaacuugaacacuagggaggcgcucuugaguuguaaaaguuaccccuuucuuccaguggagauggaaaauucccccuuaaauuuugucuuuagauuauuuuuaggcaucauaaagaaggaaaaacuugaauuuauauuaugaaauuaagguuuuacuuuuauuuagcaaucauuucacccauugggggauuaauuuuuaaaaagauuaguacuuagcugagcuuuagauucucuaagaauuaucccuuuuucaaaauggcuugauaaaacaccacuuccuguccagggaggaaguuauuuuagcucaaggacugaaauauuuagcagaucuuuagacaaaaggaacaaauuacauuucucucuggcuuaaaaagggugcuugagccagaggggguuaagaagcccuccccccucccccuguugggguggucuggaggggcagggagguguggggguggggguccuuaggcucccugggauggaggaucugucucucucucucucucuccuuuuuuuuuuuuugguggagaugaaggggugggucuaugguacaucaccugaguugugggguaaauguagagagugucaaucaaaggcagagcucucagagcugggaaggaggcucuagauggcggcugugccuuagagagagcgcgcucugcucccugccuuugccucacuuuacgcaacuuucccuaacuuucgggcagccucagggggcccccguagcccccugccuuuccuagggacuuacuggggucgauucgaaccuuuuuuugggagaaaagcagcuuuuaggagcuuucuuuucgugccuuguuggaaagaagcagccguacugagagcccaggucguuguuuuuuccagcuuagaagccauggcgcaccuccauuuuugugcgcucuccuaaugagguuuuuuuucuuucggaccuguuuuaguauuaauuauugcuuuauuuuuuugaccaguuaacauauuugaggguuauuuuauuuauuuuucguuuuuuaacggaggauuuugccuuuauuuuuaauuauuugggaucugauauuuuucuacuaguagauaggacucuugguuuggacauacuacauggaucagguaaguucacgaucauuggugauaauuuuaaagauuuauuuguuuaaguuugccuuguuuucuguaaauacgagaaauucuuggaugacgcaauaagauacagagauuguuauuuguaucuagugugcuacuuugagaaaguuuccuuauugauagugaugcuuccacuguucgguuuauccuguuguuuuuucuuuuaaggaaaaaauagaaauauuuaguuuuuuggugcuuaccguuguuguguuauaacaauaucguuaacaucgucaggacuuuguuccugauaauaaaaagcaucgauagaagccgggaccuuaccuuucuuucaacuuuugacaguaaauaccugggcacaggacuucaaagcaaacacagauucccccucccccuuaauauuuaagaauuaaaagaugaugagaaauaaggacaaaagccaagaggaggacaguucgcuacacagcaaugcaucgagguaugagcuaucaacuuucuuccuuuuugucuuuuuuuuugggggagaaaccucagcuuacaauuguuuaccuugacagacauggauugcugucuguuuuauuguguuuuucuaauuuggauucguuuuuuaaagcaugaccuugagauugcuaauaugccacacccuaauuuuuugguagcaauuuaugaaaguugaguugugacuuaaggccucuuacagcagucaaaagguaagguaccuuuauucaaaggggccuuuacuguaauguacaguuuuucugucaguaaauuucaguuuuuagguuuuuguacugcagaaaaaugaccuugucgguuuagccauugcugcauugcaccauuuuacauacaaggcaaauuuuuucuuugaagaauccaggauaucuaaacuuguaacugagggccauagagaagccuuguaguaguaaauuauaguaaauagacauaucagaaaguuauaugaaugaaaaaauguacauuuaaaaacaaaaucacuuaaaggacccuuugacugaugccucucaguuuauauuuuuaugugacuuuauauuucuuuugauacacuugacauuuuaggaaauuuugaugugauuuaucaaaaccuuuacuugaugguuagaguuccugcauuuaugaaaucaaaucuguaauaacagaaauccuggaauacucuuaauauauacuucuauuuuguguuuguuacugugauuaauauuugcaguuguauauuuuacauuuaaauuauuuuaagguuugcauuuguaugcuuaagacauugauuuccuguugguagauguauuuuauccucacaauuuagauguagcugcuuuaaauuuauugauguauuucgacagagucgucuggaaugcuuuaucuucugaagcuuaaaaauguacuguuugugcaaaucaugaucuguuucacauuccuuggaguaccuuguuagugaugaaguaauaaagccucuaagauguuuuuguuguaugaccucuguauauuaauuuuuaaaaguacauaugaaugcauuuuuugauguguucuuuaugcauuuucauauuauaaauuuuaaaucaugcaguuuaacaaggaugugauucauuaugugguuuuccuucccaauuuuuacuuuucuaauuuuuauaaauaauacacuuuucuauuaggcuagugaauuugaaaguuuugaacaugauguguuacuaauaugcugaauucuauuuauuuuauuugacugaaagcauauugagccuugcuuuagaaaauaaguuaccaaauuuuuuugcauugaguugucacccaguuuguagugcugucuuaauugaauugcccauguaaauuacuagauuaaauugaggacagaaaaguuuuuuacucauccuaagcuguuuuuuucuggaaaguaaugacaauuugaagaaaugagaaccuccagauauauuuggcaaauuauuaaagauucagcacuaaaauuguugcucccuugaguguaucauuugcauaggucucacauggguuuuggcucucuuaugcaagguuugugguuaacaucauugaucagacugugcuuucuaauucuaaaaaauugagcaguguugguauucuuucaguauuuuuacucucaccuggaaaacuaccuggaaguugucaggcauuugcuuacugguaguggagguuacagcuguacaugaagcauguacugacuguacuuuuaaauugguuugucaaguauacuuugaaucauauaccugauggauguccaaaaauauuuaagacucuuugaaaagaagauaguuacuuuuaaauuaguuacccuaaauuucauaucuuaauacauguacauaauuaugacaucacuuccuuuuaaaaugugcagcuguagaauguuagugguguuuuaaugugguagauuaauauuacuucuacugagcugaacugucccuguaauuaguacuugguuccuucugccaucagaguuuuuauugcccaaaguauaguguuuagggaauacuacgaaaaucaccuuugcagccugagccacagaagaggaaaugaguuugcaggucaaguaaacuuuggucugagaauuacuuuaguaucuggaaagaaugagugcaaguuuagguaaaucugguaauacccuguuuuuggaaauagugcaguaguuaauagugguuauauaaguuuguauuuuaauuugaaguuaaugcuaaagucuguuauacuuuaucacgauuuuugaaaauuaaaaacuuuaaaaaacgcgauuuuaaaaacauuugauugauauuuguaaaauuucuaaguauuuaaaacaaaguucuaaugauggacauacgagaaguauaccauacuuuuuaucugaauaauuugcagcuuggggauaacuuaaguaacaucaaagaaugaaaacgggacugugugcacacaaagaguucaguguguucuccacggcaccacguuagcaauuuaucuuaagaauugaacgaguuuauuaaauuuaucuccaaaucgucugccuuugagccagauuuauuuuuauaaccugaggugcggguaaauccuacaauuuucaggggcgcuuuaccagauauucuaaaaggcuggggaugauuagaaauggcauaaugcaguuacuuguguacuagaacaggcaguuuaacuggcagccauuuuaugacgcugauaauacauuaaaaaacgggauuuuggagaagacugaaucuaaacuaauagaaaucugaaauaccaaagccuauuuccuucccccucucugcucuucuggggaacucuggugccgacauaaaaggcaguucgauagggcacgcagcagcucuuugagccccuggcaucuugaugcagguccagcucagucacaaaauggcuguuccuuugugccgcagcgcugacagacauacugcauugcacuguguacucgccaaacagcaggaaguugccgugccgaguucaaaggccggccggcgccggcgcggggugcugauuggcugugcgcgcgccugguaacagcagggucaacggcggcgccuucggcagccuccgccccgugacgucagacggcuccccuggggggcggggagagaacgcagugacgucuggccgcgugcgcaugucgggcgcuuucuccucccccuacccagggagccgcacgccgaggggaaaaggaagggaacucuaguugggacuuuccggugggcggcuucuuuccuggacgcguuugcuccuggcagucuuguccgcccuugccuguagcgguccgcacccuguaguguguucuuuugcccauuuccgggaaugguuuauccucuuugagaagcggcugcuuuuggagaaaaagugcaggcacuauuuauaaauuuuaaaggcacuauuuggaaaucuuaaaauagaaaauuugcccaguuuuacauuuucccuuuucauaccuuagcgucccuucuccccgcccccguucagugugaagagaugaguggguuuaauuuuguuacaauugaccaaaacguuugagugucagaggcggauacuuuuauuuuagugaaaaccucuugacggguguuaacagcuguuuaauacauggcucauaaacaaagggaagauuauuugaacuuguccccaugcguuuuuacuugguaccguacauuuucucaguuggcauuugauggagaaaaacucaggucaguaugugcuaaguacuauauauuuaagauucacagugggauaguuuaguagaaaauagaaaauuucacguucaauaacauuaaaaaguggcagaauacagcguuaggcaaccauuacuauguaaguaaaugucagaaaacuacucuuuuaaguguuaauagcacuugcuaaugcagggugacugacagcuuggcugauaguggggucacuuggccaaaucuucgcaauuaucuucccuaggccuccauuucgggaauucugagucccgguaaacgguuggguuuaugcucacugauuugccuuguuuggaaaccuuuacaaggauuucugguuaaaacuucaucguucagcaacgaugucuuaauaauuaaauuacacauacugaauuuaagcaagcaagaaauucaguggauuuaucuacuguggacaaaguuuuuuuccugccauacuagaguuuuuuuagcaguuggaguaggcuguccuguaguuagccauaguuuagaguuauuuuaguaaaguguguuacuucaaaggagauguugacccuucagugcaggugauauuugcuugggcguaugucaaguuucugaauacagucugugaaaguuagaauucacuaugauagugaguuuuguagguucucauaaucuagguucuuugggaagaauuauuuggauaguuugugaaaacuagcugaaauugcuuuuucuguuacagagaaguguucaucaaauaauuuguaccugauuuuaaaauuauaugcucaaauguauauugcguauaaaaugcuaacagagaauuaaguguuuauagaacuugaugaacguuuaacuguagcuuccaacuuaaaguauaccugccacaagaacgaaaguaauaaucucaccucccuuuuuguguagagacugaauucuaauuaguuguguuaauaguauuugcugaauaccuuucaauuccuaaaacuggggucaaaguagucaacauugcaguuaauuauuuuugaagaggauaugaacuauucuguuauuuaagauauuuuaaccuaaauaccauuaugaguuaaaaugcauaccaugauauaacaauuuaccuauuaacuguugacaaucuugcagccaauuaaguuuuuuauagaaccaguguucuuagguauguuuguugagccuucuacuuuuuuucccuuugauguggggaauagcaucaagcagcaagaaaagaguguugaucgauuucucucucuuucucucucucucucuguauccuugccguuuaaaauaugcacuuuccaacuaguauuuggccguuagggaguuaguaucuuuguaaagauuaagucagcagaggaaggugggcaaauaauauuuuugauaaagacuuuugguugugacaguuguagcaaguuauugcuugaggagugaaucuggaaguuuauuugaauuuuaacuaaaacucacagauuuuaucauuaguuuacucucccuuacccccaaauaaaacaacugacaguuaugagagaccuccugagaccaccugguauuuccaaacuccuaucauuucucccauaaaauuugauacacuaaguuuguuucugguauaaaaauugagugacugcucugugucagccauuaaauuuuuucuugcuaugagccaucuuuuuuuuuuuuuuuuuuuuaagauccuuuaguuuuuagcugcuucuugguaaccuuagaacuuugcuuccuugaagaacuuggcuuucuugauauggugucacuugaacaaagaaacuuaaaaaaaaauuccucuaagaguauuuuguguacaggugaaaguaacuuuguggcuugguuacacugggugugucacagcugaguaacucccuccugcacuucagcuugacuaagcguugaguucacauguauaccuuugcaaagcugccauucacaacuuguuuuggaacuuuaggguuaucaguauaaagccugaguaacaaaacuuagucauccaauguccaggcuggauuguauuuuuauuuugugaucaguaauucagcacaaugcuggaacacauuacucacauuugucuuaugacccuuuucuguaaucaauggaaucuuuaauugauaaagcaagucuagggggagagacauuuuuuaaaaaaagcuccuauauacugaauauauuugagcccugauuaugaagugagggacaaggcuuuucuuuuugaaauaaaugauggaggacauagauaugugguagccauucaugcuacauaauuuagcauuuuauuguuaauauguuugguuaugggucuucuuguuugguauuucaacauguucuggacuggauaucauacugaaaaguauuucaguucucauuacugagucccuguaguuuggggaaaaugugaucacugaucuugaaggagagaauguuucagaagcauccggcuaaggcaggauuguagagauagucuugauuuuauacuuuggauuuaauucugaugagucauuuugucacuuguguaugcuuaacuguuaccucugugccuggcaagagcuagguaugaguucagcuuuuacuuuaguccugaaaauuuuuguucccaguuuaggccagugaagaagcacuuaugauuggacuuguaauuuucucauuuuaaaaauguagauaauggucaucuucauugggucaugaagauuaaauaauauagugcccauaaaaugcuuagcaaagagcccaucacauuaaaagugcucaauaaauguaagcuuuuaguaagguuauuuuauucuuacuguuuguuucaucuuacuuucuugcaccccuccuucauauccuaaguucuucuucaggagcuagguuggcccugaggaacucgcugguugucuuggccuaccaggagaguuuguuuaggccaguuacaggagagauuugugagaaugauuuuaggaggcaaguccucauuuagucagcuugggugcguuuuacaguucauccucucuuagaauuuuuuuuuuuuuuuuuuuuuuuugagaagagccagccuuuugagagagcauaugacucuuccuggacuacaacagcuucuugugugaaucacagcccggcuuuugccaguuagucugaguagauaacuacccacccccacucccccaagcugauaauuauuacccugguuuauccucugucucauuuccccucucaagcuguuagagaaugaauacugaauacuguggugcacugcuccauggauauaaauguaacagcaguaauauuuacaaccaaugucuaauuggcuguagcuugcuuucaguguucagucuaaaccauaggacuauauauuugucuuagcauaaugccgaacaugcaagucugcuuaaacuauagucuuaagauuuguguguuuuggguuuccucuacuuccucuauuuccugucuuuuuuggguuauaggucagauggguucuacuuuuuauucccauuucagacuguggagagcuucuaaaaauaccaguguccaucccugccccuaggaucuaguuaauuuuuaaaagcucucuguguuucaaauuugcauguguuucuguauguuugcaguaucuccguguguuuucaaaucuucugauggagcacuucguguacuuuaacccuuggucuuuccauugccugucccauuuuuaaauucccuuuuuagucuuaauagcugcuugaguuaggaccucuggaagcaaaagugggauaggaugcugacggggaauuguaggcuugauggaagaggauguuucuauauuaaaugucauggcagauccaguucuaggcauaccuuuaaaauguauacacaggcugggcgugguagcucacuccuguaaucccagcaguuugggaggcccaggcaggcggaucacuugagguagggaguucgagaacagccuggccaacauggugaaacccugucucuacuaaaaauacaaagauuagcuggacaugauggugggugccuguagucccagcugcuugggaggcugaggccggacaaucuccugaagcugggaggcggagguugcaguuagaugaacugacacaccacugcacuccagccugggagacagggugaccaaaaaaaaaaaaagaaaaaagauaaaaaauguauaugcaggugggcuuucuccccucaagauucugaauuccuuguaagugucuucuagucgcuuuaagcucuuguggucgucucuuccuuaguguacucuccuuacauccuuuggaaguuuagauucuagaauuauuuacuuggaaugcaguuacauuccauucuaaacuuccuuucccuuggguuuauaaaaacauugguggguugugaauugugaccgacauugaaaaaauacaaaagaaugugguaauaaacuccaggguguaucccauuuguauggguuguuucuaagucuagcagugccugcuagcugguaaucuuucacuuuggauuuuuuguuguuguugggacagagucucacucugcugugcugggauuacaggugugaaccaucauacccagccucguggugguauuauagaugccugaggcuggauaauuuguuauuguggggagcgucucauacacagugcggugcugcaaucccagucucaggugggauuuucccaccucugccucccaaggagcugggaccacagguguguaccaccccaccugucuaauuuuuguagagauggguuuggaccauguugcccaggcuggucucuaauucuugggcucaccuagaccuccgaaagugcugggauuacagaugugagccaccguaccuggccuucacuuuggauuuuaucaggaaggaauauuguacauggugaacauuuuguagaaaaauaccaaaguagauuuauauuuauugagugcuuacucuggguaagggacuguuuuaaggguuuuacguguguguguguguguguguguguguguguauguauauauguauauauauacacauauauacauauauauaaauuuuuucuuuugagacaggguuucacucccaucucucacacuggagugcagugguacaauuucgguucacugcaaccuccacccuccaggcucaagcaguucuccugccuuagccucccuaguagcugggacuacaggcacaugccacugcacuuggcuaauuuuuugaauuuuuuguagagaggggguuucgccacguuucccaggcugguguugaacugggcaugaaccaccaugccuggcuauauguauauuuuauuuaauaugaaagucaguauagcaaaaauguuaguaacccuccuaaaguuaaccaacucacuaaaugaaugauuacauaguccucuuccuuuaaaggccugugggugaccuuagguccugcugaucuuauuuauuuuuuugagacggaaucucacuguguugccuagguuggagugcaguggcgccgucucagcucauugcaaccuccgccucccagguucaagcgauuguucugcaucagccucccgagugguugggaucacaggcguuugccaccauacacccagcuacuucuuacuauuuuuaguagagaugggauuucaccaugucggucaggcuggucucagacuccugaccucaaaugaucuugccaccuccgccucccaaagugcugggauuacaggggugagccacugcgccuggucccugccgagcauuuacuacccaugccguucuguuccuucaguuccauugugugcuuaccaaggauuaguagauacaucuugaauuuguuuaugcugguuguacggucauguguugcuuagcaauggagauacauucugagaaguaugucguuaggugaucuuguaguuguaugaacaucucacacaaaccuagguauagccuacugcacacuuaugcuguagccuguugcuccuaggccacaacuguauagagcauguuacaguacugaaugcuguaggugauuguaauacaaugguaaauauuuguguaucuaaacagaaaagguacaguuaaaauacaguauuacagucuuaugggaucacuguuguauaugacaccagucauugaccuaaacuuccuuauguggugcaugauacuuguaacuuugcauuuuaauuaaauagcaagucaguaggcgaaaugauugugagagauuguuucagugaaaacuaaguugaaugcuuuaggaagacuaaauaauagcauguauacuaccuccuaagaaucuagaacuuguucugauugcuuuguauguguuaguuuauguaauucucaccacuccugagguacauaugcuuaucgcuauuugcuagaugagaaaauugagucacaaggagaguagaugguagaauugggauucaaacaguggcaguuugacuccagcauugauuaagcaucuugugaaaaguugcugucaaauuaauggguaagaggaaacuuagccggguguagugguugauucuuguaaucccagcacuuucggaggcugaggcuggcagaucacuugaggccaggaguucgagaccagccuggccaacauggugaaacccugugucuacuaaaaauacaaaaauuagcuggaugugguggugcacuccuguaauaccggcuauuagggaggcugaggcagagacgcuugaaccugggaggcggaaguugcagugagcucagaucgcaccacuccacucuagccugggcagcagagugagacuguguccccccaaccccugcccaagaaaaaaucaacaucaacaaaaaaagaggaaacuaauguauaugagacugcggaaaauaguaaaaaucuugcauaauucuguaguuugcuucuuuuuaaacacuuugcauuuuaaagaagcagacucaaaaucacagugcacugugggugugauugaugccagucacacauucugcuguucaaaaggccaugacucuacaucaaaagauucuaguuaaaauguugcccugaagugaugcucauggggauaguauaagaaacaaaugugcaaagauggguagaugggagguacuggaggccucggaacuucaccuuugugcaguuugucguccauuggcacacaugaacuuuggauuuggccacacguuuugaagauuugugcuuugcuucaaguuuguuuuuuuuuguucgaaacuuaguucccagacagguuuugcaugagaaucacuuggagaauuuuaaaagccaagcucccugucugauuggauuugggagccauguaguagguuugaggaauuguccaaagcucugggugggucuguggcauagcuaggcuugagaacuguuguguuuaucugccgucucggggaauaguucuugaguguguuguguguugacaaucuugaggcggagucucgcucugucgccugggcuggagugcaguggcgcagucucggcuuacuguaaccucugcccccuggguucaagugauucuccugccucagccucccaaguagcugggauuacaggugugcaccaccgugcccaguuaauuuuuguauuuuuguuuuguuuuguuuugagacggagucucgcuuuguugccugagcuagagugcaauggcucgaucuuggcucacugcagccuccaccuccuggguucaagugauucuccugccucagccuucugaguagcugggaccacaggugcccgccaccacgccuggcuaauuuuuuguauuuuuaguagagacagggguuucacuauguuggccaggcuggucucaaacuccugaccucgugauccgccaaccuugugauccgcccgccucggccucccaaagugcugggauuacaggcgugagccacugcgccaggcccugacaaacuaaaaugaucagugugucuuccauuuagaugcagguuggcauucaaauagaggcaauauaugacuggugaauuguaauuucaaaggaaagcaguaauggaucaaacucuugcacuguucucuuucccuugcuuaaaaaaaagucuguucccucugaaucuagcuuuauauagacguuuaaauccuuaaguuuacuugcuaaaaaucaccuggggugcuuguucaacauauucccaggcuucuugcuugaaaguuaaaaaauucagcaauucuaggguuguguccaagaaucuguauguugaacagcaaccucaguugauucuuguacugaggcaaguuugggaauaaggucagugugggacgggguuucgaucuuuucuguucuguucugcugcuuuuuagcuguagaaucuugggcaggagugucugagccuguuucuucaucuuuuaaaauagaguaaggguaguacuugucucuuagggaaggaaguucaaauuaaauaaaaugauacuucuaggcaguggucuuuaacuaguggcagguuuguccccuuccauuacccuggacauuuuugcuugucacucuggggguggggguguuacuggccucuaguggguagaggccagagaugcuccccaacauccaagaguguguaugagacagcuccccacaauaacaaauuauccagccucaggcaucuauaaugccaccacuaggcugggcacggcgguucacgccuguaaucccagcacuuugggaggcugaggugggaucccuugagcuaggaguucgagaccagcuugggcaauuuagggagaugccauuucuacaaaaaauguaaaaauuagccggguguggcaguaugcaccuauagucccagcuauuuggaaggcugaggugggaggauugcuugaguccaagagcuugcggcugcagugagcugugaucacauuacgugcacuccauccugggcaacugagcaagacccuauccaaaaaaaacaaaaacccuaugauugagaaaccgugcuugccuugguaaauguugguuguuaguaauaaaguugagucccuuugcgguuucuucucuggccugauccagggaccccucuuacucccaugacguuaugggcauacguuucacauuuauuauugggauugguaaucagaucuuuuaaucuccuuugaacuuugggaguugcugaaagcaccauauauuuuauaaaagucuaaaguuuauaaccuaaacaauagcuaacuaaagacaagacucacagggcugaaaggaacucuuggucaaauugguccaucuguccuuagggcuuuaauggguguaaauacauugcccgaggugguuaaguauucuuuuguuaaugaauucuggggagaacuccccuuguaacugcuuuucacagcuugguuauuuacaaagacuuuugauuuuaccugaauagaaagcuucuuuugucuuuuguguauuagcacauugccagauccugauuagguagguauuugugaagugccuuaacuaauuuguaccuuaaccaggcuucuugcuagaauacauguuucucuaauguaugccugggugcuaauaguuuggugcuauggaaacuacuuauauuugguuauuggggagcagaaguaguaugcaugaugaggcuaaggugaugccugccuggcuucagcugugaauuuuagaaauacacugauuaaagguaaauuuuuuuuucuguccuuacugcuggauuucuuaaucugggagguacuugauggaauuuagccuuuuuaucccuugaaauuauaagcagcauuuugugugcacuuuuucuuauacauguaccuuuuucugcugucaaaagacaacauuucaacacauugaguauaaagaucuaauuggauuuuauuauugauuaacaaauuagguagcaccccaucuauaaaaaaauaggugcccauugggcaugguggaacaaucgguuuuuauaagguugagcaggaacaggaaaacaacauaguacaaaaauguggguuaacaucagguuacuugagguuauuuuccuuauaaggguuaaagcagagggaacuuccuuaugccagcucacacugucugucuggggauuuggguaucuucuuuccugaagguaagguaaacaauuuagaaguuuaacaugagugacucuauuuugguuuggucuguuagggucuaggagcucgguccaaauuaguggccuuccauagauucuguuuaacacuggaaggaggguccguaguguugcguguguuagggugacugcugagagcacugcugaauccuggggaggggccugcaccuuagaacugaucaguucuacaguguuagaaacagaccucuuuugucagaaauuaagaauucagaaaaguucaaaggauauaauuaaaguuuuuuuuuuuuugagacagagucucgcucuguugcccaggcuggagugcaguggugcgaucucagcucacugcaagcuccgccucccggguucacgccauucugcugccucagccucccgaguagcugggacuacaggcaugugucaccaugcccggcuaacuuuuuguauuuuuaguagagacaguguuucaccguguuagccaggauggucuccaucugaccuugugaucugccugccucggccucccaaagugcugggauuacaggcgugagccaccacgcccggccuaauaaaguuuuaaaauaaaaaaguuagacauagcuagggucacuuuuaugauuuuggcauauaaagaguuggcacuuauaaaauguacaugguuauguaaauauguuuuguguuuuaaaaauuuaauaguuuugaaauuuucuuuuugauauugugaaaggaaaauaaaucucgguaucuccaaauuacuaagccaaagggaaaagucaagcugggaacugugucaggcaaaccugccucccauuuuuuuccuaaauaagauagcuagaaaaauaaaaaugcuacauaccucccuaacaauuugcccacagggaaauuccuuguggacaaagaacucaaagccauccccucuguucaccuaagacaaaugcguaucugauugcuuccucugcccuguuguuuugcuaagccagacugaggcauaaaugacuaugccucuacucucuucucacauggaacuuguguauucagugaaaggcuaaucaagagacuuaaaagaaugcaacuguuugucuauuaucuaccuaugaccuggaagcccccuccccugcuuccaguuguccggccuuuccaggccaaaccagugugcaucuuacacauauugaugucucaugucucccuaaaaugugugaaaaccaagcugugccccaucacccugggcacauaccaucaggaccuccugaggaugugucacgggcacguccuuaaccuuggcaaaauaaacuuucuaaauugauugagcucuguuucagauacuuuugggcucacaguauuuacagacauaauucagcccuaaucuagcugcugcauuuaguugcauagugugaauauuucacauuuuacuuuuacauuuucauaaauggguauauggauuauuuagguuuuguuaugaacagagcucugaauauuuauuugccucguccuauacaaguuugauaauuugucuacguuacaugcccacaaauugaauuacaggauucauacacuuuuuuauuuuuuugaguuggagucucacccuguugcucaggcuggagugcaauggugcaaccucaguucacugcaaccuccaacucccacguucaagcgauucuccuaccuuggccucccgaguaacugggacuacaggcgcgugccaccacgcccagcuaauuuuuguauuuuuaguagagacgggguuucaccaugugguccaggauugucucagucuccugaccuccuaaucugaccaccucggccucccaaauugcugggauuacaggcaugagcuacugcuccuggcugauucguauacauuuuaaggguuacuggcuauucuuacaauuauuuaauacuaagagacucuaauuucugcaaagcagaugagugcaaaauaaccaguuauaauguuucccaaguuaacagagguuuaguuauuuuuaaaaaugaguuuauuggccauuucaguuucuucuccguaauugcguauccauuuucuuugugcaguuuuugguuggauuuuugauagguaauucuucauauguuguguaucuauauacuuuguuauguguacauugaaauuuuguuucccaguccgucugggaaacaaguuacuugucuuuuaaccuuguuuauaguaauaacuuauucugaagaagcacaggacuugaaccaaagguggagaguuuaaagaacuacauccaguauucuuuaccaauaagaaauguguggccaggcgcaguggcucaugccuguaauccuagcacuuugggaggccaaggcgggcagauuaccugagguccggaguucaagaccagccuggccgacauggugaaacccugucucuacuaaaaauacaaaacaauuagccaggugcaguggggcaugccuguaauuccagcuacucuggagacugaggcaggagaaucgcaugaacccuggaggcggagguuacggugagccgagaucacgccacugcacuccagccugggcuacagagcgcgacuuggucucaaaaaacaaacaagcaaaaagaaaaaaaaggugugaccagucagucuucuuugcuuuuccaucuuaagacacauagaagugacugagaaggaauaguuaugcaaugacaucgguuuaauaaucaguucaacugaagaauguauguaaauaagggcagugauaccuaacgcugauaguugauaguguggauugcauaauucagacuguggggugauaucuuacacacgcacauacacacacacacucuugggcuuugucuucuuuauagguaaggauuaggagaauuuugacauaugccugacacaaaagugcuccguaaauauuagcuauuguaucacuggcaggaaguuagccuggaaauaaguuuuauggaauuccaguguagauugcuuugugauuguuuugccagauuuugcuuucacccacaaaaacacuaagcucugccaaccaguucggccauuuuguaaguuagcaaaauaaacacuaaagugaaauggcggcuuuugggcggggcucccacaggcuggcuccuuuuaaguggaauguugcugugcugcccucuuguggccauuugggaaaccgcgauuaaaaauggaacaguaaguguuaauggcacuucguuucaaaguccaguuccaagaagguuaaucacuccguuuuuaccuacuucagaaaguauuuugaagagauaccaaauucuuuuuauccacaagcaaaaggaagugguaaaccuuuuucucaucagcauuuauuuuugauuggaaucugaauucccaguuuugacuuguuuuuuuaucuguguguuguauuuuccuuuuaauuauuuguuaaguaaaaaauuauaaaaguuguuugcaauuuagauguugaauaauuuucagauaguuguuuuucgugaagauucuguauauauguuggauagucauuccugaaaauccaauguuuaauugcccuguaacuaguaagccacugguagucagcuaauuuuauuacuuuguuauuuaggugaaggcuuaaaggacuccacucacuaacucaguuugacccuuucuauuagucuugugggcuuucugccuccucuacuaaaccagcacuaaagcuacagcuuaguacuaauaguauuuacuauuauaauuauuagguauuaauggcaauucuacauagucuuuuaggaaaugucguuuuuuuaagggaauaauaugaauauauauauacguauauauacacauguacgcuauauauacacacauauauacacauauacauauauauacauacacacauauauauacauacauauauauauauauuuuuugagacagaguuuugcuguugaugcuugggcuggagugcaguggugugaucucggcucacugaaacguccaccuccugaguucaagcgauucuccugccucagccuccaaaguagcugggauuacaggugcaugccaccauaccuggcuaauuguuuuuuuaguacaggcuggguuucaccguguuggccaggcuggucuugaacuccugaccucagguguuccacccgccugggccucccagagugcugggauuacaggcuugagccaccaugcucggcccauaauuacacuuuuuuuuuuuuugagacggagucuggcugugucauccaggcuggagugcaguggcacgaucucauuuuccauuuccaguuuauuuagugauuauuccucuuacgagaaguaugaaaauuaaguaaugacuuuguuaaggcuuuuuuuuuucuucuuuaagcaguuccccucauuaguacuuguauucagucuuacaucugauucugguuccaaaaacaauuuaaaaacacuuuuuuuuuuuuggagacggagucuugcuuuguugcccaggcuggagugcaauggcacgauugcggcucacugcaaccucugccuccuggguucaagugauucuucugccucagccucccgaguagcugggacuacaggcacacuaccaugcccagcuaauuuuuuguauuuguaguagagaugggguuucaccguguuagccaggauggucucccaucuccugaccucaugaucuucccaucucagccucccaaaguguugggauuacaggcgugagccaccgcgccuggccuaaaaacacuuuuuaaaaacacucauucaaaucuuugcugguuuuguguagggugggauguacuugccgcccuugguuuggauuuggcucucaugauuagacuuacuuuagacaauuaacuaguuuagacauuaaaaauacuuaagguauauaaugaagugcugugaauucacuauuaagcuucacuacuaaguuucagucauaaaaugucacuaguaucauucccugagagcaucugccucccucaaccccuaaaggcaaauauaguugugaacuugguguuaaucuuuucuuggguuugauuuucauuguuguuauuuuugaaauuacacaaguaauccauggaacucacaaguauacuucaaauaacccaucccuaacagaguaaaccaguguuagcaauguggugauuaaaaugcauuuauacacauagauauaugcugacagaaaaacggcuuuuuuuuuuccccagaagguauuguugugugcauuguuacauuucuaggaaucacucuccuacacaaacucaaaaacacauagcugcacaagaagauacguagaaagaaagauauuuaugguuacagucaacaguuuccaaauacaaauacucuacucagaaauauggaaaguguaucagagauauuugcaacuuauugauuaagugaaaaaucugaaaauaaccuaaauguaccguuaauaggggaauguuauauaaaauguagugaauuuauaguauaaaccaguucaaagggaaugagaugggcauccauauagacauauccugaugcgggcauuggcauuccauuacauccuaucugcagugcuucccacuuuucaacacagaacacuauaaacauuucuaguugggcuguucuaguuaucuucaguaaacuaaugcugccuuuugugggucucuaguugguaaagauuuucagucuuuuuguugcuguuggaguuuucuguuuccuaguaguguguagaccuguugucugugacaguuuuauugguggugauugccaaaacaugauucuauucuuaaacuuuugucuggaguuaaacauuauaguaguugaaaaacuaaauacguuauuucaaaggggaggcaaauugcacauucuagcaaaugaaugugcaauugaauccuucucuaauauaccaggcacaaagaacaucaaaggagauaugcuuaguuugcaaguuuauuggggagguugacaagcggccagauuacucgauaguaugggacaaguggaggcaagguaguguagauguuaacagcugccggagcuuuggagugagucuuucuaggucagcaugugugucauugcuaaaaguauagagagccagcagggcaugguaauugaagcucagacuugagauguggcugccuguuuuccaucucgguggugguaacugcugugacauaugucaguauuguggaaguaucugauagguauugagcuuaggauaggagaccaaaggauguuuucugggagaaggugauaccuaagcccacaaaauuagagagguauuuaauuugcuguguccgcagugggugcaggagcuagaggggagcaaugcuaggucuagagucuggagcagugggggugagggaagaaaugauuaagucaugugccuugagaaauugucagaggccagguuuuauagggcaugcugaaauuggauguuaucagugaccagaagacccggaugccugggaggugaacaagccuucagcugccuuugcuaugggaauacaguuuccagguacugccuugccuaacaucccuuucaaguagacugcccuuucuauuaaauaaaucccuuccuuacuuacaaggaaauucuggagcugucucuguaccugucuguccaugaacaaauaguggaggcaaaacuaauaaauuccagcuagugucauggauugugggguaacgacucacuaauggguguuagcuggggagaauuuuguguuagaaggggaaucucagcuuggaugugauaugcucagauuuccuguuuggguagggcuuuggcauuuauagggcacugcuuucauagcugccauuagauguucuuaugacacuacugguagaugucacauagguugacacaaguuaaaagaugacacaggccugaggugagcuaggacugaaauggaagcugcgaugccagagcccacagcuuuuaaguguuccuaucacuauccagcucuccucuuccuuuuuucuuuccuguugacaaccugccuggucacagguauaaaguaaaugacucagaugcuuuagucaccuggacuagucagcuuggacugugcaagggguuaaggagucaguaauuguaaugaggucuugaaacuguugagucacuuguuacaaggaagccuguuuugggaccuuguguaacagggauaagaguuaauaauguuuucugagucucuaaucuuuuggcccccuaugguaaaauagaaagaaaugagcuuuagauccacacuuggauuggaaucccggccccucacccucuuccucaauuucuaguuuuguccauuggccaaguuacauaaaagaggucaguuuuuuucgucauucauauggugauaauaaugccuaauaguauuguccuugggaauaagcaaaauaauacauauaaaguacuuagccuagugucugauaccuguuaggugaucaggaaguuacaugguuuuucucaucuuuccccacuucccaguauugagaaccuccccucgaccccugcucucccauuuuuucucauugcuuccucaugguaacugaaaggccuccguauuguaaugugcuguggaucgcaugguguuauuugcagcagucccaguuugcaguguacugcccugugcaccucuagaagaugcagugaugguaaauauagaacuuccccuuacccuuucagguuuugugccacgugucuuaucuccuggcuucugaacucagggacuuuucuguuaauguuacuguagguucuggguuuuuccuugccccccucagagcaaagauggguaguuuuuaagcaagaguaaacaguccaccucuugcuguagaguccauccguuugaggucuuuuugcuucagaguaucuuccccucuaccagcaugccccucaguugcuuuuucaccauuagaggaagaugaggauauuguuuucucugugcuugagauugauacucuaucaccccucagucucugugguuucuguuuuguuccuuuagaugacaucuaccuacuuagguugcugcucccuaugggauguuuggaaugaagaagggaagggagauguguggaggccaguagccgucuuuauuggguuggguguucucauuagcaucagagugcccuuuuuguuuacuuacuucuguuaagucuaccacuucuggaucucacugcagauuauaaggcagggccucuggauugaaguuaauguguauaaauuuuuauaaagcuccucagaugagccuaauuugcuccuauuagugagaaccacgauuggauaauugcaaccaguuugcauucuuccucuuugggugagaugcuuuguuuuuuuuguuuuuguuuuuuggagacagggucucacugugacacccaggcuggaguacaguggcguaaucauggcucacugcauccucgacuuccuaggcucaaaugauccucccaccugaguuucccgaguagcugggaucgcaggcaugcaccaucauacccagcuaauuuaaacauuuucuugaagagauggguuuugcauauuguccaggcuggucuugaacuccugggcucaagcaaucuuccugccuaggcuucccaaaguguugggauuauaggcuugagccacuguguccagcuuguuuuuuuuuuuuuuuuuuuucuggagaccaagucucgcucugucucuaggcuggagugcaguggcgugaucuuggcucacuacauccuuugccucccagguucaagcgauccuucugccucagucucccgaguagcuuagacugcaggugugugccaccacagccagcuaauuuuuguauuuuuaauagagaugggguuucaccgugugguccaggaugcucucgaucuccugaccucgugauccgcccgccucggccucccaaagugcugggauuacaggcaugagccaccgcgcccggccugcuugguuugguuuuguucuguguuuuguuuuuuucuuguugagaggggaaugauacuuaacagauaagacuucguggauucauauauaucugguuucaaaucuuacuguguuaacuaggugugagaguuaaauacuuaugagccucaguucagccucauuugaaugaaggggacaguaauauccauguucagaguuucugucaagagccuguccauagaaauaaccuguucuguagcaucauguaaacauucaggaaaggguagcuauuggggauuuugagaaugguagcaauaacguuauuuggaauguaaaaguauaaaugugaauuugaagauuuuggucuuauauuacuaaaauuacuaucugcaaauguuuuaccaugagaauuuuuuuuuaagcagauucaugugucaguucuuaaauauuuuuaaaucucucucucucucaaaauaagucacucagccucugaagaagcuucggguucagacucaggcagucagucggaaagugagcagggaagugauccaggaaguggacauggcagcgagucgaacagcagcucugaaucuucugagagucagucggaaucugagagcgaaucagcagguuccaaaucccagccaguccucccagaagccaaagagaagccagccucuaagaaggaacggauagcugaugugaagaagguaucuacuuugcccugcaguacaaaugugcugcuagccuaggacaagcuagcagaccuuuguuguucaugaaaacucauuaguauaucuugaugaugaaaccuacagccauuuuuucuaguaauauacaguaguauaucugaggauacaaaugaagacuucuuucugcucuauuaaggaaaauaaaugaccugaaccauccaauuauagggaggaaagacaaauuuuuauacgcuugguuuuuaacuuuauuuauuuauuuuugcaacagagucuugcucuguugcccagccuggagugcgcaguggcacgaucuuggcucacugcaaucuccgccucccagguucaagugauucuccugccucagucacccaaguaguugagauuacaggugucugccaccacgcccagcuaauuuuuguauuuuuagcggagacuggguuucaucauguuggccauucuggucuugaacuucugaccucaggugauccaccugccucggccucccaaagugcugggauuauagaccugagccaccaugcccagccuaaaauauauuuuuaagguuaaagugagcaguuccggaaaguuaauaauauguaguuauagguuggauggaccuacaagccagucagaaugauugcacugugccuuugauaaucauuauccuaaaaugagaacuucuaaggaaggcucuugguuuucuauguacaccuccuuuucacaugguagcucucugucccccuccaaaagcuuauuacucauguaagaguacucaguagugaguaacuccacauaguagauuuuucauggaggaguugacuuagauaucggcucucaaaaggacaaauaagaacacaagauaauuuuaggauguaaacauuauaauauaugcuguaauaaagucauaauaguugagcuagaaugccuggcugguaucuugaagugauaaaacuaguugauguaguaacacugaaaugauuuugcccucccaguuaauaagggcuccauaaaaaccuguguugaguaaaaacuuucauagcucuagcagagggccaggugugggcauggauagacaggcuagaguaaagcgcacuuucccuccuuccuuucucugccagguuuuuucagaguguuuuauguuuacugccucuaccuauauuuccuaccauuugguuauuccuaacuccuucuguuuggaccuuuuguccuuuaacuccaaggugaugcuaaggccguuacagaaucuguggacuuuggguuaugugauuacauuggauucuaguuguaaaaugccuauucugggccaucuuuucuuuugaagccuugauuuucuucagcuuacuucaucauuuuuauguuguuguuguuguuguuaaagucauuguugauaauguccuuucuuagugacauuguuggaucauuuuucauaaagaugagacagggucuugcucugucccccaggcuggagugcaguggugcaaucacagcucacugcagccuugaucuucuggguucaagugauccucccaccucagccucccaaguagcugggacuacaggcacguauugacacaccugucuaauuuuuaaauuuuguuguagagacaggaucucccuacguagcccaggcugaucuugagcuccugaacucaagccauucuucugccuggaccucccaggguggugggauuacaugccuggcccuacacuuuuaaauacaaacauuucacaagucucagcuaguggcuucuuuugugcauguucugaaccuuacuuuuccaaauauucucaugacguuagcugucaccuguaauuugauaacccauauuucucaucucagcuuuugcuacuugcuuaauuucuguuacaccuuuucaugucaguguuccacaauccauucaaauuccuuuugcuuaugugugauucuguuaaaagaauacagaauauacuuaguaguaguuaucucuggggaagaaagugaaaaugauuuuucuccucaacuaaucugucuuuuaaacuuuuuaaaucacuggugaggauuguuacaggucuuaaagguuguuacaggucuacaaaaaucaggucuuaaaggcaaagggcuaauuacugcuacagaauaaaaaauagauguguuagagaaaggguggcagugguucucauucugagaacuucuagcuaaguguuagcaaugccucaucugcguuuaucugggauguuacaugaccugaggaacuuaaagaaaaauacaaauuccugauucuuacuuaauuagacuuaaugggggcuuugccgcuuguauuuucaguuucacagguguggguuagugcagucaagacugaaacucaaagcaguagggaauuuaaaauguaucaguaaauacuuugucuuuaguggaagcagccgcugucuuaccuuucuguauuauucagcuguauauuuuaaugauggguaagcgguguaccauauagauuuauagcuguuaaguaaugaagacauuguuaaacuaauauuuccuaggauaauaugccuauuuuaaaaaaaauggcgcuuuauugucucauaaauagaacuagcaaaacaacccuuuugauacuugguuacuugaauucucuucaauugcaauaaacguuugauaauaauaaugggggucaagaaaaaagauuaaugcguggucucuuaauuuuacagaugugggaagaauauccugauguuuauggggucaggcggucaaaccgaagcagacaagaaccaucgcgauuuaauauuaaggaagagguaaggaaaaaauguuuuaagggcaugcauuuaaacucccuaucuuacuucauucuuucugacucugguauguauuaccauuaaaaagacugaacuucaggcaugaggguuaagugacucuaauaugagcuaucuaugaccagauacaguaaggcaagaaguuaauaaucaaauaaaagaaucuaaccagaaagaucauauaauagugaauuuuuuaguagaguauuauacagaacugaccucaaaaugguuuauuuuuuaaguugucucucauagugaaaauugauuauauauagcaagaaguuuaccuuuuuaagccccuaacuucuaaaucuccuagauauuuauuaaauggguaacuuguuugguaaacaaacagagcaauagaaauaguuugggauuuauuccugaaagaggagggagugcuuaauuaauguaucuacuuuuauuuaacuucuuaaauuugguuuccuugcucauuuuuagugugagauauaauaaaaugaguuucaaacauacuuacucuaauugugagagauugaucagugauuuuuuuaaauugguauucuauaccaggcuugguugucuauagaaucagacuucuuucaccuuucucauuuugugugauauuuuuguggauucuuauucugaauuagguuuauagacuagauccugaagagagauucuuuugucucaaugaaaugucuacuuucugcuuucuugggaggacuuugcuagucuuagcuauauaacguacuucugaugaaaguuaaauauugauagccacaggucagugaguuggguguggguuuuuaaauaaauguaccuuaaaaaucuaauucacccuaacaucugcauuacauuugugauguuuuauuuugagugaccucugagcuguuuugccuuugcuuuuguuuuccauagugucucgcacuagguuacugagccauguuuguuaaaaccaaucacauaguuguagaaaucuuucccucuuuuacauauuaauuaacacauucucuguaggguacaagauuaacagcaauaggaauaguuugccauuuuccuuaauuguggagagaaagagcuacugaaaugucugugacuguaagcuuuccuuggccuagugcuguuagcagagcacuguuggcucaugagugaacauacucuuaaaugagucuaaaaugaauacaucaguaguuggugccuuuaaggcacacugacuaaauguuguggcauuuuuauuugauagucucaaucugcaguauccaguaugguccccacuacucacauguggcuuuuaaaauucgcauuaguuaaaaauaaaacuuccauuucucagucacaccagucacauuuuaagcgcuugguagucacauguggcugauggguacuguauuggacauuguagauacaggacauuuacaucguugcagaaaguuauuggauauugcuguucuggaagucaagcugagauaaauauuuccuggcuuuagagauaacucagugauagcagagagauauuaauuuucaaaucaaaagaagagggaguuccaccaagcaagugcuuagguuucuuugugucuaaaagcucauauugaauaaugguauauugaguagacuguugauccaggagauaguguugucccgaagaacugugaauuaaagucuguaaucauuuuuccccccucacacacugaaggcaaguagcgggucugagagugggagcccaaaaagaagaggccagaggcagcugaaaaaacaguaagucuuucaugggggaaauuauucaaucuaguaguuucaaacuugucagcauuucuaggacugccuucguugugucuuuagucuacuccaggucccuuagucugcuucugucucucuuacuagcucgggugacugucuaccuugaccuguugcaauagcagcagcagcauuggaaacucaagauucucaguuuaacacauggaagggguccacguauacucgagcuuuugcuugggauaaaucucagcuucuuccaucggguuaacccaauuagcccauugauuuuuuucagaaaaauauguauaaauaacaaguacacagguauuugguauuguaguaagcaaggaacaaauguagauuugcuauuuuuauggcaaaauuauauuggcugaacauccauuuugguaagaaauuacauauuguuguuucuguauaauuuuaauguugcaguucauaagccagaaaaauuuaauuuguggacuuaauguggaguuucuuuauaacauagauuuauauguugauuuuuuaauuuaaaaaguucgauuuauaugauaugaaauuauuugauuuuuuuugagaaauaauuuuuaaagucauuuuuuggagaggguguggaucccguugacaaucugaauucuauagcuucucucaaaaauguagauauucaaaacuuuguauaccaguucagggguucucauguuaaacaguuguccauggcuucuauuaagagcucuagguacauaugcucuguuguaaaauauuauuacucuuuaguaaguggccuaaggcaagucauuugagauuuuaaaacccauuuccucaucuccaaaaaaaaaaauaauaccaucuacccaacaggauuauuagaaacuaugcuaagauuuugugacauuaaauaaauguaggguauuacagagccuuacagaaaaguacuuaauuuugcccugcuagagcgcauucaguuuucauuuguguuuuggagaaauaguaacuguaagcaaaccugcacuuggcaucuuagaaggcuuuuguucugccccagucuccuggucugcuugggagacuauuaucugcuuacuggucuaauggccuuuugaguaucuuuccugaaauguccaccuugauuacacccugggaaauccaugcauguaaucauuacuucaccaucuggcuacauuccuuuggucucuugacugcaaguuaaauggugcuaugcuugaauucuugacuuccuauuuuaauggccuuauuugugugugcagaagccagcguuuuuuucagucacuguauaauacauugcgcuuacucugguuacuggcucauagucuugucagccuuuuuguuuuguuuuguuuugagacagggucucacucuguugcucaggcuggagugcaguggcuugaucucagcucacugcagccuuggcuugcuggacuuaauugacccaccuaagccacucgaguagcugggacuacaggcaugugcuaucaugcccagcuaaguuuuuaaaaauuuauuguauagauggggucucacuauguuucucaggcugguuucaaccuccugagcucaagcaguccuccagccucggucuccuaggauuacaggugugagccacugugccccgccacuuaucagucuuaagaauuccccaaaguuggcaaccuucaguagcauauauggaccuuucuuuuccugaguagaaccucuuaguuccuugcagagugggaucugucuucuuuuucauauugcuucccuacccuagggcuguucauaggaacugccuugggcugagauaguuccccucauguuccuguguuugggcacugggcuagccuucguuucugcuauucucuggccagcuggugaguauuguggauuuacagagagcucuucuccugagucaccaguugagauuccugaaagauuaauuaggggaggucuuguagcugcugacacucaaguugcaaggcacuuuaggagccuucugugauccaagcugagcaaguguaacauaaccuaauguguggucacaugcauuucagaauucagacucacucagagagugaaagguuugaaauauuggcacaaagaaaugcuuuucugaaacccugcagauuuuauucacacauuuuagaguuuuuaaaaagggaccauuuuguaaaauugguuuaaaaaaauuaauuccaaacuuuaggaaaguugcaagaauaaaagugcaguacaaaggacaccuuauauacuuuacccagauuaccauuuuuccuccauuugcuuuauuauuaugggugcuguuuauuuaagagagagggucuugcucugucaccuaggcuagagugcaguggugcaaccuuggcucucugcagccucaaucuccugagcucaagugauccuccuaccucagccucccaaguagcugggacgacaggcgugcaccaccaugccugauuuuguauuuuuguagacauagaggucucacuacguugcccuggcuguucucaaacuccuggccucaaguuauccucucaccuugcucuccaaaaguguugggauuagcauacgugagccacugcacccagccuguguauauuuauauauauacaaacauaauguuuuuuaugaacuauuugagacuaaaauucauaaaauuuuaccuuuuaucccuuuaccuuaaauauguaagguguauuucuuaaaaauaaggauuuucucuuuuauaagcacaguacaguacagauucaacuuagauuuaaaacauugcugacguacuuuuuuuuuuuuuuuuuugagacgcagucuggcuuugucgccaggcugggguacaguggcgcaaucucggcucacugcagccuccgccuccgggguucaagcaauucuccugccuuagccucccgaguagcugggacuacaggcgugcgccaccacguccagcuaauuuuuucuauuuuuaauagagacgggguuucaccauguuggccaggauggucucagucucuugaccucguuaucagccugucuuggccucccagagugcugggauugcaggcuugagccaccgcaccuggcugcugauguacuuuugucugauucauauuucaguuuugucaauuaacccaauaaagucuuucauaauauuuuuccaucucuacuacaggaucuaguuuagggucaguuacauacaauuaguugcacaucuuuuuuuuuuuuuuuaauuguacuuuaaguucuaggguguaugugcacaaugugcagguuuguuacauauguauacaugugucauguuggugugcugcacccguuaacucgucauuuacauuagguauaucuccuaaugcugacccuucccccucccccccaccccaugacaggccacagugugugauguuccccacccuguguccaaguguucucauuguucaauucccaccuaugagugagaacgugcgguguuugguuuucuguccuugcgauaguuugcucagaaugaugguuucuagcuucauccauguccuuacaaaggacaugucugauuucuuuaauugggagcacuuucacagccuucuuuugcuuuuaggacauugauguuuuugaagaaugcagucuugcaagggacuguguucuuugcagaauuacgaagagaccaauuaccccgucacgauuuguauuagguuuuuauuuuuugggauggacucucgcucugucgcccaggcuggaguacgauggcgcaaucucagcucacugugacucaagugauucuccugccucauccuccugaguagcugggauuacaggcaugcgccacugugcccagcugauuuuuguauuuuuaauagacaugggguuucaccauguugcccaggcuggucuugaacuccugaccucaggugauccacccgccucagccucccuaagugcugggcuuauaagaugagccaccgcgcccggccccuuuuuuuuuuuuuuuuuaaguuaaagagacagggucuuccucuauuggugcacauguguggccauagcucacugcaaccuugaacuccugagcucaagugauccucuugcuucagucuccccaguagcugggacuguaggcacguacaaccacauccagcuguauucauacuuuuaaagcuuagaagaaguuauacagcacaauggaccugcacaauauuuaaaauauuuuuaaauuaguuagcaucauuuaauugagagugcauaacaaucuguguuuuuagcuucuuuugagaaaauuugguaaugcuggcuuauguaacagugauggaccaggaguucuccauuuugccuuguuugcaguucucaucuggccccugugaguauuugagauuguaaucucugacuuagagucauacaaacaaacaaaacauugaacuuuuuuuaaccaacucagaugcuguuuugauuaaacucuuuuuuucaugcauuaccucuuaauguuauccaaauugcgcaguguuguauaagauuuuuguugacuucugguccuggugguuuuguuuuguuuuuguuuuugagacggcguuuuauucuuaccaggugggagugcagugcaguagcacauucacagcucacugcagcuuugaccuccugggcucaagugauucucccaccuuagccuccugaguaguugggacugcaggcgcacaccaccacaccaagcuaauuucuuaauuuuuuguaaaggcugggucucacucugaugcccaggcuggccuugaacuccuugguucaagccauccucccaccauggccucccaaaguguugggauuacaggcaugagccacugugcccggcccuuuuccaguguuuugaauuggagauugucacauaccuguaacacaguggaagggaaucccuauuagccucagauuucuguugaucauuggaauuuuuuuuucaaaagcaugcuuucuuggggaaaucuacugaagacugaggaaacaaaaguagcuacuucccucuuccagaugucuucuaaguggaggaaaaaggaguuuucuuuuuuacagacaguuaauagcaagccuuaccaacucuuggucaaaguucuggcucauuauauuuaaaaguagcuuuuguucauuuccuacuuuacaguugauuagauuugauuugucugucuuaggauuugugucuagccaaccaccuuuucccaauaaaggaagaaaacuauacacauuuaaauugcauuuugacuuuuuccaugucuauuuacauugccuuggggccucuuggcuaaaucuugguauuuuucucccuaguucucaaaauuucgggaaaaauuuaguugaauuauguguuuuuacaguaucuaggggggacucuguuaauggccucuaaagcuggauauuguaaguuuccuuugauagacauuuuuugcucacgaucucauaucuuaaacuauucuuuauuguagacugacuuacaauguauggcuuagugguggagucuugauaagauuugcauuuuauaagaggccaguaauguaggagaggacagcaguuucacaugugggagagccuuauacaucuguaggguugggaaguaauuucuuuguaacagcucagucacuuuuuucacuucacccauucuucacagugacuuaguauugcugguccuuacuaucuuuuuucucguucuugaaaaugaaaagaaaacgugaaagaauccaaccaauuucaaauauacauacacacacacuuaggccuuuuaaaccuugaguuuuucaaauacucccaggacguguaagccuggcuuuaauguuuccugauucuuugguccucagugaguuaugauugaaaguagcagggcugaggguuggugauauggccaagcaacucauuuccucacugcacuucaguuuccuucucugggaggagaacuuuggacuaguugauuugcuaaguuuuuuuuuucuuucuuucuuucuuuuuuuuuuuuuugagaacagagucucgcuuugucaccuaggcuggagugcaguggcccgaucucggcccacuguaagcuccaccucccggguucacgccauucuccugccucagccuccagaguagcugggacuacgggcgcccgccaccacgccuggcuaauuguuuuguauuuuuaguagauacgggguuucaccacguuagccaggauggucucaaucuacugaccucgugauccgcccgccucggccucccaaagugcugggauuacaggcgugagccaccgcgcccgaccuuuuuugcauucuuauauugggagauucuaaguccuccugguuguucauaagucuguaaaucuguaaucuaacuggaaaacucuagccucaacacauccauucucuguguuugcugucugcuauacuuauagaaguggaccucauugguggcccugguuuagguucucaauuccugggggagauaugguaauuagaauuuauuggugaaucuuucuuaucugaaggacuagcuguucauauuccuucaagcaugcuucuacuucucuccaguuugacuguguaagcccccucugagggguaaacuguuguggacuuggucugagggagacugcagacucaugcuggucucccacuuacuguaaacaucuuccuuucuuccuuccuggugaucaccuuauauuccuuggauucuuagcaaacauuuauuguacuaugcuccggggaagcagaauuagaccaguguccagaguguauauacgaaggucuuuguuuuaaagagacugaaggauauuaggcaauacuaacaggccuuucugucuuaccagaagcaccccuacccgucugacugauagacuaauugcgcauucuuucauugauuuuuuuuuuuuuaaccuaacaaagaaacaucuccauuugccugacuuuggcuaaacucugguacaaagacgaacaaaaagucuugguguacaaggacccaucuacuggggaaaugcauauggaaacacgcagugcuaguagaaguugaauaauauucauaaaauugcuccacugaccguccguggaaggccugaauuguuguuuuuucccccuaaggucuccaccaauucagguuuagggugaccguuguagcuuuuaggaagguucucaaucugcacaucagccaccuccuuucaauaagcuuucaccauuacuugaccuguucucccaugaagaauauugauuugacauuugucuuguuguagcuguugucuuuaguaugaccucauucccuauaaagugacccauaggcaaauugguaauuguuugauuuacagagaagccccaggcacuugccugucaguuuuuuccuagguauuucaugccuagcagcuauuacauguuucuucccucuucucuguaggugagaaaugaguggggucccugcaauaucuuguuggauuuucaaguaaacuaaaacuguuugggauaguaggacgccuguagguuauggcucuuucaagccuucuaagaauucaaggagcaaaggaacaucuacuguaucuaauaauuauuaaaaacuacaucuuuagcugaacagauuaguuauaugauagguuuauuguugaaaaauaauuuuagggacuguuuccuuaaauguauucuagagacuuaaaauaucuaguauagugguucucagaguuucuacccaguaucagcauuacuugaauuuguugaaauucauauuuuuuaggccucaacugagaccuacugcaucaggagcucugacuagggcccagaaaucuuuuuuuuuuugauggaggaggggcagauaggggcaggguuucacucuuaaccgccuaggguggaguacaguggcaaaaucacagcugacugcaaccucaaacuccuggguucaagugauccuuccgccuccucagccuccuuaguaacuaggacuguagacaugcuccaccaggccuggcucaauuuuaaaauuuuaacuuuaauuuuucuggagaggugucuuguauugcucagcuuggucuugagcuccuggacucaagugaaacucccaccuuggccucccaaagugcugagauuacaggcauggaccaucucacuuggcccagaaaucuuuuuuaacaagcccuuuaggugguccugauaacauuuuaaaauuuuggaagcacugaucuugugcauguuaugguuucaaucuugucaauaagaguaguaaaugaaaaaaguacauauauauccauuuuuauuuauuuuuguuacuggagauaaaauaggaaucgauauuauguaguccaggaaggaucacaauucaaguuuaaauggagcuagaaucucuuuuagcaugucuaaaaugugcauguucugcccuuuggauaguaaaauugaaauugguuuugucggauuauuuaucuugaaggauucuuuuagaaaaaaauuacuuuguuuugcuuuugaucacagagaaaaauggaaacaggaacccucagaagaugaacaggaacaaggcaccagugcagagagugagccagaacaaaaaaaaguaaaagccagaagaccuguccccagaaggugcacuguuugcuuaagaucucuacuugggaugagcuuaaucugcuguagauugggaaggauaaugucgugcugaaaugagagcuuuaaugagaugcauuguguuuugauucugcguuuuagauaucugugguucacuuucagccagccuacauugcaggucuuacugcuucuuucuucgcagacuggcuaucguggggcaaacaugucuuccgcuuuuaguaaaacuccuuauauguuuggccaggguacagucucuuuuugggagaacaaauuguuuaaaacacuguuugccuggcuuaaagcauacuugagugguuuauuaccuuguucauaaaaucuauauaacauuaaacaaauaaucugauuguguagagaaggagguaggcugaaauagcagcaaauuaugcuaauuuuugauaagacagauggcagccuaagauagugaugacaggaaaagggagucagaagacaggccccagggaaaauuaccuccuuguaguauugcuuagaauggacucagcaaacuaugcccuuugggccaaauuucauccaccaccuauuuucauauggccugugagcuaagaauaguuuuuauagaugaacauuucuaauuuacaguuuaaggauagagagcacuaaauuugaacuccaauuaagugaaauguuauccccucaaaaacaauucuguucucauuaguagauauauauugcaguaaauguaccugauuauuucauuuugaauuauuuaaaaaaauuugugaaaauuuauuuucuuucauuauguaaggaccuauacauugguccccauuuugccucuuggcuggcagagccuaaaauauuuacucucuggccauuuacagaaaaaguuugccaaccucuggccuaggacauuguacuuaccccccaacaccagcaggggaauuugucaacugaauuuuaucuuauuuuaucucagcuuaauaaguuuaucucagaacugucacgccaguucugucuuuuagaauuuugcucauuauuuauuacaucguugaucaucuguuuagguuugguuaugagaaagguaugggagguaugagagaaagagauaauaaaugugaucaugaguauccauuucucucccucucugacuucuuucaccuuuuuaucacugauggaauauuuggggauuuccuuaggugagcuucuagacuguggcuuucaauccuggccaucucccuggucuguccaaguuaauucugugauagggcacacagucucucagguaguauuccagguauauuuuauacacauacaguaaaaacuuauguauaguuacuucuugugcuuuacuuucuucacacagauaauagcauccucugcugcuuguucuguagguuucuuuauccuggaaauccuuucguauuaguauacaaaaaacucuuuuuuuuuuucuaugaguacaugguacuguuuaguuuccaguugaagaauauuuagaguuuucuuaauguuuuguuguugcaaauaaugcuauagugaauacuuuauuaugccuguuuagguguauaucaauaggauuaauuccuacaaguaaaacuguuaauuccuacaaguaaaauaguuugauagcuauuuccaguuugcccaccaaagagauacuaucaugaacaacaugcuguguauguguuuuuauaucagguaauccugaugaacauuugugaaacauucacguucuuucccauaaaugauugaggauuaucagcauuagaaugaccuuccuguuggaaauccagauuucuagugaauuagaauuucagggaguagggcccaagaauaugcauguuuaacauuccccaagugaaauguuacauucugauguaugaaccacugcucugggaaauacuguuauauaaaguagacaccaaaugauaaagugaagacuuagccuuuuguuucucuucucauuuuagaacagugcccaaaccucguguuaaaaagcagccgaagacucagcguggaaagagaaaaaagcaagauucuucugaugaggaugaugaugaugacgaagcucccaaaaggcagacucgucgaagagcggcuaaaaacguuagguaaguuguaccccagaaguguuucacuggugugaugugauaaaguaguugguuagauuuugguucucauaaguccgggguugugcacuuaauagauaaaaauaacagccuauguccugaaguuguuuucagaaaucugguuagcuuucuugcaaaaagagugguauugagccaaggggaauaggaaaagaguagcaauagcucauuugaagccuucauuccuaaaaaacaccacaaguucguguccuguccaauggugacuuaguggcauuaucuucauuucauaacauuuuuuuccauuaaagauauuuggauuauauuccuacuucugaauugcucuuugaaucacagacguuuuucugagguucagcuuaacguauugcuacuugaaucugauuuuaucaaguacuaauaggauaugaagcauuaauaggaauuaucauuagugaaauaggccaggcucaguggcucaugccuguaauuccaacacuuugggaggccgaggcaggcagauugcuugagcccagggguuugagaccagccuagacaacagggcgagacccugucucuacaaaaaauaagaaaaagccgagugugguggcggcaugcaccugcagucccagcuacuugggaggcugaggugggagaauccugggagauggagguugcagugaguugagaucacgccacugcacuccacuccaggcaaaaaagcuagauccugucucaaaaagaaaaaggaaaaugaaauaaaggaacagauauaugcaaacacuaguaguuuacuuuauagaaaucaaguauuuuuuuuuuuagauuuuacagauuuguucuucauagagauggugaaaaugaauccuagagauauucauaacuuauucaauguauccaguuaauaauuccaaagcuaggacugggcuuugaguaugcuaguguauagccuagcacuuuuucuuacuguaacuguacuacauccaggauuguuuuucuuucuugugacucaaucauucauuguuaauaugugauaggaaguuacauauauaaaaauauauauaaaaaauauaaaaaauauauaaauauauaaauaaauauaaauauauauaaauauuauaaauauauaaaaauauauauaaauauauaaauauauaaaaauauacauauaaauauauauaaaaauauauauaaauauauauauaaauauacauauaaauauauauaaaauauauauaaauauaaauauauauaaauauaaauauaaauauaaauauauauauaaauauauauauauaauuuuuuuuuuugagacggagucuugcuguguugcccaggcuagagugcaguggcgcgaucuuggaucacugcaaccucugccucccggauucaagugauucugcugccucagccuccagaguagcugggauuacaggcgcccaccaugccggcuaauuuuuguauuuuuaaucgauacggucaccauguuggccaggcugguuucuaacuccugaccucgugauucaccugugucagccucccaaagugcugggauuacaggugugagccuccgcgccuagccaauauguuucuuuuuuuaaaccaggaaguauuuguguugaagcuuccagcagucugggaauacuuaaauuucauauucuuauuacugggagacaacauacaggguugacauuuuuaauuuuagaaauauugcuucucuuuuugccugaugaaauaguagcaaauuuuuucuuccauuaugguuuuucuuuuuuugugugguagucuacuuguuuacauaauaaucugauacuaaaaaaugaaaaaaauagaaguguccuuauaguuuucuauaucuugcuuauacaaaucaguauaaauauagaauuuuuauuuucaaauugaguuagacucccuacaguuguuuaggagcauucaucagcacuuuaggaaaaaaaaguaagcuuugagccuacuguaaauggcagaucuauaaaacaacaugcuuuuggaaccaaaaggguaugguuucuuauucuagugacgguuauguguggcaguuuaauucugaagagaucauuucucauuuauucagcauuauuccucuugcaguuacaaagaagaugaugacuuugagacugacucagaugaucucauugaaaugacuggagaaggaguugaugaacagcaagauaauagugaaacuauugaaaaggucuuagauucaagacugggaaagaaaggagguauguguauuuggggagcaaauuacauuuuauguaugcuuaguaagacuuagauuuuagguauuuuaacucuaaugugaugaauuuuagucuacugcuguauuuguugugauauguagaagucuuucugacccaguguuucagagcugaggacaaagguauguguacacuaugucuuuaagauuuuaaauuaagcuaguauagauaagugucaauguuuuauaaagcagugauauagcagagauaccugcuaauuaacauuaagcaaauccaccuuugguuauuuguuucuuaagcuccuugugaaaauaucaaacugguuaaauaaauauugugguaauauugaagauuuuuaaauaucuaauuuagauaucucauaacuaaguugcauuaaaguaaacuuucuguaaaggaaauaccaaaauaauacuuaaugcuuuuucuuuuggcuuuuuuuuuuuuuucuuuuuuucauucuggcuucgauugagguuaagaaaguuaaccggggacuucgaguaggggagguuggaggaggauauuuugguguucuauccuuagucuuggagagagggauuuguuuuccgaguuaguaagggaccaaaacaaaaggauguugcugcucuguuuuuauuguuuuugaauaagggauuucuuugauuucaccugcaaauuuaggaauauguaaaaagugguuuacauuuuuaaaauacuugaaauuuuugauugaguccguucuguguuguuugugaguuuguacuuauuucaaguugaaguauuuuggugcuucauccacaaagggagucuucagauaauugcauucuugggaagcuuuuuaauaucugguguaauauacucucuuucaaguguacuuaauccuuuugcagccacuggagcaucuacuacuguauaugcgauugaagcuaauggcgacccuaguggugacuuugacacugaaaaggaugaaggugaaauccaguaccucaucaaguggaaggguuggucuuacauccacagcacaugggagagugaagaauccuuacagcaacagaaagugaagggccuaaaaaaacuagagaacuucaagaaaaaagaggacgaaaucaaacaaugguauauuuuccaucauggauuaaagaaauguauuugcagccugaaagaagggaagguuuuaaaauaaugcauggagaucacagcuaucuagaaucucagauuuugcuuugaucaucuaaacauggagccauuuacaauucuauuuuauaagauugugaccuucagauacuauauuuuuauauguggcuaccaaguuuuuggaguuaacuagcuuauggagcguuauucacacauucuuuaguuuucacaauaagugcaugagauuuguacuguuauuacccauuuuguagauggggagaauacggcacacagcaauucugcaaguggacucagguuuugaauucugaugcccugaauccagagcuuauucucuuaagcaccuuguuauuuuccuguaguuaggcugggguggcuuagauguagagaguuaauauucuggaacucucuggguuaugauauacuuaaaacaaauucugguuuuauacaauuugcagaaaugaugugaaggaaauuauuagguuaacuacugaaacugugauaguccucguguguuuaguuuacuuacagccuugaaugucuggguguuguauaugggaaauauguggagcuauagcacacaaaaaccuaaacuggguaauaaugguaucaagcucagccugaagacauaccugucuguguggugugauuagccuauuuuugugucuggaaugugcauagauuuuugugucuggaauguggacaguaauucugguuuuacuacugugcaaaaugugcuacuuuaguaaauuacauguuuuuucuuugacucaaaacugaaaauauguaccccuuagauggugagguaggcuuguaaagcaguuagaaauuugaaauccucugaaauauaauaauucuaauauuaaguugcugcuguugucaucugaaagguuuugguaauaagaauaacuaguuuuccaagucauguuuaaucaauccuaaaacccauauauauauaagaaaaggcguacaguuuuauuauccugauuuguugagauguaugaauuugccacaugaaucuaucacauaaaagaguuauuuuugggucucuuuuuagacaggacacaucagaggcagguaacugguauauccuucuaugaguguaagguuuucaguguucucuaaaaguguuuuuuuuguuuguuuguuuuguuuuguaaaaucucuggcguaauuacuaguaaagauuacuuaaggggcagaugggaguaaaaaauagguuuucuuuuccaccuuugacuuuugcuuugauguauguggauccccagacuuuaguuuauguguacuuuuucugucugucugccauucagguuagggaaaguuucuccugaagauguagaauauuucaauugccaacaggagcuggcuucagaguugaauaaacaguaucagauaguagaaagaguaauagguaaguacaugguaacucacuucagccauauuugaacuugaggaauaguggcuuuugcuuuuggaaguaauguaaauuuuaaaaaugcacuuuggagacuagacacgugcuagguuuauuuuaaaggaaaagcuaagaagauuugcugguaaauuuggaugugggggaugagagaaagagguguuaaguaugaccucaagauuuguggccuaaacauguagaaguuuagagguaccauuuaccgaaguggaaagaugaagggaagagcugaucauuggaguggagaccaagagcuuaguuugauauuuguaaguuugauuuacuucuuagucaucuaaguggagaauauagugaaggcuggagcauaugugaaccuggagcuuaggacucuuuagucugggcuggagauuuaaauuuggaaauuuaucaguauuuaguauuuaaaggccaagauugaacaggaccaucagaaauagaguaucacgugguaagaagaaguagucugagagcauuucagcuuuuggaagucagaaagaagcuagcaaaggagacugagaaagaacagucggugagacaggaggagagcugagagagagugguguacuggaagccaagugauucacauagccaggagagaggaaaugcugucagucaaggacgauuaggacugagacuugaucugugaauuuggcacuggcaaaacgcauccauggaguggugagggugcggccugauuaggguagguucaagagaaaaugagaggggauagcaaguauaaacaacucguugggggaguuuucuuacaaaggggaacagagaaguggagugucagccugagagagagaugagaaaaagaauuuuuuucuucuucuucuucuucuuuuuuuuuuuuuugagauggugucuugcucuguugcccaggcuggagugcaguggcgugaucucagcucacugcaaccucugccucccggguucaagugauucuccugccucagccuucccaguagcugggauuacaggcaccccccacccccaccacgcccggcuaauuucuauauuuuuaguagagacagaguuucaccauguuggccagguuggucuugaacugcuggccucaagcaaucugccugccuuggccucccaaagugcugggauuacaggcgugagccacuauaaucccauuuuuuuuuuuucuuuuuuaaggugugagguaguagaauauauuuacauuuuauucauagaacccaaaaucuuucauucuucauuguguuuauaacuuuucugucuuauuuuuuauuuguuuagcugugaagacaaguaaaucuacauugggucaaacagauuuuccagguaagcaagaaauuuuauuuauaaauguucuucaacauuucagaacaguguauguuuugcagauuauuuuguuuugccacaugauguuuuauugauuaugcauaaaacagaaugucauuuuucacuuuuaauugacaguugcuaaucuauaaauuuuuuuuauaugaaauagcucauagucggaagccggcacccucaaaugagcccgaauaucuauguaaauggaugggacuccccuauucagaguguagcugggaagaugaagcccucauuggaaagaaauuccagaauugcauugacagcuuccacaguaggaacaacucaaaaaccaucccaacaagagaaugcaagguauggugaugguuggcuuuuguuuuuucagggagaagauauacugauaaagaggauuggacacauaugugcugagaaaauauuacaaaaugaaaugaugauugccauuuugaagugaaagaaggugauuuaaauaugacauuaaagcaaaaggagagaaugaauuauuucauggcuuugcugacuuguuuaaucuugcaauuuacauaauuagaaauagagauauuugagagaauacuugaaaggauuuaggcacuuuuauuuuauuuuauuuuauuauuuuauuuugagacagaguuucgcugugucgcccaggcuggagugcacuggcacuaucuuggcuaacugcaaccucugccuccuggguuuaagugauucuccugccucagccuccugagcagcugggauuacaggcacgcaccaccacuuccagcuaauuuuuuguauuuuuagcagagaugggguuucaccauguuggucaggcuggucucaaacuccugaccucaaaugauccacccaccuuggccucccaaagugcugggauuacaggcgugagccaccaugcccaguugcauuuaggcacuuuaaaagagaagugaagccaguugcaguggcucacaccugugguuccagcuacuugggaggcugaggcggcaggauugcuugagcacaggaguuugaggccaaccuggggaagauugugauacccguucucuaaaaaaaaaaaaaaauagagagcgggaagugauagaaaaggcgagugucuuugaauucuaaguuagaaauuaaauauauaggcuuauuugcuagauuggcugaauaaauccuuuccuuggaauuuauuccaucaggaaacugaugugcuuggguccucaguaaugaaauaucagacaagugauacgucucugagaaguugacauucauguuaauggcacuagaauucuaucugugaaaaccaguauuuaauugccaaagagugugauagggaaaauguggucagagaagcaccaauguagaagucucugagcuccaguggucauugaauggguuuuaagaggaaguugugguuguugaacugcaucuggcccuuguauaauggauuggugcugcuggcuauacagacaagagggggcccaggguauugcccuccugugaaagguaucaagagaaagauucuuauaguucaauaggagaacuacuagaccccaggggugaggagaagaggaaugauguugacaaguacaucaaggucaaagugugugugucuuggcuaccucgaaggguauuuugacuuuaucuccuagguauucguacagcugaguacaguggcauuaugaaauaguuuuauuuagaaagcuucauguaauagcaguauauaggagacucuggaguaaguaauuauuaaagccagaagguccagccaguaagaugucauugaaguccacgaaugaagaaguagugugaggacaagggaaguaacaguggcguggaaggaguggaugggagaacaguuaugggguagguuugguaggaguggauggauggcuggguuuuggaguugagaguaagcagucggauuccauucacugccagccgcccucauagagaacugaacacaucaauaaccuuaucaaauauucuuauuagaaugauacuucucauaaugugugcuauagagcacuaaucuucagagaaaaguccccugaaaaaagacuuuuuggccauguaacuuugagauacaucccugaaugaauuucuccuguaaauucacgcuauggacacacauuucagacuuugaaaagucaugaguaaagaaauuguauaacuuuuugaucgguuguuuccuaaacugauuuggccacagaauccacauuuuaugcaaaccauagagacugaccucacuagaaugcuauccuuuaagcuucugggggugaaaacaaccuucccuucagaagcuuguuucugaagggaaaaccaaauucacgcaauuaaaggguuuaagguagaugggcggcauuucugaauuuacaaauccuguuauggugaagaucaacuguauuuagcauaugacagcuggaggcaauguuuuguacucuuuagaaucagauaacagaaagauaguuguuucugaaaaauaggagacucugacugccauauaauagacaagaccuaaagugcuauuuaaugauguucauagauuuauuucaggaaaggggcaaguuaacuaaaaauauuuuauuugaggaugaacuaacucuggcuuauggaauauuaaccaugaagaaaggggugauggagugagguggugauucacacacaugaaauuuaaguuuuuggccaggcgcgguggcucacgccuguaaucccagcacucugggaggccgaggugggcagaucacgaggucaggagaucgagaccauccuggcuagcauggugaaaccccaucucuacuaaaaauacaaaaauagccaggcgugggugguggcgggcgccuguauguagucccagcuacuugggaggcugaggcaggagaauggcgugaacccgggaggcagagcuugcagugagccgagauugggccacugcacuccagccugggugacagagcaagacuccgucucaaaaaaagaaauuugaguuuuuaugcuuugaugccgaauaugugaauuguggcuagcguuuuaacauaguagcaguaagaacauuuucucagacuugggcuuuuguuuuucaggcccugaagcagagaccacgauuuguagcuuuaaagaaacaaccugcauauuuaggaggggagaaucuggaacuucgagauuaucagcuagaaggucuaaacuggcuagcucauuccuggugcaaguagguagaaaaauaugagugcaauuuuccuuacuguuucuggcuucuuuauuguuagaugucaagaauuuuuuuuuucuuuuuucacacccuuauuguaucucaaccaagaaaucuuuaugcugcauauuacagaaauaaaagaugauugagagaaaugcuuccugggaguuuuuauguauguguaauaccauuuuauucugaucuaaagaauacuuuauuucauuauuugguggguaauuugucauagccagaaaccuguaucaucauauguuacucaugaguguauauagcaaguuaagucacucaaaucuuuaauguggaaggaguuacucagaagaaagaagaagaugucuuuuucacauguauuuucuuucuaggccagggaagccuuuaaauuaauuuccuacaguagugcuguagagagugugauuccccucccuucacuccacucccuaccuauauagucuguaggauuauccuguucagaggaagguugaaccugugaaaguauccuuuuuauaagaccacguuaaucuugggggggugaaaaaaagaugagacagugauagcacuggagguuuaaagguacuuuugggaaguacuuacaaauuuccuucaccaauuucaaguaguuccuaauuacuaagugcuagguguuagaaacaaaugcuuguuccucggugcugaaaagaacuagugcucaaggaauuuucucagcaaggcaauuuuacuuucugcagaaagggugcuucuuggaagccuaauugucaugagagcacaccgaacaaagaaaagcagagguuuuuaucccugacucauuggguucuuacugcugcguccugucuccauuggcuggagcuggaccgcacaaucuagacugauuccgauuggcuaaaagcuuaaaacuuuccuaaauagauaaacgcgcaguggaaaacaaaggaaggggguuguuuacaggaaauuaggagaauaauaacauuuccaaauaaggaagggguguaggcuguaagcugggaaaugccugggcacguucggacaugucugagcagguuauaguccagaacaaauaaccugguuaaaguacaaggacauagaauguacuuauucccuuacuauauuuaacagccacauagggcuuaacaaagaguuauuagcaaaaagcaagggagcuugaaggaaguuaauuucuaaaagaaacuguuauuucuaacacuuguuauuuauucuuuaacaaaaagggaaacuuugaagaggaacuuuuuacuuuucacaugcggauccauuaguccucgagaauuuaacagugaaccuauauagauguauuuugcuguccuuacagaacaugcaguguaagaaguaccuuuaaugccaaccuacacacuucuuucccgaaguacccaauuaagugcaaaugcuuaaugucuuuaguguuuuauaguaaagcaaaaaauccuuauuuagaauuagaaguacaggccugugcaacauggcaaaaccccaucuuuaccaaaaaauacaaaaauuagcuggacaugguggcaugcuuauguagucucagcuacuugggggcugaggugggaggaucgcuugaguccaggaggccaagguugcagugagccauuuucgcaccauugcacuccagccugggugacaaagugaaacuucaccuuaaaaaaaaaaaaaaggacagcuuaaaaaauauuuuuccccucauugcugaaaggaagcuuucuaguuauagagaugcauuuacagugacuuuuucccaagugaaccaucuccuacuuuuuaucugauaaaaucuaguacaauauuuaauacucaguugugaaaauuaggugucuugagaagauugagaauguggguuugauauaaugauucugaauugcuuaaaaaugauuuuuccuuuuagagguuagugggaccuaauucaucuaaaugacaguuaauaaaaguuagaugaacuuuaauugugaucuaauccucucauuuuauaauugaagacucuuaggaacaaaggugccguguacccauccagagucacaugguguuuuguguacaguccuuggccagcauuuuuuagacuuuuuauuuuuuaguuuuuuugagacugaguuuugcucuguugcccaggcuggagcgcaguggcaugaucuuggcucacugcaaccuccgauucccagguucacgugauucuccugccucaggcucuugaguagcugggauuacacgcacgcaccaccaugccuggcuaauuuuuguauuuuuaguagagacgggguuucaccauguuggccaagcuggucuugaacuccugaccucaagugaucugccugccuuggccucccaaagugcugggauuacagccaugagccaccgugccuggccagcauuuuuuuacuuuaaaccaaaggaauaaaaaucaguugaaaagggcucaagcaccuguuaagcccuggucacaggaauguuacuacauuacauaaugugcuauuuuggucugguuccagaaaaacaggugaaucaauucaaaccuacuguagucuguauauguagacaauggcauuuucuaggggcaggaaauacuggagaaacuuaacugugcuuccuccugaauaguauugaaaagugagggaaauaagaaggaaauuacucaaaggaauauacuacaucguuuaaacuguguagaaaauuagguguaccugagauguauagggguauggcuucaucauucucccuuucccaagugugaucuucuuuguuucuguauuuuacccuuuaaacuagcuaguuuguagaacacagaagguauuuuuagaaauuaugucuuuuuggugaauuaaaugucuuguuuuuugaaucaguuagguugccuuuaacucauaaauuacuuuuaguucuuucugauuugcugauuaagcacauauuauauauacgugcaaacuuucaguguccuuauuuuccagaaccuuuuuauaauguuugcaaucugaugucuuacauguaauccuaauuuccugccaaaaugacuguauucuguuucccaaauauauuuuccuaacucuggcuguuucuucaauuuuaaauguuuuucuuagauauucuuuuuccauuaauauccuguugaaaucuagcccauuuuguagaguaguguuucucaaacugugguuuuaagguagugcuucccaaccuuuuuggcacuagggacugguuucguggaagacaauuuuuccacaggcuggggaggagggagggggaugguuucuggaugauucaagcacauuacauuuauugugcacuuuauuucuauuauuauuacauuauacuauauaauguagaaucagugggagcccugaguuuguuuuucugcaacuggacggucccaucugggggugaugggagacagcaacagaucaccaggcauuagguucucauaaggagugugcaacguagaucccucacauguguaguucauagugggguucaugcuccuaugagaaucuaaugccguugcugaucugacaggaggcggagcucaggcacuaaugccagcaauggggagcggcugaaaauacauaugaagcuucccucccucacccgcugcucaccuucugcugugcagcuggguucccgaguggggaauccuggucuggucuaaggaauaccugagucagaaucuccaaagguguuugucagcccuuuuccauauauuguuuaguauaucuagggugggguccacaaguaugaucuguagccuaccccugcuuuagaccaaaguguauuuaaaacaagccccaugcaccuauacauguaggucuaggaaauaguguggguggcauuaaacaacccaguggccugcaguggaauggggugggccagccacaggauucaccagcggugcugauagcuuucucuauugauggagucuaagguuacaugcuugucuucacuuuuuacaaagccugucuucucugugauaaaagauagccuauggaaggugaugugaaaagccuaaagguaaagagucugacaaggcugucauaguaauccaagucuagguaggccacuuguuauucugcuuuuuaugguuucuacuuucuuccuuauguugaaagcugaaguaauugcagaugagaagaaauacauuugaggcuuaugaaugacaccuugcuuggcuguuauugugaagcauuggugucguugcuguuuaugcacauucuguguuuuggugaacuaaugauuuuuuuguuuuuauuuauuuuuucuuucugcagaaauaauaguguaauccuugcugaugaaaugggccuaggaaagaccauccagaccauaucauuccucuccuaccuguuccaccaacaccagcuguauggccccuuucuuauagucgucccuuuauccacccucaccucauggcagagagaguuugaaaucugggcaccagagauuaacguagugguuuacauaggugaccugaugagcagaaauacgguguguaaacaaaaagagcuggguuagaaucuguguuauaaauguaauuuagaaauucacuuaaagccuucaguagaucaucaguaaaauuugugguuauuauucugauacugugcuguguucucaauauuaggagguuuaucuaucacaaaagugcaacucagauguucuuuaacaaauaugcuuacuaguuaaaaagcaacagcaguaugugagugggaaucucuuuuagcuggguugcaauauuaaauuuuucuucucucugcccuuuuuacuucuaagauugcuuuauaugagauaauauggaguuaauacuuuguguaauauuaauauuauuuuugcuuucucaauagacauauuacugaaaauaaucauucuucgaauuucuuaauuucuuaaacagugagguugcauaacuuauaaaaaaggaauaaaaguaaaggaaaacaagcuauuuuaggacuguagaaauaagaauuauccuaaacuguuaccaaacuuuauuugggcaucaugaauuuagaacacagugacuuaaguuuaucuuuguuuagcagaucuuuucuuuauaguaacuuuuuuuaaagcaccuacugugugcuagauguugcgcugggugcuuuacguauaauaccuguaaucuucaugauagucuucaaagcugauggcauucuuuccugcuacugaugaagaauugacucagagagucuuaacacgcgacccuagcgagcaagaauguggcagagcucagauucggacacagguguuucuaucuagucuagagcuuugcucuuucaucacuguauauaaacuauuucugggaaauugcuuguaauaagagcaagccauuagcaauguuuaaauauuugaguugcauguuguaaccauauauuuucauacaaauucaaauuuauuuuugguaaauacuuucauuaaaauuguguaacuuaaacacuggcugauuucauuggccuaauuuugaguuucuaagaauauaguuuuagcuuuguuaaaucauuaguuaaccguuaaagacgaaaaaagagaaauuuauagguuuacaaaauagcguaaagcacuacauuccaaaaaugauugcaaacaaagaaaaugaacucuaaaaaauuguagucagagaaguuuuccuugcuaucuccaguucuccuuuucuuuguucuuuuuacccccacuugggggcgaucaccugcaggcacuuacugucuuguucuccaguuccuaacuugacagccaaacugcaagagcguugucaugagucuucgugcuugcugaguguccaguuauacuucaguaugaauguacucaucuuuguguucuuuuacauugacguuauuauacguauugcauuauauuuucaucuuacaagccucccuuuuuguugggggacauaucucuuuggucuaugguugaugaaguuccaaagguuggaauuuguuuuacuuguuaauauauguauuuuccuauucaaaaaguaaauaaauugcauuuuuaaaagaaauuucuaaggaucugggagaucccuuguugaguuccaaucaccaggguucaguagcugaugaagugcauuuucuucaguagauguauuucugggggccaguuucuucugauucuggcaauaaagcuuuugcuguucgguggucaguguuuuaauucuaacucuuacugcuuuauaguuugguugcuuaggucauuuuagaaugugagauauucauugaauucuaaucagauuuauuuuuuauuuggcauguuucuauuacaucaaucacaaaacuuaugugauauagaaagguagaaguagaaauuaugucuuaauuauguuuuuuucuuauagauacgggaauaugaauggauucauucccaaaccaaaagauugaaguucaacgcacuuauaacaacauaugagauccucuugaaagauaagguguguaauuaauaucuaaaaggcuaaaucuuuuccagugcgacuuguccagaugguagggucuguuacuguucuguggagcauguuagaaauaaauacuugaaaguuaaaaauaaaaaacaaaugguagggucuguaccuccuacuugccauguuacuuuucuucucuuauuucaaaaagcaagcaaaugaacaaccagaaaaauuacuuuucaaaggauauuaacguuauaaauagaaaacagaacccuauagaugaggggaccuuaggucaccaaguccaguugaauuaaacagaaugaaaggguauugaauaggucaguaacuuaccugagauuauugucagucauuggaugccaucucagguauuucccuugaaugucaucuuaggcauuuccuauuguaucauuguuaaggcauuucuccagaaaagaugaugugaauggucuuugugaggaggacaaaaauaagaagcucuuuaaauaccgccuuucugcuaagaaauauaugugguagguagaucccauugguauuaagugcaaacaaguugaguuugguggcucuugguguuugugugcuucaggguugggguggagaauaggcaagagaaggaccauaauuaaggggagaauacagaaucauaugguuuuuuuguuuuauuuuugcccagcauagcaauuuuuguguucuugcuguggggcaugcaguaauagcugguauaagaggcccaccuauaccuuuuagaugaugauacucucuuuugaauagcuaccaaucuggcaacuaacagaauaaacagaagaggccuaauauauauugucagugaagaauaaaugugucaauuuauaccuuuguaaugguauuuauacagagauaauuaacacuugaaagcacuuguggguucccuucugaccugguggcucguucuguuuuguuuuuacuuuagacugugcugggcaguauuaacugggccuuucugggaguggaugaagcccaucgguugaagaaugaugacucuuuauuguauaaaacucugauugauuucaaguccaaccauaggcuccugauuacggggaccccucuucagaauucccucaaagagcucugguccuugcugcacuuuauuaugccggagaaguaagcuccuuccuguguauuucaaaagaugcuagaaugucugaaaugccaaugcuuuuuaacuuucuuaguagaccuuagggaaaacagauggcaugguuuggggaaagcaaagcgucaaauggaggcagggauggcgguaguaaaauguuucauaaucaaugaaagaaggcacagaaauuagccuguuaaggaggaaagcaguauugucugcugaaaggcugaauuaguuaaugcacuugggaaauaauuguuaaauagauaacaucagaccuuuucacuguugguauaagauaaucaauauaaguaaaaugaaauauacaagguacacaagcacugaaaaguauguuauacucaaauaucugauaaccgaagcaucaauuuuacaucuuauucacguauuauuaaagaacuauggaauguguuuauugaaaagauuuuuaugggagagaugauaugcacauuucauaaaacuuaaaauuauccaaugguauucagcgauacuuagaauaacaucuauauucauuaauuuggaggacuccacucagucuggccccuugacaauagucugauuccucucauccacuuucuccauuacucauuaugcuucagccauucuggcuaucuuucugucccuuaaacaugccaagccauuacuauuccuucuugacuagaauuauauuucuucuugucuucacauggccaaccaccuuaauguuucagcucaucuuaaacgaccaccuccuuucagaaaucuuuugcagauugccuaaccuaaaguagcccuuuagacaucuuaucccuaaccuguuuuagugucuauauagcaucucuuuuuacauuuauguucucauucaucucaugucauuaaauuauguaugaaaaucgcagggauuuuguuugcuugauucauugcugguucccauugucuagaauagcaccuggugcacaguaaacaauucaguuaauaguuguucaguugauagauauaugcucuacaaucuuuuuuuuuuuaauucaggauuaaauuuuauuuuuuacuuuuauuuuuauuuuuaaauuuuaaauuuaaauuuguuuaguaacuuuauaguuugcaaccaucaucauuguccaguuuuggaacauuuuccucaucccaaaaaguucccccuugcuuguuugcaguuaaccucugcuuccacauauagccuuaggcaaccaguaaucagcuuuugucucuagagauuuaccuuuucuagaaguuuuauauaaguggaauccuaauauguaggcuuuuguuuccggcuuccuucacuuagcauauuuuuuuugagauucauucaugucagagucugucaguagguguucucuuucauuggguaauauuucauugcauccaguuaccgguugauggacauuuggauugcuuuguuuugggguuauuauaucuuuguguggacauauguuuuucuuucucuugcuuagagacuuaggaauagaauugcuggauuguuuggaaaguuuauguuuaacauuuuagaaacuaccacgcuguuuucuaaagugacuaccauugugcaguccuaccaaaaauguuugaagguucuaguuucccugcgucaucaccaggacuuggugcauugucagucuuuuugauucuagccguucuggcgaaugugugucauugugguuuugacuugcauuucccuaaugacuaaugauguugaacgucuuuucauguguucauuagccauuuguaugucuuuggugaaauuucuauucaaauguuuuggcauuuuaacucaggcgucguguuccgucauuggaacucuaagcaugugggaauuauuuauauccuacugcucaaggucauugccaaggucugauugcaaaaaauucaaaaaauugcaaccucuaucauaaauggguuaaaaaaauuggauuguuugucuuauuaugaguugaagagguuuuuuauuucuuuuaaaaaaauucuaaagacaagugcuuuaucaguacaguccccaacuuucuauaguuugauguaaaauguuuugacuuuucagugguaugaaagcaauacacuuucaguagaaaguauacuuugaaugaacacaaccauucuguuuuucauuuucaguguaauauucgauaaauuacaugagauauucaacucuuuauuauaaaguuggcuuugcguuaggugauuuugcucaauauccucaugauaagcguucugagcacauucaggguaggcuacggugugauguucuguagguuaagugcauuaaaugcauuuuugauuuaacaauguuuuaaacuuacgauggguuucucaggacauaacccuguuguaaguugaggagcaucuguauauaauuugaacauauuuuaucccaaucuguggcuucuuuucacuuuuugaauguugucuuucaaagagaaaaaguuauugauuuugaugaaguuuaauuuauggauuucuuuguauggauugugcuuuagauaucauaucugacacagauuugccuaaccuauggacacgaagacuugcuucuuuauuuccuucuagaaguucuagcuuuuguauuaagucagaguuacauuuuguuuauagugugaagugugagugccuuaguucauguuuuuguaguagaauuugggaaauuguucuaguaucacuuguugaaaagaauaucuguucuucauugaauugccuugacacuguuguugaaacucaguugacaccauaaaugucaugcuuuguuucuggacugucaguucuguuuuauuaauacauauuucuguccuucugccaaugucacacugucuugauuaauguagcuuucgacuguuuuuuuauuuuuuauuuuuuuugagauggagccuugcucugucacccaggcuggaagggaaguggcgcaaucucagcucacugcaacgucugccucccgggcucaagugauucuccugccucagccucccaaguagcugggauuacaggcacgcaccaccaugcucaacuaauuuuuuguauuuuaguagaaaugggguuuugccauguuggccaggcuggucucgaacuccugaccucaagugauccaccguccuuggccucccaaaguacugguauuauaggcgugagccacugcacccggccuagacugcuuuuuaaaaauggagaaguacaaguuccauuuucuucuuuuucaaaauuguuuugguuauucuagaauucuugauacuuccauguacauuuuaggaucagguuguuaauuucugcaagaaaaauauggaauuuugauagaaauuguguugaaucauauaucaguuaaagcaaaauuauuaauauugagucuucuaauccauaaucauggaaaguuuuucuccauuuauuuagaucuucuauaauuuuucucaguguuuagugguuuuuaguuuagaaaucuuauacauucaaaauauucuuuuaauucugacuauauuuggaguggaauuuuuaaaaauauaaccuauuauagaacuacaauuggguuuuguauauugaucuuacauccugcaaacuugauaaacuuacuguuuucuacuguguguguauguguguguauauuguucuguauuucuuaguauuuuucuauagacaggauuauguuuucuguaccuaaagauuucuuuuccaaaauggaugcuuuuuauuucuucuucuugccuuauuguauuggcaggaaccuccaucuuaaauagaaauggugggagcaggauguuggcuauagauguuuuuuguagauaaccuuuauuggguugaggagguuuucuuuucuuccuaguuugugagguuuuaauaaagaauggauauuagguuuugucaaaugcuuauuuucugugucuguugagaugaccaugugguuuuguccuuuaacaauauaguauauuacauuaauugcuuuuuagacauuaggccaacuuuuuuuuuccuagcauaaaucugacuuguuaacaguguuugauacuuucuaugcauugcuagauucaguuggcuaauauuuuguuaaagauuuuugcaucuguuugguguuuuuuuuuuuuuuuuuuuuuuuuuuuaagacagaguuuccgucuguugcccaggcuagaguacaauggcaccaucucggcucacugcaaccuccaccucccagguucaagcauuucucaugccucagccuuccagguagcugggauuacaagcaugcaccaccaugcccggcuaauuuuuguauuuuucguagagacagugggguuuugccaugucagccagguuggucucgaacuccuggccguaagugaucugcaucugccugucuccgccgccuaaagugcugggauuacaggcgugagccacugugccuggccgcauuuguguuuuuuauuuuaauuaggauuuuagucuauagcuuuuuguuuuguuuugauguuuacguugcuuugguuuugggaucauaaaaugaauuggagagcguuucccuucuguuuucugaaggaguuuguguaaguuuaguguuauuucuucuuuaaauauuuacuagaauucaccaguguagccaugucaaccuucacuuugugggaaaauuuuuaaugacuaaccugguuuccaguuacagguucacuuaaguuuucuauucuucuugacuuaguuuuguuaauuugugucuuucuaagaguuagucuguuucaucuaacuuguccuaauuuguuggcauaaaguuauaguacucucuuagccuuuuaauuuuaguuuucuuuuuuaagagacauggucuuucucugucacccacgcugagugcagugguacgaucauaguucacuguaaccucgaacuccugggcucaagggauccucccacuucugucucuugaguagcuggggcugcagaugugcaccacaaugcccagcuaauuuuuaaaauuuauuuuuuguuauuuguagagauggguucuugcugaguuguccagguuggucucgaacuucugggcucaagugauccucccgccucuguuuccuaaaaugcugagauaauaggcaugaaccacugugccugguagauucuuuuaaggaucaauagugauuaaaguuaauuuucuugauuaugguaauuuguaucuuagcucuuuuucuuggucaguucuagcuaagggcuuaacaauuuugaugcucucaaagaagcaacuuuugacaucauugguuucuuccucuguuuuuucuucucuuuuuuuuuuuuuuuuuuuuuuugagacugaguuuugcauuuguugcccaggcuggagugcagggugcgaucucggcucacugcaaccuccgccuuccaguuucaagugauuauccugccucagccucuugaguagcugggauuacaggcaccugccaccacgcuuggcuaauuuuuguauuuuuaguagagacgagguuucaccaaguuggccaggcuggucuugaacuccugaccuugugauuugccugccuuggccugccaaagugcugggauugcaggcgugagcccccgugcccggacccucuguuuuucuguuuauuuccacucucaaagguugccguccuuugcuugcuuuucauuuaauuuucucuuuuucucuuaagauacaguuuagauuacugauguaaaacuuuuuucuuuucuaguuguuuaaagguauguuuacuucuaugcacugcuuuagcugcauccuguaaauacugauaauuuuguguuuuuguuuucauuugauuucaucuauuuucuaaauucucugugauuuauucuuugaagcauggguuuuucagaaggaugguguuuaauauccauauauuuagggauuuuccaaaugucuuauaauucgguuuugucuuagagaacaugcuuuaaaugaauuuauuaugacuuauuaaauagucuuaguaugcuuucuuuccuggagacuguccgauaagugcuuguaaagaauaaucuguauucugccuuuguuugaguaguguuuuguaaauguccguucagugugguguuaaugguguuguucaagacuuuuauaucuuuucuaacugccaguuuaguugugcuuugaauuauugagaaugaaauauuuuaauuuuuaacuguaguugaguuuuugucuucuagucauuuuuugcuucauuauuuugggguuguucuguuagguauguauccauucauaacuuuuguauguuccugagguauugaccuuuuucuggucaauaucagaaugucccauuugaccucuaaugauauuuauuguuuuguaaauccauuuugugugauuuuauuauagcuccucagcucucuucugauuccuguuugcaugauauauuguuuuccaucauucgaacugguuaccauuugcaugguauacuguuuuccaucauuuuacuuucaacuuacuucuuucuguaagucuaaaaugugucuuauagacaaccuguacuuggauguaccuuuuuuauccaggcaaauaauccuugccuuuugauuggaauauuuaguucauuuacauuuaacagaauuaauaauaugguuggauuuauuucugcuauuuuacuauuuguuuuccauaugucuuacaucuuuuuuguuccacuuucuccuuuauugcccucuucuguuucagcaaguauuuuucagugugucauuuuaauuccuguuaauuuuuugcuauuaaaaaaauuguaauugguugcuguagggauuguaugcaucagucuucuucagguuaguacugacucaguucugguaaaauagggcaacuuugccccgcuguagcuccauuuucacuuccuuauguuauaaauccaagaauacaaggaaauaauuauugcuuuccacagguuugucuuuuaaggacauauagaaaagagaaaaaaaauauauacuaucuuucauauuuauccauauauuugaucauuuucagugaucuucauuucuuccuguguauucaggucgcuguuggguauugcuuucuuuuagucugaagggcuuccuuuauuuacauauugcaaauaagaauaugcuggcuuagaugauuaaaagaugucccguaugacacagucaauaaguagauagacgaagaucaauagcaaaucuucugugaccaaggccaguguccuuugaacuucaaguucuaggagaaaaaaauacauccuucauaaaaccauugagacgaaguaaggucacccuacguaguaagaguuaugagacacagugggaacaucugugcuuguuuuuauagaaaaagaauugugguauguaguuucuaccagugaauacuuagccaugauuugcuuuuguguaccuaccugcugaaguggaugguagggauuuugcuccuaaguggucauaauuagcuuuuuccugccauuaaguagcuguggcauuccacucagcaugggcuauguuuggaaaaaugucauauauccuucuuuuguaauuggagagaggaacuuucaauuacuuuaucauucagggagucucuuccaaaauuuuccuuuggccaguugaaucaauuauggaaugauagguuagaguuagagaugcaaguuuuuuucugugaaagagaucuuuuuuucuuugaaaauuuuguguuuaaagcauugucauuuucaaauaaaguuucaaaauuguuguucacaaagauauguauaugaaaaggaaaccaauuaguuaaggaguucagauuugcccuuauuucugccugagcuugcuggauggguaacuauagucuugugaaguauuuugccucauccucagcagaaguuccugagguaccuuaggacucuacagagcuuuugaagaaaggauccacugaagaaaaacuauuguaaaggagagaauuagguuuagucaaauagcuuuggaacuuccccacucaaauguuacaggcuauuguuucaaaauccaaaaguuaguccucuuuuuaaccaacugaaauucuguuuccuuaguauagagucuaagugccuuuccugcaggguggcucugacagggaguacacaugacuaaccauauugggaauacuuaucaaucaauagcuucauuuuguacauacuguuugcaaagcauggaacuugguauuaaggguagaaaaagauaugacaagauugaaaaauucggcuuauaaagaccaucaugugcaaauauauacuucagacuuaccgcagaaaacaagucaguuugauagcauguauuucagagauuacaucuuuuaguguugggaugauuuuuuaaauuuuuacuucugucgucuaggccaaucucuuaauuuuuuuugcacuuuuccuuuuacauauuuacugugugacuuuuagcauaccauuuucacugcuuugguuuaauuuccguuguugguccuuauuaaaguaaccuauuuuucuaaaauuccguguucugcaaagcuauaaagaucagaauuuuuucuaguucugugagagacaaauauuaaauacagaaguugauagcagggauuuaucuaaaauaugaaucuuuagauguaacauggugucuuuauacaucaccacuaugaccuuauaccuuuucuauaucuaauauuauaaauuaauaauuguuuucagggcagcagacuuuuucuaaagaaucugauaguaugccgggcgugguggcucacgccuguaaucccagcacuuugggaggcugaggugggcagaucacgaggucaggagaucgagaccauccuggcuaacacggugaaacccugucucuacuaaaaauacaaaaaauuagccgggugugauggugggcgccuguaguuccagcugcucaggaggcugaugcaggagaauggcgucaacccaggagcccaggaggcagagcuugcagugagccgagaucgcaccacugcacuccagccugggcgacagagccgagacucuuucuccaaaaaaaaaaaaaaaaaaaaaaaaaaaaaaccaacucagaaucugaugguaaauauuuuugguucauagcccacacagucauuguuagccacucaucucugcuguuuagaggaaaagcagccauagagaauucauaaacaaauaaaugauacuuauaucuccucaguguguguagaucaagaacuagugucucauauuaacucccuuaauauaauaagaguacaguaggcaggugaaaauauuuguugcuuaaaacauagaggaaguaaaucuuggaaauaaacuuuacauuuaauuuuuuagauuaguaaaguuuuaauuuauuauaacauguguuagguaaauuagcuuauugaaauugucucucagguauucagaaaauagccugauacagugauauuucuacuucuacugauuuccggucacuucacacauuuagugugugagguaucaucuccagcauugagauaguucaguuuucuuucuuucuuuuuucuuuucuuuuuuuuuuuuuuuuugagacagagucucacugucacccaggcuggagugcaauggcaugaucuuggcucacugcaaccuucaucuccuggguuccagugauucuccugccucagccuccugaguagcugggauuauaggcacuugccaccaugcccagcuaauuuuuguauuuuuaguagagaugggguuucaccauguuggccaggcuggucucgaacuccugaccucaggugauccgcccgccucagccucccaaagugcugggauuacaggugugagcuacuucgcccagccagagauaguucaauuuucauugugcauuugaauuauuaguuuuaauuccucaccuauuuuauguucuuggaguauuugcuuaauagcauagcagugugagaaaauacaguuuaccuuagguuuaucaggcuguaggcuuuaaugacgacuuuagaugucuaccccaaaagaucauauaaucugcuucccuguagauuguuucaggccauaccggguguuacuaaggcugauguugauucacuuaacaauaccugauaaaauguauggcuggauaugguggcucaaacuuguaauuccagcacuuugggaggccgaggcaggcggaucacuugaggucaggaguuugagaccagccuggccaacaugaugaaacccugucucuacuaaaaauacaaaaauuaguuggguguggugguggcaccuguaaucccagcuacuugggaggcugaggcaggagaaucacuugagccugggagguggagguugcagugagcugagauugugccacugcauuccagccugggcgacggagcgagacucugucucaaaaaaaaaaaaaaaggaaugacuauuuaugaguucagaaaugacggugacuuucuugaggcuguuguauccauuggcaguacuggcaccagcuauaucugacguuccaucuuaccagagggcaugugcuuugaguaguuacugaguaguucuagaugauguugguuacaugauagacugaaguauuuuauuaacucugaauucagucugagaauuggaaacgugcuauuauccaguguagacugauggaguugauuucauuuuacuuuuccccuuuuuguuuucccuucuauuuaagagcucuagugauugauaaugucuuuccuuaugggaaagauucauuuuuuuacaguuuuuuuuccuauucuucuuuuccucaauguggcuaaauaacacuauacuguuucuucccuagguuugaauuuugggaagauuuugaagaagaccaugggaaggggagagaaaauggcuaccagagucuucauaaggugcuagagccuuuccuucuccggagagucaaaaaagauguggagaaaucccuuccugcuaaaguggaacagauucucaggguggagaugucagcccuucagaaacaguauuacaaguaaguucuuguuuggguuaggccugaagggguugagaucaguaccaugaaacuauuagauaggagauauauauauauacuuuuguuuuuuuuuuuuuuggagacagagucucgcgauucugcugccucagccuaccgaguagcugggauuacagggaugcgccaccacgcccagcuaauuuuuuuuguauuuuuaguagagaugggauuuuuccauguuggucaggcuggucuugaacucccgaccucaggugauccgcccaccucggccucccaacguuuuguuguuauuaagcaaaauuucaauacuguuguuaugucuaaaaaauuuuaauaauuccuuaacaguuucguaauaucuaguguuuacauuuuccugguugucauauacauguauguauaucuccguuugugcaugugccauuuugcuuguuuugggaucgauguaagcuccgugcauuuugcuuguuuugggaucgauguaagcuccgugcauuuugcuuauuuugggaucaacguaagcuccaugcauuuugcuuguuuggggaucgauauaagcuccaugcauuuugauugguugguaugucucuuaaguauauuuuaaucaauuuauuuuucuuugccuuauaaauuuuuugagucaggaaacugaauuuauguuuuguagacuuuucucacagucuggauuuugcugauucuagcuccauggcauucuuuaauauuuucagccaggugugguggcucacgccuauaaucccagcacuuugggaggcugaggcaggaggaucgcuugagcccaguaguuugagaccagccugggcaacacagugagacuccaucucuauaaaaauaaaaaaauuuuuaaaaaccacuuuuccucugaacuguguuuucuguauacucauaaguaaguguaaaggcuugauuagacucagauucagugugacuuuagaggcagaggaauauuguuucacaggauaaauguccuuuuuugugauguuagugacuaacgaugagcauugccuagaucuguuaauucauuagagaguacaaaagggugauauucaaauuuuaucacucacuuguuuauuagguggaauacuuuuauaaaaagaaacuuucccaugucagcugaggaacaguucauguaggaaaggcagaauaagauucuuuuuuacuuuugccauuuucaaaggaaaagaucuacuuuucuucaaagguuuugaccaaugagauuuacuuugauaugauuaugaacucaucaauuacaccuauuuauguuuaauucuguuggaguuaauauccauauucaugcucuaacagucccauuuuuagcuagugggaacucauucaaguugguuguuguaguccuuuugacauaaccguaauaguaguugauaguuucuuugcuaucuggaaugauuaaguguuccacauccaucuuguacauuuccugccccagaacuagagucagccauuuauccaagaaguucugcauacuccuuuacuaggaaaugauauuuguuuguuucuguuuuuccucugaaaauaguuuaauacuguaaaauguaaaaggggaaauaguguuaccuuaguaacaacaugaaugugucaguuggucagugcuauuuuggguguugauugaucauaugauuuuucuggcaacucuagauacuuccaguuuacuuaaguugauuuaguugaguuuuuaucacuugcaauuuaagaguccuggcuaauauucuguugccuucaggcugcacaacaugcaggauuggggaaagcacuagagagccaaagaaagugagcagaguuacuucagggccaccagcguuccccgcaaucccuguccucaggcauaggcccuucugcucuucccacuguagagcagcacccauccccaccaaaccucacuucugggugugacuucauaggcugucguguucugcaguacccucgaguccgaggcuguugagucugaaggauccucagaagacuggccucuuucugaugguuuauggacuauggcaaagaugaggaaaugguauuuggagaccacauacugggcccuaggggugcucuuugcaacugcaacaaacauggacagaauugggaaauuuguuuuuaaugguaaaaauacaugaugaacaguaccacagagauuuuauuugaucuuacugaucuuaugccauacuaaaaaucucacuucccaaccacaccaagcuaauucauucuauacauacaacaaagcuaauacuaccaccaacaauaagaauaguaaaaacagguuaagauuuucuuuuuuuuuuuuuuuuugagacggagucucacucuguuacccaggcuggaguguaguggcacgaucucagcuuacugcaacaggauuuucuuuuuacagguuuuguuuuuacuuuuuuuuuugcuuuuuaagguuauauaccacaagaaguggaaaagaguuuuaaaguacucaagauaguuuuucuucugugucuuuaggcaacuaaugguuacauagauuuauuuauuucauuuuaguuuugauuuuuagggauugcuuuaauuuuguuuuuaaauuauaguauuuguagauuuccaaaggcaaagcuacaaagccugguauguucaaagaaauguagcuucagucccucuucccuccauucuaguccaucuuuccccauagguaauuauuauuauuauuuuuugagauggaguuucgcucuuguugcccaggcuggagugugauugugugaucucagcucaccucaaccuccgccucccagguucaagugauucuccugccucagccucccgacuagcugggauuacaggcaugcaccaguacgcccagcuaauuuuguaguuuuaguagagauggaguuucaucauguuggucaggcuggucucgaacucccaaccucaggugaucugcccccuucggccucccaaagugcugggauuaacaggugugagccaccgcaccuggcccauaauuauuauuauuuuuuaacauuuuaaugcuuauccuuccuuuaacuuuuaauuauuaaauaaaagcaaaugcauuuuaacuuugaauauccuccuuucucuuagguaagugguagcauaccguauacacuuuucucugccuuccuuuuuuccuuaaugauacauggcugaagagcaccccauaguagcuuauagagauaggccuuuaugaugcauaguguuccauugagguuauauaguaugguuuauucaaccaguuuccuugugguaggcacuuagauuguuuuaccuacuuuuauaaauaguucuggagugaagaccuugagauagauuccuaaagugugauuucuaagagaagcaugaagaaauugcgccacucaggaaaaaauguacuuuuacuauuuuggaguuugugguuaaggaauauacauggguauacaugaauauaucuguauuucuccuccaaauuuggguagaaaacauacugauaaguuauuuugucagauaaaauacucuuuuacaauguuaaaauggguauguagccucuauuuuaugguauauuuacauuuauuuaaccucauaauguuagcuuauuuccaauuuuuauauuucagugaagaguguuucagugacagucauuuuccauucacacaugcacacacagguugagucucuuaucaaaaaugcuuggggaccagaaguauuucagauuuugggauauuugcuuuauacuuacuaguuaagcauuccaaaucuggaaaucagaacuguaaaaugcucuaaugagaauuuccuuugagcgucauacuggcacucagaaaguuuugagugccauuuuggaacauuuuagauuuucacauuuaggauucucagccuuuguguacacacacacacuuaaauauguauaaaguacauguguguaaauauguaaaauguauguauguauguguguguguguauauauguaaagcauauguguguguuguguauauguagagagaguuguuuucuucuaguauuccuguguucagugagguugaaauauccagcagaaucuuuaacauuccuaauucugacuggagaugugaaagauguaugauuagauggcaggagauacaaaagaaaauauucuuugcuucuuaaacuuuuuuaggccucuuuuuuucuccacaauacuacuacuaucucuuauacucuucugguaccuacaacuuucuguuuuuuuguaucuaguaguaucauuaucauuuuaauuugcagguggauucugaccaggaauuacaaggcucuugccaaaggaacaagaggcagcacaucugguuuucuuaauauugugauggaacugaaaaaauguugcaaccacugcuaucugauuaaacccccugaagaaaaugaaagggaaaauggacaggagauucuucugguagguaguuccucauaauuacuuucucaaaaaaaacgcuuaguuucucuaggugcuuuucaucagaaugcucuauuuccuuguuggugaccuaucaaggaucaucaaaggaagcuuuaaaaaugggagagaaaagguaacuaagaaugauuuggaaaguaaaguauaguaucaacagauacugggaaaaagaacauuucgggaauugcuggucaagcagguugcuaagggcuucagaaagcuuuaagaugauuuuuaaaauauggauuuguagagauuagggaagauuaaaauuuguguuucaacauaauuauuggaaugucuuuuaaaucuucagucccucauaaggagcagugggaaguugauuuuauuagacaaacuguugacaagacuucgagaaagggggaaucgagugcuuaucuucucucagauggugagaauguuggauauccuggcugaauaccuaacuauuaaacacuauccuuuccagguaaggugauuucaguaauugcuguggggggaaucaaucucucucuccgccuccccuccccaaccuuccuacacuggguuguaugcuuugcuuguuaaaguaggaaguaagaguuuucuuguuucaaagaaguuaagguuaagauuccagggggccgggcgcgguggcucacgccuguaaucccagcacuuugggaggccgaggcgggcggaucacgaggucaggagaucaagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaagauuccaggagggucuuaauuuuuacuugcaugccuuuaggcuaccauaugaaaguggucaugaggagacgauucuuuuuuugaagguggguggggaggauuagagaaagucaaacggggcaagauaaaaaaaggaugucagauggcaucuuauugcauguguauggugaaaguagagaggaaguaagugugagcucaauuccaggagcccaaauccuagaaggagagggcaguaucagacauuccccccaaaaguugacccuggcugugaggcugggaacauagcagaacacugcuacuuaaaaccuugcuacucccugaaguaagugaugauggcuuccccuauuuucuguggaguuccuuaacuggaguuacugucuucacacaguuaucuccuauggggaaaauuucuuccgcauaguaacauuuuucuagguguauauaaucuaguagaaacuuauucucugaucuauuuauagacacauagacauauacgcaauuuaccuugucucuuggcauguuuauagugcuuugauuuuuaagauuuauuacauuuuuuuuaaaacuuugaauggaugaacucuucuaccaacucacauaauuauguugggauugaagaaacuuggaccaaugauuaucuccuaagaaggcccaccuuugagacuaucagauugauuaucuuucaaaauacccugaaaggcauuguuauauccauaauaucuuauauggucuuucaguugcugucuuagaauauagcuuaaggcugugcuuguuaucaagaaacagccuauugcaaaaagucacuucucugucagugaaucgaaucccuaugagcuuucauuccuaggaaaucccgugauaccaaguaaaucaagaaugcaucguuuuucucucuagggaauagauaagcuuggucagugacuuuuagauaauuaaugcccucuacuaaugggaauauuaaaaggcggcauuagguuuucugauuucaaguaaaggcucugaaucucccauugaauacgucuucgguuuaaggcucugaguagaguagucagugagaaagaaguaagggacuccucaccugucaguugacuugaguuaggucuggugggcagaguucuggguauguaggcccuuccacagagucugcugccagccaagucaccuuucagguuaguuuugccuucuguaaaaugaaguauuuuguucaucucaaguggugauugugaggggaugaaaugcaaaaaugauuuuaaagaguaagaaaugcuuuauaaaauguacagcaugcaggugauaauucuuuaguauuuuaugugucaaugguuucucuauggugacauuguauugcauguagaacugacauauguucuaauaaaggaauuguguaugcuaauaaaugccaggggcuuucuugaauucucauguaguuuagcugcuugaacacuuuacuaugauuucagaguguaauuuuuggcaaagcugggauauaugaucaauuuuaacauuuucaaugauucagcaaaauguuuuucaaacaaaauuauuauauaaauaaauuuuugguuugugugacacuuuaagugauaguuuuagccacauuagcuaagaagcaucauuuuucugcaggagcuuauuauugggugacccgugguccuauuuccuaaucucugcaguaccuacagaaacagaaguaaacccagccuccaagcacagguuggguuuucgucuuucuccuuuuagguccuggcagccauucugauccuuggcuaaaccuggacagcccuuugaaucagaagcuuguaaccuugagucuguaacuggagagcucaggucgaguaggguagggugugcuucuuaagcacagcuucuucauagcgcuuugccagugcuuugcaguuauuuuuacucaguggguguucaggugauaaagguuccaagucugcuguucuauucugaguguagcugaucuuccuaucuuacaguuuucuugugguuuauuuuuacagcgucuggaugguuccaucaagggagaaauccgaaaacaggcacuggaccacuucaaugcagaugggucugagguauacuaugcauggcuuuguuauuugagcaacuugggcucugcaucaaggggaaagucucucucgcuuaauguauucuguuucagaaacaauuuauagugcaauucuuuugccuugagaagaaaaugagaaaucucucauauaaaagaugguguuuuguugucacuccagaaaaauaaauaugugcuuauuuaucuccccuguucuggguugacaacagagugguucuccugguagcuuccagauaccaaauccuugggcguggaagagcaguaaggcaggaguaggggagaguugggcaauagaauuaauauaagaagguucugaucucuguacucuuuuggugacuaaguccugaaaaauauauuugccaugucucaaauuuguuggacuucugauacaguguggcuuaauguucuugcucucgcuaacagcaacauuuuacaaucagugucgagcuuggauuuggcauuaugaaguauuuuguuuggggggcacauauagaagagcuacuuaggaugaaauagaagguaugacaacauuguaguuugugcauaucaaaucaucagaugccaugggauuugagagaagugggagagaaaaguuuuggugugaauaaaacuguaauaauguguagagcuaaaggaagcaguggagacaaccugaaguagaaguguuucacagagaaugcuaauuucuggagccugagccacuacuuuuuuuuuuuuuuaaacagauagaacagacuuagcuuucugaagagcuuuaaaaacucuugaugccugugccuguuacuacagaaugcucugcugucugccuuuagaguguagaaauccuaguuagacuaguauucuggcuacuucuguagucuaaacauuuacuucuugaggggcuuggggcauuaaucuauucagagccaaggcucucguucauuaaggauaagaggaauggaauaauuaaagacaucggucaucaacuaauucccauuccuccuuuccuugcuccuuguuuccucagcuguaaaaucacaaugauucugauaccccacuucauaauauugcucugaggauuaaauuugguaaucaacauaaagcacugaucacauugcccagugcauaguaagcgcucuaaauaucugcuauuuuuaucauguaguguugguugaaauugguuuuguguucuccacucuuaguuuaaaaaauaguaugagucgaauguuucauauugcccugucucaggggaaaaaaaaaauugcuuuuugcauagcucucaguugauucccacucacuaugauggcuauauagaacacaaguucucuaccauuucugcaguauuuuaaaaauuccuuuaaaaaacuaaauauuuauugugggacaaaauauuauaugcuuacuuagaauauugggaagaugguaaagaauacaaagaaaaaaacaauuguaccccucauucuagacacaacuugcuguucacgucuuugggguguauuuccauuccuacuagauggaaccauuuauauguuuaccuaauucggaucauguugcauacaguuuuguucccuucaaaauuauacuuugaggcuaggcgcgcauaguggcucacaccuguaaucuuagcacuuugggaggccaagaugggggaggaucacuugagaccaggaguuugagaccagccuggucaacauagugagaccugucucuaccaaaaaaaaaaaaaaaaguuuccccauguuauuaaagauuuuacaaaauuuaauuucuaggcccauagcaagacccuaucucuacaaaaaauuaaaaaaugagccgugcauaguauugugugcuuguaguuccagcuguucaggagacaggcaggaggaucccuugagaccaggaguuugaggcugcagugagccaggauugccccacugcacuccagccugggugacagaaugagacccugucucaaaaaaaaaaaaaaauuuuuuuuuuaaauuucuaaauuuuucuuaugcuuguaccauuuauuuauuuaacuaccuuaccguuaguggcauugaguuuuauaauuuuuuaaccuuuuucaacuugaucauagaugcagacgacauauuauaauccacguuauccuugcuaaagagugauauagcagauuguugguugauaggaucuuuuugacuccagauuucauuuguuuuagauaucucaucuuaaauuguccacuguuuaucuuuagacuucucuuuggagugugguggugcuuaauauuucucuuaagaaucacagauuaugugccuggacacuccuguugaucacuucuuuauuggaauuguuuaauuaaaauucuugugaagcagcugucuccauuuuuauuucuauggcauaauguuguugaaugugacuauuagaacauggagaccuuuucauugcaucucuauguguaugcuaaauauacccauuuaucaagauggaacucaggacuaccaguuuuucaaugcugcuucucucugcuacaaaggcaucagcuuuugacauauaugauuaaauucccugaaaauagaaauauuucaccuuuuccccccggcuuauauauuuuauucuuuuucuccugcccccauauuuuucugagcacucagacgcaggcaggugugcugugcuugcccagugucuacugucauugcuguggauacugcagugucagugccugggugguuccacacaucgcucuccagccaaaccuguuuugauuuuuuuauaauuuuggcauguuuugugguaauugaggauccugugguucucaacacuuaccauauaugaucucuuuagugcaguguuucuauauuucucgccagccuaacaaacauaaauauuuauauaauaaaguaucucuguuuauacuaacugacuuacauggcauaaucuaccuuuucccuaaaaauaauuauacaggugacuuccuggaguuaaugaucuccaugauaauuguuugucuguuuuuauuauuguugcuguuaacuucuuguauauuaguuguagccgggagguagcacuaauucucucacucccauugccuuauuagagucuacucuacuccuguucauggcacugacuuugccucuuaaucaaaugaaaauucauucuaccaucaagucccugacauucuuuuagccuccauaaaguuuguccaucauaucucacuuuucuucacaccugcagggguuuccagguguaagggcuuauuggacugugaaacuguuucugagaaggccacugcauaaaguaguauauugcauuguguacaggacuucuguuuccugcucucgacaagggcugguggccugggaaucaauuuggcuucagcggacacagucgucaucuuugacucugacuggaacccccagaaugacuugcaggcacaagcccgagcgcauagaauuggucaaaagaagcaggucaguauggagaggcuucuggaaauugcuuuaggguugggggccagggggcuuguucagcccuuucaggauguuaauaaaaugcuuuuucccuguuuugcuuuuauuuccccugaagcauugauuucuguuuguuaacuagcacagagauguugucuuugggcccaagaugaaccuauuaaggaacuuuucuuuuucucuguuugaaaaguacaacaucagcgaccuucuauguguuuaucuugagagagauauaugaugaauagacuuagaacugaacauuuucucuauuuuaguauggaaaaguuaaauauccuauuguucaagaugguuuguuuuuauuauacaugacaguguuagcuuuaaagguacuuuggaaaaccacacacuuuuuuguuuaugaaucuuaaagucuguucuauauuggauaacccguaaguuucauucuuggccaaagauucuguuuuuguggaacuuuccaucacugaagcacgauuuuuauugauggaacaggccauaacgacagaucuuuagaggcaauuuuauuuaagacuguaaccugcugcacauaguaaaaguauugcaucuacuuaagcugccugcuuggauggcuuacagucuucuaugguuagagaauaaauucuguuaaaauuuuccccucuuggguuuugacagagcuaauccuucucucuuuuuuuggggggguuggggggugguucaggcauaagcauaacaguuccuuuuccuacagguaaauauuuaccgcuuaguuacaaaggggacuguggaggaggagaucauagaacgggccaaaaagaagaugguauuagaucaucuggugauucagcgcauggacaccacuggccggacgauccuggaaaacaacucaggaagguccaaguaagugccaggaagauugggagguaggcagaaucaaauugauucuacaucacuguuggauauaauaggauuuucuaccacagacauuagucuguucauuaccuggaagaugccaggccagaaccacaaauaggauagcauuuucacuuugaguuucuugguuccuuuuuuugcccaucaccccccuucuuauguguuuuccucucuuucuugcccucucccuuaccuuugcuuuuggcugcucaugugacauaugacacagcaacagcaguggaguuguguguugggugucagccuagcauaaugucaccuuugacuuuucugcagugagaauccagauuggauuggcagcuguuuuuuuuuuuuacuauuggcaaaaauguuuguguggagauuguugugcuuccagaaggguguaaaaagaaaguaaugaaguuuuaauuggcuuugggaagaggcacagcuacaucuccuauaaaguuuaauuagccaggcaugguggcaggcgccuguagucucagcuacuugggaggcugaggcaggagaauggcgugaacccgggaaguggagcuuacagugagccgagauugugccacugcaguccagccugggcgaccgauaauaauaauaauaauaucaaaauaauaauaucaauauuaucaagauaauaaugauaucaaaauaauaauaaaaauaaguuuacauuuugagcagauuguugagugucuucuguggugguguuucagcuauguuuuuuguuuguuuguuuguuuguuuuugagauggagucucgcucggucgcccagguuggagugcgcuggcacgaucuuggcucauugcaaccucugucuccuagguugaagugauucuugugccucagccucccgaguagcugggacuacaggugugcaccaccacaccuagcuaauuuuuuuuuucuuuuuuuuuuuuuuuuuuaguagagacaggguuuuuccauguuggccagacuggucucaaacuccugaccucaagugauaggcccaccucagccccucaaagugcugggauuauaggugugagccauugugcccgcugcagcuauguuaaagguguauucaaauuagcccuuccuaaauaaaauguuuucagauaguuuucuguuuaagaggaagcuagaugagaaaagccuagcucuuuuauuuuggaccgggguugagaagguugaaaauucuuggugaauuauaacuuucugaguaaaaggccaaaggaaagagcuccauucuauaacauugcuagucaccuuucuggcuuacccaugcaauaggugaaccaguaggacuguaacuaauuuucuauucugcugguuuaggguuaccaucacagacucauccuguagauagaaaaugcgauguuugagaaaucauuuuucuugaggcagaguuuauauuuucagcaguuaacuugaccucuuucugaaggauaguuauucugaaguagaacacuuuagagguuauuugauguuucuaacaacuacauuuuacuuccacagcucaaauccuuuuaauaaagaagagcugacagcuauuuugaaauuuggagcagaggaucucuucaaagaacuggaaggggaggaaucagaaccucagguaauuaacaaugaggagagggaaauuuuuuugagaaguaugaucugugagagucuaacuuuucuguaagaagauucuguuagaggcuuuuguaaagaaaaaguaauuacuugaaggacaguguguuuuucuuucguaggaaucucauagcucuuaccaaauugaguaggaaggaauuaauaaagcauucgaguauacuuuuuuggguuguuuuuuucucccauuucuguucguuuuaauuuuugaaguuucaccuugucauuuguauaaauuauaguuugagacauuagauguaaaagauguagaguugaaacugaaaguaaaugaaauaucagaaaggagaauugguuuauuugcaccaaacauuuuuaguaaauacgaauaauuucugggcaacuaggcaacucaucuguugccauuuuauucuauucguguuggcuuuuguucuuuuaggaaauggauauagaugaaauuuugcgguuggcugaaacgagagagaaugaagugucaacaagugcaacagaugaacuucuaucacaguuuaagguaugaagaucuuugugggagagaguucucagcauugauucauuaaugaugacuaauguuuaugaacgcuuucuuugugcuaggcgcucugcuuuucucuuuaccugaauugagucauauccucaauauuguucucugaauugugaguauguugugaauguagguucuacaguccgcacgaagguaaucacugaagugggcuauccuauguagagucaguguguggcggaaaagaaaucacugaagagagggcuagguagagagccaggacagaguguagaaccaggacguguggagcacugugggacacgucaauagaucagaugccaaagagaggucaaagauaggaaaagaguagaugacaauuagaagguucugaugacuuggugagauuuuaguuuguuuuuuguuugguaagugagagaaagaggugucaguggugucucauauaacagaaaauuacaugaaaugaggacuaaacacaaaaguugggcaccagacgaauaggagguggcagcacagaguaucaauguuauuaaaaagcuuagugaaagaguacagggaugcuaaauuauauggcuagaagguugaagcaagacaagguuuuugaaagauguuaccauguuucuaguuugaggaaagaacuugaguauagggagauauugaagguucucaggaaggaaaugauuugauggcacauugccccagaggagacuggaagggauacagucaaaagcacagauggaagacuuggccuuggaaagaaaaaggacaaguacacuuuagggaagaggaggaaagagaugcugugggaguuuaauuuaugcucuuaaugacuaguaaaguaagugagguguuugcuugagaaguggaaaagauuugggacagccauggaugaggcagaaaguuguugggaggaaccugauagggagucagcugaauugagaugauacagcuuugccguggagccagucagcagggucauaugacuuucuccagcaauacuuuugaggucagagaaauuggaucaguuggcuaucccaaggugggagauuggcuugggaggcacaggaaagucaaaauagcaaagguuuucaagauucaugugacagcuuggaaggaaggauugaccauggguugauuccauggagguagagaagcaagagagaccugaugauuacaaugauggcuaaguguaguaugcccauuaggauugaauugaauuaggggaaauugugugaaguguuuggaaggaagcaauauugugugauuagcuccaaagcuggccacugguagaaguuguuucaauggaagaacaaggauggaauugagugggccagagagcccuagauuaauggguuaggaugcagaggaugggguagagaagggggaaggugauuuauuaguguucgucauagucgguuugggcuccugcaguaaaauaccguagacugggugguuuauaaacaauagaaauguauuucucacaguucugaagauuugaaguuugagaucagggugccaacauggucagguucugguggaggcucucagguugcagacugcugacuuuucuuaucuucccaugguagagagagagaagcuagagagcucucugggggucccuuuuauaagggcaguaauccuauuaugagggcucuacccucaugaccuccuaacaccuuacauugggaguuaggauuucauccuaugacuuuugggaagaacauaaacauucaguccauugcacuguuucagcucaguuccaccucugugacugcugcuccuuucuucagcaauaaaaaccugcacuuguguaacucuuacuguguuucaagcacuaucuuaaguuaagggccagagucuggccuuuaaccacgaugucccuuuuggaaaaguuaaauuccuuacugcaugaaccacuaacguaugugcauauuuacaucaaucuuaauuuuaguuaauuuuagccaaaagucauaaaguaagagucuuaacuugacuucacuguuggcuccaaggaauggagccuccagaagcucauuuauaccuuaugacugucucaaaggcuaggagggagggaauaagaagaaugcggagccaggcugggggcugccugccacugcucagaugcuguccagaggugguagauguuucuguguacuccuccucugguucuuugaaauggauacacuuagauggcuuucuuucugggauaccuacuguuuuaguacaaauacauaucggauauuaaauaauauuugauaagaaaugaagagaauauucuucuagauuuauuuaaauuuuuucuguuuuauguuuucauuuuauuuccuaagacuaaagugcacuugugagcauaugaaaucaccacacaucuuuaacuuucauauuuuugauaaaaaugaauaaagcaaccaguuggcuagaugauaaugagugcuuugaguuaugcauuguuucaaaugaacucuauacaacuuauagaaauguaaguucaucauggaguauuagguauuaagcauuuuaaaaucuaaauaaaucuaaauuuuaucauuaguauuauauuuauuagaacauguauaugauuuauaacagcucauucaauaaaacuuauaaaaacaauuuguaucuuuguagcuguuucucugcuuuucaguaaaauuuaugaugugaugaacuugaggacuugacaaguugauuuuuggggguauaaaggaaaaauuaauagaaaauugauuaucugauuauguaauaucacaaaaguccuauuauucacagugucuacuuagauaaaaacacuggauaaauuguuuuaguagaugguguuuagaaauagggaaaugucagacaauggguugucuguuuuaagguugccaacuuugcaacaauggaagaugaagaagagcuagaagagcguccucacaaggacugggaugagaucauuccagaggaacaaaggaaaaaaguagaggaggaagagcggcagaaggagcuagaagaaauuuauaugcugccucgaauucggaguuccacuaaaaaggugaucaagugagaugaaagauaugaaauuauuucuuauguugugaaugcuacagaaguguugauuauucaaagaagaggccuugcauuguuccccugacacagaggcuucaggagcagaguugauacuguaggaaacuuaacaaaggaaaguggagaaaucugcagagcuccugagcacaccugugagacaucggauuuggucuuugcaaauuggcucuuugugaagcugauaaacagggucugaaauuuccagaaguuugcauuuugccuuugaguaguccucacaguuuggcuguuaauugccacugccuucaacuuucagaaagucacaccucuguuuguccauaacaguucacagcacuugauauaaauacuuaguaaaggauuauauaacuauaaauaagaaacauauaccaacuugacaguucacaaagcuccaucacagacacuaucuaauuugauuuuuguaacaacauugaaauagguagaacaaguuuuuuuacccauuuuguuggagguaauagacacagauuuguucaaggucacaguaaaucaguaugagguaacacuagcuaccauuuauugagcccuuacaaugugcuaggcauacuucuaagugcuuuaacuuacugaaaaccaucuguuauagguacuauugucuucauuuuucaaaugagaaaauaaaggcacaaagaguaaaauuacuugcccaaaggaguaaacaugaaccuguuuuauaaugggauauuguaaaaauauucauauauuuuuaauccaguucacuuaucguuauauuacaaugucucugaaaguaugacuguccuaaguggguauuucuccaagaccugucuccccuuauuugucaaaggaaaauugacuugucugauauggugagaaguucugaauacuaaagaauuaagauggccuucucuuaguccuuucaccacuugaacuucgcacuuguuacagugugacuuugccucgaucuuucucaggcucagacaaaugacagugacucugacacugagucuaagaggcaggcccagagauccucugcuucugagagugaaacggaagacucugaugaugacaagaagccaaagcgcagagggcguccgaggagugugcggaaggaccucguggagggauuuacugaugcagagauccgaagguugguggaggcucuguucucacugagcuuguuugaaagugcguacuguaagucuuggguugacuggauccuggacaucgugacaggguaggcagaggcuaauaccuacaaaaaaggaaagagaagcuggguccugucccagaucuguaggaugauccuuccuucuccaagguuucuuucuguugagaucacuuuuauuuguuguucaucucucuauuucucucuuauucucugguuauucagaacauuuucacaaaguucagcucggggaaggagauaauugacauacauguauauacagacuuauguaucuguauauaaaagaaauaucaaaaauaaaaaugguacaaauaagucuacccucacuaccucuccccuccgccacaaucccacuuccaccuguguuaguacugacaucaguuugcuagugguuugcuuugauuuauaaguaguauguacagcauguuguucagcaccuugcuuuccccgaucccauuuaaaauccauuuuagacaucuuucuaugugagugauuacuauacauuucuugguaucugauucaaaugucucuauccuccauaaaaaaaucuaaaauuguugcuuacaaauuauuuuuuuuccaguuuccaucuuuuuuuuuuaagccugaagaaaauagaaaguauaaagaugguuuuaaggccuaauccauauuauaauuauauuaaauaguccuuuaaguuucauguauuugaaacugugagguguuucuuuucacuuaaaggucacaccuauucuucuuucuuuguuuaauuuacuauggaaaaauagaaauauuucaaaauacugacagaauagcauguaacacauccccucuugugcuuaucaucuuaacaauuuugaauuuguagccaaaauuguauguauauauacacaccccaccucuucuugcucccuauucccaguauuauuuugagaagaauguguuuucugcuauggggcaguauguucuauagcuguauuuggcuuaguguuuuucaggucuuuaauuucuucauugauuuucuguauaguugugguuauuuugguagagucagaaucuugcucucuugcacaggcuggaguaugauccuaucucacuguaaccucacacuccugggcucaagugauccuccugccugagugccuuuuucacucagccucccagguagccaggucuacaggcaugugccaccaugucuggcuaauuaaaaauuuuuuuuuuugguagagacaagguuucauuauguugcccaggcuggucucagacuccuggccucaaguauccuccugcuucagccucccaaaguguugggauuauaggccugagccaccgugcgcagccuaguuguucuacccauuauugaaaaugggauguugacaucucuguuacucuuauaugauccauuuguucuucaauuguuaguuuuugcuucauguguuuuuggacucuuauuaauuguauauauuuuuuauaaucgauaggucuugauuggccuuuuuauuguaacauguauuucugucuguaguaacaauuuuuguuuuaauuccuauuuucaguuugauauuaguauagccacuccagcuuucuuuuuggguauuugaaauuuuaaaaaaugguauuuggccaggcauggugguucacgccuguaaucccagcacuuugggaggccaaggcaggcagaucgcuggagccuaggaguuugagaccagcauggucucaacauggcgaaacccucucucuacuaaaaauacaaaaaauuagccagguguggugguacacaccugcagucccagguacuugggaggcugaggcugaggcacgagaauugcuugaacccaggaggccaagguuugcagugagccgagauggcaccacuaaacuccagccugggugacagagcaaaacucucuaaaagaagaaggaaaaaaaaaaaaagaugguaucuuaaaauuuuuuaaaaauauuuuuucugccaaucucuuuuuuuugauugcaguauuuaaucuauuuacauuuaaugcaguuauuauaaaguaggaauuaugucugcauuuugcuauuugucuucuauaugucauguuuuuuuuguuuauuuccccauuacuacuuuccuuuguguuaaauauauaauauaccauuuuaauuaccuuaaaaaaaaaacuuuuuuuuucacuuauuuucuuagugguugcccuagaaauuacaaguaacaucuuagaacaauuuacuuugaauuaacaucaauuuaauuucaauggcauuauaaaaacuuugccccaguuauagcucaccauccccauuugugcuguugucgcacauuacaucuuuacacauuuuaaacccaucaaugcaguuuuauaauucauacuuuauauaguuaguugucucuuuuuuuuuuuucuuuugagacggaguuuugcucuucucaccaaggcugggguacaguggugcaaucucggcccacugcaaccuccacuucccagguucaagugacuguccugccuuagccucccaaguagcugagauuacuggcuccugccaccacgcuggcuaauuauuuuuguauuuuuaguagagaugggauuucaccauguuggccaggcuggucuugaacuucugaccucaggugaucggugugccucggccucccaaagggcugggauuagaagcgugagccacccacacccagccuaguuaguugucuuuuaaaaucagauagaaggaaaagaguuacaaaaaugcauguauacuguuuuuauauuuacuuacucuauuauuccaugggugcucuuauuucuucaugugauuugaguuacuauuuuauguccuuucaugucugcccaaaggacucucuuuuagcauuuuauuuugaggcaggucugcuaacaauggauucucuauuuuggcuuagcucgcacuguuaauuucaucuucauuuuugaaggaaagucuuaauuucuuuuuuucuguuucucacgugggauaaucucaauuggccuaucuucagauuuggcaguucucucuucuucaggcuaauaucugcugcugagccucaccagugauuuuuuuuuucauuuccguuauuguaguuuucaacucuagaauuucuauuucacucuuuaaaaaauguccguuuuuaaacagcauuucuguuucuauugauaucauuuucgaccuuucuuuuuaauucucuaggcagacuuuuuuuaacucuuguaaauauuuauaauagcugauuagcauccuugucuuauaagccuacaugcuagacuuccuuagggaugguuucuauuaccugcuuuuuuuccuauguauacuucauacuucauacuuuuuuuuuuuuuuuuuuuuuuugagauggaguuuugcuccuaucacccaggcuggagugcaauggcgcgauuuuggcucacugcaaccuccgccuccuggguucaagugauucuccugccucagccucccgaguagcugggauuacaggugcccaccacaaugcccagcuaauuuuuauauuuuuaguagagacaggguuucaccauguuggccaggcuggucucgaacgccugaccucaggugauccacccgccucggccucccaaagugcucggauuacaggcgugagccaccaugcccagcuuacuuuuugguuuucuauaugucccguaauuuuucccgugaaaaacuggacauuuuaaaucauauggcaacucuggaaaucagaucuccccucccagccauguguuguguuugccgcugcuguuguauuugcuuguuuagugacuuuccuguacuaguuaucugaagucuguauucuuugucauguuaugugauccuugucaugcuauguguagucucuacuccuuuagcuuaguggucagcuaaugauugaacagagauuuccuuaaaugcuuugagccuguaagucuaccagccuuuguugaagggcuggguauguguuguuggggcacguuucaaugcucuggaaggcaauugacaacucugccuuaacuuucaguuccugcuugcacaguugcucaaggucuuucucaggcucagacaaaugacagugacucugacagugaguccaagaggcaggcccagagauccucugcuucugagagugagacagaagagucugaugaugacaagaagccaaagcgcagagggugucccaggagcgugcggaaggacccuuugagaucuuuccucugcauggacacagaccugcacaugucagagcuuuucagaguaucuauccuaugaacaucuuuccucccaguuuuucuuuuugucuuuguucaaccuuuuguuauuuccaguugguaauguugccucaggccgucaugguguuaaaucuuugcaucuaauuguuuuugaccaaugaauuuuggacagggcuauucacacagugaguucugggucaguccaauaaagacaagccugagaauggagcuucuuagggugcuguuagccagguccagucauucugggggaauagggcuuuuggagaacucucaaccucuucuuuacccuccaguggcugcugugcugcugguuacacagcuauuguaguugcagaaguguuaguuuugaaggcugucaugcagcugggguuaaggggugggaauagugcaaguuaaaaaaugccuugaagcuugcugagccauuuucuugaauaaauuucuuagauggcugcacgcauuugguuaauuuccagaguugugacaauacugauugugaccguuuaugccagcauuccuauugcuuuuaugggggagcagauuuucacagacccuuagucugucauuucggaaguguuguuauuuagacauaaaauauuucagugucugucaagaaggagaaaugcaguuaaggaguaauccucagguuuuguucauauauaauacuuuccuaaccuuuguaucugcgcuguuccuuuaauguuguuuuuagcuauugucauauucagucccauuuuauucuguagccaugucuucucauuuccauuuuucccuuagcaucuguccuuacaugguuauauaacccaauuaucauaguaauuuggcauauuacaugaugcccuuaaugugucaugaaguccugguuuuuaguggaaaguacuggugaccagccuguaggaauggggaugauggcaugaguugguauguagcauaguuuaggguagagacuugcaggaagauagauuggauuuuugggaggagaggucaguagaguuuccaaaauuguuugccuaagaaguuuuaaaucauauuuuacugugccuuauuccaaaaacuauuugagacagucaaaaaaaucuuaacagcugaaaaaucauugguuuucuaauaacgaaaaauaugguauugaagguaacaguggugaacugaauacgcugaugaaacgauauaaggguuugucacaauagagucgugaugauugaauccuuuaugacacagugaagucuauaaacuuguaucuucuaaaaaggauauuagagcuaagucacaguucucuagcauguuaucuaagcagguuuauguacagucacugagaauaaaguugaucuuuaauuugaauagauuuuuagcagucauuauuuuaaguugacuaguuucaaagacauucaacauuuauucauuuuuuugguagugcaaggauugaguccacucuauuuuugacaauuugcauggcucauaugucaucacaggauaugcuagcaucaacauaacuaaaguaagucucuguuuuuuuaauauguuuuauugauccuauucuuagguucaucaaggcuuauaagaaguuuggucucccucuugaacgguaaguucaguguaauagucccuuaucuuccucuuuuuugcuuuuauuauauaguacguucuuuuuugguaaauuuuuccauuuaauacuaaugcugggaacauuuuuuuuucuggaaacauuuauuuacaaacauuuauauauugggugccuguucauucaugucucucugcagagggaugacaaagaugauaaagacaggccauccauaaaaagacuuucaccuucgugagggagauaaagcaaguauauucaaaaccauagugcgugaaauaauuuccagagagauguucauguaacuccaguugaaaagaauguauguaguuauuauuuguauccuaguucuuagauuuaauaaugucaaagguaaaaggcucuuuaugauuuuauaaucuucugcuaauuagcaggauuuuaugaggauuaaauacaaaggacuuaacauagccuugacuauaaaaacuuccaaaaggguagcuguuguuacuauucuauaagcauuuagaaaauaauucagaaguuagauuuuaacagaagacucuauuugaaaugguucgguacuuuacuuccuauaaaaucuaaaaagcccuaauuuaaaggaaauacugggcucccuucucuuucuucugauaaacuucuugagugggugaaaauuacaagccuguuuuuguuugguccucuccauuuggcgaggagguagugauguguagcauuaagccacagcaaggccaagaaggucaguugcaucuuuccaggacuauugcugaccacccagggguagacugucuguuuuugggccaguuaccguaaaagccaauagaauguggaaaagggggcuugacaccuuuugacagccuguuuuuuagcuguuaauguaguugugugcuucauaugacauggagaucaacuaaacauauaguagaaguagcuauacucugcuucuaggagcauugcagugaaugaaaguaggcuggagaaaggaaagugaacacaaaagaagcaagcuaguacggaugguguucaggcacuucaccugcugccacuaacagccuauuuauuuaauaaacuuugcuuugcuuguuucuuucuuuccucucuguuuuuuggaauuauuuuguuuuguggaauauucaagacacaauucuuuaugauggaaaaugaauguguuagccuucagucaauguccagggguucuuguuggagccuuagaaugaccacuaaaggaacgcaaagaaaagugucuuugcaggagaagauuaugugaggccuaguggcaucucaugacacuuaagaagagugggcacaggguccuaaaguguccccauauuuguuccuccucaggcuggagugcauagcacgugaugcugagcugguagauaagucgguggcagaucugaagcgccugggugaacugauccacaacagcugugugucagcaaugcaggaauacgaagagcagcugaaagaaaaugccagcgaggguaagcgaaguuggcuuuagugagucuucgcaaccuggcacucuuggacuggauuucuguugcuaaagggcguuuuaaggacaggcuugaggaccacacaugccuagugauuucagguguuuauucugagcugcguuucugugagcuuaauauucuacucuccuacaggucuacucacaaaugaaguugauuugcagaagguguagagugaagaaaaagaugaaaugguuuuuuuuuguguugcuguagaaaguuuaaauucgucggagugauguaaaaacccaggggcagagcuugguggacaccucuguauuuuggcugcaaauaagagguguuauagaucacaagcauuguuaauuaucuuggauauauauugugcguuauggcaaacacaaaggauuuagagaauuaauuggaauaaauaaaauauuggaugaguaucguaaacauuuuuggguuacguugagauuuucaugccacuagaauuuguucucauuggauuggacaugcaguguguuuucucuuugauaccagaaagugauuuugccuguccugugugauaucuuuaaaagcaagagguauaggaaugcuugugaggagagaacucugaaguaguuauugguaaggacacccucauagugaacuuuaaagaaacgaagagaggccaggcgcaguggcucacgccuguaaucccagcaguuugggaggcugaggccagaggaucacuugagcccaggaguucaaguccagucugggcaauauguaagugagaccuugucucuacaaacaguuuaaaaauuagccgaaaguaguaggaugcacaccuguaaucccagcuacaugggaggcugaggugggagguucgauugagaccaggaggcagaggcugcagugaguugagaucaugccgcugcagugaguugagaucaugccacugcacuucagccugggugacagagcgaaacccugucucaaaauauaaauaaauuaauuaaaaaauaaagaaaugaaguuauuaucauucuacuucuccagacugugguuuaucugugccauuucugcauuuuuuggggacagccuuuacuuagguaaggcuacccuucugcagcuuuguugagcugugguuaaaucuucaggcuccagagaaagaggcagucaguuaucuggaauuuugguucuaccacuucuaguuauaagacuuugggcaaguuauaucccuucaacugucucauuugcaaaauagaguaauaguaucuacuucaaaggauuuggauaauugaauaauuccauacuuguaaauuguuuagcaauggcgucuggcuugcaauguuagcuguuauuaagaagugaguauuugugcuuugaaauuuucuuuuuuucuuuuuaagauuuuaauaauaaaaaauuauuuuauuauucaauaauaaccuuaauauuauugaauuugauauaauuuaaaaauaucuucaagagagucaaaacuuauuuuaagauaauguucuuuuuuguaaaagacaaauaacuuguaugguuugcaaaaugaucugaauaugugcuuuuauaacauucagaauacacccaaaaguaaacuuuagguuuaauguacaguauguuuucuauguaauuguuuugaauaaguaauacaucuacauggcuuaaaacugaaaaacguauuccuguuacuucuugaugcuuuugagaaaugaauaauguuuucucccuuuuaaaugguaguacagcaugcacacuuuucugugcuugcuuuuuuaucucauaguaucuuguggagcuguuuucuuaacagucccuucuccccaaagucucccuuuuuuuugugcauguccacauucuggaucuggcugauugcuucuuccugguauuaacuuauuuccucacaccuguauuuccuguaaacugguauucagcauauucugaauccaggcugacauuucuagaucaaauggaagauuauugauaccuuuuuucccuuagguugaaauuuuuguuucuaaaaauguuaacauaauuacauauuugcuuuaucccaaacauauguuuccaaauaccaauaccaaucuuacuguuaacaaaagaaugcugaaaugcgaagugugauuucuuugcauuucuuuuugaucuuagaauauaucacacuaacaauauaaagucaaaauauauguuuaaauuauucaaaguuauuccuuucucugugugguuaaugccaccaccuuaauauauaguuagacucuuuuguuuucauuuauuuucaguacuuagggacugcuuuucucauuuagauucgauuuaauuuuuuuaauuauguaaaaacauuuacaugguucaaagucacaacuauaaaacaagguacauuuggagcaucuuguuuucguuuuuuguuccccagcugccuucucuuccuccuuaauaggucacuguuucuauuaguuguaaguuuaucuuugauuguuucuuuuaaaauuuaagugugugugcguguguauuuuccuucuuacacagaagagaacauacucuuuugcaccugcuuauuuucaugacugagauaaauucauaucauuauguagagaucauccucuuuccuuuuacaguugcagaguauucuaccauguagauagaugucaauucacacuuccccccuaguauuuaauauuuggguuguuuucggucuuuuguuauuauaaagaaagucacaaugaauaaugaucuaaugaauauaccauuucauaucucugccagcauaucuuugggauaaauuucuagaagugggauugcuggguccugggaaaaugcguauauacuuugcuucgauauucccaaauccuucugcauaagucuggugccacaauguuugucacaagccucacaaacagaauauauuguuaaacguuuggaguuuugccaguuugauaggugagaaacgguauuucauuuuucuuuuaacgaacaagguuguacaucucuaagggucacuugcauuuuguucuauaaagugucuauucaugugugcugcccauuuucuauugaaaggaguuuuccucucacagguagcauuaucucauggauuucaaguuggacuauuugguuggggcuucauuuuuacuucugugaucauuuuaauuugaaauuuggguuaggguaaguuucuuuuuuuuuuuuuuuuugagauggagucucgcuccaucuccaaggcuggagcacaguggugugaucucggcucacugcaagcucugccuccuggguucacaccauucuccugccucagccucacgaguggcugggacuacaggcgcccaccaccacaccuggcuaauuuuuuuguauuuuuaguagagaagggguuucacuguguuagccaguauggucucgaucuccugaccucgugaucugccugccucagccucccaaagugcuaggauuacaggugugagccaccgcgcccgccuggguuaguguaauuuucuuaagccaccacuuguucaucauuucacauguguuagaugugaacuuaagcucauguguuuucaguaauaguguugugaagaucaaguucauuuuuaaaacacuugagaguuuuuugaccuucgcuagugggauggguaggaaaacaaaaagagaaaccuucagcacuaauauuauacccucagaaucuacuuuuguucauuuggaaacaaaguaguauaaaacaagcaggaagauuaaaauacaacuauaaacaucagugaauuaaaaaagaauuccaaaucuuaaaagacugaauguucagagguuauuuuacagacauuaguugagaaaaaaauuugucuuauagauuauaucuucaaaauaacaauaagccagagauauauucagagagacuaagaggucaggguucguugauacauguuuucuguggaacuucugcagauuuucauuuaacuaaugugaaacugguauuuuucaggaaaaggaccagggaaaaggagagguccaacaaucaagauauccggaguucagguuaaugugaaauccauuauccaacaugaagaggaguuugagaugcugcauaaaucuaucccuguggacccugaagaaaaaaaaaagugaguauauuuuguguacaugcuuagauggucguaccguaagaaaauagauuugaaguuagacuuuguguaguuccauaguauuuuuacugucucuucuuuaacauaccaaaaaggccccucuucuaaugucuuccuguuuuuaaacuuucuuuagauacugcuuaaccugucgugucaaagcugcacauuuugauguagagugggggguggaagaugauucucgccuguugcuggggauuuaugaacauggcuauggaaacugggaguuaauuaaaacagacccagagcuuaaauuaacugacaaaguaaguaacccuaccaugcuagagauuucuagaagauuuguuguguaauauuuuuauaucgauuacuuauuucuaacuauuuucgagggggcaucaaauuagaaauuaguauagucauucuuggaaauacuuccaucuuuagcagauuguggcacuguuucacggaugaagauaaagggaaaagacaguagccaggugaaauuuuggggaaacuguaggagaaaucuuaaaauucugguauuuaauuauaggucagauuucauuacaauaaauacccaggugaguuuguuaaugauaaaagcauuccuuggccuuaguuauuggcccuuuguuuaaaaguacauuugaaacaaccauauuucacuuccucacguaaagauugaaugucaccuugguauucuuuguaauggaauuaaacauuggcuguucuucucccacaaaaucgagccucccacccuaucuguugcaaguagcaaggccaugguuggagcuauaagcagggaaggcugacuggcucaaauuuugguaggauuugcuccauguugugcuccuggcaguucaacagugcucaucccaucugguuuuaggagggugacagcacccugccuuaagcacugagaccagauucagucuggcaagagacccaguuguuguagcaaggaacagaucauguccuggcguagcucagugcucuccggcaaugcucuaagaagcauuuucaaucuaaaacgaagcuuuaaccuagcuccagggauucccugcuccuggaaggaggaaauccacgacggcugggaugcucuagcagaugaagccacaagccccuccuaccugaguuguucuacccuguuaacagcacagguaggagccauugggagagcuggauuucuccaucccauuuuguaaaaugagaacggcucgugagggauuuucagugacugggagccauggacaugagauaggaucugaggcuuuaucuauauuuugggugguuggggagggaaaggacugugcucaguuuuuguugucucuguuuauccugauccacuaaccaggaugugggugguggcgggugcuucucuuccuuucuuguugaagauucugccgguggagacagauaaaaagccucaggggaagcagcuacagacccgagcggauuacuuguugaagcugcucagaaagggucuggagaagaagggggcugugacagguggggaagaggugaguacgcugccagcugguuguuuuucaggggccugaggcuccuacccugcagaauuagguaggaagagagaggcccucucugagcacugcacagaaugucaccuucucaugggcauauuuuguuuuugagguuccaguaaugaugcuuugcuugguaauaauagaaauguucauuuaggccuggcgcaguggcucaugccuguaaucccagcacuuugggaggcugaggcgggcggaucacaaggucaggagauugagaccauccuggcuaauauggugaaaccccgucucuacuaaaaauacaaaaaaauuagccgggcgugguggcacacgccuguaaucccagcuacuuaggaggcugaggcaggagaauggugugaacccgggaggcggagcuugcagugagccgaguucgggccacugcacuccggccugggcaacagagcgagacuccgucucaaaaaaaaaaaaaaaaaaaaaaaaaaaaaaaaaauucauuuaagaccacggcaucuuggcagcuuucuuacaaacccauccuucugaaauguugcuucaaauucauccucugcuccccagucccacuauuccacacauacuguuacuguuucuuuauccuacuuucucaauuuuggaacauaguugcaguuacugcauugaauaccuguggguuugccuguuguucugucugucucugugguucuuguaauaguggaucccagagauaaaauggacaguuguaaugcacaguuaauucagaaacuagaccuuacuugcugugugaaauaccaacuaaauucucagugaacucagcugagcuuuaucuccuuuuguuuccccaauuuauaauuucaguucaggcccagaaagauggaaucccagcuaagaaauacaaguuacacccuguacuagcagcccaugugugcauguucuuuaagugcucuugcagcuaugucauuuauauugauuucccuguauuauuauaagcaaagcaaauuugaggaaaaaaacccauaauaccacaccucauuuuuuucaaguaauagggucauaagucucauucuucauauaauauguugaguaugcaauauauuauguguuaggcucuggaaaggcagagguuagaucauguuacagaucauaucugauuaggcagauaaacaguauuuuaaccuuuuccuuauuauauguaacuugcuuucagguuuuuuaauguuacuauuaugucuuuaauauauuaucuuuauuuguacuuuuguauacagagugauuuuccuuuuuuaaaaaaaauugugucuuuaggauggauuccaaagauguggaaucaguagguuuaaggaauauggauauuuuggcuggcaagguggcucacaccuguaaucccagcacuuugggaggcugagguggguggaucaccugaagucaggaguucgagaccagccugaccaacauggcgaaacccuguuucuacuaaagacacacaaaaaauuagccaguggugguggcaugugcuuguagucccacuuagcuacucgagaggcugaggcaggagaaucgcuugaacccgggaggcagagguugcagugaggcaagauggcaccucuacacuccagccugggugacagugcaagacuccaucucggaaaaaaaaacgaaaaaggaauauggacauuuuaaugugguauaggccauguauaaggccuauagguuuuuauuuguuuugguuuggucuugugagguaaaaugaguugcacucuuuugauuucuuuggaauuuucuuguuugaauuauauggcugcuacugcuuuaaagagucaucauguuguuugguuaugcuuuugagugucuugauuuguauuuuaaucaucauuuucucuccuuuuccaggccaaauuaaagaagcggaagccucggguaaagaaggaaaacaaagugcccaggcugaaagaggagcauggaauugagcuuucaucuccuaggcauucagauaauccaucagaagagggagaagugaaaguaugaagugggguuucgguugaggguuauuuauuuauuuuagcuauacuuaucaugccagcuggaauaaaaucaucugaaauguguuugguuuacgaguggauuaaauggaaauagaauauguaagucuucgcuuaaucugucagcgaggauaguuuaagucagcaacugcaaauuuguacauaauggaaguaaaugaaggggacuaugacauuuuuguuguuguuguuuguuuguuuguuuuugagaugaagucucgcucuuguccgcgaggcuggagugcaauggcacaauccuggcucgcugcaaucucugccucccagguucaagcaauucuccugcuucaaccucccaaguagcugggauuacaggcaccugccaccacgccaggcucauuuuuguauuguaaguagagaugggguuucaccauguuggccaggcuggucucaaaacuccugaccucaggugaucuuccugccucggccucccaaagugcugggauuacaggcgugagucaccgcgcccguccuaaaguuuuaaugauaaauggcgauugacacguagccucauucuugcaaaugacggggaguggucaggacugugguuaaccagagagcucaugccuaauguaaagggggcagcugcuauggaguucuguuaacaaaacuccugugggucagguuuggcuugccaguuuguaaccucuggucuaaguaaagugaauaguaaguugguaucauuuagugugcuauuucagugacaacuuuauggaauuucugagaguguaauuguacuuggauauuagcuccaagaggaucagcaguguguacaggaacuagcauggauuugagucauacauacagauauuuauuuauuuauuaugaguugcuuuuugagauggagucuugcuuugucacccaggguagagugcaguggcgcgaucugggcucacagcagcuuccaccuccuggguucaagugauucuccugccgcagccucccaaauagcuaggauuacaggcaccugccaccacaccuggcuaguuuuuguauuuuuagaagagacaggguuucaccauguuggccaggcuggugucaaacuccugaccucaggugacaggucugccucagccucccaaagugcuggaauuaugagcaugagccacugugccuggccaauacauacguacauuuaaauacuagcaaccuaaucaguuauuagcugacuuuguauagguauauaaucucuuugguacucaguuuccauccgugaaaugagaauaauaaacuuacguugaaggguugcuaugagaauuaaaugagaggauaucaguaaagagcuucugccucuacaguuguaacugguuauuacuggaaaguuuagacuucucugagucccuugaggcuauuugcuugaaaacaagcuucuaaguauagacagugaugaaccacugggggcagugcuucuuuuuccagaaaguacauaaguagauauaaaauuuguagcaaaaauucauagcccuguuuuguuuccuaggaugauggcuuggaaaaaaguccaaugaaaaaaaaacagaagaagaaagagaacaaggagaacaaggagaaacaaaugaguucuaggaaagacaaagaaggggacaaggaaagaaagaagucaaaagauaagaaagagaagguaaugaugcccuucuguucaugcagauauccacagccuuugcaauucgccauuuggauuuagaaguagaaugagauuugagggcccuggaauaauugucuuuuuauggguauguucaagaaggauggguggggccguugaugggauaccugcaccuguccuugcagagagaggggaaccugcaaguuugggguguucuuuaaaaaagaaggccuuuacuuggucuuuuaugacauauuucagggggaaauguuugaaugagauaggacaggugagagaaaucggcauuuacauguaaauacgaaauacguucucagauucauauuagaggagcacaauccacaacugaauuugaauacuugaagaguuugagucaaaaacaaauauuagcaagaguuauuggaauauaaauggaugaaaagccuugcuauuauaaccuuuacauuagggguuuuaugaaguucauucuaaaccaaagaauuugguacaguguugcaguguauacuugcugaccucugaacacaguaaaaucauugccaaaacacaaacaacugcuguaauucuaauauccaguugauaacucuaauagauuucuugauaagugccuuugaaacuuuuacuuugaaauuuuauauuaaauauaaaauaaacuucuauuuaagaacaaauauaaaaaucagauuaggcuguuuggguaguuuuuccuccucacuuagcaguauaucacaacuuuccaagugauuaaauguuaaagucauuuuuacagccuuggcaacguagggagaccucgucucuacaaaauaaaaacaagcaaaaaucuagcugggcauugcggcaugugccuacgggcccaguugcaugggaggcagaggugagaggauugcuuaggcccaggagcucgaggcugcagugagccaugguugugucacacuucacuccagcuugggcaacagaggaagaccuugucucaaaaaaaaaaaaaaaaaaaucauuuuuaauaguuggggaggauucuguuuggguguaacauguuagaagcaauuugaauuucccauuuugaaauacuuucuaauuuuugauguuaauagaccauacugugauaaauaaccugugcauuugugcucccacagaaagacauuauuuuucuuaaaguaaaauauuaaaaaaauaaaaaaagagcaauuuuagcaaacaucuguuuauccacucuccagauaccacaacuguuguuaauauuuuuucauguuuacuuuaaguggcuuuuuuuuuuuuuuuggcggggccaggcggggggagacgcugauaucuuuuguauuucaugaacauaugacugauacuguugaagcugcccccuguucccuuucccugauuuuauuacucuuccucuguuuuccccauaaccacuacugugaaguggguccgaaaccuuccuguucauguuuuuauauuuguaguacauauuauaguguauauccauauaacuauaaacaaagcauacuguaugcuuaaaaauguacaugaagucaagcuaggcgcaguggcucacacuuguaaucccagcacuuugggaggccgagguggacagaucacaaggucaggaguuugagaccugccuggacaacauggugaaaccccgucuguacuaaaaauacaaaaaauagcugggugugguggcgugcgccuguaaucugagcuacuugggaggcugaggcagaagaaucucuugaacccaggaggcagagguugcagugagccgagaucaugacgcugcacuccggccaggaugacagagcgagaaucugucucaaaaaaaaaaaaaaaaaaaguaccugaagucauuuuauauauucuucugcaaccuuuccuucaauguaauugagauuuguauagaguucauuuacaauaauguaguuaauacagauuccuaaaccaaaggguaugcuguuaauaaagguugcuacaugauacucuagagaguucugccaauuuacaagcuuaaccucuugaugacauuucugugcauuuuauggauaaaggaguaagaagcccaaaaauagcacugaugaaauugaaguuauaauuggguacauuuagagauggaaaugggaauaaugugugaguaagcugcuaaucagacagguuugucuucaugauguuucaggauuuuauuuuacuuuuuaaaaaauaaacugagaccaucauauuuacccauuuuaauaacacaacauagguaagaaaccuaaaucgcacgguaggauugcacaaaugacaaugacuccuuguaacucuuuuuuaaaagccuaaaaguggugaugccaaaucuucgaguaaaucaaagcgaucucaggguccuguccauauuacagcaggaagugaaccuguccccauuggagaggaugaggaugaugaucuggaccaggagacauucagcauaguaagucuugaaaucggggggugccagugucugcagccgcgguacuugcuguggcucugccuuuuauagguccagccagagcuucaguugagcuaagcaauaguacauuacuugggaaacacauugcuuacaguaucggaagaccaugugcucuucagcaggcuggcaggaagagauuuucuugucuuuuauugaggggaaguuuaaggaguggauuucaugucuugugcuccuaguuaagagaggcucucagggcccuuagaggcauuugggaaagagaaguguucacugagcaaguauuuauugaauguuuucuguguuccagcccccagaguuaccauguugaauagauaaccauuucuaucaucguaaacuguacauuggaguaggggaguuagauaacuacacaaaucauguuggugccccugugacagggcucuggaggagagagagugcauacuguggagauccugugagaagggaauuugaccuagucagggguugccaggagggcuuguguaaggaagugauguuugaguuggguucugaaggaagaauaaaagguaacaggagaagaggggagggcaaggcgauggggagcgagugcauggaccaggucuugcacgggauuggauacaggccaguguguccucaaggucccuuugccccuggcuggagcugcagguauagauuucacugugccaccaucccuuccccaccucucuguggucucuucuccccauacuuccacaaauccauuaaucaaacggcucauucaggcugaaagaaaaagcgguuuucuuucaaauuugaaaauacuuccauccuguggcagcaaaggacccuguugacccuguccuguaaccucucucugacuucuuucucugaguucucuaaaaccuauacacguauguauauagauauuguuuucuuugcacuuaacucuguuuucuuaagucucuuuuuugccugugagcucucugaggacaaguauuguuuuauauaaaggucauuuagaugcuagaaguauaucaauaaaugaguaaauugaauaaaugaauaaacuaauuacauagccagcuaaccaaucuguuuccuagucuuucuuuuccgaguguuuauaagagaaaaugauaucuaauguucuaugguaccaugauauuuaaaaaaugcucuuacaaaugacucauuuaaucuuguuuuuauauuaugaaaucuuuaaaagaugcagagaaauuucagggauauaauagucauugauaaauauaccaugaaguuuugucaaaucugaauuuuuuuaagacucaaaauauaaagcugaaucccuugguguuccucccucucaaccuaugcuuuuucugucucucucucucuuuuuuuuuuuuuuuuuuuugaggcagagucuugcucuguugcccaggcuggauugcaguggcucaaucucggcucagugcagccucugccucuccgguucaagcaguucuccugccucagccuccugaguagcugggauuacagaugcgcaccaccacacccggcuaacuuuuguauuuuuaguagauaugagguuucaccauguuggucaggcuggucuagaacuccugaccucaugaucugcccaccucagccuccuaaaaugcugggauuacaggcgugagccaccgcacccggccuuuucucucucucuuaccucccagacguaaccaugauucugaauucgauguuuauacuuaacgugugguucuagaguuuuacugcuuaagucuguaaagaugauaauagcucacauuaauagccaguuacuguuuaugugcuuuauauauauuuuuuccacaacacuccugugagguacguuaguguuuccauuuuacauauuuaaaaauaaggugaagagaguuaagugauuugcccugugucacacagcuaagacauagaacacaguuuugacccaggcaguucggcaugagagguuggguccauaaccauuguccuacguagccucccacauauaaacaacauagaggauugauuuccaugucuuaaaacuguaauuggcacuuguguauccuguaacuugcuuuuccucucacagcagucacauuuguugagauuuaucuauauuaauaauuguggcugucauuuaaguuucauguuauucuacaauuuauucuuccacaguuuaauuuuuucccguauugguggacaucaggauuuuuccaaauguuugcuacuacaaauaggcuacagugaaauuguugcccauauuuucuugcacuacacaagugagaacuucucuaggguguauggcuugagcaaaaauggugggucauucauuagguguacacaucugccacuuuauuagauacucgaguuccucuugaaagcaguuguagagauugcaugaauuauagcaaugaauucaaguucugauugcugaccagccuuagaaacaguuguuaauuucugacucaguuaacaguuguuaauuuuugcuaaucugaggacuaugaaauacugacugaaggucguuggacauuuauuuucauauuuuaguggucauucauguuccuugugaauugccuauucaguuauucaaaauugacauauuuggaauaauuuaucuuucuuaccuuuucuguaggaauucuuuuuacauucuuaauacuaaucuuuuauuuuuuauagucauuacaggugucuuuuaguuuuugguauauuuuuuauuuuauguccuuuuuaaaaauugaaguauaacacagaaaaauccacaaauaauaaguauguagcuguggaaaugaccacaaagugauggggaauuuguagaguuuucauuauuugaaaauuucaugaccaugugucuuacuuaguucauugugccagauacucaguggcugacaaccaugucccuacaccauucugugaaauuuucuugaauuauauggugguaauuuucucuaaguucccaguuuuaccuuuauggaauuucuuguguuuggauaucgaauucuggauauuggucccuaauuuuacuuuuuaaguuguucauuucugcuuuuuacucuacuuucugggagauugcuucaacuuuguuucacauuauuucuuuccaagaucuuuuuccuccaccgcucucgaauaucuuuauacuucucuuugcuuuccauuguucacguuacacacuuugcuucgguggcuuugcugacccucaguugucagcucauguuuaagaguggaggacgaaacaugugauuggaaguuugagcaugugggugguggggcuugaucuccuuugaaaguuuucauuauaggaugauguagcagaaacuucugacagauagucaggaucauuugguguuuccucuggggcggucacauuuugugaagaaugccccaguuuccugacucuccagagcgugaaggccuggcuccauccacucuggaaugugagaggcagagaccugggugugggucauccugugugacugugcucaugugcucagguaauccuguuuucaguguggugggcucagcccucaucugugccugugcagucccgcucagagguccuuuuauccuuuucuggagaauaagucuuuauauuugcugcugguuggaguuagagaucuggguaucuuaugaaucuggauauguguuacuucuuaagcaguuuuuaaaccgcuccccauuuuagcccucauccuuccuucugaagacaccucgccguugggggaauuuugccguguaagucagguuaguucuaggcugucuucccuccuggcuucgaauuucauuuucucaggucuguuuugucauuucccgugcugccaauauuuuguugccauuauccucucucuuguuuucucuugucuuugugggcuugucucuuuuaaggacagucccuuuaccauuguuuuagugggauuggggaggcagagaaaagaugcuuguguucuguuuaccaucuuaucuggaagccuuucucuugcuuucuuucaagccugaaggauuugcaaauauuauaucccguauuuuuagacaguuucuggugggagaauuucagauuaggucuguaauacugcugcucauuagaucuucaaaaugggcuugugaggcaugccaugccucucuugcagaugaggaagcaguauuuagagagguuaaguaaggcgugaaggguuaucacauaacucuaagcgauggugcuggcacugcacuucaggguuuucugacuugaauacuuacacuuacuccacugcacuagcuuuacccacucuuccucuagcaauuauauggcauaggggugggcuguguuuucaucgagagcacaguaagcaaaggacaagacuuacuuucugcagauuguuuaugucuuuacucuguuguccuguugcaguguaaggagaggaugaggcccgugaaaaaggcacugaaacagcucgacaaaccugacaaggggcucaacgugcaagaacagcuggaacacacccggaacugccugcugaaaaucggagaccggauagccgagugccuuaaagccuacucagaucaggagcacaucaaacucuggaggagguaaccacuuuggccucgucugcccaguuugauuugacugagugugggaguggauucuguuuucuuuuaauaaaagguggcauagccaccuaagaaaucuuucucccagcacaacucaucuauuggcaauauaccugcaggcuuuaacucccuuuccaugaaauaggccauuccacugagaccagccuuuugaagggguaggacgaugucauuaauuuauuuuaugagagaaagauaguguuacuggauuugcuggucuauucucagaaauaaauuuucuuuaagccuacaaggggcaaaaaucaucuggucuuaacuacuuuacccaucucagguugauauccagauauucagauauuacuguaucuaauacaacuaauugguugguucuguaccaacacauggugacacaaagauuaaaaccgcaagaacuaugaguucucuauucucauaugcuuuuuuaguaauuaaaguaguaauuuggauuaaguuaaucuagaacuucaguguuuaaggcaucaugguuuauaaauguuccuuuauauagccacugaaacuuuuuuaaaagauuucaauaguuuuagggaaacaggugguguuuggugacauggauaagcucuuuaguggugauuuccgagauuuuggugcacccaucacccgagcagugcacacugcacccagugugucaucuucuaucccucagcccccuuccccccagaguccguuauaucauuuuuaugccuuugcauccaauguuugguuuuccauuccugaguuauuucacuuagaauaauggucuccaauuccauugagguugcugcaaaugccauuauuuuauuccuuuuuauggcugaguaguauuccaugguauguauguaccacauuuucuuuauauacuuguugguugaugggcauuuaggcugguuccauguuuuugcaauugcagauuaugcugcuauaaacauguaagugcaagugccuuuuucauauaaugacuucuuuuccccuggguggauacccaguagugggauugcuggauauauauccacuguccacuuuggauauuuuaagaaaacaugacuggaaauuuuuuuuuuuuuuuuuuuuuaaaugagacagagucugacucuuucacucuaucgcccaggcugaagugcaguggcacaaucuuggcacugcaaccuccaccucccugguucaagagauucuccugcuucagccuccuaaguagcugggauuacaggugccugccaucacgccuggcuaauuuuuguauuuuuaguagagaugggguuucaucauguugaccaggcuggucucgagcuccugaccuuaggugauccgcccgccuugaccucccgaaaugcugggauuacaggcaugagccacugcgcccagccauggcuggaaauucuaaaaggcaauuguaacauuaaaucucuuuccauuaaucacaguuacuucguuuuuauuuuauuuuagacucagaggguacaugugcuuguuuguacauaaccacaguuacuuugaacuuguauauaguucauggauaaugugauuaucuuuguauaauauguccaaucucagaggacugguuuuugagugaaaaguggauuuaagaaaacuucugcaugaugguguccacagcaugcuucacaccuauaaagaaaagauuuaauuuucaaaaugguacuuuuuuuuccgcuuaacacuguuaccaacuucuuucuuuaccuagcggcaucuggccuuuuuuuuuuuucuucuuuuuaaauuuaacacugauuagaagauagcaaaaggucaucccagugaacagacccauuuuuaaaugugccaggcacugugaucuuggcuagcaguaguuuauaagguccucgcccuuuacaagucaaaaaaguaguacaagguaagcccucggagaaacuguucgucaugaggcagcaaaugcaagcccagauagaguggaaguguugagaaggaagugcgugaagaguagucaggaaggaaggucuucugagaggcaggcaggugcacuugaacugagcauacaugagcugagucgaauugcugagaugaacagaguucucaggcuucagcaaaggcuugaaagugggacagggaggggacugggugguguucaggauuuaaagacaguuugcuaaaaagacugaagcucuuuauaggaggcuuuagacaggaagguaaauggcucuucaccugaugcagcaggcuuacuaguuagggagccuguacaggugguccugucagcagcaagccauggugaaacuaccuguuaggaaguuugagaagauaugagacuccuuuaucuggcucacucugacuaccugugcuuacucuuucuaaacaccugucucaucauaucauuccccuguugcgcaguaacaccaugcuagggugaacauaauggaauuggagggaaaaagccacugagaguuuuaaggaagaaaugaaagguugugguggcgacaacugggaggaaggaggggcagcaacacagagaugaccaacugaauggaggccacaaccugggagaugguggugcugauggauuugugguagaguccagaaagugaaggaaaacuuaaaaggacuggagucuggggugucauugauagaaauuuggaggaguucuagguauugauagagccuuagucucuaaaucccucugucagacucuuuuggcagaaccauguaaagguguacgguaaguccucacauaacguuguuuccuucagcuuuguuucauuauaacauugaugagaaaaaaaauugauuuuguuucccuuaaaguugcaauuuccaagaaccuaucgacaacauuaaguuaggacuuacuguauuauuaaugcaaauaccugaaauaauauuucuguagcuuaauuucuaugcuuagggaguauaccacagcaaaauuuaauagcuugccauccaugaagaucauaaaaaauugcuuuucuaauucuauaauucaccagaacuguucauuuuucuuuuuaggaaccuauggauuuuuguuuccaaguuuacagaauuugaugcucgaaaacugcauaaguuauacaagauggcucauaagaaaaggucucaagaagaagagguaaaguacaaauucaguccuaauucauacaaacaaauaccaauuccacagaaaaaucucuuaauuuuuguuuuuccauggggagaugaucacagaaucauggguuauugcuggugcuaauagucaaacaauaagaccagaugggugaaauagccaauguauuggagccuaacaugguugaaauucugacaaagaguguuuacccuguguuuuuagguccuaaaaucauuuguucaccagguuuuuucuuccauuugcauuuuucuucuguacaugucaguagcuuauaaauguggcuccuaggaaguaauaggguggugggcagaaaauacuuuuucucuucuuuucuggaccaucuauuugguguccuuccagcuuuuguauggaagggguccugcuacucacuugugagaggugcucagaaguugccucuccuuuggaauagggggaugggugcagaagugacauggaggaggcugcagaggcagugcuccuugugugggugugcccauuugcagaucugcugacuugccacaugggcuguacccaaguuggacauugaguucaaucugugagcauuaaauaccaccuccacuaaugcgucagcuccaugaagacagagauuuuaugucucucaucuacugcuguguucucagcacauagaauggaauagaauggugcuggggacagggaagcacucaggaguauuuguuaugcugugcccagugcuguguuggccugugaagcagcacccucaaguaguugaugauuuaauuuuacauggaagaauauguuauagcaguaacauacaggaaucauauacuaauaagcauuauaaaaagucuauaaauggauaguccggaaaggccccaggagggaaugaaauaguuaggaaaggcccuuuagaagggagugaaaauuaggaagagggucugaaguuggacacauaaucaugaaagacuucauucauuuagggaucagaaugaauaacaaaacaguauaagcugaauaacaaaaacagugguauccuacuagugggaguauacauugucacaaccuuucuggaggagaauucagcaagauuuauuaaaagacuaaagcaugcaguuuugcuuccaggaauuuaguuuugagaaggagauagagauuuaaacauguuuauaauggaaauggcuuggaagcccaacaguaagaaauacauucaauguggcuaggcgcgguggcucgugccuguaaucccagcacuuugggaggcugaggcggguggaucacuugaggccgagaguucgagaccagccuggccaacgugaugaagccucaucucuacauaaacuacaaauauuagcugggugugguggcacaugccuguagccccagccccucaggaggcugaagugggaggaucgcaugagaccaggagguggagguagcagugagcugagauggcaucacugaaugccugcgacagagugagacucugucucaaaaaaaaaaaaaaaaaaaaaaaaaaaauacagaaaacaaaaacauucaguaguucaugauauauccauauuggggaguauuaaucaguuauuaaacauaauauuguagaaauaaguauuuacauggaaagauuuucacaauacaugaagugaaaaaugaauaccaaauauuuuuguuuaaaauauaacuacaaaaaaaagcuuagaaaaauacgugccaaauuauuaacaguaauucccuugcugguuaggauuugggucacuuuauuuuuuuuauugugugauuuuuuuuauaucaaacauuugacuugugugauaaggaguaauguuacuccaacauucagauauuuagcuugaugacuugggcauaggaguuaguucccacuggacagucgaggguuguuuguugugguuagccuuggaaaguugguagucuugguuuuacaugguccaggaugauccucugagagugccgccagccugggcgccuacaccauacccuguacagugacaucuagcagucuaugcauguguucuugcagguacuuagcaguaauggucaaacucagcauaaauuccacugaguucccccagcaaauagccuaacaguggaauuuaugagccuuuuuuuuguuaggagguaguaaacgccaguucagaaguuuaagaaggacaagaaggagcuguuuagaggugauagccuuuauucuucucuggggaauuaagccugggaucuugagcuucuuugguuuccuuuuacucuuuaggagcaaaagaagaaagacgacgugacuggggguaagaaaccauuucguccagaggccucaggcuccagccgggacucucugauaucucagucccauaccucacacaaccuucacccucagaagccucauuugccugccucccauggcccacagaugcauggacacccaagagauaacuacaaucaccccaacaagagacacuucaguaaugcagguaggucauuaaguggaguuuuuaaaagaggugccaaaagauaaaaaauucacacagccguuucauuuuccaaagacacuggcuagacuucugugcuuuauuaucuucuaacacuuuauuguccucucuuuucuuaaugagagaaagcaugaaauaaagaucccccaauuuuuuuuuuuguuuguuugagacugagucuugcucugucacccaggcuggagugcaguggcacaaucucggcucacugcaaccuccaccuccuggguucaggcgauucucgucccucagccucccgaguagcugggauuacagaugugcaccaccacgcugagcuaauuuuuaaauuuuuaguagagacaggguuuugccauguuggccaggcuggucucaaacucccggcgccaugugaucugcccaccucagccucccaaaauguugggauuacaggugugaaccacugcgucuggcccccaggacuauuauuucaacuuccgauuaagaagaacccagcuaacaugaacaaacgaaaaagacugagggagaaguuuacauucuguaugacagugaaaugguuaaaacugcuaaucuugaaagagcucuuguaaauugagaacaaaacaauaacugaauagaaaaaugggcaaucaacagagugaagagacaguuuauguaaggggagaaaauauuaccaaccguacaucugauaaggggauaauauccaaacuguguaaggaacucagcuccuuauguagcaggaaggcaaaugcucgauuaaaaaguggguaaaggaccugaauagacauuucucaaaagaagacauacagauugccaacagguauaugaaaaaaugcucagcaugacugaucaucagggaaaugcaaauuaaaagcacgaugagauaucacuucacacuuguuaggauggcuaguaccaaaaagucaaaagauaaggguugccaaggauguggaggaaagggaacccagcgcauuguugcugggaauguaaguuagugcagccauuauggaaaacaaugcagagaugccucaaaaaaaucacaaacagaacuaccauaugaugcagcagucccuuuaccagguauauauucaacgaaaaugaaaucaguuauguugaagaaaugccugcacuuacauauucauugcagcauuauuuacgauagccaagauacguaaucauccuaagugcccaucagcaggugaguggauaaagaaaauguguauauacacaaucgaauaguauucagcuuuaaaaagaaggaaauccugucguucgcaacaacaugguugaaucuggagggcauuuauguuaagugaaauaagugaggcacagaaagagaaaaacugcauauucucacuuacguauggaaucugaaaaagucaaacucauagaagcagggaguagaacaguaguuaccagggucggagggcaggggagaauugggaagauauuaacaacggagauaaaauuucaguuagauaugaggaauaaguugagaaaucuguuguacagcauggugacuguaguuaauaacaauguauuauauaagugagguagugcauauguuaauuaggcugauugagccauuccauaauguauauguauuuuaaaacauugcauuguaaucaauaaauacauacaauuuuuaauugucuauuaaaaaauuuguacagucugggcaacauagacucagucucuacaaaagugugaaaauuagcuaggcguaguggcguaguagucccagcuacuugggaggcugaggugggagaauuucuuaggccugggagguggagguugcggugagccaggauugcaccacugcgcuccagucugggcaauagagugagaccgucucaaaaaaaaaaaaaaauugcaguuuugaaacaaaacucaaaggaauccagauugaauuaaaauuuuggaaauuugauuagaaaaaaacucuguggagcuuauccauuguuuuaaaacaaaaugagcaaaaguuaugaauuagacaguucauguaaaagagaaaauucaaauggccaauaugacgagaugaccaaccuugcuacuaggaaaauauaaauuaaagcaacaauagguuaaucaauuuuuuuacccauucagaucaucaaaaauuaaaaagggaaauacacaccgauugcuaagagugugaauugcuauaaucuuugcagaaaauaaucugaaaacccacucugcggguugucuguuccuccagcaguggucccugccugggaaagacccagauccuuagccuguugcaggugcucaggaucacugaucucuucaguggugacagaagucaucucuuaacucuuugagguuuucugcucuguggaaucuuaguccuucuaguccucauugcuuuagcugcucuuugaugccuuuaaacacuucuuucuuuuuuugggagauggagccucgcucugucacccaggcuggaguguagcggcggcacgaucuuggcucacugcaaccuccaccucccggguucaagcgauucuccugccucaaccucccaaguagcugggauuacaggcacacaccaccaugccgggcuaauuuuuuuuuuuuuuuuuuuuuuuuuuuguauuuuuguacagacagggucucaccauguuggccaagguggucuugaacuccugaccucaggugauccauucgccucagccucccaaaguguugggauaacaggcgugagccacugcgccuggccuaaacgcauucuuuuuaaucuucccuuucucauuguuuuuggcaggauguaauucugcuacaagcuacccugccuggaagcauuacguucuauguucuguaaucuuaaaaaucugaguucaaaauuauuucaucaccauuuuguugagggaaagaaagcuaaugauuuugcagaaugauugggaaauguuucccuguucuuagauguaguugcaucaguuauacuggcuuuuuucuaguauuaggcuguuuuuguguuuuguauacgaugucacuuauuuuauauucugaauccuuuacaauaacuucuuacuaaauacauucuuuuauuuaaaccuuggauuccucacccaucuuuuuaauagcucaauacuuuguaaccugugauuuaccucacagaggguuuaagaagaaagaaaaucucuuugauuuacuccagaaaaaaugaacuagcuugaguuuuaagcaccucuacaaaaccacagacauugacacccuguuagaaaucucacuuuccauuugauaugaagccauccucaagugauccuucgcauauuuagaaggugucucuuuuuguuguuauuuguuaauucuuagggugaauagucaaaaguuuuuuacuuuguggugcucucaucugaucuacccaggucagccaugaauuuaagccacugguggacuguacaucauauuaaugcuaucaguuucugagcucagcacuuccuuaaugguguuguucuucagcucuguagaaaaaagcuggaaggccaguaaaaugaguagagacacuuauuugguggcaugucuuugaucuucacauaauuauagacagaagauggauuuuuccaugaggucauagguuccuuuugguuaguccucuguauuaguuuccuagggcuguauauaacaaaguaucacagacuagguggcuucaaacaucaaacauuuauuuucucacauuucuggagaccaggaagucugauaucaaggugucagcaggguugguuccuucuggaggcuccgagggaaaagcuguuccaugccucucuucugccuucugguggcugccagcaguucuuggcguucuugacucacgccgauuucugccuccaucuuugcauagccuucuccuaugcauagccugucauagcucccucugccuuuauuuugaaaggaugccuguccuggaauuuguagcccaaccuaaauucaggaugaugucaucuagagauuuuuaacuuaauuacaucugcaaagaccuagguaaaaucacacucacaggcucuggguggacaugacauuuugguagccacaguuuaacucuccaucccuggacuucugugucuucacuacauuuucugauucaagugaguaugauucuuuuccuuaggagaaaaggaaggcuacagaaguuaaaaggauuguaguuuggccuuaauccguaagagacagagcacugauccaagcucaaaguuagagaaauuacuuuuuuauaggaggagguccauuuuugugugugugugcagaauagggaagaauaauagaaucggugaguguagucuggagagauuuucagagaccaggcacagcagguaccagcaggugaaauaaacguuagauguguaaccggaggauauuacucgcagcugugaaacucagcgguaucauuuucugaauuaguuugguuuuguuguuaagagucugccacagauuggaagguuaaacagguauggagagugaaaagcgguaguuguuaagauuucagaaggagaggaguaguaaauuuugccuuaaaauuuuguuggaaagaauguuuaggagucauuacugauacguuagccagcagcaacaagaccaagaagaaagaaauuuaaugucuguuuguaacaugugucaggcuuucaguuugaacuucagcaaaguagugcuuacuucagcagcauaccuacaagaauuggaacaauacagagaagauugguguggaagaaaacaaaaauaaaaaauaaggcugggcgugguggcucacagcuguaaucccagcaccuugggaagcugaggcgggcggaucaccugaggucaggaguuugagaccagccuagccaacauggugaaacccugucucuacuaaaaauucaaaaauugggcaggcaugguggcgggugccuguagucccaucuacuugggaggcugaggcacgagaaucgcuugacccaagagauggagauugcagugaucuaagaucgugccacugcacuccagccugggcaaacagagcacgacuccaucuccaaaaaaaaaaaaauuguagugaaagugaaauucauccauuucuugcagucaucagaucauucuuucuuuuccugcagaucgaggagacuggcagagggaaagaaaguucaacuauggugguggcaacaacaauccaccauggggaagcgacaggcaccaucaguaugagcagcacugguacaaggaccaccauuauggggaccggcgacauauggaugcccaccguuccggaagcuaucgacccaacaacauguccagaaagaggccuuaugaccaguacagcagugaccgagaccaccggggacacagagauuauuaugacagguaugcaaaaggcugugagacaccaggugccaaccuuugccaggagcuguuucuagggagaaagugacguauacaugaauguauuuaucuaucaaauuacugaagaucucaucaugcaugugucagccacagcgaaucccaugucuugguuauagguuuuauguuuuguuuugugggucauagggagcacauuucaccugugcaggaaaagaguuuucugccgucuuuugaggaaaucuagugaagaggucgccauaaaauauuagagucaacaaccaaaauuauuaagcucugugcgaggcugucagccacacuagguaucagggaucccgagauggguaccagcccacaguccuuaccugccacgagcccauaauugaagagucaaagucuucugaagcugcacccucuuuacuucaguacaaugccaccaguaguacgaugagccgaagcuuuacauugugagaguagcaaguccagggagagcuaaagagguuuuaucuguauuuccuaauuucaaaucuuggauaauuuaaccucauagcagcuuugguuuucccugggcugaugaugugcgucauuugcacuguaccuugaauuuacagugggaaaauuucauauaaacgugucaaagucgugcuuuguuuuuggaagaucugguaacagcagcccgcauuagcagagagcuguagcugaguagcugccaccucguugggagacugccccucgcucccacccuucucuauugucuggacccagugggcaucuugcccugcguucuucuaguaggucuguauuucuauuugaugucacuuuccuuuugccugaaggacuuuuucugcuggugauaaacucuuucaguguuuguauauaugccugaaaaaguauuuugccuucauuuuugaaaguaguuuuugcugaguguauacauuuuuggcuuuacaguuucuuucagugcuuuaaagauguaccucugcuauuuacuugcauuguuuugugaugaaaaaucugucauccuuaucuuuguuccucuuuacauaauguuccuuuuaaaaaaaaucacugauuaugaugugccuugguguauuuuuccuugguuucuugugcuuggaaauuuuugaacuucuuggaucuguggguuuauuguuuccauaaaauuuggaaauuuuuacaaucuucuucaaauauuuuuucugaucccccacucucucuucuucuuuggagauucucauuacaccuauauuagcuugcuugaaguugucucacagcucacuuguauucuguugacuuuuaaaaaauuaugcuuucuguuucacuguggauaguuucuauugcuaccucuucaaguucacuaauacuuuccuuuucaaugucaagacugcugugaggcccauccaguguacuuugcauuuuauacauuguaguucuaaaaguucggaaaguuguuuuugggucuuuuuauauauguucugugucuaaccuuuuaaaaccuggaacacagauauaacaaugguuuugauguccuugucugcgaaucuuaucacuugggucaguuucaguugauaccuccucacugugggucuugcuccccuggugcuuucugugccuaguaauuuuugucagaugccagauguaacauuuaccuuguugggugcuggauauuucuguauuccuguaaguauucuggagcuuuguuaugaguugcagguuauuuggaagcaguuuccuuuuucaggucuugcuguuaagauucguuagguagaaccagagcagugcucagucaagggcuaaugauugcccacccccaagguaaagagccucauugcacucuacccaauugcguuagucuguuuugcaggaauaccugaggcuggguaauuuauagagaaaagaguuuuauuuggcgcacaguuccgcaggcuguacaagcauagcaccagcaucugguuggcuucuggagaggccucagggagcuuuuacucaugguggaaggugaaguggcaguaggcgucccauggcaagagagggagcaagagagagaggaggaggugccagccucuuuuaaagcaccagcucucacgugaacucagagaacucacucauuaucacaaggacagcaccaagccauuuaugagggaucugcccaaacaccucccacuacaacauuggaggucacauuucaacaugagauuuggaggggacacauacccaaaccguaucaccaucuggaggucuuugguguggcuggugagaacaggcacgaugccaguucuuugugagcacagggcacuguuaccuucagucuuuucgggugguccuuucccuggccuuggguaguuuccccacaugcacauccuaagcaguauucagcuguauaccugggaacccucuguagaucuucaaacuucuuucucugcagcacugucuucucucaugccaugcccugugaacucuggccaccuugguuccccaucccucaccuugggaagccaacuggugucuuucuggguuuccuucuuccugugucacagccugagggacuaucucaugauagugaacaggagccguuaaaaggcucauuucauuaguguccauuccucagggaucacuguucuucauugccugaugucuggugucuugaaaaccacuguucuaugcauuuugucccuuuuggcuguuucaggcaggaugguaaaucuagucccuguuauuccauuuugacuggaacuugagauugcucacuucuuccucccucuuucuuucauugaggugaaauucauauuacauaaaggaacuauuuuaaagcgaacaacugaaugaccuuagugcauuuauaauauugggcagccaccacuucuaucuaguuccaaaacacuuucaucagucagagaaaacccuauaaccauuaaauaauccuuccccauuauucccucuccccagccucuggcagccaccaguuugcauucugucucucuggauuugccuguucuagacauuucauauagaaagagucauacaauaugugaccuuuugugucuggcuucuuucacuuagcauaauguuuucaagguucauucaucaguacucauuccauccuuauggcugaauaauauuucguuguguggauauauaccacauuuuguuuauccauucaucuguugauggacauuugaguuguuuccaucuuugggcuguugugaauaaugcugcagugaagauugguguacagguacuugacuaccuguuuucaguuuuggauaugugccugggaguggaauuauuagucauauucuuuacguuuuuaggaaacaccaaaauguuucuacgauggcugaaccauuuuacauuccuaccagcaauguguaagaguugaagguuuuccuuaucuuugccaacacuuauuuccuggguuuuuuuuuuguguuuuuuuuuaaugaguaucuccaucuucgugggugugaaguagucucauuguggcuugaacaugcauuucccuagugauuaaugacauggagcaucuucucaugguuuuuuuuggccauuuguauagcuucuuuggagaaaugucuguucaaauccuuugccuguuuuugaguuggguuguuuuuguuguugaguuuuaguaauucuuuuuuuaaugguaucaugagcaguuuaccaugguccaagcuaaaaauuuuaauacucuucacacugaguugguuuuuaagauaauuuuauuaacuagucacucacuuguugcauauuuagguugaugguguuauuaauaacuuacaaaauaauuucuguggcucuuuuucucaugggcuggguccaggaauaugguaauguuuauggaucuuaccagauuuuuccuaaagggagugaguuugcaaaagccaucaguaauuuuucaaguguguacuugugucacugcacacuugagccuuauuucauaggauguauuuugcuaauaaguguaaaaugacucuguuauuaauuuuuuugauuccuaauaaugugagcauuuguccuugaauaugaguauaugaggaagagccaaguggguagugaagagaaguggaugggaaucuggcuucagucuuucgacuaauccuugcaucucuauuucaggcaccaucaugacuccaagcggaggagauccgaugaauuuaggccucaaaauuaccaccagcaggauuuccgacgaaugucugaucaccgccccgcuaugggcuaccauggccagggacccucagaccauuaccgcucuuuccacacagauaaacugggggaauauaaacagccucuacccccauugcacccugcagucucagauccucgcucacccccuucucagaaaucuccucacgauuccaagucaccccuggaucauaggucuccuuuggagagaucacuagaacagaaaaacaacccagauuauaacuggaauguucggaaaacauaaaggacagcucguaaaggagagaguaagagucaccaaacacguggauauuuuugguc

SEQ ID NO: 15222 - RNA, 17566 nt, Homo sapiens
cuuccugcuguuuggcgaguacacagugcaaugcaguaugucugucagcgcugcggcacaaaggaacagccauuuugugacugagcuggaccugcaucaagaugccaggggcucaaagagcugcugcgugcccuaucgaacugccuuuuaugucggcaccagaguuccccagaagagcagagagggggaaggaaauaggcuuugguauuucagauuucuauuaguuuagauucagucuucuccaaaaucccguuuuuuaauguauuaucagcgucauaaaauggcugccaguuaaacugccuguucuaguacacaaguaacugcauuaugccauuucuaaucauccccagccuuuuagaauaucugguaaagcgccccugaaaauuguaggauuuacccgcaccucagguuauaaaaauaaaucuggcucaaaggcagacgauuuggagauaaauuuaauaaacucguucaauucuuaagauaaauugcuaacguggugccguggagaacacacugaacucuuugugugcacacagucccguuuucauucuuugauguuacuuaaguuauccccaagcugcaaauuauucagauaaaaaguaugguauacuucucguauguccaucauuagaacuuuguuuuaaauacuuagaaauuuuacaaauaucaaucaaauguuuuuaaaaucgcguuuuuuaaaguuuuuaauuuucaaaaaucgugauaaaguauaacagacuuuagcauuaacuucaaauuaaaauacaaacuuauauaaccacuauuaacuacugcacuauuuccaaaaacaggguauuaccagauuuaccuaaacuugcacucauucuuuccagauacuaaaguaauucucagaccaaaguuuacuugaccugcaaacucauuuccucuucuguggcucaggcugcaaaggugauuuucguaguauucccuaaacacuauacuuugggcaauaaaaacucugauggcagaaggaaccaaguacuaauuacagggacaguucagcucaguagaaguaauauuaaucuaccacauuaaaacaccacuaacauucuacagcugcacauuuuaaaaggaagugaugucauaauuauguacauguauuaagauaugaaauuuaggguaacuaauuuaaaaguaacuaucuucuuuucaaagagucuuaaauauuuuuggacauccaucagguauaugauucaaaguauacuugacaaaccaauuuaaaaguacagucaguacaugcuucauguacagcuguaaccuccacuaccaguaagcaaaugccugacaacuuccagguaguuuuccaggugagaguaaaaauacugaaagaauaccaacacugcucaauuuuuuagaauuagaaagcacagucugaucaaugauguuaaccacaaaccuugcauaagagagccaaaacccaugugagaccuaugcaaaugauacacucaagggagcaacaauuuuagugcugaaucuuuaauaauuugccaaauauaucuggagguucucauuucuucaaauugucauuacuuuccagaaaaaaacagcuuaggaugaguaaaaaacuuuucuguccucaauuuaaucuaguaauuuacaugggcaauucaauuaagacagcacuacaaacugggugacaacucaaugcaaaaaaauuugguaacuuauuuucuaaagcaaggcucaauaugcuuucagucaaauaaaauaaauagaauucagcauauuaguaacacaucauguucaaaacuuucaaauucacuagccuaauagaaaaguguauuauuuauaaaaauuagaaaaguaaaaauugggaaggaaaaccacauaaugaaucacauccuuguuaaacugcaugauuuaaaauuuauaauaugaaaaugcauaaagaacacaucaaaaaaugcauucauauguacuuuuaaaaauuaauauacagaggucauacaacaaaaacaucuuagaggcuuuauuacuucaucacuaacaagguacuccaaggaaugugaaacagaucaugauuugcacaaacaguacauuuuuaagcuucagaagauaaagcauuccagacgacucugucgaaauacaucaauaaauuuaaagcagcuacaucuaaauugugaggauaaaauacaucuaccaacaggaaaucaaugucuuaagcauacaaaugcaaaccuuaaaauaauuuaaauguaaaauauacaacugcaaauauuaaucacaguaacaaacacaaaauagaaguauauauuaagaguauuccaggauuucuguuauuacagauuugauuucauaaaugcaggaacucuaaccaucaaguaaagguuuugauaaaucacaucaaaauuuccuaaaaugucaaguguaucaaaagaaauauaaagucacauaaaaauauaaacugagaggcaucagucaaaggguccuuuaagugauuuuguuuuuaaauguacauuuuuucauucauauaacuuucugauaugucuauuuacuauaauuuacuacuacaaggcuucucuauggcccucaguuacaaguuuagauauccuggauucuucaaagaaaaaauuugccuuguauguaaaauggugcaaugcagcaauggcuaaaccgacaaggucauuuuucugcaguacaaaaaccuaaaaacugaaauuuacugacagaaaaacuguacauuacaguaaaggccccuuugaauaaagguaccuuaccuuuugacugcuguaagaggccuuaagucacaacucaacuuucauaaauugcuaccaaaaaauuaggguguggcauauuagcaaucucaaggucaugcuuuaaaaaacgaauccaaauuagaaaaacacaauaaaacagacagcaauccaugucugucaagguaaacaauuguaagcugagguuucucccccaaaaaaaaagacaaaaaggaagaaaguugauagcucauaccucgaugcauugcuguguagcgaacuguccuccucuuggcuuuuguccuuauuucucaucaucuuuuaauucuuaaauauuaagggggagggggaaucuguguuugcuuugaaguccugugcccagguauuuacugucaaaaguugaaagaaagguaaggucccggcuucuaucgaugcuuuuuauuaucaggaacaaaguccugacgauguuaacgauauuguuauaacacaacaacgguaagcaccaaaaaacuaaauauuucuauuuuuuccuuaaaagaaaaaacaacaggauaaaccgaacaguggaagcaucacuaucaauaaggaaacuuucucaaaguagcacacuagauacaaauaacaaucucuguaucuuauugcgucauccaagaauuucucguauuuacagaaaacaaggcaaacuuaaacaaauaaaucuuuaaaauuaucaccaaugaucgugaacuuaccugauccauguaguauguccaaaccaagaguccuaucuacuaguagaaaaauaucagaucccaaauaauuaaaaauaaaggcaaaauccuccguuaaaaaacgaaaaauaaauaaaauaacccucaaauauguuaacuggucaaaaaaauaaagcaauaauuaauacuaaaacagguccgaaagaaaaaaaaccucauuaggagagcgcacaaaaauggaggugcgccauggcuucuaagcuggaaaaaacaacgaccugggcucucaguacggcugcuucuuuccaacaaggcacgaaaagaaagcuccuaaaagcugcuuuucucccaaaaaaagguucgaaucgaccccaguaagucccuaggaaaggcagggggcuacgggggcccccugaggcugcccgaaaguuagggaaaguugcguaaagugaggcaaaggcagggagcagagcgcgcucucucuaaggcacagccgccaucuagagccuccuucccagcucugagagcucugccuuugauugacacucucuacauuuaccccacaacucaggugauguaccauagacccaccccuucaucuccaccaaaaaaaaaaaaaggagagagagagagagagacagauccuccaucccagggagccuaaggacccccacccccacaccucccugccccuccagaccaccccaacagggggaggggggagggcuucuuaacccccucuggcucaagcacccuuuuuaagccagagagaaauguaauuuguuccuuuugucuaaagaucugcuaaauauuucaguccuugagcuaaaauaacuuccucccuggacaggaagugguguuuuaucaagccauuuugaaaaagggauaauucuuagagaaucuaaagcucagcuaaguacuaaucuuuuuaaaaauuaaucccccaaugggugaaaugauugcuaaauaaaaguaaaaccuuaauuucauaauauaaauucaaguuuuuccuucuuuaugaugccuaaaaauaaucuaaagacaaaauuuaagggggaauuuuccaucuccacuggaagaaagggguaacuuuuacaacucaagagcgccucccuaguguucaaguugcacuggagcaaaaguuaaugcaaccaauuuuuauucaagaauauccauuuuucuuuguucuuucacaaaauucuuuaacccauuauauaaccuugaaaauauuacacuccuccccccaaagaaacuucucauaaucacaauauauuuacuucccauacugauucaggcaaaaauucaagaguaugguccaaacacgaucaccuuuaaaucaguaacccaagaaacuccacguccaaauccaacagaaaacacauaucccaacacuucccuuauauuucaaaucaaguaaguauacacccauuucaacaauguuauuaacaauaggacauacgugauugcaaauuaucaaaguaaugucacaaagcaaauucuccuaaauaucaaaaccaugagauccacagaaacaaauuacuaauuccagaaacaauauccuaccaagcacuccauucagacaagcauauucacacacccaaaaaaauccaaucaacuuuccuuauucaacauaaucugccagaaccaugucucucccucacugaagaaauccacuuuagauuuacaccaaacaaaaucaacaauguccaaucuagguaaaauccauaauccaaacuguuucaauuccauacucuacacacaaagauaaauuucguagcaagaacaauauccaaaauuccauuuuugaauuuaacaaagaccaaccaccucacaucagucaauaacaaauggugcucguguauuaaccauggauguguaugcugcaguauuugacaugaaucacaaacaguaugauuaacacaaaacaauuuaaccugaacuauuuauucuucucauguaaaaugggaaaacagaaucaagaacucauuuugucuaccaaaauaaugccuaccaccuuuguaauaguuaccaaaacugguaucaguugauuaguaauaaaugaaaaccuggcauuuaaaaaucaaacguaaguaaucuauggcagggugcaauucauuuauucuaaauccccaauuguacaaaauaaagacgauacaagauauuaauccuacuucaaaguuauauaaaauggauuacacacauaauuucaaauuuaaaaaauugugaauacuccaaggacccuaacccauaaauccaacacuucuuccucuaauaguaagacaauaggagacauuaauuuaaauauucagaugaauauucuauagcaagauguauuuauaguauuaaaaagcuuaagaaaccauuucaaucaacacaaaauaauucagaaguauauguguaucacucauccugaauuuucgagcaacaagcaguuuguuucaaguucauuaaaaucuuguggcagauuaaaaucagauucuauuauuacccauugaguuguuuugaaagguguuucaugaaagcacaaacaaaacaguauuuaaaccaaaugaccaucuaagagcacaacuuugugaaaaacguaaaucuucauaaaccaaguaaaauguuuucgauuacaccauuuccaauuuaccagcuuuauucauauucaguacacuuuaccacucggcaacuacaaaggccaaaguauuacuaaaauaaaacuaaacauuuaauuaaacuuccacuuaaaaaaaaaaacccaaacugagaaauuuuuaaguguuacaaauuuuauuaaaaauuaacauuucaagaggucauacgcauacaaaucaaacugcaaaaaauuccaggcauaaaaacuauuaucuggguuagugugccaucuuucuucuccaaaugucaaaauguccacaaaaaaagucuuuagaaagucaaauccacuguccauuuguguuggguaagaaaccuaugucuucauucacugcauggaauccauguuaaaagaacccugucuugguuguauauuaucacaggacucuuguauuaauccauuuuuccucaauuccccauaguagacugccaucuugauuucucagugguaggguccauuugaaacucuucaagcugacugggugcuugaugaaaaaauuaaaagaaaaaaacgcuguuggcaucuuaaucuuuuaaacagaaaacauccacccaccuugaagauauccuaccauacacaaaacuuucauuuuguaacagcuuucaacuaugaaauuguaaaguuguaugcaaaacacacacacaacuccuugauaagacugcacgccaaaguaacaaaguccuuguacuaccacagauacauuuguaucuauaaaaaagucccagugaagagucagauuuuuaauauuuaacacuaacaucauuauacuguguacauaaaaaguaaaaacaaaaauuaaaauucaaaauuccuggaaagcuaaauuacagaaacacuguggauucuaaaucucaaugcagaaaacuuuccaagcuucuucaaagaaaacuaauuauagaaaagaaucuuaagggauuugaaaaaaaaaaaaaacauacacacauaaagcagucgaucauagcauaguuuuucaauccaacagauguugguuuuguuuagauaacgaaaauggccacuauagguggcaccaucuuuaacgacauaucugagaauacagaaaagauguagccaccaaaaaaaaaaaaaaaaaaaaaagaucaaaaaugcaaaguaucugccuggcuugauagauuugccauaaaaugcuguuuucaaauuauaugcaacuaaaauaauacacuuucauuaccaaaauaccaaaugucucucauagaaaaacaaauccauuacuuaaauaauuuuaacugaagggagaagugagaagugagaagucagaugauuuuaucauuaaauaaaugauucagauucaucaugaccaaacauaauuugaaaaaacaagauuuaaacccuggucuucucuauaaauuuuccagcucuccaucugaauuuguggagauacagucaagugugacugaauuugagguaaauaaauauaagggcauuuuugcccauuagguaauuccuugucuccuuggcaacaauuaggauacuguuuacuauauacaauacaaaaaucuacuuacuuaacuauuugguuaacugagauacugccacccauauuaaaaaacauugauuaaagggagugucacagcaucaguaauaaauaucaaaagcaagauauuucuccuugauuuugcucauuucuccccagcuuuaaaaagaaaacuaaauuacucaauucauuccugaucucaguaaaaaucuuccaucugacuuguucauuccuuaaaauuaagggacauguacuucuauagagaaguauaaaaguaaaaacaucauucucugucagaguuaauuauaaaccaauuuauuuucaaucucuauuguuacaagauucaagcucuaaaugaaguuggugauguaaauacuauuaugaugaacaaugacacugagaaugaaaaugcauuaucaaauuacagucauauuucaauaucuauagaugcaauuuauuuaucuuaguaccuuaauuuaaaaaacucaaguuuuauauuuuucugacacaggacagagauaaaauuuauccagauuuccuucuaaaaccauuauuuuuuucaaaaaauccaaagaaaaucuaaugacauuauuaauaucauuucaaaauuacucaaaauauauuaguuuaugugacaacagcagagauuagaaaacagcauauuuaucauacucuuacagucauauauuuaaagauaguaaaaaaaaaaaguaaagaaaaaaaugcuacaagagaaaacucugacaacucuuaggacaugaaaaaagcuaugaucaaucugcacuccugcaaagccaauccaaagccaaaagugagaauuuuguuaauaaggaaaaaguguucacugaggcaucagagauuuaggaguaauccauuuauuuucauagaauucaaauucuuauaaaaacuguauuugcuaaaaaauaaaaagaaauuaggcuuaguucugugagccuggaaauuuucuuagaaacaaaauccacaguucuucaucuguaaaauaaaaauaguaccuaccuccuguggcuguagaaagaauacuuuuauaggauuuuuauuaccugacauauagaaagaucucaguaaauacuagcuaucauucugauguaccacaauaaccaaaguacuuugagaccuacaaacugaccuuacugaaucaaaguucauuuauacaucaucaguaagaguaucucugaagaacacacaggaucauggggucagcagucuugcauuaaaauaaaaucaagauccuacagaaaacuggguaggguuuagauaucaaaacccucuacauguuccuuuccaguaacuugugaauuacugcagacauggaagacauguuuugaucuagaauuccauaaucagacaaaccuagaucuuuucuguauuucacauauaaccuucaagcucauaauauaaaugguuaacaaaauuuuuccccuuugauauucacuaguuuauacuuccuuuucaaaauaaugugcauguucuaagaguaccauucccacagcaaagguaaaaacuuaaauggcaacaaagcuucaaugaguaacuacuaccccuuaaaauucccgcauuaucauacauccagaagaacauaaaguugaacauggagguauucucuucauuguauuuuuaauuauuuuuuaagauggaggucucacuacguugcccaggcugguuucaaacuucuggguggaagagauccucccaccucagcuuucccaguagcugagaacacaaguacaugccucugcacccaacuaagguuuuuuuuuuuuuuuuuugagacggagucucucucuguuccucaggcuggagugcaguggcgcaaccucggcucaccacaaccugcaccucccaggucaagcgauucuccugccucagccucccaaguagcugggacuguaggcgcauaucaccaugccuggcuaauuuuuguaauuuuaguagagacgggguuucacuaugugggccaggcuggucucgaacuccugaccuugugaugcaccugcccucagccuccccaaagugcugggacuacaggccugagccacugcaccuggccugguauucuuuuuaaauucuacuuuaguaaauuuguuccaaaaacacugggacaugauaaaauacauuguugguggauacacagguaagugauucaccaucuggauugaguuuacaagggcucuccuaaaauaaaccaucuccuuuccucuacuucucagcaacuuuucccauuuuuaauagcaaagaaaaauggggcggggggcaggggcagagaguaguauaaggaaaaagaaauuagugauuccuaauugucuuaauggauggcuaucauaaagcuacuauuauuaaugcaacaaauuauuuuaaaacuuaaaacacuuauuucaaagucaaugaugggacaaacagguguaaaauuaccuagagcaaaaauucauccuucucaucauguaauuaacauucuuggugcuuaugaugauuucaaucuucgucuacugucuuuaaauguggaaauauuuaugcaagaaagcccugagaggcugggugcgguggcucacaccuguaauccuaucacuuagggaggccaaggccagcacauccccugaggucaggaguucgagaccaaccuggucaacauggugaaaccccaucucuacuaaaaauacaaaaauuagcugggcgugguggcacaugccuguaaucccagcuacuggggaggcugaggcaggagaaucaauugaacccgggaggcagggguugcagugagcugagaucgcgccaccacacuccauccugugcaacaagagugaaacuccgucucaggggaaaaaaaaaaaaaaaggaagcccugagaaguaaauucacauauguugacuuauuaccaagauaccuugaaucuucaguagaauauauauuaacaagucugggucuuaugggcauaaaaacuaacuauaaaauuaaugucaauugugacaacuaagaaaaggagucaucuuauuuaagguuuacaaucaaaucaaauauuccgguaccguccucaaugguuuaaaaguugacuauauaugcaaacuaagagauugagaauugcagagaaaaaaugaaaucuugucacuuuuaauuuuuacuuggucaaaacuuuggcuuucaggcauaccuacaauuuuauauuuaauucauuaaaacauguuuuaauagucaaugucacuguuuuuaaauuaaauccaaaacacuagcugauaaacaauguuuaacagaagccauauugauacacuaaguauuuauugagcaucuacuauaugcuaugcaacugaucccuuuaaaaugaccacagccaauuauuguacuauauuagaaaaguuuucaucucuuucaucauccuguauugaaaaacaaaucccccuccaaaaauaaaaucuauuucgcaggcccuagcagccauuuacacaacgcaagcuaaaguagccauaggcaaaaauuaucaucuaaaaucuagauucccaaauaugauucaaaaaaauuauuuuuaugaaguagcuaauauauaauuaccaaaaagguugucaauaauaaaucauguuggccaggugcgguggcucacaccuguaauccuagcacuuugggaggcugaggcguguggaucaccugaggucaggaguucgagaccagccuggccaacauggggaaaccccaucucuacuaaaaauacaaaaauuagcugggaaugguggugcgugacuguaaucccagcuacacuggaggcugaagcaggagaaucgcuugagccccagaggcggagguugcgaugagucaagaucaugacacugcacuccagcaugggugacaguggaacucugucucgaaaaauaaaauaaaaauaaauaaaucauguugagaauucaccaaaauucauuuauacaaccuucccaucaacucuuuccaacuauuuuucaggcuguuagaaaaacuauuucagaggugcuaaccaugucuucuaacaucaaagcauaacuucagggacaaucaggcuaaagaacuuuuuguugggcuuucaaguuuaacuucaaaauuaauuaauuaaaaguaauuauaauauuggaaaucauuaaaaauuauguucuauuaccaaaagagaaccgaagggcuucugaguucuauacagguuaaggcaaugcugacaaaaggaaaagcuguaggaccuaggauaaacuuucccuacagaugagacaggaaauauuuuaggcuuuguaggccauucaauagaacuccucugcuugcugcugcuauauacugagaaagcagcggcaaacaauaacuaaaugaaagcguauagcugugcugcaauaaaacuuuauuuacaaaaacaaagaggaaccauuuagcaacauccauguuuauaauaguguuagagguauguucaaauguggguuuguuugcauuuuaacuugccuaagugaagaaagcagaaaauaauagauuggaguaaauuaauaagcgaaauuuccauguugauuuucuuguacuguguugaguuucacuaaaucccucuuuacaauucugacucgaauuuucaaaauuuccaaaguaguauuuaaaauuucuaaacagauuaaacauguaaauugaauaauacuuacuaaauguuuccaccaaugucuacuucauuguauggggccuuuagaggauucaguuugagguucauauuucugcagaggacaaaaagaauuuaauuuuauacauaaaaaaugaaaacagauuauuaagcaccaugauuuauacccaaaaugucaacaucuugcaagggucauuugccaauagaccaaaagauguauguauguauuaacaauacaguccaagcagaaaucauacaagcucuugaguaucacaaauuuggcuccucucuagaauagguuacuacaaaaucacaagcguaaguuucagccccuaagaacuccaaaaauguagguaaauauuugggcuccccagguggaucugauguuugggaacgaguuauuuaacacagccaacauugcucuuacaguacagaauuguuucacuuucuagucuuacaucuauuuacuuucaauccuucuacaggaaaguuuacauugcccaccuguaaggccacuuucucauuccuuaguauuaccauauuauuucacauuauuaugucuuuaaucaacacuaagacaaaauguuaggaaaccauaggcaucauuucaaauuacuacuaauuguaccaaucuauucaacuaaaccaacacuaaucauuccuaaaauauauacuugauaauaaaaauguauccggccaggcccgguggcuuacaccuauaaucccagcacuuggggagguggaggcaggcagaucacuugaggucagguguuugagaccagccuggccaacauggucaaaccccgucucuacuaaaaauacaaaaauuagccagaaauugcuugaacccaggaggcagaaguugcagugagcugagaucgcaucgcugcacucuagccugagcaacagagcgagacuccgucucaaaaaauaaauaaaauguauccauacuuuccacuaguuagacuugaauaccccauaacuaaacauggaaaauagcguuucccauaucucaaguaacauaccuuuuucaucacuucuguucccaaguaugauuacaauaaucaucccaccaccacaaagaaaacuuauuuaaaaguucaauaugaaaauaggcagggcgcaguggcucacaccuguaauuccaauacuuuugggaguccaagcugggugggucaccugaagucaggaguucgagaccugaccaacauggugaaaccccagcucuacuaaaaauacaaaacucagccaagugugguggugcacgccuguaaucccagcuacucaggaggcuaaggcaggauaaucacuuaaaaacgggaggcggagguggcagugaguugagaucacaccacugcacuccagcagccugggcaacagagcaagacucaaucuccaaaaacaaaaacaaaaacaaaauguagcaauuuaagguuuuuagaaggcaacgaaguuuaggauuuuaguuaaaacuaugcuacccaaaugcuucuuuaggacuaauuuucaaauuauagagcaagucccuguuuaucuucccaaaucuaaauuccuuuagucauucggacagaucauaaucaagaaauauagcaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaacaaaaaaaaaagaaauauagcaaagaucugcuucaaaauugcucuaagaguaggugcuaaauuaucuucccaagaaauugacaaaugaagcaauuuaaaaggaacacaacauauuucugaucuuccaaauuuaaucugaccuuauaaguaacagaggguuuugugaagacagacaaaucguaaaccaaguaaacccuuaagagaagggcagaagugacuuaaggaaucucgguaaaagaaaugucuaagggaaaucccucacacugcucugauaaugugcuuauaaguaaguuaucuaccaguagauaggguucucacaccaccaaagacagaaaauguaucucacuuugcaucaucacaagaauuagacacuaauguaaucuaccauagcaucuccuuccccaugcaucacucacaaaaauuacuaaccaccaaaauugacaaagucuaaaaucacuuugccauccuuggaaagacaggagaagggagcaaaauucagcuuaggcagacuaugaaaguuaaugauuuugcucguauuuccaccuacccuauuucauaauaucauaguuucagauuuaauaacuuacagguauaauauacauauuuugguuguuguucuuucaaacaguaaggacagcuuuagucaauugucauauuaucauuagucauuuaugcuuuucuuagaaaacuugguuuuuaaaaccauuuuuuacuuuuucuuuuuuuuuuuuuuuuuuugagaugaagucucgcucuguugcccaagcuggagugcagugguguggaucuuagcucacugcaaccucugccucccagguucaagcgauucuccugccucagccucccaaguagcugugacuacaggcgcgugccaccacauccagcuaaauuuuuuuuuuuuuuuuuaauuuuuaguagagauggggguuucacuauguuggcugggcuggucucaaacugcugaccucacgugauccaccugccucggccucccagagugcuaagauuacaggcgugagccaccgcgccuggcaaauuuuuaacuuaaaaauaaaaucugagagcaccauuaacuauaaagucauuaauaugucuaagaaaauucacaaaccucaaaguuaaaauauagcuuuauaaucuaaauuaaaaugacuaugauuacuauguagcacacgcuuaagauauaauuguuugggaaauaauuucaaauacauggcuucauuucaaaaggcagaggaauguuuucuaaaacagaucugucaagcaacauacaagguauguaucaaaacuuuuaucauauuguuauagaaaacaugcuacuugaauguuacauaaaccaucaagucacauauuuauaaccuaaggaucagaauauccuucaauuuaaauugugaagguuaauuacauuaaaaaauaauagccaauuugaaaaucaaagugcacugaagcauucaaucuggaaggagguagcugguaaaaugaagacauuuaucuuucauguacaaaaauuuuguaaaggaaauuaaauagauuauaucaggcaugcaaacuauaaauccucuuauuuauaacauaaucauggucaggugaaaaguauuaaauaaaaccacuuaacuuuauauuagguacauuuacuacaucauuagaaaaauuuuuuaaaaaugcuuuuacugaagcauucuaaauauuguuuaaagacaguacaauuccuuaaucgcuucucugaaaucaguuuacaaagucuguauaagaguauuaggcaugccuuaacaauuauuuuuaucccacaauuugagagcuaauagggaucuuaagagcuuggaacucuaaagucuucauacagauuaugagaugaagguacaaaaggaauaaaauaucaagaccgcaagggcuuauuuacauuggaagguaggucuccugaaugccgaaacguguuauauuuuccacucuaucaccaccucugauuaacaaaagauaaagagacguccucaacuuaucuuucucccccuuaugccgcuccacaaucaaaucucagaggauaaaaaguaaaauuaauuaguuguccauaguacaaauuuuuaaauaaucaaaaaacgaugacuaauaguaaauaaaacuuaaaauuuacauuugaaauuaccuauuucauauaaucuauaaaugucaugucaugaaagccuugugauuacacagcauggcuccuuucauuucuauagaaugucagguaauuuuuuaaacaguuucuaucagaacuaaugcaauccaauucaaucaccaaguugaucaggagauuuuuaugacucaagaauuaucccaaaaugcuaggguaaaaacaauuauauaaguaucaccuugguucuuaagcagaaaacagugguaaauauacaauaauccaccuuccuuauaaaauauaguacuuuaauaucauaucuacaugauccacuauauuuaucuuauauaauauuaucuaucuauaauaguuaucuacauucacauuugcccucaugugccaaucaauuagguucauuauacaagauuggcucaagcaguuaaguaucaaaacacugaauauaugcaguaacaaagaucuaaguacaugugaaucuuugauuuaacauuucuagcccuuuccagcuguuuucuuuuuuaugaaucaaauuacaccuuccguaggccauuauaaauguauugccuguuuauacuuaaacacagauuaugcuucacauaagagacccauuucucaauuuccuuaacagugcccaaugacaggaaugccaauuuaauaucacaucaauugcacagaggaaacccuaaucucggcauuuguguuaaagaaguuuugaagugagggauguuucaacuauucuuguaaauguuguaucuuuaaaacacuacaguuaaaagucaaacauuuaguuuucucuugcacacuguaauacacccaaguuugaucgaacugcaaaaaaggauuaaaaagaaguuaagcugaagcaaaggcaauaaaaauauuccucuuaccaccuauuucaaucaauggaauaagccaacaccaaguauugaaagacuguauuuuauuuuccacauaaauuuugaagaaaagguaaacuugcccuuauuuuaauuggucauuuggcgauucuuaaauuuucccaagauacccauuauuauaccgcguauuuccucuagucaaucgcuaauaacagcuugacauuaauuuucagauucaacguuaacuuacaaaaaaggcauauuuccuuaaaaacaucaguggacauucuuuuaaauucacguaucuagcuuuaagauuuuaaagugugauauacaugguaugcugggggcccaauaccuacugcgcgugaaaauuaucucuaucuuucaugcuuuaaaagcaauuacuaagcaauuaaauuagaggacucuuuagaugcauuaacucucauuuccuagaaaacaacacauuuuuggaccuguuugaaaacucaugaaaacaauuaaaaugaguauuuuaaau

SEQ ID NO: 15223 - RNA, 17566 nt, Homo sapiens
auuuaaaauacucauuuuaauuguuuucaugaguuuucaaacagguccaaaaauguguuguuuucuaggaaaugagaguuaaugcaucuaaagaguccucuaauuuaauugcuuaguaauugcuuuuaaagcaugaaagauagagauaauuuucacgcgcaguagguauugggcccccagcauaccauguauaucacacuuuaaaaucuuaaagcuagauacgugaauuuaaaagaauguccacugauguuuuuaaggaaauaugccuuuuuuguaaguuaacguugaaucugaaaauuaaugucaagcuguuauuagcgauugacuagaggaaauacgcgguauaauaauggguaucuugggaaaauuuaagaaucgccaaaugaccaauuaaaauaagggcaaguuuaccuuuucuucaaaauuuauguggaaaauaaaauacagucuuucaauacuugguguuggcuuauuccauugauugaaauaggugguaagaggaauauuuuuauugccuuugcuucagcuuaacuucuuuuuaauccuuuuuugcaguucgaucaaacuuggguguauuacagugugcaagagaaaacuaaauguuugacuuuuaacuguaguguuuuaaagauacaacauuuacaagaauaguugaaacaucccucacuucaaaacuucuuuaacacaaaugccgagauuaggguuuccucugugcaauugaugugauauuaaauuggcauuccugucauugggcacuguuaaggaaauugagaaaugggucucuuaugugaagcauaaucuguguuuaaguauaaacaggcaauacauuuauaauggccuacggaagguguaauuugauucauaaaaaagaaaacagcuggaaagggcuagaaauguuaaaucaaagauucacauguacuuagaucuuuguuacugcauauauucaguguuuugauacuuaacugcuugagccaaucuuguauaaugaaccuaauugauuggcacaugagggcaaaugugaauguagauaacuauuauagauagauaauauuauauaagauaaauauaguggaucauguagauaugauauuaaaguacuauauuuuauaaggaagguggauuauuguauauuuaccacuguuuucugcuuaagaaccaaggugauacuuauauaauuguuuuuacccuagcauuuugggauaauucuugagucauaaaaaucuccugaucaacuuggugauugaauuggauugcauuaguucugauagaaacuguuuaaaaaauuaccugacauucuauagaaaugaaaggagccaugcuguguaaucacaaggcuuucaugacaugacauuuauagauuauaugaaauagguaauuucaaauguaaauuuuaaguuuuauuuacuauuagucaucguuuuuugauuauuuaaaaauuuguacuauggacaacuaauuaauuuuacuuuuuauccucugagauuugauuguggagcggcauaagggggagaaagauaaguugaggacgucucuuuaucuuuuguuaaucagagguggugauagaguggaaaauauaacacguuucggcauucaggagaccuaccuuccaauguaaauaagcccuugcggucuugauauuuuauuccuuuuguaccuucaucucauaaucuguaugaagacuuuagaguuccaagcucuuaagaucccuauuagcucucaaauugugggauaaaaauaauuguuaaggcaugccuaauacucuuauacagacuuuguaaacugauuucagagaagcgauuaaggaauuguacugucuuuaaacaauauuuagaaugcuucaguaaaagcauuuuuaaaaaauuuuucuaaugauguaguaaauguaccuaauauaaaguuaagugguuuuauuuaauacuuuucaccugaccaugauuauguuauaaauaagaggauuuauaguuugcaugccugauauaaucuauuuaauuuccuuuacaaaauuuuuguacaugaaagauaaaugucuucauuuuaccagcuaccuccuuccagauugaaugcuucagugcacuuugauuuucaaauuggcuauuauuuuuuaauguaauuaaccuucacaauuuaaauugaaggauauucugauccuuagguuauaaauaugugacuugaugguuuauguaacauucaaguagcauguuuucuauaacaauaugauaaaaguuuugauacauaccuuguauguugcuugacagaucuguuuuagaaaacauuccucugccuuuugaaaugaagccauguauuugaaauuauuucccaaacaauuauaucuuaagcgugugcuacauaguaaucauagucauuuuaauuuagauuauaaagcuauauuuuaacuuugagguuugugaauuuucuuagacauauuaaugacuuuauaguuaauggugcucucagauuuuauuuuuaaguuaaaaauuugccaggcgcgguggcucacgccuguaaucuuagcacucugggaggccgaggcagguggaucacgugaggucagcaguuugagaccagcccagccaacauagugaaacccccaucucuacuaaaaauuaaaaaaaaaaaaaaaaauuuagcuggaugugguggcacgcgccuguagucacagcuacuugggaggcugaggcaggagaaucgcuugaaccugggaggcagagguugcagugagcuaagauccacaccacugcacuccagcuugggcaacagagcgagacuucaucucaaaaaaaaaaaaaaaaaaagaaaaaguaaaaaaugguuuuaaaaaccaaguuuucuaagaaaagcauaaaugacuaaugauaauaugacaauugacuaaagcuguccuuacuguuugaaagaacaacaaccaaaauauguauauuauaccuguaaguuauuaaaucugaaacuaugauauuaugaaauaggguagguggaaauacgagcaaaaucauuaacuuucauagucugccuaagcugaauuuugcucccuucuccugucuuuccaaggauggcaaagugauuuuagacuuugucaauuuuggugguuaguaauuuuugugagugaugcauggggaaggagaugcuaugguagauuacauuagugucuaauucuugugaugaugcaaagugagauacauuuucugucuuugguggugugagaacccuaucuacugguagauaacuuacuuauaagcacauuaucagagcagugugagggauuucccuuagacauuucuuuuaccgagauuccuuaagucacuucugcccuucucuuaaggguuuacuugguuuacgauuugucugucuucacaaaacccucuguuacuuauaaggucagauuaaauuuggaagaucagaaauauguuguguuccuuuuaaauugcuucauuugucaauuucuugggaagauaauuuagcaccuacucuuagagcaauuuugaagcagaucuuugcuauauuucuuuuuuuuuuguuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccugcuauauuucuugauuaugaucuguccgaaugacuaaaggaauuuagauuugggaagauaaacagggacuugcucuauaauuugaaaauuaguccuaaagaagcauuuggguagcauaguuuuaacuaaaauccuaaacuucguugccuucuaaaaaccuuaaauugcuacauuuuguuuuuguuuuuguuuuuggagauugagucuugcucuguugcccaggcugcuggagugcaguggugugaucucaacucacugccaccuccgccucccguuuuuaagugauuauccugccuuagccuccugaguagcugggauuacaggcgugcaccaccacacuuggcugaguuuuguauuuuuaguagagcugggguuucaccauguuggucaggucucgaacuccugacuucaggugacccacccagcuuggacucccaaaaguauuggaauuacaggugugagccacugcgcccugccuauuuucauauugaacuuuuaaauaaguuuucuuugugguggugggaugauuauuguaaucauacuugggaacagaagugaugaaaaagguauguuacuugagauaugggaaacgcuauuuuccauguuuaguuaugggguauucaagucuaacuaguggaaaguauggauacauuuuauuuauuuuuugagacggagucucgcucuguugcucaggcuagagugcagcgaugcgaucucagcucacugcaacuucugccuccuggguucaagcaauuucuggcuaauuuuuguauuuuuaguagagacgggguuugaccauguuggccaggcuggucucaaacaccugaccucaagugaucugccugccuccaccuccccaagugcugggauuauagguguaagccaccgggccuggccggauacauuuuuauuaucaaguauauauuuuaggaaugauuaguguugguuuaguugaauagauugguacaauuaguaguaauuugaaaugaugccuaugguuuccuaacauuuugucuuaguguugauuaaagacauaauaaugugaaauaauaugguaauacuaaggaaugagaaaguggccuuacaggugggcaauguaaacuuuccuguagaaggauugaaaguaaauagauguaagacuagaaagugaaacaauucuguacuguaagagcaauguuggcuguguuaaauaacucguucccaaacaucagauccaccuggggagcccaaauauuuaccuacauuuuuggaguucuuaggggcugaaacuuacgcuugugauuuuguaguaaccuauucuagagaggagccaaauuugugauacucaagagcuuguaugauuucugcuuggacuguauuguuaauacauacauacaucuuuuggucuauuggcaaaugacccuugcaagauguugacauuuuggguauaaaucauggugcuuaauaaucuguuuucauuuuuuauguauaaaauuaaauucuuuuuguccucugcagaaauaugaaccucaaacugaauccucuaaaggccccauacaaugaaguagacauugguggaaacauuuaguaaguauuauucaauuuacauguuuaaucuguuuagaaauuuuaaauacuacuuuggaaauuuugaaaauucgagucagaauuguaaagagggauuuagugaaacucaacacaguacaagaaaaucaacauggaaauuucgcuuauuaauuuacuccaaucuauuauuuucugcuuucuucacuuaggcaaguuaaaaugcaaacaaacccacauuugaacauaccucuaacacuauuauaaacauggauguugcuaaaugguuccucuuuguuuuuguaaauaaaguuuuauugcagcacagcuauacgcuuucauuuaguuauuguuugccgcugcuuucucaguauauagcagcagcaagcagaggaguucuauugaauggccuacaaagccuaaaauauuuccugucucaucuguagggaaaguuuauccuagguccuacagcuuuuccuuuugucagcauugccuuaaccuguauagaacucagaagcccuucgguucucuuuugguaauagaacauaauuuuuaaugauuuccaauauuauaauuacuuuuaauuaauuaauuuugaaguuaaacuugaaagcccaacaaaaaguucuuuagccugauugucccugaaguuaugcuuugauguuagaagacaugguuagcaccucugaaauaguuuuucuaacagccugaaaaauaguuggaaagaguugaugggaagguuguauaaaugaauuuuggugaauucucaacaugauuuauuuauuuuuauuuuauuuuucgagacagaguuccacugucacccaugcuggagugcagugucaugaucuugacucaucgcaaccuccgccucuggggcucaagcgauucuccugcuucagccuccaguguagcugggauuacagucacgcaccaccauucccagcuaauuuuuguauuuuuaguagagaugggguuuccccauguuggccaggcuggucucgaacuccugaccucaggugauccacacgccucagccucccaaagugcuaggauuacaggugugagccaccgcaccuggccaacaugauuuauuauugacaaccuuuuugguaauuauauauuagcuacuucauaaaaauaauuuuuuugaaucauauuugggaaucuagauuuuagaugauaauuuuugccuauggcuacuuuagcuugcguuguguaaauggcugcuagggccugcgaaauagauuuuauuuuuggagggggauuuguuuuucaauacaggaugaugaaagagaugaaaacuuuucuaauauaguacaauaauuggcuguggucauuuuaaagggaucaguugcauagcauauaguagaugcucaauaaauacuuaguguaucaauauggcuucuguuaaacauuguuuaucagcuaguguuuuggauuuaauuuaaaaacagugacauugacuauuaaaacauguuuuaaugaauuaaauauaaaauuguagguaugccugaaagccaaaguuuugaccaaguaaaaauuaaaagugacaagauuucauuuuuucucugcaauucucaaucucuuaguuugcauauauagucaacuuuuaaaccauugaggacgguaccggaauauuugauuugauuguaaaccuuaaauaagaugacuccuuuucuuaguugucacaauugacauuaauuuuauaguuaguuuuuaugcccauaagacccagacuuguuaauauauauucuacugaagauucaagguaucuugguaauaagucaacauaugugaauuuacuucucagggcuuccuuuuuuuuuuuuuuuccccugagacggaguuucacucuuguugcacaggauggagugugguggcgcgaucucagcucacugcaaccccugccucccggguucaauugauucuccugccucagccuccccaguagcugggauuacaggcaugugccaccacgcccagcuaauuuuuguauuuuuaguagagaugggguuucaccauguugaccagguuggucucgaacuccugaccucaggggaugugcuggccuuggccucccuaagugauaggauuacaggugugagccaccgcacccagccucucagggcuuucuugcauaaauauuuccacauuuaaagacaguagacgaagauugaaaucaucauaagcaccaagaauguuaauuacaugaugagaaggaugaauuuuugcucuagguaauuuuacaccuguuugucccaucauugacuuugaaauaaguguuuuaaguuuuaaaauaauuuguugcauuaauaauaguagcuuuaugauagccauccauuaagacaauuaggaaucacuaauuucuuuuuccuuauacuacucucugccccugccccccgccccauuuuucuuugcuauuaaaaaugggaaaaguugcugagaaguagaggaaaggagaugguuuauuuuaggagagcccuuguaaacucaauccagauggugaaucacuuaccuguguauccaccaacaauguauuuuaucaugucccaguguuuuuggaacaaauuuacuaaaguagaauuuaaaaagaauaccaggccaggugcaguggcucaggccuguagucccagcacuuuggggaggcugagggcaggugcaucacaaggucaggaguucgagaccagccuggcccacauagugaaaccccgucucuacuaaaauuacaaaaauuagccaggcauggugauaugcgccuacagucccagcuacuugggaggcugaggcaggagaaucgcuugaccugggaggugcagguuguggugagccgagguugcgccacugcacuccagccugaggaacagagagagacuccgucucaaaaaaaaaaaaaaaaaaccuuaguugggugcagaggcauguacuuguguucucagcuacugggaaagcugaggugggaggaucucuuccacccagaaguuugaaaccagccugggcaacguagugagaccuccaucuuaaaaaauaauuaaaaauacaaugaagagaauaccuccauguucaacuuuauguucuucuggauguaugauaaugcgggaauuuuaagggguaguaguuacucauugaagcuuuguugccauuuaaguuuuuaccuuugcugugggaaugguacucuuagaacaugcacauuauuuugaaaaggaaguauaaacuagugaauaucaaaggggaaaaauuuuguuaaccauuuauauuaugagcuugaagguuauaugugaaauacagaaaagaucuagguuugucugauuauggaauucuagaucaaaacaugucuuccaugucugcaguaauucacaaguuacuggaaaggaacauguagaggguuuugauaucuaaacccuacccaguuuucuguaggaucuugauuuuauuuuaaugcaagacugcugaccccaugauccuguguguucuucagagauacucuuacugaugauguauaaaugaacuuugauucaguaaggucaguuuguaggucucaaaguacuuugguuauugugguacaucagaaugauagcuaguauuuacugagaucuuucuauaugucagguaauaaaaauccuauaaaaguauucuuucuacagccacaggagguagguacuauuuuuauuuuacagaugaagaacuguggauuuuguuucuaagaaaauuuccaggcucacagaacuaagccuaauuucuuuuuauuuuuuagcaaauacaguuuuuauaagaauuugaauucuaugaaaauaaauggauuacuccuaaaucucugaugccucagugaacacuuuuuccuuauuaacaaaauucucacuuuuggcuuuggauuggcuuugcaggagugcagauugaucauagcuuuuuucauguccuaagaguugucagaguuuucucuuguagcauuuuuuucuuuacuuuuuuuuuuuacuaucuuuaaauauaugacuguaagaguaugauaaauaugcuguuuucuaaucucugcuguugucacauaaacuaauauauuuugaguaauuuugaaaugauauuaauaaugucauuagauuuucuuuggauuuuuugaaaaaaauaaugguuuuagaaggaaaucuggauaaauuuuaucucuguccugugucagaaaaauauaaaacuugaguuuuuuaaauuaagguacuaagauaaauaaauugcaucuauagauauugaaauaugacuguaauuugauaaugcauuuucauucucagugucauuguucaucauaauaguauuuacaucaccaacuucauuuagagcuugaaucuuguaacaauagagauugaaaauaaauugguuuauaauuaacucugacagagaaugauguuuuuacuuuuauacuucucuauagaaguacaugucccuuaauuuuaaggaaugaacaagucagauggaagauuuuuacugagaucaggaaugaauugaguaauuuaguuuucuuuuuaaagcuggggagaaaugagcaaaaucaaggagaaauaucuugcuuuugauauuuauuacugaugcugugacacucccuuuaaucaauguuuuuuaauauggguggcaguaucucaguuaaccaaauaguuaaguaaguagauuuuuguauuguauauaguaaacaguauccuaauuguugccaaggagacaaggaauuaccuaaugggcaaaaaugcccuuauauuuauuuaccucaaauucagucacacuugacuguaucuccacaaauucagauggagagcuggaaaauuuauagagaagaccaggguuuaaaucuuguuuuuucaaauuauguuuggucaugaugaaucugaaucauuuauuuaaugauaaaaucaucugacuucucacuucucacuucucccuucaguuaaaauuauuuaaguaauggauuuguuuuucuaugagagacauuugguauuuugguaaugaaaguguauuauuuuaguugcauauaauuugaaaacagcauuuuauggcaaaucuaucaagccaggcagauacuuugcauuuuugaucuuuuuuuuuuuuuuuuuuuuuugguggcuacaucuuuucuguauucucagauaugucguuaaagauggugccaccuauaguggccauuuucguuaucuaaacaaaaccaacaucuguuggauugaaaaacuaugcuaugaucgacugcuuuauguguguauguuuuuuuuuuuuuucaaaucccuuaagauucuuuucuauaauuaguuuucuuugaagaagcuuggaaaguuuucugcauugagauuuagaauccacaguguuucuguaauuuagcuuuccaggaauuuugaauuuuaauuuuuguuuuuacuuuuuauguacacaguauaaugauguuaguguuaaauauuaaaaaucugacucuucacugggacuuuuuuauagauacaaauguaucugugguaguacaaggacuuuguuacuuuggcgugcagucuuaucaaggaguuguguguguguuuugcauacaacuuuacaauuucauaguugaaagcuguuacaaaaugaaaguuuuguguaugguaggauaucuucaagguggguggauguuuucuguuuaaaagauuaagaugccaacagcguuuuuuucuuuuaauuuuuucaucaagcacccagucagcuugaagaguuucaaauggacccuaccacugagaaaucaagauggcagucuacuauggggaauugaggaaaaauggauuaauacaagaguccugugauaauauacaaccaagacaggguucuuuuaacauggauuccaugcagugaaugaagacauagguuucuuacccaacacaaauggacaguggauuugacuuucuaaagacuuuuuuuguggacauuuugacauuuggagaagaaagauggcacacuaacccagauaauaguuuuuaugccuggaauuuuuugcaguuugauuuguaugcguaugaccucuugaaauguuaauuuuuaauaaaauuuguaacacuuaaaaauuucucaguuuggguuuuuuuuuuuaaguggaaguuuaauuaaauguuuaguuuuauuuuaguaauacuuuggccuuuguaguugccgagugguaaaguguacugaauaugaauaaagcugguaaauuggaaaugguguaaucgaaaacauuuuacuugguuuaugaagauuuacguuuuucacaaaguugugcucuuagauggucauuugguuuaaauacuguuuuguuugugcuuucaugaaacaccuuucaaaacaacucaauggguaauaauagaaucugauuuuaaucugccacaagauuuuaaugaacuugaaacaaacugcuuguugcucgaaaauucaggaugagugauacacauauacuucugaauuauuuuguguugauugaaaugguuucuuaagcuuuuuaauacuauaaauacaucuugcuauagaauauucaucugaauauuuaaauuaaugucuccuauugucuuacuauuagaggaagaaguguuggauuuauggguuaggguccuuggaguauucacaauuuuuuaaauuugaaauuauguguguaauccauuuuauauaacuuugaaguaggauuaauaucuuguaucgucuuuauuuuguacaauuggggauuuagaauaaaugaauugcacccugccauagauuacuuacguuugauuuuuaaaugccagguuuucauuuauuacuaaucaacugauaccaguuuugguaacuauuacaaaggugguaggcauuauuuugguagacaaaaugaguucuugauucuguuuucccauuuuacaugagaagaauaaauaguucagguuaaauuguuuuguguuaaucauacuguuugugauucaugucaaauacugcagcauacacauccaugguuaauacacgagcaccauuuguuauugacugaugugaggugguuggucuuuguuaaauucaaaaauggaauuuuggauauuguucuugcuacgaaauuuaucuuuguguguagaguauggaauugaaacaguuuggauuauggauuuuaccuagauuggacauuguugauuuuguuugguguaaaucuaaaguggauuucuucagugagggagagacaugguucuggcagauuauguugaauaaggaaaguugauuggauuuuuuugggugugugaauaugcuugucugaauggagugcuugguaggauauuguuucuggaauuaguaauuuguuucuguggaucucaugguuuugauauuuaggagaauuugcuuugugacauuacuuugauaauuugcaaucacguauguccuauuguuaauaacauuguugaaauggguguauacuuacuugauuugaaauauaagggaaguguugggauauguguuuucuguuggauuuggacguggaguuucuuggguuacugauuuaaaggugaucguguuuggaccauacucuugaauuuuugccugaaucaguaugggaaguaaauauauugugauuaugagaaguuucuuuggggggaggaguguaauauuuucaagguuauauaauggguuaaagaauuuugugaaagaacaaagaaaaauggauauucuugaauaaaaauugguugcauuaacuuuugcuccagugcaacuugaacacuagggaggcgcucuugaguuguaaaaguuaccccuuucuuccaguggagauggaaaauucccccuuaaauuuugucuuuagauuauuuuuaggcaucauaaagaaggaaaaacuugaauuuauauuaugaaauuaagguuuuacuuuuauuuagcaaucauuucacccauugggggauuaauuuuuaaaaagauuaguacuuagcugagcuuuagauucucuaagaauuaucccuuuuucaaaauggcuugauaaaacaccacuuccuguccagggaggaaguuauuuuagcucaaggacugaaauauuuagcagaucuuuagacaaaaggaacaaauuacauuucucucuggcuuaaaaagggugcuugagccagaggggguuaagaagcccuccccccucccccuguugggguggucuggaggggcagggagguguggggguggggguccuuaggcucccugggauggaggaucugucucucucucucucucuccuuuuuuuuuuuuugguggagaugaaggggugggucuaugguacaucaccugaguugugggguaaauguagagagugucaaucaaaggcagagcucucagagcugggaaggaggcucuagauggcggcugugccuuagagagagcgcgcucugcucccugccuuugccucacuuuacgcaacuuucccuaacuuucgggcagccucagggggcccccguagcccccugccuuuccuagggacuuacuggggucgauucgaaccuuuuuuugggagaaaagcagcuuuuaggagcuuucuuuucgugccuuguuggaaagaagcagccguacugagagcccaggucguuguuuuuuccagcuuagaagccauggcgcaccuccauuuuugugcgcucuccuaaugagguuuuuuuucuuucggaccuguuuuaguauuaauuauugcuuuauuuuuuugaccaguuaacauauuugaggguuauuuuauuuauuuuucguuuuuuaacggaggauuuugccuuuauuuuuaauuauuugggaucugauauuuuucuacuaguagauaggacucuugguuuggacauacuacauggaucagguaaguucacgaucauuggugauaauuuuaaagauuuauuuguuuaaguuugccuuguuuucuguaaauacgagaaauucuuggaugacgcaauaagauacagagauuguuauuuguaucuagugugcuacuuugagaaaguuuccuuauugauagugaugcuuccacuguucgguuuauccuguuguuuuuucuuuuaaggaaaaaauagaaauauuuaguuuuuuggugcuuaccguuguuguguuauaacaauaucguuaacaucgucaggacuuuguuccugauaauaaaaagcaucgauagaagccgggaccuuaccuuucuuucaacuuuugacaguaaauaccugggcacaggacuucaaagcaaacacagauucccccucccccuuaauauuuaagaauuaaaagaugaugagaaauaaggacaaaagccaagaggaggacaguucgcuacacagcaaugcaucgagguaugagcuaucaacuuucuuccuuuuugucuuuuuuuuugggggagaaaccucagcuuacaauuguuuaccuugacagacauggauugcugucuguuuuauuguguuuuucuaauuuggauucguuuuuuaaagcaugaccuugagauugcuaauaugccacacccuaauuuuuugguagcaauuuaugaaaguugaguugugacuuaaggccucuuacagcagucaaaagguaagguaccuuuauucaaaggggccuuuacuguaauguacaguuuuucugucaguaaauuucaguuuuuagguuuuuguacugcagaaaaaugaccuugucgguuuagccauugcugcauugcaccauuuuacauacaaggcaaauuuuuucuuugaagaauccaggauaucuaaacuuguaacugagggccauagagaagccuuguaguaguaaauuauaguaaauagacauaucagaaaguuauaugaaugaaaaaauguacauuuaaaaacaaaaucacuuaaaggacccuuugacugaugccucucaguuuauauuuuuaugugacuuuauauuucuuuugauacacuugacauuuuaggaaauuuugaugugauuuaucaaaaccuuuacuugaugguuagaguuccugcauuuaugaaaucaaaucuguaauaacagaaauccuggaauacucuuaauauauacuucuauuuuguguuuguuacugugauuaauauuugcaguuguauauuuuacauuuaaauuauuuuaagguuugcauuuguaugcuuaagacauugauuuccuguugguagauguauuuuauccucacaauuuagauguagcugcuuuaaauuuauugauguauuucgacagagucgucuggaaugcuuuaucuucugaagcuuaaaaauguacuguuugugcaaaucaugaucuguuucacauuccuuggaguaccuuguuagugaugaaguaauaaagccucuaagauguuuuuguuguaugaccucuguauauuaauuuuuaaaaguacauaugaaugcauuuuuugauguguucuuuaugcauuuucauauuauaaauuuuaaaucaugcaguuuaacaaggaugugauucauuaugugguuuuccuucccaauuuuuacuuuucuaauuuuuauaaauaauacacuuuucuauuaggcuagugaauuugaaaguuuugaacaugauguguuacuaauaugcugaauucuauuuauuuuauuugacugaaagcauauugagccuugcuuuagaaaauaaguuaccaaauuuuuuugcauugaguugucacccaguuuguagugcugucuuaauugaauugcccauguaaauuacuagauuaaauugaggacagaaaaguuuuuuacucauccuaagcuguuuuuuucuggaaaguaaugacaauuugaagaaaugagaaccuccagauauauuuggcaaauuauuaaagauucagcacuaaaauuguugcucccuugaguguaucauuugcauaggucucacauggguuuuggcucucuuaugcaagguuugugguuaacaucauugaucagacugugcuuucuaauucuaaaaaauugagcaguguugguauucuuucaguauuuuuacucucaccuggaaaacuaccuggaaguugucaggcauuugcuuacugguaguggagguuacagcuguacaugaagcauguacugacuguacuuuuaaauugguuugucaaguauacuuugaaucauauaccugauggauguccaaaaauauuuaagacucuuugaaaagaagauaguuacuuuuaaauuaguuacccuaaauuucauaucuuaauacauguacauaauuaugacaucacuuccuuuuaaaaugugcagcuguagaauguuagugguguuuuaaugugguagauuaauauuacuucuacugagcugaacugucccuguaauuaguacuugguuccuucugccaucagaguuuuuauugcccaaaguauaguguuuagggaauacuacgaaaaucaccuuugcagccugagccacagaagaggaaaugaguuugcaggucaaguaaacuuuggucugagaauuacuuuaguaucuggaaagaaugagugcaaguuuagguaaaucugguaauacccuguuuuuggaaauagugcaguaguuaauagugguuauauaaguuuguauuuuaauuugaaguuaaugcuaaagucuguuauacuuuaucacgauuuuugaaaauuaaaaacuuuaaaaaacgcgauuuuaaaaacauuugauugauauuuguaaaauuucuaaguauuuaaaacaaaguucuaaugauggacauacgagaaguauaccauacuuuuuaucugaauaauuugcagcuuggggauaacuuaaguaacaucaaagaaugaaaacgggacugugugcacacaaagaguucaguguguucuccacggcaccacguuagcaauuuaucuuaagaauugaacgaguuuauuaaauuuaucuccaaaucgucugccuuugagccagauuuauuuuuauaaccugaggugcggguaaauccuacaauuuucaggggcgcuuuaccagauauucuaaaaggcuggggaugauuagaaauggcauaaugcaguuacuuguguacuagaacaggcaguuuaacuggcagccauuuuaugacgcugauaauacauuaaaaaacgggauuuuggagaagacugaaucuaaacuaauagaaaucugaaauaccaaagccuauuuccuucccccucucugcucuucuggggaacucuggugccgacauaaaaggcaguucgauagggcacgcagcagcucuuugagccccuggcaucuugaugcagguccagcucagucacaaaauggcuguuccuuugugccgcagcgcugacagacauacugcauugcacuguguacucgccaaacagcaggaag

SEQ ID NO: 15224 - RNA, 2628 nt, Homo sapiens
ugaaugaaaauguagaagugauugaaaugcucuuccaggccaguaacagcuuguguaguucucuggcagccaucuugggacagaugguuuuacuuucuuuugugacaggagcaaaguaagagcuacagggaaagacaccuuuccucuuugggauuuuuuccgguaguaaaauaaaguuuuauggcuuucuuaucucuaccucacagaaguauuucaagaaccuaagaaguaugccaauguagacugccaccaaaucucagacggagagcugcauaaaaauucauguaacuagcggauaccaauuaucuugaggcuuucgaagugacaacaguagacagauuuaggaaugaagacuuagacccguguuccuaagaacaaugagagugucggaugucccaaaaggaaaaggaaaaaucccuuaucaggauccauaaauuuggagucugcuuauuauuaauaguuuguuguggaauucaugagaaauuauaauaguuuauaaacucacuuuuucaagguauuuugagccagaucugcauaugauuauucuuggaggguuuaagggcaaaaaauuguuuaaaugugugaggugacaacauauaccguggucuuugccuacuguuugaaauaaaauucugaaaccagaaaacauacaauccagucaaaauauuugccgaaucgacguuaccacaaaguaugaugucuuuuauauauguaguuuuauacaaagaucaagaggauuugugucugugugugugguuuauaaaaccacuguagucaaagcuucucagaaauacaugguauuuauaagggcuagaggugugcugauuuuuggaaaagaauuaauacauaauuugaauucagaguacaagcuuuuaaaaaauaagauccagcuuggagaagcauuucugaaauaccucuagggaauaaauuucuuuuauuaauccagucagccauuggaugucauucuuccaauuuaauuacguuuaucugcuaaugggugacucuguuucuuguggauauaauuucggugggugcaaauggugauggcaaauaauugcccucagggagauaauugcuguuacaauuauuuacccauccaaguuagcucuguuaaaaauuuaacacucuguuagaugaccuggaaaugugagagaauguguuuucuaugugcugaaguagaagaggagcccuuauauuucuuggauauuuucuaggggccagguacaguacuaagugauuuagaaucaucaucuugcugaauccucacaaucuucuuauggagugaguaugauuauccucauauuauugaugaggaaacugaggucauacagacggcaaguagaggaacugagacucaaaccccagcuaaggggcugguaugaaaugauuccuauuucacagggggcuugcaaggauuagacgaggagacaguuuuguaaagaauuucgcccggcaccugguacguuguuguuauccuagugucuauucauagacauuuuucuucucuaaccacugcccugccuccuuucagaaaccuauuguuaugagcagggcaaagcauuguaccugaagccuaaaugacaaauauuuccuuugaggucuuugcacgcuccaaguucuucagaaagcuuccucuggcuauuucaggucauagggcuucucuccgcuccaaaugcccaucacugucauguacuuacugcucaguaggagcccuugaauagacagggcucugauagcggucuuuguauuauguggguucuugucuugccucaaucuacauugaaaguuugaguacagguucuccuuggaucucucuacacguccuuagaggauacagggcuccauaccaggcuuugaaccaguacucuuugauuaagugugaaaucuacaaagacauaccuaccuggagguuagaagacucagguugaaggcucagguguaggguggguuuucauuaugaaaauuugggagguaguaucaucucucauuauugucaccuguuggcuggccuuccucuuuccauauuuguauagugugguggugugguguguggggugaggaucuuuugaguuuucuccuuuuggaaaaacucacacuaccaacuccuugcacccacccuauaugcacccauucccaaaacacacaaagggcuggagaagagcaugagaggucaccuuuuugggugagaagaguaauguuucugaagcaaggcacuguuugggaaggguguucucaaagcaguugcucauagaguuuggggguaugcacacugguuguguguccucccagcauguggacuugccaacaugucuuguugcuaccagagcagacugagaagagguguggggaguacacuggaaagaugggaccauggaggagggaggcagggacagcccuuggaagcuaucuguuacucauaguggggaauaagagcccugcuaauacuuccauccuagaguucaagcuaaaaggaaaagaugagguuaggcuaugggcuucccugagacuaauccaugcaggggaaaagggugcuuacugaagggggguggagcucacagcgggcaacugagaguuugcugggaguuggagcugccucucaaaagggagccccagagcugaagggagcug

SEQ ID NO: 15225 - RNA, 1253 nt, Homo sapiens
gugagcccugagccuuaagagauaguuuaugaaugguauacagcccccagcgucuggcccucaugaacuuuaccccaaggccaggaaugagggauuaaucauagcaucaggauacgcgugguucuaucucuggaugugguuauucaauggccaaaaucuuguccaauucuaucuccaucaaacuugcucaggaauacucaaagucuaugacauuugauuccaguugcgggucaauagccaaguaaugauuuaacacuauaaacucucaaaaaaaauuucccguuuagacaggacuguacuuagguguggaagcacgcucucuggaacucaaguugcgaccaccugagcagaggaggcgaaagcgacaaaguagguaccugacagugcugagucauuacaagcuguuuccucugaaauguuacgcacccaugggcccucugagcauuaacauccccuuucuggaggcaaauaaaauacauauucauuguggaaaauggugcaaccuucuguaggcgacagaccacgauggggaauuuagcacuaagaguggauagcaggaacuacacaaacucgcagcugcucucuagguaccguaacuuuaucccagacgcucaaagagggcuauagggauaccggguggcaauauucccccugcagccccggcucaggccagggccacacuagggcgcauuucacucuaagcuguuauaucccccuguaauuggcggauguagaaagcgcccggagaaaaugaugcauaauagauuuguucucgaggaggaugcaauggagaguagaggacgcaggaugcuaacugguuuuucuucccaugugcaggucaccugaaaaccccgacgcuuuuucguuccucuccaaggagaacccugaacucaccgucucgcuccgcucuuauggggggagaggaauaguuucacgcccaccugcccgccgccucuccucccccggcacccccugccccagccggacgcgcgcgagcugcuaccggcaucaacggucccgcccgcuacccgcucgcuggcagccccggccggcagcucccccggcggccgccucugcaccacucgccaaccuccacgccgggccgaggucaugcccgccugcccccagcgccgggcggcccccucgucgggccaggcggccgcucgagagccgggcuggggaaggggcccgcggcggaguuggcucggggacucaccagguaggcgcccaccgugcccugcgccagcaucagg

SEQ ID NO: 15226 - RNA, 212 nt, Homo sapiens
cauggacaccagccgugugcagccuaucaagcuggccagggucaccaagguccugggcaggaccggcucucagggacagugcacgcaggugcgcguggaauucauggacgacacgagccgauccaucauccgcaauguaaaaggccccgugcgcgagggcgacgugcucacccuuuuggagucagagcgagaagcccggagguugcgcugag

SEQ ID NO: 15227 - RNA, 3063 nt, Homo sapiens
uuuguuuuuuuuuuuuugaauuuuaaaaucuuucaauauuauuuaaugaaaaagucucacacugucauguacaggauauaucaacauuuacuacucaucugucauguuaggaaaaacaucauuauuacacgcuuggaaaauccucaaacccaucucuaguggaugucugucauaauuuaaacgguauuuuccccauucaaauaaaacaaucucuuguaaagcuacaacaguuauauaccaaagcaauaccuaguuacaugcuuuacacggucccgugaaaaaauaauuuaauugcuccuaaucccugaugcaaggcacuucaaagcacccgcacaaaacguccauguaaacagcaguacagugcaucauuuaaauaacauaaaugacuuuuacacagcuugaccuaggaaaaaauaaaauccaucauagccacagcuaaaaagcauguuaagauucacaacaagaauuuguuucucuuauuauaaagagaagagcaaucauaaaaccuccugggggugggggagaccucauaaauauuuuauauugauugacaaaacagcaugcucccuggguauguaugaaaucagaauauucaggaguaacugagaggaugcaaaugacauuucuuaguacccagcuuuaauaucuaccaggccugguagucuggauuauuuguagcaccauggaaaacucauuagaaaaucacaaagguauauaccucaaccuuuccaugagguucauuuaauuauaguaaaaaacagcagugaugcagauaaagaaucuuuaaaauuauuggcuuacuggauuuaccuagcaagaaaaacucuauauuacuuauuuuaguacaucucauguacauaaagcaccaguuuaaaugagauuaucaaauaucuccagcaucuuuuugcuuagccuaaaaguucauuucuuaucacuuuccauggcacauucuuaaagccaaggaagauaaaacuagaaugguuauaaauaugaauggagaaauucaguuccuucccuaucauauuuacgugucucaaguaaaacauagaugaguggcaaaaggucuacugcauucucuggaaccugccaccccagaguaguuacuagcuacuagaggauuaacacacagggcugagcaggucaaagccagggcucugucagguaagggccaguuuuuacuacugagcaacccacaaacaccacugguaaagcaaagaggucugagugugcauauagcucaggaaacccugaguuuacccuuaguuaccacuaaaaacuaacaaaugagacucugcugaggcuuaacuucauauacaaaaaucaacaccuuugccucuuugacagugguaauuauuagcaugcccuucuuagguauaaaagggauaaugguauaucuagguuuaugcacaguuaagaaucaacuacaaauauucagacuuguauuuuaaaauuacagaucaaaagugacucccaaaagaaaaucaauuucuucauaaaugaaacauaguauauaaaaagcuggaaugaugauuaauucaaauacaaaagcuaguauacaacaacccuacuuuuucuuccaaacuacuuagguucauacgguucacacuaccacacaacuguucuacauuacaauuacaccacuagaguaaaauacuaauaaaacacuucaguuagcaagcugagguucuacuuguugacaacugcauuaaaacugcagcauuuaagcagagcugagaagcaccguucuuaagcauggcuuucuucuuccuguucuuguguuccacagugauuauuaaaggaaggaauuuggucuguaaaugacugggucauccacugcucauuaggaaugccacugaaaguugauucuccucuuaacuccaggcucucaauuagcccauuugaagagaagcugcaagguucacugucgcauggauuuucuccguaagcaccaccauaugcugccucauaacccagaucauauuuuucuuccuuaacagccaucuucuuugcaucuucuugggcaagcuguaggucaaauguauauugcaccucuugaacguccguauuucguucaaugccucucaacugaucucuuaagucuuucaguuuuauguaguaaugaacuuugucuugggcccgaggaaacugagcacuucuugcacuggaugacggcauaacauagcagagaguuucugugccuggaaucuuauggggcugaagcccaaauuccaaguucuuaaccuuuacaccaaaaacuucuuuacuaaaaauuucauaaauacauuuuccauuaaacacugcuauucguggcugauauuucuauaauuucuguacuagaauacguccuccuucacgaaauucuuuacuggagagaucuuugcugccaggcgugguccuuuccaccauguugguaaauccaauaccauacuucccugguagagugugaucauccauaugguucaccuggaccucacugagcccugacauaaacaaacacuuccaaaaaugguuuccagguccaggguaaugaugcccuuuguaagcagccauuagacccggguuuaugccaauaaugacaauguccagauugaaggucaaaauaucggggagagucuuggucagaaguucagcuucugaaacaccauuaaaacggucuacuuuucuuuugacuuuaaaugugucuguaauuuuucuugcuuuucuuuugauuuugcagacuugcuagauuuuuuugacucaacagguuuuuuggguuccacugguuguuuugguucuguuguucuggguuuucuuuuucuuccuuuuggagccucuugcacugguuccugagcaggagcuggggcuggaacuucuucuggcauuugcuguucauucacaacugccauauuaggagcuucagccaucaguuguugaaauggaaacguauaaaaagcuugagcuugcugaagggaguagcugcccgcguucuccgcuuccauuccccgaggccgcugaugcgggcagcuccaccugccaggcacacgggcagccggucucuguaguaccgcgugguacucacugcgg

SEQ ID NO: 15228 - RNA, 8578 nt, Homo sapiens
agggccacggccuaacggucacuggggcccggguggcucaagggacacgaguaggagcauaguccuggagguggcggugggcucgagggggcagucauuuguuacccggcugucuggggccaaguccaggaccgcaggaaccgcgaccccgcguuucucacagccugcaugacuugaauugaccccagucaguuuccgucugcagcgacagucacagcugcgccggcgccgguaccaugagugccugucggggaggggacagaagggaaagucaucuacucuucauuagguccacugaauauuuuuauuuccauuuaaaugcucaauaagacuuucacuguaguucaccaggggauucuuucccuuuuuuaauguucugagauggugggucacccccuccauaugcgaaugguucguucuagcaguuccgggacugagcuuuccccuaguuugccgcucccgcggcugagggaucccugggagccgcggugcauugugggagaacgaaagauggcggcgcccguaaggcggacgcuguuagggguggcgggggguuggcggcgguucgagaggcucugggccggcagucuaagcucucgcagccuggcucuugcagccgcacccucaagcaacggauccccauggcgcuuguugggcgcguugugccugcagcggccaccuguagucuccaagccguugaccccauugcaggaagagauggcgucucuacugcagcaggugggacugagaugcaggguucagagugacguuuauucugcgugacuuugagcgaguaauuucaccucucugaacuuaaguauacgguacuuauccgcagaaugguaccuaccuuacugacuugguuugguacauagauguucaacaaaaagugguuucuuuucauuggccguguuuauugucaccuuagacaacucuuuggagauacucuacuucuuguucaugcaacacaauagggauccuguggugaacaagaaucgguccgugucacuaggagcuuacaagucuggagggagaaagucuuugugaugugaugaauguuaagaaggaaauacaagaggcggugggcacaucugucagaugccuaugauaagccuacucuguuuuaucucauggggcuaucugugugaggggcaagugaggaagcaugggcaaaaacaguguaguggcugugaaggugugaggucgcuacagaaaguguuugaagggugauauguuuccucagaauccgagauguuuuugucuuggucuguugagaacuauaaacuucucuucugugcuuuuugcuugauuuauucauuuacucgcucgcuugacaaauauuuguuacucaaccuacagauguucauugugcccauacuaugcaucagagaguauguuaagugauagagaugcuguaaugaauaaggcagaaguagcucugguucucagaguacuucagucuaguugagugaggggaucagucaguaaccaaauaaucauacaacuaaaugcagacccugauaaguguuguuaaggaaaacacaaggcacuauaagaguguuuaacaaauacaucacauuuugauuuuauggugagugucaaggaaugccucagacuuucugaauacagguuuuucucuuuaugagaaaugucucucugagacagucauauuuaaauugaaaucagaaagaugaguaggacucucccagaagaaagaaugugaggaaaaacauucuaggaagaaggaacaaccucuugaaagucccugaacaggaaaguccuuggugagugagauucugaucaaagacugacaugacuggauuguggugagucagcaggcauugcccaacccagcucucuguuuuuguagcacucuugacccccagugacauuguaacauuuuuggcaaauguaacucaagcccaaaguucagaggaccuuuuuuucccuccauuuccuuucugcaugguguuuugacuguguaucugguuauguugggugauaaacuucugagcuugccaagugugccaugucucuguuuuauucuuccuguuuuuuuuuuccuuuuaauuuugccagauuaagguaguuuuuugcccuuugaauuuucccagauugagauagagagaagccuguauucagaccacgagcuucgugcucuggaugaaaaccagcgacuggcaaagaagaaagcugaccuucaugaugaagaagaugaacaggauauauugcuggcgcaagauuuggaagauaugugggagcagaaauuucuacaguucaaacuuggagcucgcauaacagguugugauccuuuuaggccagccagaaggaagggaaaagggguauuuggauucccaaauaaaagacaguugcuuggccccugcuuuguguuuuaaguaacaaauaauuucauauucuuuucuuuguugcucacaucuaccauaauacgacuuaaaaagucugucuuauuuucgggugagagguaaggguauuggaauagccuuuucucucaguuaaacuuugugaauguuaucuguguuuaacuccaaguuugagacugagaguggggcaaaugaagccuuuuuccacuaauuccuguguuuuaugugaaaucccucuuaaagcgggagauugaguucuguuuuccuuguuucacagaugaagacugaagaacagagaaaguaggggcuaguuaagucaguaauaguaucaaaaccaaugaaguaguuguguuugaauuaguaugaucauuguuucuuuuuugaagacucaaaauaugguuugcuguucaaagaagcuuaccucuugauuucuuaccuuuuaguuuccucaagauugugagacucuucccuggaagaggucagaguuagagagaugggucgagguguaauuugguucuaagcucuuugagggcaaggauuguggaucuuaaaggaagauuguaaaacuccagguuucuugguucuggcagaucacagucuucuuaccuccucugacccccuuugcuguagaagcugaugaaaagaaugaccgaacaucccugaacaggaagcuagacaggaaccuuguccuguuagucagagagaaguuuggagaccaggauguuuggauacugccccaggcagaguggcagccuggggagacccuucgaggaacagcugaacgaacccuggccacacucucagguggguuuucugccuuccucuaaauuccacaaaauucacuucagacucagccagaggauuuuuaggcugacuggggaauuggauuaagggugggggugggaagguuaauggaaauuuugaaguuuauaaaaauuucagccagaaaaacccagguaaggauuuuuuuuauuuuuuuuuuauuuuuauuuuuagaccaggugagaauccuuuguuccacugagauuuuaaaauuuaguacauucaaaauugauauuucuaccauuuucucagccugcuugucuucuuaucuuugcagcacugcuuauugccaucacugcuuaucuguucacucaacuugaaaccucagaauuguccuugaccucauucccacauccauaaguccuugagucccucgugaucuguucuaaauaguccccucuuuguucuaacagcuuuagcugugacccucuucacuucucacuagacuaggguuucccaucucuggcauuauugguguuuggggucggauaaguguggggagcuauucuuuguguuauaggauguuuagcaguaucucuggccuguaccuacuagaugccaguagcacuaccucauccccugaccccacccccagugcaguaaccaaaaauaucucuagacauggccagauauuucccagggagcaaauuacagugguugagaaguacuauacugagcuauugaauuagaugcccaguaaguuuaaccuugguuuuguggagugcccuucagugcugccaaaaugagcuuucugaaacacacaucccuugucacuucucugcauggaauucuuaaaagguuuccaauaaaaauucuaacugucaagcauggccugcaaaucuuauuugcccugaucccagucucaucagucugccgucuugcuguucauuaauguaaaauucaaguucuaacuuaacaaaccuuuugcauuccuugaauaguauggucuuucaugugucucugcuuuggggccugcuggucccugaugaaauacuuuacuccuuccuggccugacugcucaguuuuuaagacaguuuauacauuauaccguauguggugaaaccuuuccugagccuucaggaagacagagcuacuccucucucuaggcucccguagcacugguguguguccuuauuccauuuaugcaacagacauauagggucucagugaugaacaggacacuacccuacucccuaggagcuuguguucuaguggagaauacauucuuucacuuaugccauugcacuauaauuguuuacuaacacauuuuucucccuagucagaauuuugacuuccuuaaacaugugggcaguaucuguuccucucucugauccuagcuuucagcaaaguaccuggcacauaggcauuuguugaauguugacuaaauggauuugguggugcacagccacuuuaccugcccucccaucagcacaaguaccugcuaacgaaaugucgguagccaguguguguucccuugacucucccaaggggccuguguggccugcaggagagacaucaagacagaauggaauaugguaggagaggagguugcugcuuucucagucuccucagccaucacauaggagucagcagcugaguuucuugcgaggaucauuguguccagaugcucaacgucucuuaacgucaaacauucacaacugauccuugcucagcuccccuuucuguuugcagugaggaaagggguucuacccaagcacuaugcuuuccuuuaaacauugccauuguaauaaguaaauguaaaaggaaauauaucaaauauauuaaaacacauauuuauguuuaauagaugcauauaaaauaguguauugacuuauuacaaauuuacuaaacugacaaauaauauaaaauggcaaagaaaaacucaagcaauguaagaguauauacuguauauuuaaaaagugaaagugcgcuccuuuccuccccucuggcuccacacugccaguauuucugcaagauggaauuucuagcgguagaauuaaugggucaaagaugugcacacuucaguuuuugguaagugcagcccaguugcccuccagaauguauauaacaauugacguuuuccaggaguggugucugagagugccucuuugucuaaaccucacugacacaugaaauaguugcuuuuaaaauuuugcucgucuagugagucagaugaucucuuucagauuagcauuuuccuguuugcuagugagauucaguaucuucauguguuuauuggcuguuuguacuucuucuuuugugaacugccuauuuagaucguucgcucaucuuuguaauaagcuguuuuuucuuuuuaauuuguuuauauuuuuaauccaucuuuuccagauuauagaaaaguaacaugcauuuaugggauuaaguuuagaaaauucaggaaaguguaaagaaauaugccaauacaauuccaccacucacagauacccacugcuaacguuuuuuacuuuaugugagcucacacuaucuauaaauuuuucaucuaaugcuagguaguguuuuuuuuuuuuaguaugagaaaagccauucacguaugugguaaaaaaauuaucggugucucguaaauguaguguaagauguaauuuuccuuuuucagaagcaaccucuauuaauaguguuuuucuguaucucuucagaaauucucuaugcauauacagaugcauaaauguuuuguuuucuuuuuuugcauauaacgggaacauguuuauacacuguugugugccuuccuuuuuucucauauacgcuuuuaaacaucuuuucaggucagccuauuaagaccuaucuuaagcuuuuuuuaacaccagcauacuauuuuauaauauguauguacugcaguuuguuuagccagucuguuuuuacaaacaaagcugcagugaauauccuuguaugcucaucuuugcucacaugggcaaauuaguauaucugguaggauaaaagucuagaacuggaguugcuaggucaaagggcaugugcaauuaaguugacaccucuugccaauuaauagcacuuauacuaauuuauaaccccuccaaaauaugugugaaaguacagguuuuuuccuuauccuucauaagcagaguacaguuaaguuuuugaacuucaauaaugauauauguuguuguuuaacuuuauuucuuuaaauuauuaauaaguuugaacaccuuuuaauguauuuaugggccagugauauuuauuuucaugugagcuuaacuguucaugugcuugguucauuuuucuuuuuaauuuguuguuuuuuuuccucauugauuuuuuuuccuuuagagauggaaucuugcuauguugcccaggcuggccuuaaacuccuauucucaagcaguacuccugccucagcuuccugaguaucugcauugauuuuuaagugcuucuuauaccuuaagauauuccuuuguugaacguguugaaaauauuuuuccuaguuugucauuuugucuuugacuuuuuuugugcuucauuuuuccuugcagaaagauuuaauuuuuauguagacaaauauaaaucuuuuguuuuuugggcuuaaaaauuuuguuucuugcuuagaaaggccuugcccucucaaauaauaucuuaagguuuaagaaagcauccugcauuuucuucuaaugcucauguguuuuuauuguaauuagaaaauaugcccugcacuuugggaggccgagguaggcggaucacuugaggccacaaguucaagaccagccugaccaacauggcaaaaccccgucuguacuaaaaauacagaaaaaaaauuagcugagugugguggcacaugccuguaaucccagcuacucaggaggcugaggcaugagaauccuuugaacccaggagccugaggugguagugaaccaagauugcacgacugcacuccagccugggugacaaagcgagacucugucuugggaaaaaaaaaauacagagaagauuggaaaauauuaaauguccaugaaacaaccauccagaaugaauaaauuuuuuaugaaaaguuaaaaugucuauuguuaaaucuuugaucuauaugguaucaauuuuauugugaggacugaguauggaauccagcuugguuuuucccaucuggcuaaucaguucuucagaugccguuuaguaauuaguccaucauuuccccaucauuugaaaugcugaauugggguuguuaacccuuaguuauagauuacagauacugucuacucaucuguuuuugucuuuaacuugguuuaugccuuuuuucacuagguaggaguuaaaacugggguccuuuuuaaugcuuuccaggugacacccauuuuaaagguggaugaacuuuguuuuacagaccaaauguccucguccuucaccagcagauagcgacugggcugauucaccaacaguuagcgacugggcugauucgccaacagauagcgacugggcugauucgccagcagauagcgacugggcugauucgccagcauagcgacugggcugauucgccagcagauagcgacugggcugaauguaggaacuaggugcucugacucccaggugugauuguaacuguguugcugacuuucagucuaaaaacaguagcuuggcacaugggagugagccuggugaaucuggacuccaugggccaggaggcauuuggauugagaggggaggagccucuuuucaggaauggcucuaguccuauuccuagggauugauuuuaccucagggccagaucuugcagggacccccuauaauuuugggagccagaguaaacagauggcuguauccuuaccuuccaauugugauuuuucuuuccucccucuucagaaaacaacauggaagccaaguuccuaggaaaugcacccugugggcacuacacauucaaguucccccaggcaaugcggacagagaguaaccucggagccaagguguucuucuucaaagcacugcuauuaacuggagacuuuucccaggcugggaauaagggccaucaugugugggucacuaaggaugagcugggugacuauuugaaaccaaaauaccuggcccaaguuaggagguuuguuucagaccucugaugggccgagcugccuguggacggugcucagacaagucugggauuagagccucaaggacauugugugauugccucacauuugcagguaauaucaagcagcaaacuaaauucugagaaauaaacgagucuauuacuguguuggucucagcugauuugcccuuugauggcccagugaagagagccaucucuuagggugucuuuccauuuuuuucccaaggugaucacugaguacuggauuauauuacagugcgucacugaguuacugggcccaggaagaaaggacagaaggaaaugaauugacuuc

SEQ ID NO: 15229 - RNA, 10822 nt, Homo sapiens
aaagcucagucccggaacugcuagaacgaaccauucgcauauggagggggugacccaccaucucagaacauuaaaaaagggaaagaauccccuggugaacuacagugaaagucuuauugagcauuuaaauggaaauaaaaauauucaguggaccuaaugaagaguagaugacuuucccuucuguccccuccccgacaggcacucaugguaccggcgccggcgcagcugugacugucgcugcagacggaaacugacuggggucaauucaagucaugcaggcugugagaaacgcggggucgcgguuccugcgguccuggacuuggccccagacagccggguaacaaaugacugcccccucgagcccaccgccaccuccaggacuaugcuccuacucgugucccuugagccacccgggccccagugaccguuaggccguggcccucaccgagcuuuucuucccagcagggucguggccagaacgccggccgggaccaucugcacaggcgcucgacagcuccaagacgcugcggccaagcagaaaguugaacagaacgcggcucccagccacaccaaguucaggugagccccacuuggaccagcccucuggagacccgcaaccccugacucuugcccgacacccuccagagucagaaccagugaauuuucagcuaugucacuugcuauccgugggaccuuaugcaaauaaaucugagccucagccuucucaucuaaaaaugcggauaaugcugagagagguugugagaaucagaugagccgugguacagaguaaauguucagugaacauucguuaaaucaaugagugaaugugagauauccauaacauguaucagcguucuuuucuucugagauggagaucuuuucagaccaauaaccuucccugccuccaaaacaaaauggggagguagagggcgcuagcgauggaacagauguuccugcacgucuuacggaugguccaggguggguuuugugcucagcccuaggaacuggcaucuugcuucccaccagugccaccaccucuguaugcuguauacacauccacuuaacuucacauccauuuaacaaacauuuaccaagaaucuacuaugagugagacaccaugcuaggugccgugaauacagauacaaaagaucauuccuccccacaaguaguucacagucuuugagggaagacaaacaugcaaacauuuuaaccauaaucugcucaauaauauaauggagguaagcauugguuggaaguaugaaaucauaagugucuaacuccuggccgggugcaguagcucaugccuuuaaucccagcacuuuaggcggccaaggugggcgaauuacuugaggucaggagaucgagaccagccuggccaacauggcgaaaccccgucuccacuaaaagcacaaaaacuagccaggcgugaugucuggcaccuguaaucccagccacucaggaggcugaaguagaagaaucgcaugaacccagggagcggagguugcagugagccaagaucacgccacuguacuccagccugggugacagauugagacucugucucaaagaaaaaaaaaaaaaaaaagaauaagugucucauuccugaggaaaucaggcaagaccauggagaaaagaacauggagcucagaagugaaugggaguucaucuggacaaguugaagugggucauuggagacaaagguaaccaucuguguaaaggcaugugguaugaaaaaacaugguguguucagguguguaugugauggcagaugaggccaacaagacaagaaggcaucagaaugccaggggucuugucugucacacuggagcuuuuacgcuguccccacugaaggcagugaggagcugcugaaagcaucuaaaccaagauucuguuguagucauuucuucaacaaugccaggcacuguucagaguguuggggauauaucccugaccaaacagacaaaaagcccugcccucauagaacuuaaauuccaguggguagaagacaguaaauagaaaacaaguaaaauguaggaguauaacgguuggaaaggggaagugggggucaagcaggccugcauagccacauucuguaggacuuuguaggccguugugaggacuucagcuuuuacugugaaugaaaugggaggccaauggaaauugcugaauaaaggguugacaugaucuugcugacaagaucuuguaagcucuuuggcugcuguguugauauuaaaccauuggagagcaagaauggaagcugggaaaaguccucuaagcaguuagaagacuauugaaauaauccagacaagaaacaaugguggcuuggaccaugguuauugccauggagguauuaugaauggucugacauauuuugaagguagaacaagcaggauuuguuaauauacagugugagaaaaaggagcgaaggaagaccccaaauuuuguuggccuaaacaacuggaaagacggaguugucauugauuaagauggggaagacugcaggaguuuggaugggaguuguuaagguugagauucuuaauaaacauucaaguggagacacaauguagaccauuagaaauggagcucaagggccgggcgcgguggcucacaccuguaaucccagcacuuugggaggccgaggcaggcggaucaccgggucaggcauuuuagaccaaccugaccaacauggugaaaccccgucucuacuaaaaauacaaaaauuagccaggugugguggcgugggucuauaaucccagcuacccaggacgcugaggcaggagaaucacuugaaccccggagacggagguugcagugagccaagaucgugccacugcaguccagccuggacgagacuccaucucaaaaaaacaaacaagcaaaaaaagaaauggaguucaagagucagacuucagacuuuagcuagagauauacaguugggagacaucauagagaugauauuuaaaaccaugagaugacaaaaucauuaauaccauaaauguagaugaagagaagagguccaaggacugaacccuggggcgcuuucacauuuagagauuugggagacuaggaagaaccaucagaagagacaaggaacuuccagagagguaauaggaaaaccaggagagaacauuuguuuuuuaauuuggcucaagguggggagaucagcugugucaaaugcugcugaugugauagguugcuagaucaauaacagaauugccuauuauauuuaguaauguggaguuaguuggauuaaagcauuuuugguggagugguagaggcuaauaucugauugaaauggguucaaggagaauagaagcagaggauaggaagaaacagcaaguauagucaguaccuuaaaguuccuuaagagggcucugcuauaagggaauagagaaauggacaauagcucccaggagguggguucaagagguuuucgaggguuguucuguuauuuuuucaguuuggaacauaacaauauguuuugccauugggagcagugcaguauagaggggaaaaaacaagugauacuggagugggaacauugcgggaacaguguccuucaggggcuaauacacaaguggagcacuguaacaggagagagcgcaaaggcugugggcacagauguucaguagugggagcugggagaaagucugauugcuucuauuccccuguggaggucauccgcucagcaaugaggaagcagggaguuggagguuagaggagacaaaagaagcuauaaaagagucaucuaggagaauggaaggauaauugaacaggguaugugcuguaugauugcgaggcaguucuaaucacuucuaaggucaaacccacaggaaagaauauaguuguaaacuuugaauaccaauguguuuuugauuugccuuuuaaaauaccucuagaaaagcagguagggcuggggcgagaguaguccuuagauuauaauauaauuucuaaaauggagucuauuguauuucaaguggcugugguggguacaaacaugaaucugauauauguguguaggccuagaggaacagcaaguuuauuuccagcuccauugcugaaggaugauuguguguguucaaauuuuaaaaagcacagcuuggugagcaaagcucuagacugagacagaucuacuagguccaaggcuuggcuucucuugcuaacccuauuucccuauugguaccuaauuuucaccaucugaaaauaaaaauccuuauuuuccuuaaggauuucuuaaggcauucuuaauuguauuaauaaguuaacuuauuagagaugauaaguuagaugauaacuuagcuagaaauagccagaagacagcuuggacuaagacaguggaagaucuugaacgcaacacaauguguucacaucugauucuauugggacauuugcaacauugauuuccauaccccauccagaaguccagggugaagcuuaaacaucuguaugcuucacagcugacugauguucagccugcauugaaaaccacuggucuaggguagagguuggcaaacuauggucgacugggcaaaucuggccaauugccuguuuuuguaaguaaaguuuuauuggaacacagccuauuaauuuacuguugucuguaccuguuguugggauauaguggaagaguuuaguaauugggacagagaccuguuggcccgcaaagcccaguauauuuacuaucuggcccuuuacagaaaaaguuugcuguccuuuauucuaggggauucuggguuuuuuuuaaugguaaugauaugaguauuauuuuugucucauuuuuugcaauguagaguccagauauugucuaugguugaugaaauaagaaacagagguuugacuguauuuuuuaaauugugggaagaggaaccuacaaaggaucugaaaauaaugaacacggguauaccugcagggacaaggaagauggggaguaugcaugaaaaucccuucucauagcggaaaguccccagaugugucugaagucagcaagucaagaaacagcaucauaagcacagcagucacacaugcggugguggcaccagaaggacugaaaaggaauggugggggcagccacuuaagaagcagcagggggcacagagcuguuauuuuuuaaccauguguuguauuucuuugauuuuuaaaaagucgagacaauuuuaaauaaaaucuuucuucuaauugcagcauuuacccucccauuccaggagaggagagcucucugaggugggcaggaaagaaauuugaggagaucccaauugcacacauuaaagcaucccacaacaaguaagugggaagggaaacacugggcaggucuagcgugagauucuuuccacuucacagggaaagucaggcuuggcccugaauaccccgggguagaagugagggugcuaagugcugcaugauggcgcuaauguagggcaccgucuuccuccucacuugaggaaccaccugccaucuuacacaaguuucauaaaaaugugaaauagggugggcauauccuaguuauaagaauucuuugcuuuccuugagaauaguguuuccugguuuugcucaagaguuggaaggaguguaugaggggcauauggucccaccaugaagguguuuauuaaguguugcugguagggaauggaugauauauaaauuaaaagauaugauucaagauauuaauaugauuuauuaauacacuaaccagaaucuagaccucuaaauagauauugucccuuuaaaguacucaccacucugggccacugugcacuggccuccaccuuguagagcuaaauguggauggugaguuuaaagugacaagacuaguguucuuguguggcuuacagacggggacagugccaagggaauucccaaacauaugcugccaacagaagcauugcugguauuagugacaacuuuacagguuggcccccacuuggaaaugagaucaguauuuggucacagccaacccacccagcaauuuagagaccagcacaagagacuacagucaugggcuaaaguguguggcacagaugaaaugcuauaggauucauuucagcauuugucagauaaauguaaagugacagcaauuggauuucuuuuucuuccccucagacuaauaaggacauaggcuaacugcauuuaagugucuauggucuacucuauacagcacuguuuaggcugucacagagacaagcaauuacgcaucuauucaauauggaaaacccuagaagcucugguagggggaaugucagagccauagccaggauaacaaguggauggcccaagcccggggcugacuccagcaggccuccccuucagucacuucuccugccuccuucugugagcucucagagcucuccagaccagaaauaggaugaugaugacuaaaggggaaaucaaagcauaucugaggauuucuuaaggcauucuuaauuguauuaauaaguaacuuauuagagaugauuaagaaaaaguuguggguggaugcaguggcucacaccuauaaucccagcacuuugggaggaucacuugaggccaggaauuuaagaccagccugggcaacauagugagacccagucucuaaagaaauacaaaaauuagccaggcgugguggcaugcaccuguagucccagcuacuugggaggcugaggugggaggauggcuugagcccaggaguuggaggcugcagugagcuaugauugugccacugcacuuccagccugggcaacagagugagacccugucucacaaaaaaauaaaaaagaaaaaaagagaaaaguuuuacuuguuuaaaauaauuuuugaucauggaauauagugucauaagcaucaaaaguauccaauaugaggccgggcgagguggcucaugccuguaaucccaacacuuugggaggccaaggcgggcagaucaccugaggucgggaguucaagaccggccugcccaacauggagaaaccccgucuuuacuaaaaauacaaaauuagccaggcaugguggugcacgccuguaaucccagcuacucugaaggcugaggcagaagaaucacuugaacccgggaggcggagguuacugugagccaagaucgugccauugcacuccagccugggcaacaagagcaaaacuccaucucaaaaaaaaaaaaguagccaauaugguaauauugcuaauauuuuuuuaagaguccuucuuuuagagcuauguacugaaauauuuacagacaaaaugauaggucugggauuugcuucaaaauaauccauuggugaggggaguggggugggaacaagguuuauagaugaaacugaauuggauaugaguugauaauuguugaagcugguugaugaguccaucagauuucuuauguuauucucuucacuuuuguguauauuuaaaacuuuccccaauacagucauuuucugggugauacuuaacuaacuacucucagauuauggagcgcucuuuaaauuaugugacuuaccaguuuucagucagguuuaggggagaauucugaccuuuccugauacuuccuguaggaguucaaaacauguucaucugagaagcucaaaguagaagcaacugaauuccuuuuucuuucucacccaggcuucuaggggcauagauuagcucucucuuauuucccugaagaagaguuguauccuaugugcuucuucuacuuuucucagcacacagauccagguagucucugcuaguaaugagccccuugccuuugcuuccuguggcacagagggauuucggaaugccaagaagggcacaggcaucgcagcacagacagcaggcauagccgcagcggcgguaaguguguguuccuucugcuuccuucuaguguguguuugcuuucugcauggcucaucacugaguggagaauccucauuauacuacccauucagaagcaaggguuugucauggcagcuuugaugcccugauuggagcauugguuugaaaagguuuagugaaaggcuccucuuuuuucuuucucucagcuucauuagaggugaagcccuuguugguucauucuaggauguaagagccaagauaccaaaggcuugagaaccaaagaccccucaauuuaaaaaccguuagccaggucugguggcaccugccuguaguuccagcuacuugggaggcugaggcuggauggcuugagcccaagaguuugaggcugcagugaacuaugaucucaccacugcacuaaagccugggcaacagagagagacccugucuccaaaauaaauuaaaaauaggccaggcgcgauggcucacaguuguaaucccagcacuuugggaggccaaggcaggcguaagagaucgagaccauccuggccaacauggugaaaccccaucucuacuaaaaauagaaaaauuagcugggcgugguggugcgcgccuguagucccagguacucgggaggcugaggcaggagaaucacuugaacccaggagguggagguugcagugacucgagaucacaccacugcacuccagccuggugacagagcgagacuccaucucaagaaaaaaaauaaaaauaaagaccagugguuugggguugggagagauaugauagucuauuuggagaggacauaguaucguggggacucaugcaauagcaauaccaguuccagugugaacugucguagaccuuuuuuagaagcaaauuggcaaggugcugcuauugguauaguuauugagcaucuacaugugccagacacuuuacauucauuaucuugaaucuucagagacccucaguauuauccacauuuucauaagccaauugagauucagagugugugacuugcccagagccaugcaccgauucaguucacugaucggaacccagauuggucugggaccaaagccugcacaauuucuacuauaguacaggccuuacaaauguucagacucugccaaaccagauguauuuccugaaggaaaaccuugaccuucaaacaagggaaggcaccccaaaauauugauugcauguacuaucaucagaaaucaaaaugcuguaaaugcccaaccauggacagaucauauacuaugaaaagaaguaugucacuguucacaguggcuucugcauggugagucaugaaugauuucuguauauuuucccauuuuuauaaugaacugccuuuauuaucaagaaaguaaauuuuaacucuaacugcuuagagauuuuaaaugauaauacuuuuaaaguggguauuuagguucagccuugaagccuaggguggcgccucauggucugaaauucugcauuugccccccugagaaaaaccugagcaauauuuagaaauuuccauuagguggcggugcuguccuaggcuaaacagaucacagucacgugaauucugcaaccugccaaauucuguggucucugcuggcgccuguccuccacuauagccaucugcccuuugccucccuguuuacuucucuggaugcccuuucccugagcucacacaccccuugcucuaggaggcaguagcaagagauuuggaugcaguaguucucucuccggggcacuaaccacucugcuucucuccagagagcuaaacaaaagggcgugauccacauccgaguuguggugaaaggccuggggccaggacgcuugguaaguuacagugauuuccauaguguacuugccuccuaguaagugugagaauuuggggcuugagagcagaguacagggagaguagaaaacaccuuuuaguggauuuccauguuugcuugaaguucccgucuguuguuucuauaauugaccaagccccucagagcaagccuagaucacuuaguauaauucaucagacacugagugccugcugcgugccacgcacugggaaugggaaggugguuccugggggaacugucacaaacaaaucccuuaggacagacuggugagcgcugugguaaagcaugugcccagaucgcugggagcccaucaggggaucccgaaccuagcagggauaaucuuuccugaugaucauuagcacagauaaucuuuagcuucuucaaagaggugacaucucucugacuuugcaggaauaaugagguaucagggagguggaggcacagcagguacggggggacauugcaggcagagaaaacugccugaguaagcuacagaaguaugauacccaaggugugccaaggucuacaagaagucuuuguucgcagaucguaaagugcaaaguggaaagugguggguacaguuugagaggggaacagugugaaaaccugguuaaaggguuuggguggagaccuuugugagaguagaauaggauugggauuauagguaucaaagccagugagcaucucaccccuccguucccuucucuacgccacccugucccucuccgaacccugccuggagacacuggaucaucauuucugggaccaugucauucuacuuuuccuucuguuccuuccagucugccaugcacggacugaucaugggcggccuggaagugaucucaaucacagacaacaccccaaucccacacaacggcugccgccccaggaaggcucggaagcugugaugggaaggaggccugcacuuggaccugaccucaagccucagcuccagugggaccuuguaaaaugcucccugucagagcucuccagaauaugcuuguuggagauccuucaggcaguaagggagaguuuugccuccuuacacaguggccuuugcuugcaccuccagcuggagaugggugugccccagaaguaagcuuugcaucucuuacaagaggggagcuacaggggcagccguggccuaggcccaaacucugcucugagaaaauaaauaucuguaccaccugucauaa

SEQ ID NO: 15230 - RNA, 10822 nt, Homo sapiens
uuaugacaggugguacagauauuuauuuucucagagcagaguuugggccuaggccacggcugccccuguagcuccccucuuguaagagaugcaaagcuuacuucuggggcacacccaucuccagcuggaggugcaagcaaaggccacuguguaaggaggcaaaacucucccuuacugccugaaggaucuccaacaagcauauucuggagagcucugacagggagcauuuuacaaggucccacuggagcugaggcuugaggucagguccaagugcaggccuccuucccaucacagcuuccgagccuuccuggggcggcagccguugugugggauugggguguugucugugauugagaucacuuccaggccgcccaugaucaguccgugcauggcagacuggaaggaacagaaggaaaaguagaaugacauggucccagaaaugaugauccagugucuccaggcaggguucggagagggacaggguggcguagagaagggaacggaggggugagaugcucacuggcuuugauaccuauaaucccaauccuauucuacucucacaaaggucuccacccaaacccuuuaaccagguuuucacacuguuccccucucaaacuguacccaccacuuuccacuuugcacuuuacgaucugcgaacaaagacuucuuguagaccuuggcacaccuuggguaucauacuucuguagcuuacucaggcaguuuucucugccugcaauguccccccguaccugcugugccuccaccucccugauaccucauuauuccugcaaagucagagagaugucaccucuuugaagaagcuaaagauuaucugugcuaaugaucaucaggaaagauuaucccugcuagguucgggauccccugaugggcucccagcgaucugggcacaugcuuuaccacagcgcucaccagucuguccuaagggauuuguuugugacaguucccccaggaaccaccuucccauucccagugcguggcacgcagcaggcacucagugucugaugaauuauacuaagugaucuaggcuugcucugaggggcuuggucaauuauagaaacaacagacgggaacuucaagcaaacauggaaauccacuaaaagguguuuucuacucucccuguacucugcucucaagccccaaauucucacacuuacuaggaggcaaguacacuauggaaaucacuguaacuuaccaagcguccuggccccaggccuuucaccacaacucggauguggaucacgcccuuuuguuuagcucucuggagagaagcagagugguuagugccccggagagagaacuacugcauccaaaucucuugcuacugccuccuagagcaaggggugugugagcucagggaaagggcauccagagaaguaaacagggaggcaaagggcagauggcuauaguggaggacaggcgccagcagagaccacagaauuuggcagguugcagaauucacgugacugugaucuguuuagccuaggacagcaccgccaccuaauggaaauuucuaaauauugcucagguuuuucucaggggggcaaaugcagaauuucagaccaugaggcgccacccuaggcuucaaggcugaaccuaaauacccacuuuaaaaguauuaucauuuaaaaucucuaagcaguuagaguuaaaauuuacuuucuugauaauaaaggcaguucauuauaaaaaugggaaaauauacagaaaucauucaugacucaccaugcagaagccacugugaacagugacauacuucuuuucauaguauaugaucuguccaugguugggcauuuacagcauuuugauuucugaugauaguacaugcaaucaauauuuuggggugccuucccuuguuugaaggucaagguuuuccuucaggaaauacaucugguuuggcagagucugaacauuuguaaggccuguacuauaguagaaauugugcaggcuuuggucccagaccaaucuggguuccgaucagugaacugaaucggugcauggcucugggcaagucacacacucugaaucucaauuggcuuaugaaaauguggauaauacugagggucucugaagauucaagauaaugaauguaaagugucuggcacauguagaugcucaauaacuauaccaauagcagcaccuugccaauuugcuucuaaaaaaggucuacgacaguucacacuggaacugguauugcuauugcaugaguccccacgauacuauguccucuccaaauagacuaucauaucucucccaaccccaaaccacuggucuuuauuuuuauuuuuuuucuugagauggagucucgcucugucaccaggcuggagugcaguggugugaucucgagucacugcaaccuccaccuccuggguucaagugauucuccugccucagccucccgaguaccugggacuacaggcgcgcaccaccacgcccagcuaauuuuucuauuuuuaguagagaugggguuucaccauguuggccaggauggucucgaucucuuacgccugccuuggccucccaaagugcugggauuacaacugugagccaucgcgccuggccuauuuuuaauuuauuuuggagacagggucucucucuguugcccaggcuuuagugcaguggugagaucauaguucacugcagccucaaacucuugggcucaagccauccagccucagccucccaaguagcuggaacuacaggcaggugccaccagaccuggcuaacgguuuuuaaauugaggggucuuugguucucaagccuuugguaucuuggcucuuacauccuagaaugaaccaacaagggcuucaccucuaaugaagcugagagaaagaaaaaagaggagccuuucacuaaaccuuuucaaaccaaugcuccaaucagggcaucaaagcugccaugacaaacccuugcuucugaauggguaguauaaugaggauucuccacucagugaugagccaugcagaaagcaaacacacacuagaaggaagcagaaggaacacacacuuaccgccgcugcggcuaugccugcugucugugcugcgaugccugugcccuucuuggcauuccgaaaucccucugugccacaggaagcaaaggcaaggggcucauuacuagcagagacuaccuggaucugugugcugagaaaaguagaagaagcacauaggauacaacucuucuucagggaaauaagagagagcuaaucuaugccccuagaagccugggugagaaagaaaaaggaauucaguugcuucuacuuugagcuucucagaugaacauguuuugaacuccuacaggaaguaucaggaaaggucagaauucuccccuaaaccugacugaaaacugguaagucacauaauuuaaagagcgcuccauaaucugagaguaguuaguuaaguaucacccagaaaaugacuguauuggggaaaguuuuaaauauacacaaaagugaagagaauaacauaagaaaucugauggacucaucaaccagcuucaacaauuaucaacucauauccaauucaguuucaucuauaaaccuuguucccaccccacuccccucaccaauggauuauuuugaagcaaaucccagaccuaucauuuugucuguaaauauuucaguacauagcucuaaaagaaggacucuuaaaaaaauauuagcaauauuaccauauuggcuacuuuuuuuuuuuugagauggaguuuugcucuuguugcccaggcuggagugcaauggcacgaucuuggcucacaguaaccuccgccucccggguucaagugauucuucugccucagccuucagaguagcugggauuacaggcgugcaccaccaugccuggcuaauuuuguauuuuuaguaaagacgggguuucuccauguugggcaggccggucuugaacucccgaccucaggugaucugcccgccuuggccucccaaaguguugggauuacaggcaugagccaccucgcccggccucauauuggauacuuuugaugcuuaugacacuauauuccaugaucaaaaauuauuuuaaacaaguaaaacuuuucucuuuuuuucuuuuuuauuuuuuugugagacagggucucacucuguugcccaggcuggaagugcaguggcacaaucauagcucacugcagccuccaacuccugggcucaagccauccucccaccucagccucccaaguagcugggacuacaggugcaugccaccacgccuggcuaauuuuuguauuucuuuagagacugggucucacuauguugcccaggcuggucuuaaauuccuggccucaagugauccucccaaagugcugggauuauaggugugagccacugcauccacccacaacuuuuucuuaaucaucucuaauaaguuacuuauuaauacaauuaagaaugccuuaagaaauccucagauaugcuuugauuuccccuuuagucaucaucauccuauuucuggucuggagagcucugagagcucacagaaggaggcaggagaagugacugaaggggaggccugcuggagucagccccgggcuugggccauccacuuguuauccuggcuauggcucugacauucccccuaccagagcuucuaggguuuuccauauugaauagaugcguaauugcuugucucugugacagccuaaacagugcuguauagaguagaccauagacacuuaaaugcaguuagccuauguccuuauuagucugaggggaagaaaaagaaauccaauugcugucacuuuacauuuaucugacaaaugcugaaaugaauccuauagcauuucaucugugccacacacuuuagcccaugacuguagucucuugugcuggucucuaaauugcuggguggguuggcugugaccaaauacugaucucauuuccaagugggggccaaccuguaaaguugucacuaauaccagcaaugcuucuguuggcagcauauguuugggaauucccuuggcacuguccccgucuguaagccacacaagaacacuagucuugucacuuuaaacucaccauccacauuuagcucuacaagguggaggccagugcacaguggcccagaguggugaguacuuuaaagggacaauaucuauuuagaggucuagauucugguuaguguauuaauaaaucauauuaauaucuugaaucauaucuuuuaauuuauauaucauccauucccuaccagcaacacuuaauaaacaccuucauggugggaccauaugccccucauacacuccuuccaacucuugagcaaaaccaggaaacacuauucucaaggaaagcaaagaauucuuauaacuaggauaugcccacccuauuucacauuuuuaugaaacuuguguaagauggcaggugguuccucaagugaggaggaagacggugcccuacauuagcgccaucaugcagcacuuagcacccucacuucuaccccgggguauucagggccaagccugacuuucccugugaaguggaaagaaucucacgcuagaccugcccaguguuucccuucccacuuacuuguugugggaugcuuuaaugugugcaauugggaucuccucaaauuucuuuccugcccaccucagagagcucuccucuccuggaaugggaggguaaaugcugcaauuagaagaaagauuuuauuuaaaauugucucgacuuuuuaaaaaucaaagaaauacaacacaugguuaaaaaauaacagcucugugcccccugcugcuucuuaaguggcugcccccaccauuccuuuucaguccuucuggugccaccaccgcaugugugacugcugugcuuaugaugcuguuucuugacuugcugacuucagacacaucuggggacuuuccgcuaugagaagggauuuucaugcauacuccccaucuuccuugucccugcagguauacccguguucauuauuuucagauccuuuguagguuccucuucccacaauuuaaaaaauacagucaaaccucuguuucuuauuucaucaaccauagacaauaucuggacucuacauugcaaaaaaugagacaaaaauaauacucauaucauuaccauuaaaaaaaacccagaauccccuagaauaaaggacagcaaacuuuuucuguaaagggccagauaguaaauauacugggcuuugcgggccaacaggucucugucccaauuacuaaacucuuccacuauaucccaacaacagguacagacaacaguaaauuaauaggcuguguuccaauaaaacuuuacuuacaaaaacaggcaauuggccagauuugcccagucgaccauaguuugccaaccucuacccuagaccagugguuuucaaugcaggcugaacaucagucagcugugaagcauacagauguuuaagcuucacccuggacuucuggaugggguauggaaaucaauguugcaaaugucccaauagaaucagaugugaacacauuguguugcguucaagaucuuccacugucuuaguccaagcugucuucuggcuauuucuagcuaaguuaucaucuaacuuaucaucucuaauaaguuaacuuauuaauacaauuaagaaugccuuaagaaauccuuaaggaaaauaaggauuuuuauuuucagauggugaaaauuagguaccaauagggaaauaggguuagcaagagaagccaagccuuggaccuaguagaucugucucagucuagagcuuugcucaccaagcugugcuuuuuaaaauuugaacacacacaaucauccuucagcaauggagcuggaaauaaacuugcuguuccucuaggccuacacacauauaucagauucauguuuguacccaccacagccacuugaaauacaauagacuccauuuuagaaauuauauuauaaucuaaggacuacucucgccccagcccuaccugcuuuucuagagguauuuuaaaaggcaaaucaaaaacacauugguauucaaaguuuacaacuauauucuuuccuguggguuugaccuuagaagugauuagaacugccucgcaaucauacagcacauacccuguucaauuauccuuccauucuccuagaugacucuuuuauagcuucuuuugucuccucuaaccuccaacucccugcuuccucauugcugagcggaugaccuccacaggggaauagaagcaaucagacuuucucccagcucccacuacugaacaucugugcccacagccuuugcgcucucuccuguuacagugcuccacuuguguauuagccccugaaggacacuguucccgcaauguucccacuccaguaucacuuguuuuuuccccucuauacugcacugcucccaauggcaaaacauauuguuauguuccaaacugaaaaaauaacagaacaacccucgaaaaccucuugaacccaccuccugggagcuauuguccauuucucuauucccuuauagcagagcccucuuaaggaacuuuaagguacugacuauacuugcuguuucuuccuauccucugcuucuauucuccuugaacccauuucaaucagauauuagccucuaccacuccaccaaaaaugcuuuaauccaacuaacuccacauuacuaaauauaauaggcaauucuguuauugaucuagcaaccuaucacaucagcagcauuugacacagcugaucuccccaccuugagccaaauuaaaaaacaaauguucucuccugguuuuccuauuaccucucuggaaguuccuugucucuucugaugguucuuccuagucucccaaaucucuaaaugugaaagcgccccaggguucaguccuuggaccucuucucuucaucuacauuuaugguauuaaugauuuugucaucucaugguuuuaaauaucaucucuaugaugucucccaacuguauaucucuagcuaaagucugaagucugacucuugaacuccauuucuuuuuuugcuuguuuguuuuuuugagauggagucucguccaggcuggacugcaguggcacgaucuuggcucacugcaaccuccgucuccgggguucaagugauucuccugccucagcguccuggguagcugggauuauagacccacgccaccacaccuggcuaauuuuuguauuuuuaguagagacgggguuucaccauguuggucagguuggucuaaaaugccugacccggugauccgccugccucggccucccaaagugcugggauuacaggugugagccaccgcgcccggcccuugagcuccauuucuaauggucuacauugugucuccacuugaauguuuauuaagaaucucaaccuuaacaacucccauccaaacuccugcagucuuccccaucuuaaucaaugacaacuccgucuuuccaguuguuuaggccaacaaaauuuggggucuuccuucgcuccuuuuucucacacuguauauuaacaaauccugcuuguucuaccuucaaaauaugucagaccauucauaauaccuccauggcaauaaccaugguccaagccaccauuguuucuugucuggauuauuucaauagucuucuaacugcuuagaggacuuuucccagcuuccauucuugcucuccaaugguuuaauaucaacacagcagccaaagagcuuacaagaucuugucagcaagaucaugucaacccuuuauucagcaauuuccauuggccucccauuucauucacaguaaaagcugaaguccucacaacggccuacaaaguccuacagaauguggcuaugcaggccugcuugacccccacuuccccuuuccaaccguuauacuccuacauuuuacuuguuuucuauuuacugucuucuacccacuggaauuuaaguucuaugagggcagggcuuuuugucuguuuggucagggauauauccccaacacucugaacagugccuggcauuguugaagaaaugacuacaacagaaucuugguuuagaugcuuucagcagcuccucacugccuucaguggggacagcguaaaagcuccagugugacagacaagaccccuggcauucugaugccuucuugucuuguuggccucaucugccaucacauacacaccugaacacaccauguuuuuucauaccacaugccuuuacacagaugguuaccuuugucuccaaugacccacuucaacuuguccagaugaacucccauucacuucugagcuccauguucuuuucuccauggucuugccugauuuccucaggaaugagacacuuauucuuuuuuuuuuuuuuuuucuuugagacagagucucaaucugucacccaggcuggaguacaguggcgugaucuuggcucacugcaaccuccgcucccuggguucaugcgauucuucuacuucagccuccugaguggcugggauuacaggugccagacaucacgccuggcuaguuuuugugcuuuuaguggagacgggguuucgccauguuggccaggcuggucucgaucuccugaccucaaguaauucgcccaccuuggccgccuaaagugcugggauuaaaggcaugagcuacugcacccggccaggaguuagacacuuaugauuucauacuuccaaccaaugcuuaccuccauuauauuauugagcagauuaugguuaaaauguuugcauguuugucuucccucaaagacugugaacuacuuguggggaggaaugaucuuuuguaucuguauucacggcaccuagcauggugucucacucauaguagauucuugguaaauguuuguuaaauggaugugaaguuaaguggauguguauacagcauacagaggugguggcacuggugggaagcaagaugccaguuccuagggcugagcacaaaacccacccuggaccauccguaagacgugcaggaacaucuguuccaucgcuagcgcccucuaccuccccauuuuguuuuggaggcagggaagguuauuggucugaaaagaucuccaucucagaagaaaagaacgcugauacauguuauggauaucucacauucacucauugauuuaacgaauguucacugaacauuuacucuguaccacggcucaucugauucucacaaccucucucagcauuauccgcauuuuuagaugagaaggcugaggcucagauuuauuugcauaaggucccacggauagcaagugacauagcugaaaauucacugguucugacucuggagggugucgggcaagagucagggguugcgggucuccagagggcugguccaaguggggcucaccugaacuugguguggcugggagccgcguucuguucaacuuucugcuuggccgcagcgucuuggagcugucgagcgccugugcagauggucccggccggcguucuggccacgacccugcugggaagaaaagcucggugagggccacggccuaacggucacuggggcccggguggcucaagggacacgaguaggagcauaguccuggagguggcggugggcucgagggggcagucauuuguuacccggcugucuggggccaaguccaggaccgcaggaaccgcgaccccgcguuucucacagccugcaugacuugaauugaccccagucaguuuccgucugcagcgacagucacagcugcgccggcgccgguaccaugagugccugucggggaggggacagaagggaaagucaucuacucuucauuagguccacugaauauuuuuauuuccauuuaaaugcucaauaagacuuucacuguaguucaccaggggauucuuucccuuuuuuaauguucugagauggugggucacccccuccauaugcgaaugguucguucuagcaguuccgggacugagcuuu

SEQ ID NO: 15231 - RNA, 14738 nt, Homo sapiens
agccgccugauuuauuccggucccagaggagaaggcgccagaaccccgcggggucugagcagcccagcgugcccauuccagcgcccgcguccccgcagcaugccgcgcccccgccugcuggccgcgcugugcggcgcgcugcucugcgcccccagccuccucgucgcccugggugaguggaucgcgccgcccucugccccucgccccuccuccccgcgccgcucggaaguuugcccggcgcccgcccuccaccuccacuguugacaaacuuagacaaagccccggggaccgggcugggcagaggggcggcuucuuccgcugcgcccuggcgggacagggggaugcggcccugcugucucugcgcuggggcuuuugggcugggacucgggacaucgggugacagcccugccgcccccagggaugcggcuuacagauaaugacaaaggaauccgcugugucgggccucucuuuucccuggugaaaaaugaggccagggaacugcguuugacuuucgaaccccuuccaccugggagauucuaggacucuaguauggauaagucuugucuggauaacuuuguccuggccaucucccugccaacuccaguuggcuggacaguucauuggauuuuugcgcucccaauuguccgugccuggucacauaagggaagggccggggagucggugcaauggacgcaggccguaaguggggcccgggaggggacccagaggcuucgaggagcuuggaagagggcugccugcugaugggagucuccugacucccucccucccgcggccuuggccggcugcuguaucuuccccgguccuccuccgccucccaggaggccuccggaggccagcugggccccuugcaggcuggacuugcggaugccccgugccauucaccguggagcgcugggagggagucagggccaggacucuuuagguggccccuccaucauuuucucauagaaaugggauugacugaagcaagguagguaacagcugagccccagcccuauguccugugaucugccugacccucggggcuagagcuuccagagugcuccaagcucccaggaacuugggagcuccuggcccuccccggccaccaugaaagacagcuggaucuucuuagccccuuucuacucuucccuguaccccccaaccugaacucuggccaaauguuacuggaaaguccccgaaagagcaggacucugaagucccaaagauguuuuuauacagggugauguggccuuuuccagaaggaggaaacaccauaccuaucuuacacacagguaacguggcuggguagaguacaccuuucccuuucccuuuuucccacuggaccguuuugcccuggagcaguguagggagagggccggugcaguugggagggaagaguccauucccaacccaagccucugucugugucaaugcucgcccccgccugccaggucagaggaaggauuaccugcuauuuaaagccaaugacuaauagcuccuugggagccacuuuaagcuccugaggccccuggagggggagcucugagggcagaucgcucauuaaugguguuguugccuucccuggagugggaugaaggggcuuugagauuucaggaggacucuccagccuuagaugggugacucugagggggaggcaaaaagguuuuuuuuuuuuucuuuuuucuuuuugagauggaaucuugcugugucgcccaggcuggagugcaguggcgcggucuuggcucacuacaagcuucgcccgcuggguucaugccauucucuuuccucagccucccaaguagcugggacuacaggcaccugccaccacgcccggcccggcuaauuuuuuguauuuuuaguagagacgggguuucaccguguuagccaggaugaucuggaucuccugaccucaugauccucccaccucggccucccaaagugcugggauuacaggugugagccaccaugcccggccaaggcaaaaagaugucucaugucuugcuccaaaugacagauuuggguguagggucuggggcagcccuucugggaugcuaaugucggcuagaggacuccuguugggcccggccgacccaccagagucaagggauugaggacaggcccuccuguuccuucuccuguguucuccaccaccggggcugauaguguacaucugucauccagguucccauccagaagcccugguggccucuccagcccuugcccccuggugguucugaaaucacccuuccuuuucacuccucugcccugacuuccucucucaccaugcucuccugcucuccaccuucacccucuucagugggauuucugcauuucagccagagggaccugucugcagcuaccagaugcuccccacccugggagagcucagcggcaugucugcacaugggccuuuucagccuucuucaucccgcaauuggaacugacuuucccacucccaucucacacuugagaaucucuguuucuuguuucuuguuuuuuauuuuauuuuuauuuuuucuccccccugguggacaauggugaggagggugaaggaagguuaaaagccacugcucuacgggaugaaaaacuaaacuugucauucuucagaucccucccagucuggccccagccuacccuuccagcugcaucuaacugugcuccaacauaccacacccucugugcaucugcuuuucuuggaacauucuuuacucauugcccagucuggcaccccccuuacuuugucuucuagacccagcucaaauauucccuccucuggggaacuucuaauuccccagcagaaaucaugccuccagugacgguccaugcaggcuucuggagcguugggcaaucuuccucaucuguggacuugcuggccucuuuccccuuggcuucuugaggccugcgcugcaucugauuucucugucucgggggccuagcauggucauuggcccucccaguguuuccuggaugaucaucgugcuguuccugagucagggcugccauuggaggugacaucugugacugcaaccugugccugaauuggugggcggaaccugcucaaugggccagaacaaugcuuccuuccacugccccugccugaaaguccucaugggccuccuuugcaaucaaacugcugccaagagaccugcccuggaccuugccugccucuccagaccccagcugccagcucuuccaccagugggcagugguccccagcaccacugccauugucagccagcacuuuucuggacacucccaggccacuuggaaagcugggcgcuucccuuaugugggccgauucgccuacacauggacuuccuuggcucuaggcggacucaggcuccauccagcacacgggggaagagggagaggaagagauaaugggcgaguuugaguggaggguccuuuugggcuggacccaucugcuacuucucaccuguguccccagcuccuuccugaucaucugcucaucuuaccugucucuguccccagauaucuguuccaaaaaccccugccacaacggugguuuaugcgaggagauuucccaagaagugcgaggagaugucuuccccucguacaccugcacgugccuuaagggcuacgcgggcaaccacugugagacgagugaguaugugggggugcuuguugccuguuucuagcaguagacccugagccacagcccugguggcauaggccauaugcuggccuuauucucugccugugauccccaccccaguggaggugucaaggccuccucuggggagacucagagagagagacagagccucaguuagaccgaggggggaaaaggguccuguuguuucuuccuucuuucugccuggcccucuuuccugagacugccggccaggccugaugcugaugcagaggagugagggguuguggucacccuggaggucacgggagugcuguuucuugagucaccaugagccagacacacagcauuaggguuaaguugcaaggauuuuucuaccuaagaggggaaaacaaacacauucuuggucuuuugaggcccaggaacucaguaaaucagccuugguuucagagucugacaguuccuggcccaaguuugaccugcagccucaucgcagagcucggggagaagggagaggccugggccagcugaaccauccccacgcggucagguggucagaggccuugcaugcccagaggggcuguccgcgugugaccugccugguuauccacucggccacagaauggcccuaggugggguggcaacagcaguuccccugcuguccucccuccaggcccagcuggagucccucccacuuagugcucccaccccacuaggacuccucauggggcaggcggguugcccacaugugggcccagggauggguggagcgggggguccuagguuucugaauccagcaggucaaucgcugagcaucuuggguaggggacaggggacaucuugcccuccucagggagauguggggauggguucugagguuugcuggccuccagaaggagggggcggggggcuugagccagcuggguggcagcaggggcccugggagagagcaggucaagugaguaggaugccuuuuaccucccaaguggcccuggggccugugccuuggacccugcccugaggccagauguguuugagauccugguggaaggguguguguaugguuuggcggacggguugcuaaggcaaucagagcccuggguagggccagguggagccacuaacaaguauccugggagcugagguaacagugagugugccugagugggaauuacccaccuugacuucuagcuucugggccugggaucuuccccaggcuggauauggcugcacccaggaagaaggcaggggugaccacacagcggaggaagcccucagagggaccuucgcagcucuuccuugccuuuuacgugguauguuuccuuggagccaacaaggacccugcgggcccaaagaaugcacacuggacuccuucagggugugagcguggugggguauggggauagucuuggaggcagacuggggucaaaucucagcucagccacuggccgagcucuggucuugaggcucuggccucacuuugcgcguuccccucccugccagagugcgcuaacacugagcucguccgcgccugugauguuggaggaagacuagaucugucuguggguucucugcuuggcagcuggaaggcccaggcacacgcuggggggauccccaggugaugagagaagcuuggccuguaggugggccugguagcuguccuggguuccugggaccacacugcuggagugauggugagggggguggggccuuggccacgggcauguucacagauggcugggugagggcccacagguggaaggcguaaagagggaaagcagaauggcauuugugccccacccagagaacuccugccagugggauucuagaaaacuccaggcagauuagcuucuuucuuuguguacagugcugguacuguucacugcuauccgagguagcccuucucccaaagccacccuccugaggaagccaggggcugggcugaggauggcgucccuuccugguggggggaggggacacugaggaagagggggucacaccgguauucugugccaccagucuaaccccugcaccagacugauugcugccagaugcccuauaugaacgaggccaccucccacagccuggcgggggggacucuacuuuccaugagugccaaucauggcuguccccacagugcuacccuggcugggauccucuggcagcccugggucccagccucccgugacucugcccaccccccucauccucaccaccccuggccacauaccuuuucuuggcaccucguccugggcacugccuucauugucccuuuguggucuuuguucugagagaggcucugagguucucccuggcccuggggcuuaggcagaggucauacagucuuauuuucuuguccgcugggucccagcugggcccgggaaccugcugggguagccaccugacugccaccucccuucccucagaaugugucgagccacugggccuggagaaugggaacauugccaacucacagaucgccgccucgucugugcgugugaccuucuuggguuugcagcauugggucccggagcuggcccgccugaaccgcgcaggcauggucaaugccuggacacccagcagcaaugacgauaaccccuggauccagguaugccuggggauggcccuggggcggggcaauggagagaaggcucgaugaauguuucugcauuuggggguuaccccaggaggguucaucacugggguucagguggcaagguaacagguucccauggaugaaguaucuguaaguggauggcaucccuggaggaaccugguauggggucaaggugaggggggaggaggccccaggcuguggaggagcuguuggugcuggaugaggccucuggaggccugggcagaagaagaaagcccuuugugcgggcagugugcucagcuaccccuccucuguuuugcuugaguuguucccccacccagugggggagugaagggaugggucugcuuggaucuugaguggaaagaacccaggagauaagggugccaucuccccugcccuguguccaggugaaccugcugcggaggauguggguaacagguguggugacgcagggugccagccgcuuggccagucaugaguaccugaaggccuucaagguggccuacagccuuaauggacacgaauucgauuucauccaugauguuaauaaaaaacacaagguaggucuuguuggggcccgaaagaagggcugugguccauacccccuaagguucuagcauugacugaggacccccagcgaguccagagaacccuaggugauuggcuaugaugugggucuucgggugcaucuuggcuucuagaaauugggaaacccagacuguguccauguucugugguuuauaagcaauagucccacuuuagagaugagacuagugagauucaaaauggcacagugaccuguugagggugauaguggugguggagcuggguuucauucugagccuucauggguacauguacaguuguguagguuguacacugcucaaggaugucauugcuaagcaggcaccauucacaguacaggcauuguacauuuguggaacucugucagaaaauugucauaauaaacuauuugagaaaggagugccuuuuccuaauuugcaaagagguacccuguagguuacagguggcccugugucagcuauagggguuuaugcccaggcuccaugaugauuaaggaaagugagaggagaaucuuuguggagggccgugggguggccaaaggagaggcugcugugugagccucugcuggcucuuccaaguccucuucacccucccagccccaccucugccucccaggucugaagaggaagaugagguaaccccagggagggggacugcucagauggacccccuucuccagucuugucccuucccugcuaggaguuuguggguaacuggaacaaaaacgcggugcaugucaaccuguuugagaccccuguggaggcucaguacgugagauuguaccccacgagcugccacacggccugcacucugcgcuuugagcuacugggcugugagcugaacggugagugcugggggugcggguaggggggcacuguuggccaauccuaggagguggcccucccugcugccucuuuucucagccaaacugagcuagguagggcagcaacaaggcacggggaccaggcuucacucgggcaacgcacucuagggggucaccuggccauagcagccccacccagguguuugcugucugccaacccaugacccagggcauucugauugauagagaaaaagacaucaguuuucaaaguauuuucccuucuucugguuggcuccucuccuguagcuucuagaacauguagcguuagguguguuuggcagaugucagcuuuacgagggcagagaaucugucuguuuuguuugcuucgguauucccagggccuagaauggugucugguuuauagguacucaauaaauauuugaugaaugagcgaaugaaugaaugaggggcguggggccccgaugaaugauuuauuaaggguacacaucugguagguauuaagacuuggucuagaucucugggcucccgaccacacccauccagagcuuucccugccaaacucuuaagagucugcacuccagagaaacacaggggcuucuuggaccacagggcuuggagcuggugcuuccugcugccuuuuccaaagagauucccagaugaagagcuggggagaccauaaagggacagauuucugcagagccaggggacagccugggcgaggucagagugccggguuugggcugacagacauuaauugucucagcccagcucaacccagcuuuccugaggucuggguauuucucucucuuugcagccacaaugccaccugcuggccaucaguggaacuguagggcucgcuaagcagagcugcagaguggagguucuuaucuuacccgcuggccuuuugaucuuaccugcccuccugugccccgccuuuccccucugugacaccucuuccuguugucucauuucagacaccacccaaauaccccucagagcugaguucagugccuggcuggguucaguguuuuuaguaugaacuugaguagguaugcuuccuccaccaggggcccuuuugagccguauuguuucaguggggaguauaagacuuugccuucugcuagaaggaaauguaggcuacugggaaaggacagagccaggucugugugccucucccuggagucccugacacuugcuguuuuggcuugaagccuuuggccauuaaaguugccuguauccaggcaugacuggccccugcucagggccaagagagggugagucuugcaaaccaaggaagcccagguacccugucugcuuccuucagggucuggaccacuccuuucccuauaggccuuccagucggcuggagaguguuggugcaugugugcaugugugcacgugugcauguguguggguggggcugaggucuggggguaccugggauuccacaagggauuccucuuugcagacauauggugucuuugguaaauuaauuauuuaauucgauggauguuuauuaagauauugauuaagccccuccugggugcuuggcucuagggaaugauuccuugaccucauguaauuugcauuguagcaaggaaggcagacuugaggcgaggagcagaugacagagagcaguaacagcucugaagaaaagcuagaggcugaugagaugaccaugacuuggggugaggggagagagcaagacaaggacugcucugucgggaaggccuuugacugggggccugaaugauggagagccagccacaugaaaaacuuaaaaacagcacugcaaaaagagcacugcaggcaaggaauugguaaaugcaaaggcccuggggcauguugaaggguggaaggaaggccaguggagcuggagccaagagauggaggggcagcuuggugggugaagagccccagggacccgcagugucaucaccuaggagcuucuuagaaaugcagacugaggccgggugcgguggcucacgccuguaaucccagcacuuugggaggccgaggcgagcggaucaccugaggucaggagaucaagaccagcuuggccaacauggcgaagccccgucucuacuaaaaaaauacaaaaauuagccaggcgugguggcaggugccuguaaucccagcuacuagggaggcugaggcaggauaauugccugaacccggucagaagguggagguugcagugagccgagaucaugccacugcacuccagccugggugacagagcgagacugugucucaaacaaacaaacaaaaaaacaaaaaaaaagaaauacagacugaaagccccagccuagacuugcugaaacauaagcuuuuuuuuuuuauaucaagauccccaggugaucugugagaauuacuccccuaguaucucauuuuauagauggggagacugagagccagagagaggaagggacuuccuagagugcuggagcugacaguccugucccugcccuggugccccuuccaacugcauuuuaccagaaaggcugucugacuuccuggggaggcugagagugaggaggguaugaaccacuagaagcagaugaucuguagaggggucugcguugagcacauugugcagaauugguguccucugcaaagcugcccagguuuuagccugccucaggccucuccucuucuggggccaagggacaaccagcucucagcccgggagccucucuuugagggggaagguggugguucccuggugcaucaccaucaggagaugaugguaccaucagcaggcauugucaacacacccuggaggcaaaugucuugaguggugagaguacaggugggcagugauauaacuuagcuggcucccaguacucuugaguggugagaguauuggagggcagugauauaacuuagcuggcucccagagggcagggggcucuccagucccaccguccacuccugccucccucaauuccccagagggauagacacuuguggagugaggauucuuccaggugggagacacccccaucauucucuugggaguuguaucucuugcccauccccaacuguucuauccauaugcaggugcagauacaagugcaaggcagcccggcacauuccugaguguuuggggcagggcugagugaaacaaaggccagcuucccgggccagcccucacaggccugugugacagcauccccagaacauuugagugugcgaaggcccucugggagacacuaagucagggggcuucuggggaauggaaauagagauguuccugugccccaggaguugucugauuucucuaacugccagcugcuggagggcagggauguuguccuguucaucacugggucgucacuaggcaggccuucaucaucuagcugggauguguagcugguagaggugacgucauagugugacauuaggaguuuguaugugacuugagcaugaugcuuaaugucuuucaguuuucucaucuauagaaugggcuuacuaauuucuacuucauuuaguguuuuuuuuucuuuuuuuuuuugguggcagguuaaaugacugaaguaagcacugaauaaacaaugugguuguuauuaaaguagauagugacugugccaugggacggaugggaggccgaggcgaugggggcagugcugugaguccagaagaggaagaaauccugcccaagugaaguagucagggcagacuucuuggaggaggugucuccaaagucaggcauugaaggagggcaggaggugguggagcaggggccuucccuggugcagaggagaaggguggugagugggaggucuugggugaucugugaggagcugagcccggcugguugaggugaggaggugguggggucggcagugagaaggucgcacaguuggcccugcaaggcggauggagcugcuuucuguugcccaagagcaugacaggggcuggucaggauccacagaguucuuucugcuucaucgccuugugcuccugccccugggagcuguggaucccagauccagaugacagcccaccuugcuggcaggaugcgccaauccccugggccugaagaauaacagcaucccugacaagcagaucacggccuccagcagcuacaagaccuggggcuugcaucucuucagcuggaaccccuccuaugcacggcuggacaagcagggcaacuucaacgccuggguugcggggagcuacgguaacgaucaguggcugcaggugggucagccuucuugggauauggggcugggguugggugggaugaggugggacugccagaucuuugaccucucuccagcccaggcuucucuucugcuccccaaaagaguucuggaaaagccuuguuuuucuucggcuuuucuuucuucuucccaccuguacucccuucucuugauccugcuuccaccaagguggagaaaggguguguguguguaugugugugugugugugaaugugugugugugagugugugaaugugugugaaugugagugugugugaaugcgugcgugugaaugcgugcgugugaaugugugugugaauguguaugugugaaugugugugugugaaugugugaaugugugugugaaugugugagaaugugugugaaugugugugugagaaugugugugugaaugugugugugugaauguguaugugugaauguguauuugugaaugugugugaauguguaugugaauguguaugugaauguguaugugugaaugugugugaauaugugugugugagaaugugugugugugugugaaugugugugugugaaugugugugugugaauguguguguauguguguacacaaggggagagccauuccaugggcugccacaggauugacaaggcucagccuauggacagacagcagggcggaggcggaagagggagacaugacccaggcaucuugggaccucucccuugagcacagcauacauauucucugacucagugucuaagaagccaccaugugacagcccuugucugucauugaaacuaggaaacaaaagagagccauggaaaaccggagcuuguuuuauagaugaggaagccgagagcuggcaggacgaugaucugccuaguacccaccugcuggcuggcagugaguuggguuuacaccuggauguuggggaacuguguguccaggugcagcuggcagguucuccagggaggucagggaccggggacaggaggucugucucagggccccauggagcacacugcggagcuggguucccugaggagcugccugccuguggacacccucaggaccagugucagacugugggcggcgccgcagggagccucuagagcaguucaugccccuccaggcuguggccucuccuguccuucuucccaucacagugcagugcaggucucaggcaggggugguuggcguggaguuggccagggcccagacccuaugagcuuuauagcagugagguaccgaacaccauguguggcaaaguaggugguauuauuuaugcccccucaccgcuuuuuuuuuuuuuuuuucugagacagagccuugcucugucacccaggcuggagugcaguggcgccaucucggcucaccgcaaccuccgccucccagguucaagcgguucuucugacucagccucccuaguagcugggauuacaggcagccaccaucaugcccagcuaauuuuuuguauuuuuaguagagacgggguuucaccauguuggucaggcuggucucgaacuccugaccucaggugauccaccugccucaagucucucccaaaguguugggauuauaggcaugagacaccauguccggccuuaugcccauuuuauagccaaagaaacugaggcucacccaaguaguuuuuuucaaaacuagaauucaugccucagugugucugccucuuuucaccuuacuggagaugguccaagcagagaaaaugugguugguuucuucuguagguggaccugggcuccucgaaggaggugacaggcaucaucacccagggggcccguaacuuuggcucuguccaguuuguggcauccuacaagguugccuacaguaaugacagugcgaacuggacugaguaccaggaccccaggacuggcagcaguaaggugggugucuguccagcugcccacccuuugccauuccuucauuacuucccugggagucuggccuggggcucugaggggaggggggcuggcucgggguccuccugacacccgcucugccucuagaucuucccuggcaacugggacaaccacucccacaagaagaacuuguuugagacgcccauccuggcucgcuaugugcgcauccugccuguagccuggcacaaccgcaucgcccugcgccuggagcugcugggcuguuaguggccaccugccacccccaggucuuccugcuuuccaugggcccgcugccucuuggcuucucagccccuuuaaaucaccauagggcuggggacuggggaaggggaggguguucagaggcagcaccaccacacagucaccccucccucccucuuucccacccuccaccucucacgggcccugccccagccccuaagccccguccccuaacccccaguccucacuguccuguuuucuuaggcacugagggaucugaguaggucugggauggacaggaaagggcaaaguagggcgugugguuucccugccccuguccggaccgccgaucccaggugcgugugucucugucucuccuagccccucucucacacaucacauucccaugguggccucaagaaaggcccggaagcgccaggcuggagauaacagccucuugcccgucggcccugcgucggcccugggguaccauguggccacaacugcuguggcccccuguccccaagacacuuccccuugucucccugguugccucucuugccccuuguccugaagcccagcgacacagaaggggguggggcgggucuauggggagaaagggagcgaggucagaggagggcauggguuggcagggugggcguuuggggcccucuaugcuggcuuuucaccccagaggacacaggcagcuuccaaaauauauuuaucuucuucacgggaacu

SEQ ID NO: 15232 - RNA, 1338 nt, Homo sapiens
gggagagcuccucagcaauugguuacauuugacggcuuuaguccagggacccagacgcuacuggauaaggccagcccggagugggcggggaaaggggaggagggcuagaaggugggucguguuugaugucgaugggggcggggugaagagacggguaauugugaccgcaaacugcuuuagagggcuggguaaggucagcugucgacugggcucagaggaaugaggucggcugguagcucagcugcugguagcucagcuggggcucuuauggguccaggccgacugacugacucacguguacucaaauuucgcaggggugaaauuugaggucauaucccgggagagaggaagaagggucgugagucaccgaacccgaaggagaggaaaagauguggaggcagcggucuauggccucuuccagcuccggacgggggauggggacgcucugggcaauacgggccucaguuauugucccacuguccuuucaacccuuaaccaacccaguuggaggccgccuggaagaauguagccuuggaacuagggccuggaauuggggcuccuaccgguugugugggcuugggcaagucacuuaaccuucccgcaugcucccuucacuuggcaacugaggguaacaauaguaguugaugagaagauuaaauaaacucugauaaaugccaacaguggcuggcacucaacaggcauucaaucaaggcugauucuucccccaucacccacucaccucauccggcugggaaacuaggcccauuucuaaaauucuaugagccugaaacugcuuuugcaauggcaugucguguaccaagaauagaacacuugagcgacuugaaaugcaaccccuguagggcagacaaggccacccuaccaaggccccauagggcucggagagagggagcaggggaugaaaugagaggagcgauuuagucagagaagggaaguggcauuuguuaccauguaaauuuuucccaacauauuucagguugugacaaggaacagugggcuggcucaaguuuuauggagcguaaccaaauaacauccuuugaaggcugaucagcaccggaccagaaaucauugcaugagcucuaucugucagagaccccugaaacccauuccccauucugaagguguagacaucacagaguguggacagaaauagcuucucaggccugaauguagccccagacccuuugugucugucuuugaaagaacucacagccaugguacaucagagugaaggagaagaaagaauccuuugccauugcucuauuuuucauucaguugucauguuaccuugaaaaaaaaagguuucaucucaguguuuau

SEQ ID NO: 15233 - RNA, 20430 nt, Homo sapiens
cugaaauuuaagucuuauguucuuugcccuuaggccagaguucuucgggaaaccaagccaaucccuaaccucaucuuugccauagaacaguaugaaaaauuucucauccaccuuucuaagaaguccaagguaaacauucucuuauuaugugcuaccauucccauuuaccuucuugacagaucuggcaaacugaagcagcacaacuacaauggaggaaaagagacucugggccauuuguguguuugccauccccccucucccccccccccccuuuuuuuuuuugagacugugucucauucugucacccaggcuggagugcacauucaagugauccucuggccucagccuccagaguagcugggacuacagucauaugccaucauaccccacuaguuuuuuggguuuguuuuuguagagauggggucucacuaugcugcccaggcuggucucaaacuccuggccugaagugauccuuccaccuuggccucccaaagugcugggauuacaggcaugagccaccacacucagccucuuugcuguucuugaucugaugaccugaaccccagcauacagaaggaagugggugcgugcuugcuuuagguagaaauggaaagguuucucagaggugaacuaaaaauggcuuaagcuguucuggcaggaccuaugaguagggagaugucccaugcuuacaaucuugucauaggugaaccugaugcagcacaugaagcucagcaccucacgagacuucaagaucaaaggaaacauccuagacaugguucuucgagaggauggugaagaugaaaaugaagaggucagugcuggcuucugucuggagcccagccacucuuccuagcugguuagcagccuaucugggagcagucacagauuaguggaagggcaacagaaugggaaagggcuaaaaggugaucaggcaaagaugagagcaaaggacucucagaaggguuguaaacuuuggaccacacaaaauccuaugaaguugccccgacuuguuugauaaacacuuccaggaagcaggugguaacaaaacaauguccugcuguggguccucuuccuguuaaucuuuuaaacuacuggaugaugaccagcuauagcagucuggcucagaaacuaguuuaccucucaugucaugcccucauucaaaggccacucauuaguuuggguuaaggcuucuuccuucaauucaugccaaugucuuguccuuuucccuugugguuuguuccucucccuuuacucuuagcaagugacaguaccgcauccccaucccugcaccaccuuugaaacagaacccaauguuuccuuacuucuagcaccuaaaauuuucaucuuagguuugucuaauaaguagcaaaucaguagcccacucccauuucaaaacuggaaguuuacauacaagugcccuggauuucagaauuuugaacaugcauucuucagaugaucacacuccaggcucuaauguaccuggccccauccacucucuuuacccacuuggcagcugcacucaggagagucauguagcauuuugaugucaauggcuucuucucuugucauuuugucccauaaguauccucaguauagcaaaaguccuaaaaggaggugccacugucuuauuacucuacacuuuggaggacuccuuccucuucuucaacaacauaauuaccuccugugagugggaaaguggggaaagcaugacuaacaaaggcuuugaugagaagauagagucuuuuuuuuccuucuuuuuauuuccacugccuuggagcagguuuaucacguuagagcauuaauucuuuccccuucuagggcacugcaucagagcaugggggacagaacaaagaaccagccaagaagaaaaggaaaaaauaaaugaaaugccugaguuaaugugaacuuuggggcuucugcuucauuuuuacccaacaagcaacaaugccccuuguccuguaguccacaccgauguuggcaucuugguucugaacccacugaauucaacugcaccuucaguuagaaggaaucuucuuggcagguccugcuacugaaaaauggcuggccuuaggcaagcccuuuugcaaaaagcacagcugaaagccugaguuugggagccugcaccaccccgaugaagcuccacgggagcaaauacagagccuccaggcagugcuaugguccaggcuggcuucguuuuuccaaggagccuuuggugaguucaauuaucugguaaauauccagcgcuucaccugaaagauagugcaaauugguuaggaugccaccucaagaacuguaacugagagcucagaagugagcaaaggagcuuaaugcuaaggucaaaaggagagugaaagguugagaacaauugccacgaacgguaauguuacauguuaggagggucuguuuucuuuuuauauaagugugucuuagauauauuuuaaauagaaaauaagcuuucugauuuacuuguuugguauuuaaagcacaguuuguuuuucugucaccuauagagugcaagaaugcacucuauagaauaaauuaucuuuaaacauuucuucugugguugaaguaggggacagguacagguagaauauuugaagcucugcugccuucauuucugaaacaucauaucacauucacucuggacacagggcaccuuauaaacugaaauuagccuagaauauagccugagucaagaguggauucucuggggccccaaguuuccuguucuccaagacccacuuucuaguccaccucagauccuauguguaaugaggaacaaauguguugugcucacccuggggaaucccguaucuccuuuccaucccaguuggguuggaagggguuuuacaauccauggucacuuccuuccugaggcaccggucaauaucgacugcacugaaaaaggcgacugacuggggcaagucauucagacccagcuuguaggcaaacaugcaccugaaagagacccaaucuacucucacagucaugccccuccugugaacagaugcaucacuccuggagcaaugaccccacaccccuuagagcagggcuuccccuggaccaacaccccaucuguucacuuagcuaagucaagaaaggugaagguccagcacuguuuuccauccagcagccuaaccucccacugagauacugaaaugcaauuauggacucaacauacuuuuuuuuuuuuucccaguuugguacacuuuauuaauuaauauacgaaaucacuuccaauugggccagaguuugaagcauaaaugaggacuuuuagcuuuguuaagcauaaccucccggagaugaugauuaagagggcaaugggaacaauguugaauauuguaaacaucuguuauuuacccaauaaucaggauagaucaugguucccaaacugguucugaguggcagaucaacauggaacgguaauauuuaauucauccauaugaacuaggaauuuuacuacaagaaaauacaacucaauauauaaaauauauaagauauuuuuaaaaaucacauuugaguguccccauuaacaguguuuucuguuagcagucaaauaacaaacuuuuggcacuuacuuaagaaagaaaacauuuaugggagaaagaaaaacaaacaucucaauuuucuaugaaaugagaaaaggcuucugucauuugauuuuccaaauagaaaagcgugaguaccacccuucggaacaauuccccuaaccucacugcuucccucaaugaucagucuugguauuucacauuuucaaacccaauaacucuuuuuuuacgaauugaggcuagucuuuuuaggacuucuacaacuuuuuaaaaauuagaaauaaauaaauaagcugaaacauucacuucuagggggaugaaaagucaaaacugaccagucuggcccaaggaacgcucacccaaagccccacauaggagcacauggccaggcuagaggccaugggccccgcauaccuggucaagagguuggugaucugcaaggccagggcagcgcgguagcgguccuccucccgcaccagguagcgaaccucgucauggaugcugaugcagaagcgcccaucuauggcaaacucuucaaacagccacuucauggccacaagcaugagguguaaguagucaacagcagagcucuguaccacccaauucacacggcuggucauaaacugggaagggaaggugggcagaggugaaaggggcuaugcuacauaccaauuaacuccaggguagaagccccaagagaagcuucacucuggcccuaccuacaaacauugguaagguccacagggagcucugcccugcccucccuggggccccucugcccaugcuccaaagguagcaagauaccucuuccuggacagccgagggcuccagggcucggcugaugcagcagcccagcaccgggguacgugguaugucagacguagcaaugcucucaagcuuauugaacauuucugacucugugccccccuuccaugcccguucagcaaccaccucccacuucuuccacugugaccuaagggaccagaaacagagggcagacuuugucuuucagcaucucaaagcuaaaaaacaaagcauccaagcucuucuggggcaagcccagaccccucccuccauccuuaacacaaagaagguucuuacuuccuugcaguuucucucuggaccuugcgcagauccugcagggaaauccagccacccucaguccuguccacugggagguucaacucccucaccagccacucgcccucauccgacagccgauaccugggggcaguguuaucaccaucauuccacgggagugcuuccugugccacgcuagugccuuggcaaggaauguucacauaucacuucaacuuuuaaaaacacugacaucaugccaguccccuaaaggcuuuuauucagaggaagaaacggcucagagaggcuaagugccuugccuaggaucauggagcuagaaagagaugcagcccaggcuuuuguagccccaaagccugggccaccccaugguagcccaauaaaggacaaagacuccagcacaggaggcaccacuauuccuacuguccuguuucuuuagacacugaauugcccaaugaccaacacgggccuuuuauucaggaggcagcaagggccaucacucuagauuuggggggauagggguaagaauaggcuacucccugaaggggagggggcauuuguugaagcagaaaacacaacagccaggccuggcuuaccccucucaacugccacaacccuagacaacucccagcuuccaucuaaccugcagaccucacaaggcuugucgccugaaggcuccagagacacgucacucgcauaaauggcuuccccaccaccugcacccacaguccaaacuccugugacacuuucaaagguguccacaacuaaagccccaccaccuuucucgccuccaccagcacacgcugcucacgguaugagccuuacccgaccucacuuuauccacuggacgauacucagcuccccuucccugcauuuauagucaucaaccacuauaucauuuaucacauacuuaacuuuuaguuguugacgagaaagugaaguuuccacaaugagccagcuaauuaaauguggacaguguacuguaccucaggaaguuguaccucucuucccucaauguuuuuggaacccugcagagagucugcuaaggcccugagcacacaguaugcaguacgaucagaggaaacaaauuggagagcuaggcuaaguaaccuggaggccugguaaugcuuucuccaguaucaacaucagccuacaugcuccaguuugccacagcgcccuccugucaacuccugucuuccacccacuccauuugcucucauucccuguaggcaucugaguuugcaaccccuguauuauugauuaugcagcauaaucagaauugucaagaugcuaccacuugguaacaguauaccaaaaguauagcuuuacucccaugaggaaaaacuguuuaaggcugacuauaaagcaaccaaaugucacaauaggacaaaucauccuggaaccagguuacacagguguggaaggagaggggcuaggugagaguucaaguaaugggcaggagauagaacagaugguaguacuaaaggacaguaaagcaggccucggguccuggguguuaaaguggaugggagagggacccucaccagcggaggcccuugguggcagcguacaucugcugggccuucucagcugccuccugcugugugagccggugguuaaacugcauuaguaagcgcucagcaaagggcugcccagcaccauagaugcggccguaguugaagauuuuggcaugcucacggcugaugcccacaguaguggcugucuuacuguguagaucagugccccugcucuuccugcccugcagugucauccacccaaaggcugugcagccuggaagacaagcaggagugagaaaagcagcucaggaacauucugcccaauguucaucagaacugucaauaugcugaggggcugggcugccccaaccccggcuccugcucaccaugcaugccggcaaagugggcgucuccaagcacagcugcaauccacagcucuugggaguccacaucagcacccacaaggguguagccagguggggccugcaccauggcuuucaacucacugccuacucggucaggcugugggaagagugagauacccaaaugagacucuuccuaccccauuccuggagccagaguugacugagaaagagcuagagccuuuccugaggggauggcuuuagagaaugccagacagcacugcugaaauuccacaguuccagagauggccaccuaucagcaauuggugugacagguaaagaaucuacucuaugccuagcgcuaugccagaccccucaccuacacgguccuaucuaaauuccaugagagcuguagcuauuacgccugucacggucuggccaggagcaggugcccagaacauauuuacugaaggaguggacagaaaucaugaagccagauuugacuagaguccugccugacccagaucacaggguccuuuucaugauccucacuaaauaccuaaaggcccucagagcccaguuucuacagaccugggagaggaagagcaggggccagagguacagaggucacauacccgggcauugcuggcggugagccaugugggcuccacagcccggcgagugauggugccggcagucaccacuuggggcaggauggccccauagaggccuuccucaucauagucggggugccugguggggugcaggggaaggaaaugggucuuagcagggugcuuuggccuuaggaccuaccaccucaccucaguucuccuaucccuacaaccacucagcagaccauaccugaucacagcacggggcagagcugaccugggcagccacaccaccaucugggagcuguggggacagacaacgugaggcucagcacagccaugggaagcagaaucuaucccacaucccaccauggcccucaccugcccaccuccaggacugcuauacuccauuacccagccucacuaacuggacucaaggugagcccuggcucagccaagaacuggggcccuaugauacaccaaucaagagcauaaaccaucugggaaccggccaggccuccgagcgagcuuccgcuccucuccggggggcauccaugaggcgcuccuuccaccaaugccucuuccuacacacaggcagacuucaccaucccaacacccacucugcucgccagugugcugauggccacaaccaccuuggaaauggccuucaagaugaauacauuugccauuccagacuagaagacccagcucccagcccccaacagggcuuacaggccaccagcucuccaugguccucagccauagcccacggcuccagcaguuacaccaagaaguucuguuggagcuacgaagggcucucaugguccuacagcaccauucuuuuuacauuaacagggaaacugaagcuagaggggagaccugcccaagguccauggcaccaggaccaaaaguagccaggccucuagaccauagucaggcuggcccucugugggaauccaggguuagucaggggucccugggugggaagagaggggaaaggcaucccaggacuccucccaugguggcccaccugauacguuuaugggcguuccuccagaaagaaaucauuuuguugauuuccagagcacggggcccacuggcaccuccugggccagccugcagggugccauccuccaucuugggcaggaaguccuuggcaaaggggcuucccacauuacagcuauuaccauccuggacagagcaaaggaagcaggggcuggaggcagguggcagaccccuggguggggaaccaacgugaguaccugcacuccucccaacacugagcccagaaccucagcagucugaggcaaaucccugauuguaucacgcacgcgcgcacgcgcgcacgcacacacacacgugcacacacaugcccccuaagacacacagacacaagcaaaccuggcucccugcauaauaacaaaucggaaaaaccuaucacguaccagaugucguaccaaacauacgacgugccccaugucauuuaauuccaccaccaugccccuugccacccgacuuucauuagaaaaacaaaagcugagagaugacaguaugugccugaaaucacacucugucccacuacuagucauucccacaaaaaggaaagucucaggugugucacucugaaggccugcugugggccuugagcagaaugaggaaacaccacaggacaggccaugacccaggacacaccuugugaggcagcuugaaaaaccagcagccagggauguccacgucguuguaagguccauugccauggugauagcugggcuggguguccuuggggccaccacgggcagucugugagggccacacaccuauaucaggcccugcuccagcaccugcauucagcaagggccaugggguagggggugggaaaagggccugaaacugucgucaucagcugggaaaugacaagauggccaugaggucucacccaggcuuucuccuugcuccaacacguguggggccucccaggggcaggguggcaucuccaacccccuuaagaccuagggaacucuggcugggaagaacuaggugggcaagaggaagcccuuuccacccagcacccaccuagagaacccaagccggcgcacugcucaccagagcuagggguugaccuggcacugcagcucgcaaguucuccaucuuggccucagccuccacuucuaaguaauccaguucuucuaccuggagcaguccaaggaccaaaguagugaagcaggggacuggguaggccccaauccaccagccccucccugcaugguacucagacacugcaggccagucuggggugagccaccagugccagccucccacccaaaggcugccccuucccuggguggaauacagagaccuccccuccccaaagcucagguucagagccugcccucaccguuugccauauggcacuauugucagugagcaggaacuccuccgccaggccggccuccuggggcaucagcugcugcuuccccuguucgagacagugcuuccuguacagggacucgauggcucugggcagagaacaguagcagcagcagccgcugauuaccagaugcccacucugggccaggcagcuugcuagugccuuccacaauucccuuuguuuaguccucagaaucagcucugaggcagaaccagauagcacuuucccggguuuuagacagggauugauugacaaacugaaaaugacagcacccuggcagcaggcugggguucaaggccuugucucacucaaauccaaguuccucuuacacuacagagcugccgucucaagagaaguucugagagcacagcagcgggaggacaggacccaaggcccagcugcaggcuggcuccuguccgcucaccuacccucgggcucaaaggagcaaggccaguguuauccccuuuggucccauggccccauaagagacucaggcugcccugaagagccaggacucuuaauucugggccacuguaaguuucuccccaacaccugccugccuaaagcucagggucugugaucuuaagucaaccaagccuuugucaacuacaacauggggauaaccauucuagcucaugggacuccuuggggaacaaauaagggaagcacugcuuggcccauaauuaucacucaaauuauauacacacacuuuuuuaaaagcccaucucccugcuacuuguaacagcccuccgcauguuccugugaaggcagcuaugcuucugggcccaagaguagggccuuuaguccuccccacugugaacaucucaacauacucccucccagagcucugagauccagaggguaaggguagccauggaagaaaaaaccugaacccagagagugagugagugagugagagagugagugagugagugagugagugagagagugagugagugagagagugagagagagugagugagugagugagagagugagugagagagugagugagugagugagugagugagagagugagagagugagugagugagagagugagugagagagugagugagugagagagugagugagagagugagugagugagagagagagugagugagugagugagagagagagaaagagagagagagaggguguguguguguguguuaauuuuuuuccuguuuucccuucuucugaacccagacucuugaacccaaacucuuuccacuagccugagcugaccagccaggggaaggggucccuaggcuccagccccuuccuccccugggccuaagccuuaccuguaggggcagaccaccccagcugacuccagggugguaccugucggcagcuuggccagguugucccgccgcccaggcaccaaguagccccagccaugacgcucugaguagugcagagggaagccaucccagguaagugccaugaguuuaggugugacccgcaucugcaggcugaggaggcuggggcccgggguccaugcagggucgucuagccgggggcagagcuuccgguaccaucuacgucccagcaggaagacagcagugucacgaugguaagggcaguuguuggggggaagguucucucucucacaauguccccacccacccuccaaagcccuggggcuuucuggugaccccagccuacagccgccauccccuccucugggaugcuuuagccaggacccccauggaauccucuagaagaauauuucaaaagcaaagacacuaagucagucccacuggacuagucagaagccaggacacaaaagcauacccugacccagggcagggcuccuucccaagcuccauuucauccaggguaacugaccagaggagggagcagaucugcccuccccaccccucuagagaaacaccaguccuucugggugcucucuugcaggcuguucaccagaguugagcccagggugagacuagcaaggcacucaggacacuugcucucagggucuugcaggugcaaagcuggcacccugcugcucacccuggcugcccuuuuucucaucucugccacccuaugaggcucaaaggaaggggcaccuucucaaggaagccuucuugauuuauuucccgaggcagagucagaacucuaccuauggacacuagcugcacuggcuggucuacgugccuggcuccuccuaggaaaaagaacuacuggaaaggaggagcuaugcuccaguguguacacccgguggcugccacgggccauugcacagcaggugcucacaacacugugcugaaugaguccagugagccgguccagagugagcaaaugagaauaggacuggaagacagugugacugaauggcagcaggucaauaaguauacaugugcaugaugccucugugccagaacccagaccagggcuguccugagaauggagcaaggguagacucuagauacacugcugggggugggcagggcucacccaggguguccaggaaggugcuggggccgcuugggcaggagcucugugguccccuucagcuucugcaagcaggcgcgggccaugacaucuuguugaaacuccuccuccucacugcaggggccgaggucugugagggugggggaagacaaucaggagcaggagaaggaacucucaauaagaucugcucccacccgcucaucuccagaaggcuggagcaauccuuucgaaggacccccucaaucacaggaccuucccagagacaaccccuacccuacccuaccucccacccaugcuccccaccuuccugauccaugggaucaccaggggccccagcccccucgaugggcaacuugcuggcuguggcugguuccuucuucaccuucuuagcuuucuucugcuuaaauucuugcaggucccacuccaggucccagagccaggggucuucuuuguaccuacagagccaguccacuagggcagggcuaaggcuaagccgaaggcuaggccgcccaccugccaguccccugccuagauccugcccacccaaggccuggcuaccucucuccugagagcagcuggcaggcaucauuggccagauccaucaacgacuucuucaucucccgcuggagcuccucauaagugcccugugccucugccagguaacgcucccaguucugguugacaggcagguaggagacacccaucuccagcaugccggccagagucacuggguggggacaccuuggaggcaaacaccaggagcugccauaaaugaccacaggaggcaagacuggcccaaucccugagcugguuuagcaagccucaacccagccacugacauggcacagcucaaaagucagacggcauuaaaucccagcucuacuguuacucaucccuggguaagcaaccccaucucucggagccucaguucuuucaucuauaaaaugggaacaauaucaucccauccucagggguaaugugggaaauauagauggcaaaagugaaaauggcugccacacguggaguaaugacucugugccaggcacugugcuaauaaucccauacaugaaaaacaucaugccugaaccucacaacuugggugguaaaauacagcugacauuuaaacaacacaugucuggaucgugcaaguucacuuacacauuuauuuucuucagccuuagccacccgagacagcaagcccaacccccgcccucagccuacucaacgugaaggauagauaucuuuaugaugauccacuuccaccuaaugaauaguaaacauauuuucuccucaugauuuucuuaauacauuuucuuuuaucuagcuuacuuuaagaauacaguauauaauacguauaacauaaaaaauauguauuauguuaucaguaaagcuucuagccaacagcaagcuauuaguaguuaagcucugagggagucaaaaguuacacccaaauuuuccucccuucuuuuuucuuuccauaucuuugguacaaauauaccugaauuuucagcauacaagggucacuucauaagacagacucauuaauaaacauaaccacgcuguaugugaagcccuuggcuaaggaucuaguuagagaaggugcacaguaaaccaggaccgugcacaugacacacaagcacaacuccauggcccuccccuucagggccucugucaaauccagaguccagggcccagauggacaccacugaacagaagggcuccauucuuucagccuagaaaagcuaagguccccaaccugagauagaaccagcgccaccugauuacagugggcccggguaccaggaacacacugacccccagagauucccacaugggcucccccucaccucuccaagaagagcgguagcugcugcuggaaaaccucauggguggcccacacguccugggcacaguacugcaucagguccuggcacaaggugacaggaaggcgcaaggugggcagccaucccauuaccaccaccagcucucagggucaggccuggcagcugcaucuccccaagugcagcuaggggugugccacagcccauguccccagagcccccuccagcaccauaccuggaaguucucacgaauguccuucauggugcccuucacaaacaguucucgaggcuccuucucuaagggaggccccccuacauaaagucugugcaccucugccagacuguugacacugcugauguccagccagucccaggaugagaucuggggaaccagagcaagggacauggcagaucagccuggccucgggccagacgggcuggugagagggggucccaagcacuaugcuccugcccaccggcagugugcucucaccgcugggccucuucuggcuuuccucugggacuucuggccuugcuuuguggggggcuggaccuuguguuugcccugcuuggcugcuauccacagacugcgcuggaagcugcuuagcccugagauggccaugugcaugcucaugguguccaggaaacgcaugcgggaacccugaggaggaggaggagaaaagggaagggaaggagggaggcugcaacuguggggccagcccaccacugcuuggugguguggaccuccagccccaccucagcuccucaaacagccuccccucccagcacacagccuucaacaccaaauacagaauccucaugcuuguucaugcuugccccaucaccuguaaggggccugccuucccaaauccuagccacccuuuaagaugcaggccuggcucaaucccaaugugcaaguccuucucagcuuccaacaauagcucugagcaacguagauacagaguggccaaaauaaagccuucagggcuaucuggucuggccccaacccugccacucaaaagcucuguggcccugagcaugucaacaaggcugucugagccucagcacccucagcuauaggguaagguugcucuccccugccuggccuaucuucuagggcuguugugaagauccagugaaaaaacacuuuucauaaaauuaagaauugccacuacuauacaccaggcagagugcugaguguuugacaugcaggcauuguuccaacccuccuauuaauccuaugagauuucuguuaugucugccuuuuuauaaaaaaggaaacuaagacuuagagauguuaaggcgcucacaguagucaucggugguuaaggcaggaagugagcccaggcuguggcucaaaaccuucaagacccaugcuaagcucuaaaaugccacagagacgaaggccauuauuacuuugugacaacuuagguccuauaccaggcuuucccggggacauacaacagcuaggcacagagaccagaggcacagcuggucaacagaugcgccuugcggcuucagcaaaggcaacagagacacgugccaggaaaggaguaccuccccuaaccacugagauuagggcuccuggcccaucccaugccagaaccugcaguuggccccaggaaccuuaccuggaucagguacugcucccugauaugagcucggucaaaggaaacauugugccccaccacuaacugcuccugccagucucucuggguggggcugcuggcaccaguagggaccuccagggggaugaggucagccggcgacagcuggcugguccaagaguaacgcucuuccaccagccgcuggcugcaccaggaauaccugagggaggugagaggcaggcagguucaccauggagacauuaaacuuccacuccacaacaaccacugcacaccuaccgccacaugccagauggugcauuggcagcuggggacacaagugagaccaaagggugcuccuaacucaaacagcuacaggucagguguggcagggugggugugugugcuggcgggcaagagcuacaaaagcuucuuuaaacuucugcacauaaaaauggaacuacugggcuauuagaccuacgugcagguauucuauuacagccugggcuaucaagguguuugcuaggcccagcguucacugagucugcaucuagcucugagguuuuaugaacauuaucaaccccucacgucuacaggcacaaaccagcuacuguucaaaguacuaguaaaggagauagacaauaacagaacccaagguggagauuuaauugaauuggcaaaaaaaaaaaaaaugacaaaugcugcugcacacauguacaggaugaaucaucucacggcugaaaagauucugggggacaaagagcaaaucacacaccuuggagaagcaaccacccucagugagaaccagggaaagugccagaaugagaaaauguauguguaugugacaggguuggggugggagggauaggggaugagugcugccuguugggggcccgacacugauucaggaaaaggcugcaguuugcucaagauccacaaggcuagguguaggggaauggccacugaggaaaugccuguugcaagccacagauuauucuaaacaaucaaggcccacucagcaucaaagugagugacgaggccacguguggacaacacagcugcgaaggagcuccuugcaaccuuuauggaagggaaaaagggaguaucugccucaacagauucaacacacauaaaacuaacuucuuucaaagagaaagcaaaaagagguuccuaguuuuaaaccugacaaaaucgaacucauacuccaaauggugaaaauaagccaagggacugaaagaaauccccacccccccacauuuuaauucagcaugucaaagcccuuaaaacaacgcagacaaaaaggcuaaagaaugccaaaucuuugaggccauggugguaacaggaacuuugguuacaguaaaaagccacacuggugucaagaugcagcucugcagcugugcaugaagccauauuauaaacuagugauuaaaaagaaacaagccaaauuuaagaugaguagggauccaugccauuaauacuaguuuuacugugaaucuuagaaaaaugcugauggccagagagacgucccucuagccugauggccgaagcccuuaccaacacccuuugggaagaagcugcccugugggaggcucauagcugacuaccgcuucuccucccauuguaaauugugggcuggucagguaccuaauguuacucagcuaaggggcaggggcaugcccagguucaaaguggaccgcuauuagggcaccauguggcacccacccccacccaccagucagacucccaggaggaaggucccagcaugagcccaggccuuaacagugacuucugccaucaggucaacuaagcaaugccccgaguaccacuggcaagaauggaaugagaaugagggcagagcagggaaggacagggagggaaaggagagguaaaaagagagaaagaaggagaaagagaaaagaaaaggggacuugagguaauuuggccuaaaaugaccgacagaucaaaaaacaaaucuuucuugucacugguuuccuaauuuucuuucagccaccaaagccuacuuuaucuuuucaaaugauggccgauauuccccuuuacuuugaccaucaaguuacauauucuaaguagugugauucucauuguaacuggaacucaaucaaugcagaaucaucuaguuuugcucuuuucagccauuaaugccuaccuuaucuauuuagccauguuuucaccauuuucaacugcauauuuaacauuucgcagcuuucuuuacaaagauguagcuuccaauaggaauaaagaaacugccaacuuuuuugcuggccaugccugaaagcauuaagguuguaaauaguauuuuaauccuggaaugaagaauaaaaaaaggggagaaacaguacugccaucauuguuugaaaaagaaacuuggguagcacuuagaaaguuauuuaaaaagaaaagagagauuggauauacuuguuugggaccaaaaugccugcuuggaaggcugggggaaggaagcaauguuucucaacuagggguggucaaccagaugccaccucaagggggcgucuggaaacguugccggcgggggcaggggggcggggggguguuggucuggcguuuaugggaaaggcuggggaugcuaaauguccuauacugccugggacagucccacaaaagggagcuuucuaccgcccaaaauaauuaauagcuccccaaauagaaacacuguucaaaugacuuuucagacuaacuucucaugacgcuauuaggagaggggguaaaggcaccaaaucaccgugaucuuaaguggccucccgaaggucucauguacagcgcucuacugugauucucugcguggccuuuacugccugacauuuacuuggguauuugcuuacugccugugaucuucccaccagaaagugagucccacauaaacaggggucuaguccuaauucaacacaucagcgcucccuacgugagcacccagcccguaacaggaccucagaaaauguucacugaaacaaacuauuaagcugggcccccaugccugcuuauguccccaacccugccccuacuuaccaggccgagggggauauggccaccgccaauguggggcaaguucccucugccaagcagaccuccacgucgaacaccagggcccgcuccucggggauggccacggguacggccucccccucggggccguaccggguccagcccuccgcccaggcccaagccgggggcuucgggggcagcugggccugcaacagcaaguuggccgccuccagguagggcaggcucugcuucugggccaggaggcggaagugcugguccagguuguccccguagaggggcggcaggcgcagcuccacgucgggcaagggcacggcuggcugcccccagagcccgugcuucugcaggugcucgacgcugcggcgcaccgcggccucgccaggcaucuccccuccuugcccgaagauuugcucgugcagcccucucgagagcaucuggauguccaauggguugugccgcagcugcccgcccuccgaggauagcacuugcggcugcugaggcugcuguugcugcugcugcugcugcugcugcugcugcugccgccgccgcugcccgucgcuggggucggacgcggggacggagcuggagacccagcgccccggagcuggaaccggcccuggcccgacgguggcgccggccaccuuccuccagagcaggcggcucaugguuggugcagggacccccacgcugggagucagaacaccuggcuuugggcuccagcuuggcuucuuuuacuggcuggaagacguggagagagacacguccugucucugcucuccugucagugaaauggguuugaccaugccugccuuccaccccaaauccuaaaggagacagaugauauaaagcguuauuuuaccauauauguaauagguguauccauaaucaucauuccuugagcauuuacugcguccccaacacugugccaggcgcuucaguugcauuuuccguuaagccucaaaacuugggaaacgucaauaccccuccugggggaaccgggguccacgcaacuucgucagugaacccacguggggaagccgagggcagcgaguaagagagcaguaucuggaguagggcgacgcgguuuugaaccccgcuucuggcucucucgagcugugugaccuugggcaaagcuccuuaggcccugauauccuauucuguaaaaugggauuacggauucugccugucacaccgggcugcugucugggggacacagggcgccuaugucgugcggcccugcucuuggcaagcgcucggcaaaugguggcugccauuaccgcgaccggcgcgggccuagcgucgagaggugccagcgcccggauucgaacccgcagggugggccgccgucccccgggacccacacccacacccggaccacggcccacccggccgagagcguccugcaggaggagucggcggccacccccgugcgccccgccgcccgccugcgcccggcagaggcgccgcggugcgcccugggacuagccgccgcccugcuccgggccucgcucccugacuggagagggaggggccgcgccgucgcucagcgacccggccuccccgccgccgaccccgccggaaaccucgguccucacggugcuucccggucugcugcucccccgaccccaggcccacggcacggcgucccccuucgcgcggccuacgcagccucgggguagcguguggccuccacccggccgguccgcuucgcuggcagccgcaacuucccgucugcacccagcuaggucccgcggcuacccgagaggcaagcgggagacucccagcgcgaccaauaggagggccgccaauggagcgguccgcccgcggggggagaagggggacuucugggugggcucucccugcggaacgcgcgaaccaaaggccaaccuccccuucucaaggagcagguggauuggucc

SEQ ID NO: 15234 - RNA, 1358 nt, Homo sapiens
aagggagguuaugauuaacuuuuaguuuauuccucccucaggaacgaaguauugggacaaugugaacguagucgccgccgauucccaccgcacuucaaagaugugggaacgccaagauccgcggaaguaaccacgcccagcaagucccugcgagauugcccgccuacgugucucagcggaggcacauuucuaaaauguaccaggucucucgcaccccgacgcagguggaggaaaguggagagggaggggcauccuguacagaaaucucaauuuauacucaauugaugguuggcaagaguuggggcucgcagccaaagcgaggcucccucccucgcccauccggugcugccuccucguccagagcaauucugagggguaaaaauguugccuuccguugaaccugaauuugcccgcagaugcuagccuccggcccacagcgcggcuggagcuuguccccuuccccagcuguuuccagucuccgcauccgucuuguguugcuccaggugcuucaacagcucucagcgcucggugguuggugaacugugguaaagugcacgcagaauaaggucuacgugauuaagcaccgccuggggguuggggucuggaggcccagcugcacagaugaaagggaggcucagagacguuugggaccaaccgagaucacacagcugauuaggaauaaaauucaggucaagcugaaagucggccgccaccguccagcguggaucccaggacaccgugaacggacuacagaaguugacuuucgcguuuuuaaggaguggggugcagggaaacaauccuccgccggcccugcgggcugaugccgacccucaccugcucccgccacguggagagguagagagaagccccgggccaagcagcauugagcccuggucccuucuauuuaaauaugaaauauuuugcauacacuuuucuagauguacuuaauauacacaauguuuuaauguuugugauuuuuuuguuuugccaaaaaaauacaaucaaucagaaauucaucuguuuuuuuuuuuuuuuucacauaacuguugacuuuuacaaaauacuggaaggagaggcucucagcuuaaaucagggagucccugaauggggaaaacauuuucaucuuguuucuucuaaccgccuacugauacuuggcauuuccuccaauuaugagcauaggcugucagccacagugguauuaacagugccugugacuuuguccccuccagcaaccacagauauuuucauaacgcauuacaagugcugcacauuuuucaaaauuuguuugcacuuaucuguacuucaaaauaacagggguuacuagacugccacuagauccuguuaguuaauaaguuuac

SEQ ID NO: 15235 - RNA, 6920 nt, Homo sapiens
cgcgguggaugaugcgggucucggagcggugccguggcggaccccgcgcgccgcucgccgucucuucggguggccgcucggccucgggccgccaguugaccguggcgcgguugcggauguucugggcgcggcuggcguaguugaggguguugagggucucgucgaagucggaggaggaagggcugacgcaggcgaucaucaccgucuuggcguucccgcccagcgagucuuugaggauccugagggcgcgagggggaggcucucaggggccccgacgcuccaggcccagggccagcgggccagaccugggaccggcuccuggcgcgguucccgugggcuggagaccucaggggaccugggcuuccacccccacuggugugcuggacacuccccgccuccccggcccccaggccacauaggagccagggggcagcucaccgggugaucuuggagucgcgguaggguauguggcugccccggcgcugagggucccccagggcgcugaugacguugcccagcgccaggaggcugcuguugaucuggaugcucuccuugagccgcucgccggugcugcccgucuugagcacccucucugagcccgccagguccacgaaguggaacuuggagacgagcagcuggcccggggcggggcgggguaggcggcugggggcgcgcccccgcugcuccagggucacggugaagaccgugugugagcggcuagacaggugguugaggugcguggcucccgugugccgcgccgcguugcccaucuccaggaggcucagcaccucauccaggcccuccacgucgaccuccuucaccccgcacagcacugcgggcacagaaggccgugagccccagggcaggggccgccagacugaccagccaggagggcaggcagagcagaacuagccccaaaccugcccuuccugacccacugcucccuccccaugcccacgggguacugcccuuccuaguuccggcuugaggggcuccggcuucccacuggcccaccucagugccucucacucuggguauagaagcauguacugaacucaguggaggcaagaagcuaaagcaaaaccucccagggcuuggguuuuccaugaggaguugccauucccagacagguaagcacuccacuccaaacaggugaagccccccuaagccccucuccgucaguggaggaccccagaguuccucaccaacauucccgcgcucaucuucccggagcuggaugucacggcuggcagugcccaccucgagcaggucucggaacuccuccuuguacacuuccagguaggacacauguaccagacagucaagcaggucguucucaucgaugagcuugaaggccucggccauggcccucgggacaaugcccugcucauccucaaggagggaggcuggggagacaccgcagggccuccugccacuucagcuggacacggcccauggcccccaggcccggaagcucauaggccccugccagagcuggaggauggugcucuaggauggagaaggcaguggccgaggccaggaugggacagguggccugagcuuggccaugcuccagcguggucaggcagaauuauaaaauuuaagaguuggaagcaaccucuccugauucaaucaaccccuuucaugcuguaagcauccccuucacugcauccucaacagauuaucaaauaaccuugccuugauuacuccuaauccaugcucaguuaucuaaagggccuccuaaauuuaucccaaggaaauaaucagaggaacuucagagcagcacucuuccucaugacuucaaaaaaugcaaacauccuaaguguccauccgaagauccaauaggagaucuggccaaaucaacuuuuuuuuuuugagacugaguuuugcucucguugcccaagcuggagggcaguggcgugaucucggcucauugcaaccuccaccuuccgguuucaagcgcuucuccugccucagccuccugaguagcugggauuauaggcaucugccaccaugcccagcuaauuuuuguauuguuaguagagaugguguuucaccauguuggccaggccggucucaaacuccugaccucgugauccgccggccucagccucccaaagugcugggauuacaggcaugagccaccgcaccuaaccaacuauuuuauauucacaauggaaugccagguagccauuaaaaaguuagauuuuuuuuuuuuugguagagacagggucuugcuguguugcccaggcuggucucccaacuccuaugcccaagcaguccucccagcucagccucccaaagugaugggauuacaugugugagccccugcgccuggccuaaaaaguuagauugaagaauauuucaugauacagagaaauguucaugauacauuuguuguuguuguuguguuuuugaaauggcaucucacuguugcccaggcuggaaugcagugaagcaaucuuggcucacugcaacuucugccuccuggguucaagcaauccuccugccucagccuccugaguagcugggauuauagacccccaccaccaugcuuggccaguuuuuuguuuguuuguuuuugagacggagucuugcucugucaccaggcuggagugcgguggccagaucucggcucacugcaaccucugccucccagguucaagcgauuccccugccucagccucccaaguagcugggacuacaggcaugcaccaccacgcccagcuaauuuuuuguauuuuaguagagacaggguuucaccauguuggccaggauggucuugaucuccugaccucaugaucugcccaccucggccucccaaagugcugggauuacaggugugagccaccacgcccggcucaguuuuuguauuuuuaguagagaugggguuuugccauguuggcuaggcuggucucgaacuccugaccucaggugaucugccugccuccgccucccaaagugcugggauuacaggcgugagccacugugccuggccaaugauacauuauuaagaaaaucaaacaggacacaaaagaauguauauaauauaaucccauuuuugaaaaguaaaauaaucuucccagggaaagaaacuggaaggcuaacagggcaggggauuuccgaaaggcaauuaucaaguacauuuuauuucgugcauguguuuugcuguauuuuccuaauuuuuuuuacacaaaguaucuuucuguaacugcuauggucugaauuuguuuaugcuccccaaaauucacauguagaaauccuuaccuccaauaugauggaagugagggcuuugggaaguggauggggggagcccucauaaaugggauuaguucccuuauaaaagagagcugagagagaccccuucuguguacuaccaugugaguuuagagagagacagcgacugucuguaaggaagaaggcccuucaaucugcuggugccuucaucuuaaacuucccagccuccagaacugugaggaauaaauuucucuugaggagccacccagucuaugguauucuguuauagugaagggagcagagcaaggcaguaacccgacagaaaacagcuuguguuacuuaaaaggggacacuuccuucaguuggcccaaaggaucuuucucgaaacugcuccagagccuggcugaagcacccugcagcccugcugugcaguauccaaagcagccucuuccaggacacacggcccccauucccaacugcuccagcuagaacagauuccugaccuucccuagccagccugacaaccucuagagacacgccaccuucccgugcccuuccucugcugagguccccagagccaggcagcauggcgccaucucuauggaggugagaaggccacucaccuccaacgacccuuccuuccugcccugccuagcccacagacauggcuggucccagccugggccacagaucccugucuaggaaaucgacucuuccucccccagcauccccaccuuccacagaacaggcagcaagaggacaaggcagaaauccaggaaggaacuaaggcuccuuaaagugggcacagggccacgaacagggucacucacccacacuggccucccccaugguguaugucuucccugagcccgucugaccauaggcaaagacaguggcauugaagcccucgaagaaggccucaaggaggggcugaacgcaggccugguacacggccuccugccccgcauccucggccagcaccacguggaagccaaagugucggucacggcccagagugacgcggccaagcccuggcuccaccugcaggcagcucugaugcccgugcagcagcuccuugggcagcaguggucgaacucgcagggcaacccgcacuggggccuccucagccccuggcagccucugagccuccagccccaugccgagggaggacugcucugggcccuguggagagagagagaagcccuggccaucagcacuuguacuccaggagcuggacucacccugcaggggacucgagccagauccugcagcuccugaccuuggagggauugggggaggguggucaaaguucacaauauccccauguccaaccuggugcucaaaaauugcaagggccaugauauauauagucccccacaggaacaugucauggcuuccggcacuggcgaaaugaggcccuaacuccugaacuccaguguuucagcugcacucuucccuauggccccuauggccccaucuccuagaagaacgcacacacacagcaccacaccacaccagggaacuccugucccuaacacccacuggguuuaccacagucuuugugucaagucacucacauccccugccccaccuucuucaaaaaagucaacagauccuucaagaccaagcucucaccaccaaauccugccaauuccaucuccuaaauaucucucaaguucaccugcugcuucccauucuguugcuaaagcccugguccuggccacugacaucgugccaggaugacuuugagcagccuucccccuggcaucagucucccuguccccucccgcagggcaaccagggacaucuuucuuuuucuucuugagacagggucucucucuuucacccagacuggaguacaguggcaugaucacugcuuacuguagccaaggcuucccagguucaagugauccucccaccucagccuucagaguagccgggaccacagacauguaccuggcuaauuuuauuauuaguauuaguauuaguauuaguauuaguauuaguauuaguauuuuguagagacagucuggcuauguugcccaggcuggucuugaacuccugggcucaagggauccuuccaaagugcagugacuacaggcaucagccacugcgccucagaggcaucucucaaaaugcaaaugcaauuauuucacucccugccuaaccccaacucccccaaaaaaaggcucuccacugcccuugggauucaaaauauuuuuguuuuuguuuuuguuuuguuuuguuuuuuauuugagacggagucuugcucuguugcccaggcuggacugcaguggcccgaucuccgcucacugcaagcucugccuccuggguucacaccauucuccugccucagccucccaaguagcugggacuacaggcgcccgccaccacgcccggcuaauuuuuuguauuuuucauagagacaggguuucaccguguuagccaggauggucucgaucuccugaccucgugaucugcccgccucggccucccaaagugcugggauuccaggcguaagucaccgugcccggccugggauucaaaauauuaaggggaaaaaaaaaaaagacaagccuuaaaucaggcccugccucccuggacuacucacuucccacaccccaggccuuuccucgccuccucucucugccugcaacggcuagguguuacccaagccuccucaucccucccggcugaggcugcagccaccuucuaauucagggagccacggaagcuccccuccucuguaaccccaccacgacacgcacacaacccccagugcuguuccacccgcccgugaccacuccaacugcagguuacuacccgcuucucuccccgaccucccagaccaggagcuggaaggcagggacccucuggguccacuuugcacuuuaucaccagcgcccaacacaaggucccacgcugcccaacagauagugauggauaaucuucauccagggaacuuucccugcccucccuccuccuaccgcguuccucacccccaccgccagcccggcacuucauucuuuacccuucaaccucucucucagcacaguaaccuuucguuaauucaaucacccagccccuauugggcucccgacccugggcacacagcgguaaacucugccucgcaauaccgugugggccuucgcgcaccccuccgcgugagcguuccgagcccggugcagucccggcuuccgcgcgccccugcucuccgcacagcgcucccgcuccgaaggugcucugacaaccccgcaggcgcuauucggagccggggcagggcagcuggggcuggaggcggcgggcgcgggacggagcuccaugaaaguuggaagaagugauuacaaaucgggacccgacucucgcagccuuggcgcucgccccuccacgcaggcccgggaugccggccucagcccccagaugucgggaagacggcgccggccaguccaaggaagagcuuccaggaggcuggggagcaagggugccgggcuccucaugccgggucaggucucccaggagugccggcucccagggccacuaggcccaggccugcgcgaggagggagcgcgcgccucccuccacccacccgguccucgccccuaacccgcucuccggcccacacucaccugccuggcugcaagcgccgucccgggccaggcagucagguuuccauccccagugcg

SEQ ID NO: 15236 - RNA, 2115 nt, Homo sapiens
uggcucuuuucaguuuauugcaugaaggaguuacacuaguccaaguuaaaagcggaccccaaaugguuacauuauacaagcugugagguuuuuaaaccugugacaagggagagaagggaaauucuacucauugcaaggaaauccucacuuaagcuucagugagccacaagcacuuaaaacccaugaaccuucagcugaucguccuuagccaguccaaucugaaaagacaaaagggcaaaguuuuaaaugggggacagggagaguuaaagccuccauuucuaauggcaacaacccugucuuccugcuacuacacugcccaagagccaggggugcgcacaaugguucaacagaggguccucaguuaagagcuaccuuuuuugaacacucagugccuuccaagguucugaauuagugugagaaugagacucaucagguaucugaaaucucuucaauuauaucaagagcugaucauguaacaguauuuuaguauuaauacucaggaaauucauuuuuaaaaacucauguccuuacaaauacaggaacaacccagcauuuggcuuauuuuacaaugcaucuauaugcuauucaaauuugcaucugugaaguagauccacagaaacaguaaaccaaagguagacaagucccuucugcuuuuuccuauaaaacagaaauaagucuauguacuuuaaaacccaacugagguuuugcucagccuuacaaagccaacuuuuauguccccagcagaagcuaacagacaggaucugagauuugccagcagagaggcacaaaucaaguagugacugaacucaccucuacgaggaacuggcauauguucuugcguuggucacccuguagcugaauuacuucuccauauuccggaugcucaauuacaguaccauugcaggcaaacuucugcaagcacaaaggaaaacgaauuaggccuagcaagagcaugaacgcauuuaucaccccuuccgcuaacaauacauacaacacagcuggcacccccuuguggacaaauccauuaugacuuucccaaaaucucacugaagaccuacuuucuuaaacgccuucacuaguuucuuuuuaucguaaucaucagcgaucccuuggacaguaguaagggucuuccugccguuucucuguugaauucuuauauggauauaauccucagugccagcaggaagcaggucaucacccuuacuugcaucagcaaaggggucugaaaaaaaagguuaagcucguucagagcugucaaagauaggaugccacugccauccccucgguccccagguguuuugcgcgugcagaaaacaacacugaaaucgucagggcuugggccaggccgaauguguccuuugcuggcucuccccgagcaggucaguccgggacggccagcuuccccaggcucggggaacgcccgggccucccgcccucccugggaagccgaucacaugucgggggaguccgggcugccaggcggugccccacccagcugaugcaacccgccggaacccgagcucccgaggcggggcuaagccucccacccccauuggugcacccgcuugccacuuagggcuggcaccgccuuucccuccggauccgugacaacggguggugacguaacggacgugacgcaauggugacgggaggggcggguguggcccgaggaggcccaggagccauuaguaaaugcgccacugagacgccgggcccgcccaagggcugaccuaccgccugcuccuuccggucgcgcucaggguccgaccccggggcccaggccuugaucccgcugcccugcgacccuggucaaguuuccccugcccgagcuuacgaaggcccggagcgcuuggcaacuucccggaacacgucuccgggcccggaaggccccgcugccccacccgggcccgcgaccuuucccauagcuuaccgaaagaguggagguucuggauagcggacauacgauacgauuccuuuuccucgguggaaacggccugcggaaggcggcggcggcgguggcgggagaaggcgggcaggggggaacggaacgucgggaagcgagggggcucaagggggaggcugcugaauccucggcggcggcucagugacuggggc

SEQ ID NO: 15237 - RNA, 1670 nt, Homo sapiens
acugacaccaguacaguuuauucacaaauaaauaaauucacauuaggcagagccuccugcuugccucaaagugucuagcccuaugggucccuccauggagggaggggcugagaagggccgccgcgguggggacggcucucacccgcaggaaugcccccgucgggaucgcccgugcccucuuccaggaaaggcagucugccaaggaaccacuucgaaggugcugaggccaaaaagccucggugcucacagagacggcgucaguugucccuugucacuugggcuccucaggcagccacuccagaggcgagaggggcauccaggucuccaacagagccagcacgucgcccggaaggagcuguagggagagacggaacagcgcagcccucaagcacugguggccuugugcggguguccgcgcucgugggcuccacucucagggggccccuagcgaggggagacccaguccucugcguggccuuucccugccuucgcuucuuggagcccugggcauacuaugguggccagguggccaggcugccggcggggagcagcagggugccugguccucaccuuggcgggcgguggggcugugcgcgggggcacggacgaagggggcgcggggaaggggacacuaaccggggacggugggcuuggcuccaucgccugcccuucagggcacgccgccucggcgaacagcgcaggcgggucgcgcggcucgggugcagcucgggcuccggggcaggcaggcggggauccccaggacgccccggcgcggacggcggauaccaggcccagcccgcgccccugccccugccccucagccugcguccgugucugcaucugcgcggggcagucgucggggcacagcgggcagccccgaggggaccccgcgucaccgcgcugccggcaccggcgcuggagacucuccucgcugaggccuagcacggccgacagguggccgauauagcggauagccaggcgcagcgucucgaucuuggucaggcucuggcccgcgggcgccacggacggcgguagaaagcggcgcagcucgugcagggcgcgggccagcgugcgcaugcgcaguuucucccgcucacuggcgcucugccucugcccgcugcccaggcggcugcugcgcgcgccgcgccuaccuacggagggggcgcgggggucccggagggugccuggccgcgcggggcucgccacggggcugucggcuggggugcugccccaugagucuggggacgagacgagggagcggccgcaguccuugucggagggcggcggccgccgaguugggccccaggccgcagagagcauccaggacucggagagcggcgggcacaggggcugggccauggcagcggcggcgcgucugggggccggcggccggcggccgcuuuaugccgagcccgaggugugaaguggccccuuccaggccgcaucagcacaucaaagugggcucggggcuuggagggggcggagccugacccuuugaauccacggcggggggccaaggugccagccccuugacugcgccuguuucgccccaccugggcccucgcuugggcgcccgacccagccucucggccuucccgccugcgcccaguguugggugaagcccggggcguugggccagcccugcagguuaaaggaagcggggucagaaa

SEQ ID NO: 15238 - RNA, 1670 nt, Homo sapiens
uuucugaccccgcuuccuuuaaccugcagggcuggcccaacgccccgggcuucacccaacacugggcgcaggcgggaaggccgagaggcugggucgggcgcccaagcgagggcccagguggggcgaaacaggcgcagucaaggggcuggcaccuuggccccccgccguggauucaaagggucaggcuccgcccccuccaagccccgagcccacuuugaugugcugaugcggccuggaaggggccacuucacaccucgggcucggcauaaagcggccgccggccgccggcccccagacgcgccgccgcugccauggcccagccccugugcccgccgcucuccgaguccuggaugcucucugcggccuggggcccaacucggcggccgccgcccuccgacaaggacugcggccgcucccucgucucguccccagacucauggggcagcaccccagccgacagccccguggcgagccccgcgcggccaggcacccuccgggacccccgcgcccccuccguagguaggcgcggcgcgcgcagcagccgccugggcagcgggcagaggcagagcgccagugagcgggagaaacugcgcaugcgcacgcuggcccgcgcccugcacgagcugcgccgcuuucuaccgccguccguggcgcccgcgggccagagccugaccaagaucgagacgcugcgccuggcuauccgcuauaucggccaccugucggccgugcuaggccucagcgaggagagucuccagcgccggugccggcagcgcggugacgcgggguccccucggggcugcccgcugugccccgacgacugccccgcgcagaugcagacacggacgcaggcugaggggcaggggcaggggcgcgggcugggccugguauccgccguccgcgccggggcguccuggggauccccgccugccugccccggagcccgagcugcacccgagccgcgcgacccgccugcgcuguucgccgaggcggcgugcccugaagggcaggcgauggagccaagcccaccguccccgguuaguguccccuuccccgcgcccccuucguccgugcccccgcgcacagccccaccgcccgccaaggugaggaccaggcacccugcugcuccccgccggcagccuggccaccuggccaccauaguaugcccagggcuccaagaagcgaaggcagggaaaggccacgcagaggacugggucuccccucgcuaggggcccccugagaguggagcccacgagcgcggacacccgcacaaggccaccagugcuugagggcugcgcuguuccgucucucccuacagcuccuuccgggcgacgugcuggcucuguuggagaccuggaugccccucucgccucuggaguggcugccugaggagcccaagugacaagggacaacugacgccgucucugugagcaccgaggcuuuuuggccucagcaccuucgaagugguuccuuggcagacugccuuuccuggaagagggcacgggcgaucccgacgggggcauuccugcgggugagagccguccccaccgcggcggcccuucucagccccucccuccauggagggacccauagggcuagacacuuugaggcaagcaggaggcucugccuaaugugaauuuauuuauuugugaauaaacuguacuggugucagu

SEQ ID NO: 15239 - RNA, 17520 nt, Homo sapiens
uugagacucgcucaaucaaucaaucaauaaaccaaucagucuuccuccacucagccucucugcuccccggcguuucucauuaucuagcguuuggaugaucagaaggaaaaaggagcugcugcguaaaggugaccccauuucagguuucgucaugacucgcuagguacugagagacagcaggagaagggaagacaaagaagggggacagggaacacucaccugugaucgcagagggacauuuugggagacacacggucacuagacugagggcugugugugggcauuugccggcacgaucugguguguaacagaggcccaaccaggaaggacaggaaaucuaaauccagguuagggcacguauauugcacccagccuuugggucuuggcuaacucaggaaggugcuggucggcggugacccgugaugugagaacacgccucaacguccaaagaggcccucccucgugagugacauagacccaacagcugguggccuguaaaaagagccaacccacccgcuuacccuccuggagugagggcccagccugagcaggcggcgggcuucuuuggagcagucccucgaggggacagcccaucccagggcugacucagaaugcccuucaccccacaccccaccggggaccgagcaccuccugugugcaggcagccggagaacuggguggacacggcccaggcagggugaguugccacggcuuucaccuccagccagggcagcugccucacugagaacccccucaucugccccgcuaccugguuaagggcccgagggcucucauagaggagaccugcgggcacccagggggccgagcugccuuuggagacugagccuugugcacagcaucacaggccagggcucucucccuuggcucacccaggacccuaugggaggaggccacagccaggcggccagggcagggagcagccgacccuguaauaaagcugauggcugccggccuguggcgccccuggagagggagcaacuccccuuggggguguaaccuguuucggggaagccuuuacagcagcucuuugauguuucuccaguggaacugaauuuauuuuuuguacuuuuaggaauuaacuugcagugcucagccucucccuccccagaaaggagagaaggagaaaagaagaaaggguuugcauugucaccgugauuggcaccgccugugaaugaggggucacugcuucaggcugcuccuuuucaagcaggccuuucuccccugcacgcugcauucacgcuagaacauucuuucuuucaaagcuucugucuuucucucccccgcccuuugugucucugccuuccuucccuucacuuuugccuuucauucugagcccucaccaccucccuuaggcuucacucucuuucccucuuuuuuccccuuuuucuucuucuauucaguuccuuuuuuuuuccccucuugccucucucucucccuuuuaaauuucuuuuuucuuuuucuuuuugaauagugcuucuguuuucaagggaagagaccaguagggaaguggguuuauuugagagagggagaauauguuuuuucuccauugcucuaaauguguaaaacaacaacaacaaacaacaaaaaccuguugaagacacuguuuucuuuuaggcuccugcuuuaaagagggaaggguguuugggggucuccaccagccguagggaccuguucgucacacaggaggaguccugagugggucagcagggauaggugacugaaggcgugaggugggacuggcaggaucuagacauggccuuggcauccuucccuucugccuggcccaauauggggcucaagaugagggugaaggcagaggcggauguggucccacgggccuccccacucuggcggagcguggugucgccauucccugccaaggcggggcuagguggcguccgugugaacaugacacaggggcugagugugaggaagggggccgguccacacgacacaagcuggaccgacagcugagcuggauaacccucaccaaauaaggggcccgccaccuuggguuuggcagccuguguugacacauccuuugugacagggacacaugugucccacgcaucagagggauuucaaaaugucaccugggagcuauagagaauuuucacucagguuuuccuaaauuauccaaacagaacaguuugguuuuuucccuguaggccucuuuauuuuucuuuaaaccuguggaaacgaaccuccucugagagccgacauaugcuugucaaucaggcaugugcgugugccugguuagcacauuuacuuuaccuguuaaagcaguggcuccucuccugugugcaugggucaguggauagcaccgcagcaaggccagcacuuucuacauccccaggggccaccagucacuguggucugaggaguaaagguggcccugccuacucuugagguguguuuauaccuguguaggccaaacccccgcacugugucacaccuccacauuacaaucacugcucccucccccagagugccuuucuucuguuagucugccugcugaacuccuacacaaccuacaaaaccuugcucaggugucaccucccccuuugacucccccacauaagacuuaaucacaucucccuuuauccaucuccugggaguuguaugucauagcugucaacucacuaagguaaucauccauuuacuguggcugcuggagggcggagacuguugucuucaucucucuagcuccuaggagaauggugugcuguccauguuugccaggcagaaaagccuugcaaaaccucagucacucuacagugaccucagagcuugagccuggucaacuggaacagcagaaagaaggaagcuggaaauggcggauggcuucaaggacgugagccauggagagguuagacagugacggcugacagguuugccgucugggaacuguugcggaccuggguaagggugcagcucuagugaggucaacacugaggugagcgcagaagccaugagagaugguuucucugagggaguccacucaggccaaggccugagcccaggggccgcugggaugcaggaggccagggaguggugguggugcguggccugugagcucagagaggguuguguggcugcugccagaugaggaggaggcccagcucaaagcuccuguguuuggcaaagggcugccaccuuccagaggacagcugagcucugguggaggggacagauaucauagaguagagcuugaggaggugauggaggacauagaucuggccccaguuuaggggguggagagaaaacaagaaaucggacauugccaggguugcagcgggcuguggugcaugaaagcuuugagcuggaggccagagagggaagagacgcgagguagcaggggccaggucucuucuggaggaccuaccgcaugucucggcacauuucugcccuguagaaggggcacgucgggcagcgggccuggaagacccuggguaccuccucaaagcacagaaaaagggaccuggucacacucugggucccccagggccacagagaaagcuuguggggcucccguccagccaggguucccaggggccccaggaaaaggcauggucucuggggggacacagggcucucugcagaaggaagcuaccucugggagggagcccugagaugucaguggccugggcuaugugagaugagggcuccaggcccaggugugcuggcacaagccaucaggccuggagguguggccggcaggacccucccaaggcagaacccugugugcccuuccuccugcguacccagcucagugcccagcccauaguaggcgcuucaugaauguuugcugaagugugaauugcauguuguuagcagauguagaguggaaacaguacagcucacagccaagugcuguguaaauuguaaagccuuaugcaaaggggaguccuaucccugccccgcagagcccagggccucagggaaggggccauauccuccccaagaagacuagaggaggguggaggagggcggagggacgagucagugccagguauggagggcggcaggagaaggaagggcuagugaccaagccagacacccagacggguggggacaaugagcccacucaucaguagugaccagacccagguagaggaagagugucaguuggauguggaaaugagggagguggaucugaagccccgugauauggugcugagccccuacuaugugcaaguugggugcuaacacccacuucccaggaggagggucuggggcuccaaagggguuggggaaaaggcuguccucccucugagucugggugaccaagacaagaugagcugugguguggguaaagguagcagggagucugcuuaucuagggacguuugggauuuaugcuccaggaaagggaucaagauggcuuuggggcaggcaccauagagauuugagccugggcccaggggaggaggccaccauugcucuuccuggccccaccugcuucucagcauacugcuggcaacccggaagcugccagggcaggccugcaaggccaucagguuuuuccaguuugggcaagaacgucuccuuacgcccaugaagaugcccacgcacagccacgcuggccuagagaugaaagagguucuggggguggguggggacaggacgaggguccgaguuugaggcaggcauguuuccagggccccaguuucccagguggcagggcaccuagcagucgauucuccccuaagaacuggcaucaaggaguccagcuccucccguaacuaacguguggcccaggcgagcugcugagugcuaauaauagcagcaaacaccacaagcgugccagguucugcuuucagcacuuuacauauuuuaacuggugaggcaggugcucuugguaccaccccacuuuaguaaggagaaagagucaugccauugggaaguagcagaggaugcaaacucaggccuucaacucuagagucuggaucuaaaccggugcuucaaaaccuggugggguuuuuuaaaguccauuucuacgccucacagacuaauacuuuaucaaccuggcucaaauaucacagcauuuucacauugcuauacaaguuucuuuucuuuuucuuuuuucuuuuuuuuuuuuugagacagagucuugcucugucgccaggcugggguguaguggugcgaucucagcucaccgcaaccuccaacucccggguucaaaugauucuccugccucagccuccgaguagcugggacuacaggcaugcaccaccgcaccgggcugauuuuuguauuuuuucuaguagaggcggcauuucaccauguuggccaggcuggucuugaacuccugaccucaaaugauccacccauuucggccucccaaaaugcugggauuacaggcaugagccacugcacccagccaaguuucuaaggcuacgcuuauguauuuggaagcagucccagagcucgagggucgugcugugaggagcaauguucuaaagcuauuaaccguucugugccucaguuuccauauuuguaaaacagggugauggcaccaguaccagccauaggcugcagucaggauuaaaugacacacugugcugaaaguuggcccagguuggcacugucacucucagggcagccagccagucugugaacgucgguuuugccauuaggaauaagagcccacacaggugcugcccauucagaugccagugcagaaccuggcagggagcaucccaugacuucaugccugggaaagcuuuguaaacugcagagggcuguagcugugugagcaggccugcucauucucuugcccagccugucuuucugagucccaggagaucuuguguuuccuucuucacuuuggcacccagagcugggggcauuuggaggagagaacccacgggguucccaggggcaggcccugagugcuucagagccaggacgaagcccuggcaucagcacagggaggagggugacuugcuuccuggcugugcacaugugagugcgugugggcuucacacaagaagcuucugggcguuuugguuucaggggucggggccagcacggggcagggugggggucccauucuuggacccagcccuucccucugacccaucugagcugcguuuguuugcugaggagugggucauuccagcuggcaggagugugaucccagaaagagauuaucuacacucuggugaggagaguuggaucuuguacuucguuuaggaauguggucuucugagcuaccuggaugaguuguaaaauuucagaaaagagguagcaucugugacgagacuucuagaagcccacagaagaugccuucccgccucuccaggguccuccucagguucuggggcccaagggacccucacagccccacaggcacugggguugagauugcccauuuccuggcaacccaggggcucccguguggaccaaggacuugagcuagaaccuuccgugggaccggguccauucccagcaucucuguccuuccuuacacuugaucucauuacuuuuuccaaguguucguccucuccccacuccuucaugggauuuagauauuuuuagugauagugagaacaugucaaauguuuaggggcccugggugacucauauuguauguguacauauauugugguguaaaggcuuaaacugaccauuuaucagaagccagcccccaguuccaggcauaucccauugcauuaccuuauugaaucuucucuaccauccuguggggaaggcagcuguuauccccauuuugcaguugagaaaacagaggcccugagagaugaagcaacuugcccaaagcaguacagcgaggagguggccaggccaauucuagagcuuccaauugcugaggggccccacccuaccuccauggccuggccggaggggccucaaccccacagucagucgcaccgcaggcagaggggacggaaacccucacaccacuagucacagccagccauucgcuuguuuuauaaucauccccucuacuaaagucacuuucgcccuugggucacacacaugcauuugaauuccagcaucugggacacauggcccagagccuaccacccugcagacagggcuuccaagcuccuacaggucauccucugugauccggauugaagaggaaacuaguuccugcucugggcugagcugaccacguuggguacccuccccugugacauccaugguccugcccucgagacccucuuccgucucuccuucccaggccccacugcccucugguucuccucccgccucuccucuacccugcagccaacaggcugccuuggccuccuccuuugugagcuccuaguaaugagcagacccaggagcuccuggcugggaugcccaucauguggcucccgccuucucugaacuucuuaucugaggcgagcaucucccuccgcagcucaacugcaggguccaguguggguacccaggcuuccaccccuugcauagguccuaccccucagcucacugcaugaaaguaucauuguuaggugacugaggaaggcauggcuuugcgcgcugcuccugccugccucugaugauagccuguguggacggccgcaugugucugaugucugcguguguacgcuaucagcugauacguugcaccagcugucccuccccccaggagauacaugaaggcauuacgugaaugagagaggcauucuuuacuccuccuggcauaaauccguacucgagcugggugugugggugacugcaaaauaaauguugauuacaguaguggcuucgggaggcagcugcugccaggggcucugcuggcauggaggcccagggaggagucauaacacugccaugagaacggagagggcuugugcccaggccauacucuucaccugcccucagaccucagcaccuucccuaccuccugcgcuucuguccgcuuucccuucccuucuccgucccaugcuuccagccugggcaggcccuccucucuggcugggucuaugggggaaggggucuuccuaaucagcuucucccuucucuaggccucccuggaccccuccacccaaccuuuggguaauaaacaccacagaucauccucauuugucuaacgggcucaguuaaacccccuaacaacuccaggaagugagaaccauuaucucaugccacagaugaggagacugaggcacacacagaccaaggugugagugguggggccagacugcagucugacccugcggcccaugcccugaguuuauugccucccaaaguguccauuuauauggaagaacauuccugauaccuuaaguuuguuuuuuuuuuuuaagcacauuuauuuacugcuuauuuccuaugugauauuuuccacuacuauuuugugguucuuaaucuugucucuagccaaauugugagguccugagacuggggaucuuugugccucaccagcacccagcaccagccuggccggaugauaggaacaauaauaauagcaauugcacaggcuggggcaccguggcucacgccuguaaucccagcacuuugggaggccgaggugggcggaucacuugaggucaggaguuggagaccaaccuggccaacauggugaaaccccaucucuacuaaaaauacaaaaauuagccggguguggugacacaugccuguagucccagcuacuugggaggcugaggcaggagaaucgcuugaacccgagaggcggagguugcagugagccaagaucgugccgcugcacuccagccugggcgacacagccagacuccgucucaaaaaaaaaaaaaaaaaauuagcggucacucccaguaacuggguccuuacuaugcaucagcccuuaugaaacacaucauuucccuuaucuccuuuaucuuaaaagcacaggcagacuaggcgcagugguucacgccugcaaucccagcacuuugggaggcugaggcgggcggaucgccugaggucaggaguucaagaccagccuggccaacauggcaaaaccugccucuacuaaaaauacaaaaauuagcugggugugguggugggugccuguaaucccaauuauuugggaggcugaggcaggagaaucgcuugaacuggggaggcagagguugcagugagcugagauggcgccacugcacuccagccuuggcgacagagugagacuuugucucaaaauaauaauaauaauuaauuaauuaauaaaagcagaggcauuuagguuagacccaacuccacuuauucucugguguaccugguaaccgugggugaaucacucaacuccugugccuugguuuccuccucuguaaauacguuuuguugucaagauucugugcuguauaaaaaugaucucaacaggcacaacuccaggcugaaaggaagggcucagugauuagacccuucuccugucacuauacagacaaggaaaccaaaucccagggagguugagacacuugccugaggguguacagcuccuaaguggcagagcuggggguggaggacaggucugcuggacugagaaccauguaucccucccuucuaccaccugcagaggaaggggcuguccuuccccauuuccuccccaccucugcugcuucucaucucccccuccucggaccuugcuccuggggcccaggaggugcugagccagccuuuuaguggaggacuaccaauaccauggccccucccuggccugaucccuggcgcagcaacgcuucucaccugcagccagacacucacacagcucgagggcuccugaagaccuagggccccuuucuucauccccaugugacuuuuuuuugucgcaggggacuugaucccauuuuccaccagugcaucucuucucuuggucacuuugagaugcuggggccacagccaucaucgguuugcuucauuuucugcagucaaucuccauucccagaucuuuguuucuccugucauuucugaucacucgagauuaaaaacagcaauggagaagccaggaggaggcugagcuaaggaggacucggagugaugugaccucaguccucccaggaacacaggaagaagaggaguaaauggggaagaaugugauuauaaucagcuccaauccugccuuuaucucuuacuggcucugugacguagacaaaucacagcuucucuaagacucaguuugcucaucuguaaaaugaaaauuaaaacgucuaucuugggccugguucgguggcucacgccuguaaucccagcacuuugggaggccgaggugggcagaucaucugaggucaggaguucgagaccagccuggccaacauggugaaaccccauuucuacuaaaaauacaaaaaaacuagccaggcguguuggcgcaugccuguaauuccagcuacuugggaggcugaggcaggggaaucgcuugaaccggggaggcggagguugcggugagcugagauggcgccacugcaccccagccugggcgacagagagagacucugccucaaaaaauaauaauuauuaaaauaaaauaaaauaaaaugucuaucucccugggacagccugucccuugugccugguccauaauaugagcucaguaaaugauggcugaaaagaaauuagaaagagguggcaaccuuucauucugccuuaaacucggggcacagacacaugggugggaaagcccaugaauuuugcuuucuuuacucagaggcaauuuagaaacauagaagaguguauuuuggggaauuggugaaucucaccauccuguuuggagugagggagcugggcacccugagcauuugcugggugccucagccuggggccaggcccugugucucauucacacaaggcaagguagggccugaagaggcagcaugggguggugaaugguuggguuucccuggacagcagugaauuccuuuuuuuuuuuuucuuuugagacacggucucacucugucacccgggcuggaguacaguggugugaucacggcucacugcaaccucgaccucccagacucaagccauccucccacucagccccccaaguagcugguacuacaggcacgugccaucauggccuguuaauauuuuguagaaaugggguuucacaauguugcccaggguggucucgaacuccugagcucaaaugauccucccuccuuggccucccaaagugcugggauuaugggugugagccccugcgccagucagcagugaauuccugccuggagcuggucaugggggauuucugcacuggcuuacccccugcucuagguccugcccuugcuucauccugaugugggugccggcuucuccccuacccugaccucagagaagcagggccaggcucucugggaugccuccucccagggagcccccccaacacacacuucccacccguguguuuuccuccucccuucccuaggugaggucaauagagaagcuucccuguggcaggcagggguccguucugggguuugucuccucccuccuggccacuguggggagucugacccuuagagaugacccgagagagagaaggccgggacugaucuggagaagcccuggcugauggaaugggguuucuuuuucccuccuuucuuccuucuuuucuuuuuuauuuuuaagcaaaagauaaauaaaugucacccugagaugacaagagaacauugaaggagauaaaaggagaguaaaagggagcgagagagcagaggcaaaggacagagggggauuuggacuguacacugcgaugaggggagagaugaaagagggaagaaagagaugagaugggaaggcaggaccgaguggcagagcggaggaugggguugccacggaaaccgaaggaggggaggaauggagggagaggaagaugggauggagaaggcggagggcuuggugcaggaggggucugaggcgagucuuggugaggaggaagggaagccaugaggggcucccaggugugaauuaggccccggugugggaaaacagguuggcaggggaggaagacaagacccagaaagcccaucccugagagcugagguggagagggcugggucucggcccugggcccacccagcuggggccugcucuauccugccugcaggggacugccucaguuuccacgucuguauaauggaaaugguaccccccaucccagaggacugccccgauggcuagaaauggugugcuuucaucccaggcccugaugaaguucaagcgcagugaaugguccuauuguuacuuccuuugauucuuaucuuuguccccuugaacuugugagcugaaguuuugucugcuuuucccguuacacgaagcuggugaucucuggguccaggauaguguacuuguuugggggacagaugugcuucuuugcuucuggacuuggaggaaagauauggagcccucuggaaacaugaggccugcugccccucccccucggaacaggaacuggccauaaagcucagggaaaagaggcgggcagggucuaucuggcugcuguccaaagcuggucucggcaaggggccucuuuuuucuuugcccuugaauauggguauucucgaaagggcaacaauuuauucuaucuguguacucugcuagggaugcaguggugagcaaacaggcaaggucucugcccuuggagaauguaaucuaacugggaugccagaaucuaacugggaugguagcuauuaggcaaguaauucuauaaauaaauaaaucauuaacaaaucauuuaaaguuacaauaagguccaggaaggaaaaguaugaaauuugagauugcacaggaccuggggucuagaccuggucaggguggggcaggggguccgggcaagcuuccugaggaaguguuaccugggcugaaagcugaagggagaggaaugaggaagagcauuccagguaggggaaagcaugugugaagaggccgugugcaggugaggucuauuaaagaacaucgaugaaguccacguggcuucacauggagggaggggacagcagcacguuguggacuugucauggaggcagggaccaaccagacaaguucuggaggcccuuggugagauguuugggcuugauugcaagagcaaugggaggugacugggauguggagcaggugggaugucgugaccgauugguacaagcauaaggcuugcuucagucuucucucuuuugacugacuauuagcaugcuagggcaagggacagcugcguggcagaacucuugagagcucaaaacauuuccugcagguggguugaaugguggaaauuccuugccccguacaaucuccugugcacaccuucaugguccccagacgguagaaggcaaacagucuggugggagagccugagcuggggggugacccccauguuugacauggauagaaggaaacacaaggagucaagagcuccacaggcacgguggcccacgccuguaaucccagcacuuugggaggccgaggcagguggaucaccugaggucaggaguucaagaccagccugggaaacauggugaaaccccgucucuacuaaaaaaauacaaaaauuagccaggcauaguggugcacaccuguaauccuagcuaucugggaggcugaggcaggagaaucgcuugaaccaggagguggagguugcagugggccaagaucacaccacuacauuccagccugggcaacagagcaagacuccaucuuaaaaaaaaaaaaggccagaugcagugguucacaccuguaaucccagcacuuugggaggccgaggcggguggaucaccugaggucggaaguucaagaccagccugaccaacauggagaaaccccgucucuacuaaagauacaaaaaaaauuagccaggccgugguggcgcaugccuguaaucccagcuacucaggaggcugaggcaggagaaucaauugaauccagaaggcggagguugcggugagccgagaucauaccauugcacuccagccuaggcaacaagagcgaaacuccgucucaaaaaaaaaagagcuccagauuaguccugacugagggguaggggccuuggggucuugguuuccauaucuguaaaaugauggcauuggacaggaggguccccaaaguuccuuucagcccugccggugaagauuccaagacccacagccaaaguggcugaagcacagggucuucagcaaggccaccauccugccaugggagagccaagcaucccucccuugcaguaaagaagcacgcaugcguuuacugggcaugugagcugcgaggugggaggaucaggcccauggcuucugggauccuggugucuucagaucauaggcggcacauuacuccuguacuuagcaucaaagagaagcuaccaugugcuuuuuaugcagcucugcaggcagcucagcauuugcccacaguaauuugugcagcagacgcccuguuaguuuaggcaggcucauuucuauaagaaccagaggcccacccaacucacuucagggcuaagggggguugauugccagcgaggguuccccaggcuaggggcaggggcugggcaccauccagaaucccggugccuucugggaucagcauucccuugggcucuccucagacacccaccccgccacccccacuugcccaagcucucugccccuuuguguucuggccucacucuaccccauggcgcuccuuuguguguucuuugcacaucugcuccuguggcugauggacugaggcuuaaugcagagccauguuuccaagagaggaaacuuuggcccaaguucuuucaggggauggggagggccaggccauaggucugggcccagcuucuguaugaacugcccuagaugguggggguaugcuaugcuuggaggcccagggcuggaaguggggcagcugccauuaggcgaaggugaggaagaaggcaccugggguggggaggggccucccacuugauucaccaggcaaggccaggucaccgagaguaugcgucaacucuugcuaauuaacuucgaggccgggcacgguggcucacaccuauaaucccagcacuucgggaggccaagcuggguggaucacuugagcccaggaguuugagaccagccuggguaacacggugaaacaccaugucuacuaaaaaauccaaaaaugagccaggcgugguggcgcgcuccuguagucccagcuacucggguggcugaggcacgagaaucgcuugaagccagaagguggagguugcagugagcugagaucaugccacugcacuccagccuggguuacagagcaagacuaaauaauaauaauaauaauaauaauaauaauaauaauuuggagaaucagaaucacuuaagaagccucuagaaaaucccauguccaggcccugaacccagagauucugguuuaacuggucuagagugagaccccgguauuggcauucugaucaaacgauaccaguucuggaacucuguggacccagggucucugucuucacaagaguuugugucugagaagucacaucaaaauaguucaugccucgacaugggggcuucaccccucauauccuuggguuuuaggguacugugaccucuuagaggagggagauccucacacaggggccacccuguggcagucagacccaccucagcccucagcuuauagaagcagaggcguggcucccaggucagguguaggugcacccgggccuggggaauggaucaagagagcgaggguugucagagcaggcccugugggaggggcucucucaccugggagggcgucaggugagaaagcacucagagcuccugggccugagcuccuggggacucugccauuagcaggggaaggcaaggaagaaggcacuugggguggggagggcccucuggcuugauucaccggacaaggucaggucacugagagugugcaucugcucuugcuaacuaauuuggagaggcccuucccuaugcugccuggacaccaccccaaggaggaggcaggacuguccugggagugaggugcucagagaagagcaaagccuugguagaacucucaggcaagaguuucacucuccaucucacuuaccgcauucagucuuggucccuuggcgacugucaguuuccuucucuucccuuuucuguacgcuggugucuuucucuagagacacucccgugcugggcccccucuguuccucugcagucacuguccuguggguggccuggcugucaggggagaugauccacagugugauuauuguaucagucaggguucuagaguaagaaauagaaccaguaggagacacuauauauuuauauauauauauauauacacacauauacacacacacguacacagagaggucucuuuuaaggaauuggcuccugugauugugggggcuggcaaguccaaaaucugcagggcagacccgggggcuggaaacucagcaagauucauaaguuacagucucaaggcagaauucuuucucugggaagccucaauguuugcccuuaaggccuucaacugauugaugcccacccacauuauggagggucaucugcuuuucuuaaagucaaccgauuguaaaugugagucacaucuacaggauaccuucauagcaacaucuagcuuagccaagcacacagccgggcaccauagcuuagccaagaugacgcauaugauuuaccacgacagugauggucucaggcugagagaggguccucauccuguccucauguacuucaagggaagcagugcuugcacuaaauccucaaagaugaugggaaauucacccaguucgagggaagggcaguccuggcaggggaaucagccugugcagaggccccaagguaggaaacaucggugaguugggggcagaggggcaguggagccugccugggagccaucuugggcagcaaaugaaggcaugggcagugcaucccgccuaccaaaaggcugugggggcugcggggccggagaccugcauucuagcccuugcucccccaccgucucacugugugaccuuggaccauucccuuccccucccugggccucaguuuccucaucuguuaacagggccggguauggugcgcaucacggggguuuguggguugguggcccugugucaggggcccagccacucugacucccagagguggggcucagugaaucuguccacagagaaaggggaagcaaggcagagacaggaucgcaggaggaagagacucucgaacuuccccugccccucccccgugccggcggcagcucccugggccucuggcuccugaggccugugggcugggcagaagugagacuguggcaaggggccccgaggcacaggccuuccagcucucgcuuccucuucccuucugcgcaugugaguagaguuucccuugaagccuccugcgaggaggacaacaggggaaaccaagaggcugguuuccuuaggcggugaaaucccgugcauguuuuucacagcggguguacaggccuggaacuuccucuucuccucccaccugguuaccugucccgcccacuccagcuucagccucuccagccccagggcccuggacuccaaggggcaaaaggcccagagccacauccuggagggcuu

SEQ ID NO: 15240 - RNA, 1509 nt, Homo sapiens
aaagucuaggcccucuucagagcuggcugauucagcuugccaacagugacaucagggugaggcuuccucuguccacagcauuagcugcgaauauccucauggucacaagauggcugccaguggccgucagggugugugcuuccuuguucacauccaguggaagagugacagccugcuccccuuagcucucugacaccaaugagaaggugcuaagaacuuacuagcaggccuuuccucaugacccauucaacaggauugggucacgugccuauuccugaaccacuaauugggaagggaugggauuacucuuagaccagugguucucaacugagcaugaguuugucuuccaggugacaguuggccauguuuggagacauuuaugguugucacaacuggggugaugcuacuggcaucucauggguagaggccagggaugcugucaaacauccuacaaugcacaggacagccucacaacaaagaauuauggcccuaagugccaagguugagaaagucugccuuagaccugucagggcugcccccagccuggggucuguuucccccaaaacacgcacaucucagcggacagggccagaaugcacuuugggggccagccacagccccugccagccucccaguucccccagauccuacccugggcuuccccuguaagagcuuuauaaugagauuucaauuuuauaaaauuauaaggggccucuuaggaguuuuugccugacauaucuuuaugaaccuacccugaguguuugucccuggagagccaggcccaaggauaccaauggcuagaaccaacagaaaagcacagcugccggcaggaggccucacccucccgcagugugaggcagagcagcacaguggcucagaacaacagcaugugcugggugaccuuuggcaaguugauucaccucucuaaaccucagccuucugagcugcuaaauggggcuguugugauugcuggaugaggcgaggccugcgaaguggcuggcaugcagcaggugcuaaugagugcugcaaaggugaugucacgcaggcagcuucccguggccagagaaacauugcagagaagggauaaguagggcuuagugacuuugacgggucaauggaagaaugacccaaagaaggcuucaaggccaggccugcaguucuccaccacaaaggcccucacugauagcacccacucccccacacucagcuuuggggccuaggucuggucacccagcuagaagccacaggacccugaggcguccgagggugggaaggcugagaggcagcugagacuccuggaggccgugacugggaagcccucucuuuagaaaggccaucagcuuccugcgugggggugacuggcuccucccgagagauggcagccaggucugacugugccccucucuuacagaccccaugauggagcugacaggcacugacccuucagagcucgacggccagcaggagauggaggacuucgaggagaacgccuacagcuaugcgagcgug

SEQ ID NO: 15241 - RNA, 19622 nt, Homo sapiens
cugcugcacccgggcugaauuugaggcccuguaccaagucaaucuguccgcucuuccgcccccgcccauccucaggugagaucuccaaccccagagccacuggaacaucgacaggguguuccaguaucuggggcucuguuccuaaauuauggggugguaggcuuguaacuuacagacuagugaagggacagaccgcaacagaaaaucauguagaucaugauuacaauuacaaaggagaaguucagggggcugugcaagcugguaauggggagccauccugaaucugcccauggguggcucuaggaugagcuccuaaauucguaugcaaauguguguauguaagacgacacuuauuuggggagggaguccugagcuuucuccggacucccagggauucuguaccccccacagagcgcagcagcgagagcgcggucggggccgggauccagauacuuuuucucucccgcaggggcccaggcccgcuccuagugcugggccucuacaaccuacugguugugacccugaugaccguagaccucgugcacuucugcugcggucggggccggagucugggcuggagccaccgcaggccucccucuggguccuccgccgcgagcucccugcaggucucugcggggacagcuuaggugcgcccggagcuugccugcaccugcgauccagagccaagcgccccgccccugcccgggcgcgcucccuccuuagcccugccccucucugaccccaccuccgacgcaagaguggggcggggcagcugccgguggcgucccgaacccagacucgccccgccccagagacugcgccugcgcgggcacgagacaaccucuccgcgaugacugugagugguccagggacccccgagccccggccggccacccccggggugcguacccaacccccgcgccaucaccccuucgcacccgcccugaccaucccuggccuccuucuccccauccaugaggcucgccccgaucccuccucuccucuccccuuagcucccgggcucugccccgaacccccuccgacguuuccgcccccuuucucucuacaggccagcucaguggagcagcugcggaaggagggcaaugagcuguucaaauguggagacuacgggggcgcccuggcggccuacacucaggcccugggucuggacgcgacgccccaggaccaggccguucugcaccggaaccgggccgccugccaccucaagcuggugagggagccuggcgcucuuccccucgcccgcccgggccccgguucgcccaucuaagcugaugcuugggccccagcuggacauucacgcucccaggccauccccgcuugccagauguuuuuugcaccucaggguggugggggaucgggugaccuuggagagcgagaguaccccugcugccugguuagugccccgagagggagaugaccauuccuucaggcuccugucuuucucuuacaggaagauuacgacaaagcagaaacagaggcauccaaagguaggggaauggugggcccugguguggagcuguagggcuucuguggugggcaaggacucugggaccgcugcaccgucacauucuccuccuuuggccccagagacacaucugccuucuuucuuucccacugccucgggccuuuccuuuucugcagcuacccucaccuuuucugaggcugaagcaccgagccccacauucgucccccccaccuucuucuggccuuuccucgagaucuuucccuacugcucuugccuggagacaguggccucaugggugcugacagcgcuccuguuugugcucagccauugaaaaggaugguggggaugucaaagcacucuaccggcggagccaagcccuagagaagcugggccgccuggaccaggcuguccuugaccugcagagaugugugagcuuggagcccaagaacaaaguuuuccaggaggccuugcggaacaucgggggccagauucaggagaagguaugugagugacccagagagguggaagcauugacugguggugaaggggucugggccagggguguagacacaguucuccagacgagaucccgguggcaagugaaccuugccuguggccagggaaaagcaaauuaagaugacagcacauuacuguugauuuggaggucugucuggcagauauuuaaaaguuuguacacuuuucgagaaggagagaggcagacacaucaguggugaggcugggggccaagggcucucugaugacugcuggagggguauaaauugguacagcucuuuucgagaguacuuuagcauaucuauucaauuucaaaugagcguaucuugugaucccauauguuuacuucuugcuguuucucucagagaaaccuuguccacgugcacaaguagacauguguauguuuauuucagccuuuuuuguaguaagaaaaacuuggaacuugccugaaugcccagccauagaggaauggcugaauaaauggguaauguccuuacuacagacucuuauauaguuacugagaauagguagauacacacauauugaaaugggaagcucugggacacuuguugaaugaacaaagcaaaauaggcagggcauggugguucaugccuguaaucccagugcuuuuggaggccaagaugggaugaucacuggaggccaggaguuugagaccagccugggcaacauagugagacccuguugcuaccaaaaccuaaaaaguuagcugggugugguggcacacccuuguagucccagcuaccugugaggcugaggcaggagaguccuuugagcccuggauuuugcaguuacagugagcuaugaucgugccacugcacuccagccuggcugacagagugaggcccugucucuuucaaaaaagaaaagaagaagaaaaauauacaauaacacauauaguauaauaucauuuauguuaaugauccccuacauagcaaaacaaugcuauauuuuuucuguggguacacuuggguauguaaauacaaaggaaaauaauuguuuuuuuuuuuuuugagacggagucuugcucugucgcccacacuggagugcaguggugcgaacuuggcucacugcaaccucugccucccagguucaagugagucuccugccucagucccccagguagcugggacuacaggggccugccaccacgcccggcuaauuuuuuguauuuuuaguagagaugcgguuucacuguguuggccaggauggucuggagcuccugaccuugugaucugccugccucggccucccaaagugcugggauuacaugugugagccacugcacccagccgaaaauauuuuauuuuuuaaauuuauuuuuauuuuuauuuauuuauguauuuugagacggggucucacucugucacccaugcuggaguacaaccucuuccucccgggcucaagcaguccucccacuucagccucccaaguagcugggacaaaugcaugucaccacgcucgccuaauuuuuauauuuuuuguagagacaggguuuuacuguguugcccagguggcuggucuugaacuccuaggcucaagggaucuacucaccucagccucccaacuggcugggauaacaggcgugagccauggcacugggccaaauaugcauuuuuguuucuuuauuuuuucaggaaaauauuuuaaaagauauacaucaaaaugauaacacggugaccccuggggaaaggaaugggauugagagggcuuuccaaaggagacugcaucaccuguucauauuuuuuuaauaaagagaaauuguguaaaauacguauauuuuuaaauuaggagaaaagaaucuaaagaccauuaugagcuacaaccaagcucaaauucgccagauaauuugacguuaaaaugcugacacaguggaagcagauaacaugauggcagacaccucacugaaauguugaagccugggaaagcaaauagguuuccucucucaaugccaacucugauuggcaguggcugcccagaguccuauguugagaagaauuaggaagcagauugccugagccaagcaggggaacgugccaugacugguuagucauggcugccauggaugcaagagaggaaggcgggugguccacaugcuaggcuugugccaccaucuaugcccaggacucuggggggugggggaguaggccuaggaugaucuuccccauucagauuauuuauuuauuuauuuauuuguuuguuuugagacagucuuauccugucacccaggcuggagugcaguggaucucugcugacugcaaccuccaccucccagauucaagcgauucuccugcuucagccucccgaguagcugggauuacaggcacccgccaccacaccuggcuaauuuuuauauuuuuaguagagacgggguuucaccauguuggccaggcuggucucaaacuccugaccucaggugaucugcccaccucggccucccaaaguguugggauuacaggcgugagccaccgugccuggcuucagauuuuauuuauuuauuuuuuugagacagaguuucacaguuauugcccagguuagagugcaguggcgugaucucggcucacugcaacuuccgcaucuuggguucaagugauucuccugccucagccucccgaguagcugggauuaccggcaucugccaccacgcccggcuaauuuuuuguauuuuuaguagagaugggguuucaccuuguuggccaggcuagucuugaacuccugaccucaggugauccaccugccuuggccuccuaaaguuuugggauuacaggcgggagccacugcgcccagcucagauuauuuuuaaaacagugaaaagagaauucuggagcuaaaggaaguguuagcaacuaccucacgaucugccagcucccuggcaggagguauaaaugcugaguucagugccaugggaagcccauucacgcugccacaauguagauggcaccacugggaguggguugccucguagcugacaggauaccuccccuccgaaaaggcacuccagcaucggcgcagccccugcugcccaagcaggaaauagcucagaaagaaaaacaggugcgggaaauuuaggaggcacugccaggcaagucucuuccugcccaggguagcuaggugcuagcccugagccuggacaucuuuacugugccucccagagugaggagcuggagacaaaugaauagggagugugaugucucuggccaagagccgugauuuguuccaugcuuuguugguuugucuaggugcgauacauguccucgacggaugccaaaguggaacagauguuucagauacuguuggacccagaagagaagggcacugagaaaaagcaaaagguauaggcccugggcugagucagugagugagcucccacuagagccacccauccauaggcccccgaagccacugcugccuugcucugccgcuccuccaaucgugcagcugggcucacggggccuggaugggagcucugagggucuggggcuuuagcgugaaccaaggaaagagaaccaguguucacagaguaccuuguuggccacgcccugugccaggaacuggguguacagagguaacugaggcacugucccagccccucaggcucugcuggggacucauuugcucuaaccaucaaucccgagagaaggcucuucccucuauuuacagaggaagcuaaacuucaaagagguuauuuuuuggccguggucacucaacugugaaguggaagcagagagguccagggcucggggccccugcucaccagugcugcauccuaugccgugugcagugucaacauuauaaugugcuuccuuugacgcaggcuucucagaaccugguggugcuggccagggaggaugcuggagcggagaagaucuuccggaguaaugggguucagcucuugcaacguuuacuggacaugggagagacugaccucaugcuggcggcucugcguacgcugguuggcauuugcucugagcaucagucacggguagguggaguggagaggcugguuacagcuucagucccuuugucugucuguccauccauuccuccauccacccaucuguccauccgcccaucugcccguccauccauccauccacucuuccacccucuaccccuuaccuuauucuaaaaagaacuuagguagguuauggugccucacaccuguaaucccagcacuuuggggggcugaggcagguggaucacuugaggucaggaguucaagaccagccuggccaacaaggcgaaacccugucucuacuaaaaauaaaaaaauuagccgggcaugguagugcacgccuguaaucccagcuacucaggaggcugaggcacgagacuugcuugaacccaggagguggagguuguggugagcugagaucgcgccacugcacuccagccugggugacagagcgagacuaucucagaaacaaaacaaaacaaaacaacaaaaaaagaaaaggcagaguacaaggagauacauguaacaagagagaaaaaauaaaaauggcgugaaaaagaccaacauaaauuaggaugaagugggguagaaagagcaaaaacagccuugggguaccccaagcacuugcuuuguagggggcuuacaagugugagccccagcuuuccugcagccaacucacaaaaacacauuggucacugacuccuucaauguccauauggcacaagcaagcucauggcccagaaugugccuggccaccacagcaucuaccaucgagacagugaccggacacguagggcuugaucccgacaugauucucagcauggauggugguggcccagcauggacagugcagcaauaacaguccugcuccugggccaguguggugaaguccaugcccccagcucuuaccugagcuggcuugcuccaggggagaggggaccaaagacuaggcccuugguugcuuuuagaggagcccacaauuccuagauaggggugaaacugugaaauagucaaugaaaucucuuuaggcuaagcuugggcugcauucugggucucccaaggcuaagacuguuaaaagcaugugcauucuguucccuccugccuuccgguccauuccaguucacagucuuggccaaggacacuuagcugcuaaguggaagcagucaggauuugggcucaguggaccaagcaggccuucuaggguucuccagcuuagaaacaggguggagagggcccggcgcgguggcucaugccuguaaucccagcacuuuggaaggccgaggcgggcagaucacgaggucaggagauugagacaauccuggcuaacacggugaaaccccgucucuacuaaaaauacaaaaaauuagccgggugcgguggcgggcgccuguaaucccaguuacucaggaggcugaggcagggaaauggcgugaaccugggagguggagcuugcagugagcccagaucgcgcuacugcacuccagccugggcgacagagcaagacuccgucucaaaaaaaaaaaaaaaaaagaaaaaagaaagaaacuggguggagaggucucacgggcccauuccguguacgugacguccacauccccaggguguggaaagaaccucaggguuuagacuggggaagaacuagaccauuaagccugguggucagguagcuucgucuagguauaggucuuuuucuuggggaggcaugagcuaaggcagcugcucccagggcugcaguauacuaugucuucucuggcaccaaggagagguaguagggcauugccguguaaugucuccuuuaggaaaucuuucuaacaaaauuauccugccauuacccugggucaugccauccauucuguguuguuuucaccuggagcugggccuuccacccaauucucuccuucuggccguauccucuaacucacaguuagggaucucuguggcugcccuucaacaacuggaagcuuccuucuguuuaccucucccaccccagacaguggcaacccugagcauacugggaacucggcgaguagucuccauccugggcguggaaagccaggcugugucccuggcugccugccaccugcugcagguuauguuugaugcccucaaggaaggugucaaaaaaggcuuccgaggcaaagaaggugccaucauugugggugaguggaagcaggucuggggucuuuuggacguuacugucauggaagggauggggcugagccagccaggccaguuuuuuggggaccagacuugcagcugcagguuguuuggaauacgguuuggugacauuauuuuacucuagauucucagcaaccaaggugccucaggacaaagcuggagcucagucuggagccugggaugcggauccccccuucccugugucucccugguuuguuggagaaguugaagggucaaacugggcugggcugcuguggagcccacugaugucuucuuguuguugccagauccugcccgggagcugaagguccucaucaguaaccucuuagaucugcugacagaggugggggucucuggccaaggccgagacaaugcccugacccuccugauuaaagcggugccccggaagucucucaaggaccccaacaacagccucacccucugggucaucgaccaagguaggugauauaguucacaaaaacuugcuucagcagcugaaguuuguuuauucuuaggaguaauaagaaaaguugugaguggggccaggcaugguggaugacacacuuugagaggcagggggucacuugaagccgggaguuugagaucagccugggcaacauagcgagacccugucucuaugaaaaauuaaaaaaaauuagcugggcaugguggugugcaucggcaguccuagcuacuccagaggcugaggugggagaauuacuuaacccugggaagucaagucuucagugagcugugauuguaccacugcacuacagacugggcaacagagggagacugucucaaaaaaaaaaaaaaaaaaaagaaagaaaaguugugauuaucuccagccacgugucugcacugaagugcguccuguggcccaggaggaugcuggagcugagaagaucuuccagagcaaugggauucagcucuuacaacaccuucuagacacaagagcuacccuuagggggcucaaaguuagacucuucuaucauaugcgugugcacauacaugcacauugagcgggccugcaagcagguuagcagagaggcuggauuagcuuucuguauuuuuuuuuuuuugagacagagucucacucugucgcccaggcuggagugcaguggcgcgaucucagcucacugcagccuccguuucccggguucaagcaaaucuccugcuuuagccucccgaguagcugggauuauaggcacgcaucaguaugcccggcuaauucuuguaguuguaguagagauagaaucucaccauguuggccaggcuggucucgaacuccugaccucaaacaaugcacccaccuuggucucccaaaguguugggauuaccgucaugagccauugugcccuguuuuuuuuuuuuuuuuuuuuuuuuuguuugagugagcauguauuacuucuauacucagaggaaaaaauaacgguagauauaucaauucaucucucuuuuccccuaaaagauaaauaagagcugggcguggugccucacgccuauaaucccagcacuuugggaggccgaggugggcagaccacaagaucaggaguuugagaccagccuggccgacauggugaaaccccgucucuacuaaaagauacaaaaaauuagccaggcaugcuggcaugcaccuguaaucccagcuauucuggaggcugaggcaggagaaucacuugaacucaggaggcggaggcugcagugagccgagaucgcgccauugcucuccagccugggcaacagggcgacucugucuuaaaaaaaaaaaagauaaauaagaaaagcuuugcaaaggccuugcaugagcagggccuuucacaaugguccuaugagguguggauaucguguucacaguggucccacgagguguggguaucguguucacaguggucccacgaggugugucuauuguguucacagugguccuacgagguguggguaucguguucacaaugguccuaugagguguggauauucuuuuccccuuaguuuuacagaugaggaaccucaaaagcuccagagcguuuggccccaggggcagggcuggcaugcaggccucacuucugagguccuucccgauccuacagccgccucccuuagguagcagaucagcuaagcagauucuccgggcugcccuggacacaguugucagaacucuguagccuucuugucuugcuuuucuccacaucuccuaggaagccuguuucuuuuacuuguagggguuggaacuaguguucuacugucuaagcggggugucuuuacaggucugaaaaagauuuuggaaguggggggcucucuacaggacccuccuggggagcucgcagugaccgcaaacagccgcaugagcgccucuauucuccucagcaagcucuuugaugaccucaagugugaugcggagagggagaauuuccacagacuuugugaaaacuacaucaaguaaggaagucuguuucaccucccguugccagggauucuagcgaaaaaguucugacuccuugaggaggggcagaaaugaaagguuuccagcagaaacaguaaucuuggggaggacuaguuggaggcugaacaaagggaaaguggccccaaggcccacuuccugcuccaaaguggccuccgcagggagguucuuucucaagucaauguuccaauaaugcaacaaacgccaucaagcacguacuggguuuaccaaacacuuccuacgcuucuguucccacacagaugaaacaugacaguccuuuuuuuuuuuuucuugagacagaguuucacucuuguugcucaggcuggagugcaauggcaugaucucaggucaccacaaccuucgccucuaggguucaagcgauucuccugcuucagccuccugaguagcugggaucacaggcaugcaccaccacacccagcuaauuuuguauuuuuaguagagacgggguuucuccauauuggucaggcuggucucgaacucccgaccucaggugauccgccugccuuggcuucccaaagugcugggauuuuuuuuuuuuuuuugagauggaguuucgcucuuguugcccaggcuggaguacaaugguaugaucuuggcucauugcaaccuccacccucccagguucaagcaauucuccugccucagcuucccaaguagcugggauaauaggcacccaccaccacgccuggcuaauuuuuguauuuuuaguagagaugggguuucaccauguuggccaggcuggucucgaacuccugaccucacaccugaggugaucugcccgccuuggccuccuaaagugcugggauuacaggcaugaggaccgcguccaggcgacaguccuuguucuuaaaggagauuauaggccaggugugguggcuuacaccuguaaucccagcacuuugggagguggaggcaggugggugaucaccuuaggucaggaguucgagaccagccuggccaacauggugaaaccccaucucuacuaaaaauacagaaaauuagccaggugugguggugggugccuguaaucccagcuacuugggaggcugaggcaggagaaucgcuugaauccaggagguggagguugcagugagccgagaucacgccauugcacuccagccuuggggacagagugagacucugucucaaaaaaaaaaaaaaaaaagaaagaaaaaaaauuaaaggagcuuacagcuguuggggagaaaacugaugauaaauuaugaaauaagccgaaucauuucagagcuuaaguccaggaagggacaucacuggugguaugggaguaaccuguauuagauacuaugucagggaaggcuugagugaaagucgauaaagaaaaucagccauuauuguccagguggaaacguccuaguccucccauuggcagcuuuccugcuguuucugcccaaguagugcaggugccuggccaguggaggggaagggagggaagaagagucccuuuauguuggccuuggugugacggcugucacccugugccccucaggagcugguuugagggccaagggcuggccgggaagcuacgggccauccagacgguguccugccuccugcagggcccaugugacgcuggcaaccgggccuuggagcugagcggugucauggagagugugauugcucugugugccucugagcaggaggaggagcagcugguggccguggaggcucugauccaugcagccggcaaggcuaagcgggccucauucaucacugccaauggugucucgcugcugaaggaccuauauaagugcagcgagaaggacagcauccgcauccgggcgcuaguggugagacggugggccuggggugggugggcaggcagccaggcagggguccugguccagccgguguugcaggguguggccccagcacacuccagaugaaaauaaggaauacuguaaugccaaaaaaauuagcuaggcuugguggugcaugccuauagguccagcuacuugggaggcugaggcaggaggaucacuugagcucaggagguugaggcuguggugagucacgcaugucacugcacuccugccugggcaacacagcaagacccucucuaaaauaaauggaugaaugaacgagauucugggcuuucuuguggugagagacaucggcauggcuccucccuccauggggcuuaagacugggccugcaggggucaugcaguguuccugggagcuggugguuuggggguuuggggacuaccuggcccuccaugagccuguuguggcugugcacccuguggaagcuggucuuccucccuggggcacucaguccuggauuucuccaucccauaaggauuuggcuguggcugaagcaccuguccucuccccacaugccucucaacuccaccugcagagggcuucuuugugcgacauggaaggaaacagagccauucucaguguggccugggaagggguggggcccacgacuguccagcggccagcgcaucagugucugcagaugcugugucaugcggccaccccaguagcugauuuucuugccacaugcucuaggugguggucuggagggagagggugcugauuugucuguguagcuuccagggggccauggcagagugccagggagggaguccaagccagguguggaggagcucagcuccugccuccuuccccagaggccaacuggucuugcccucuuccuccagggacucuguaagcucgguucggcuggagggacugacuucagcaugaagcaguuugcugaaggcuccacucucaaacuggcuaagcagugucgaaagugagucaucuggccuugcugugguuccccaccugugggguagaucucaagacacaggggucuggguggggguuggggccuccuccguccugcucucuggcucaggcaggggcugcagucuggauccugguacgugaacugcuucuguacauugaggggaugcccaaacccuugguuuuucccccuuggccuugguguaccccuccguacccccaauccugagggucguccacuauccugcguguccccagguggcugugcaaugaccagaucgacgcaggcacucggcgcugggcaguggagggccuggcuuaccugaccuuugaugccgacgugaaggaagaguuuguggaggaugcggcugcucugaaagcucuguuccagcucagcaggguagcucugugguuccugccgucagccuggggacacugucuaggauuagaccuuaccaggcuuucucggcagggcuuggccaauggggucuuuugaccccagggaagagggcugguggcugaguggcugcucuguguagugugggcauguuggccagcaccagugguguuagcaaggacguucuucuuggaggagcuggggaggucaaguuuguaagcucccaaagucuggggccugggaguuucccgaauucauccuguacccaagggucccagcugaggguggaauugggggccugggccugggcagcauuuaucugaguacugcucugccccgggaugcccaugugaauuccucuguguccuggcaguuggaggagaggucagugcucuuugcgguggccucagcgcuggugaacugcaccaacagcuaugacuacgaggagcccgaccccaagaugguggagcuggccaaguaugccaagcagcaugugcccgagcagcaccccaaggugaggggccgccagaggggcuagaggguuccccaccauggggacagcuaacccagggcauccacagcagaacaaccucccuuuuuuuuuuuuuuuuuuuuugagauggagucucacugucucccaggcuggagugcagugaugcgaucucggcucacugcaagcuccgccucccggguucaugccauucuccugccucagccucccgaguagcugggacuacaggugcccgccaccaugccuggcuaauuuuuuguauuuuuaguggagacaguguuucaccguguuagccaggaugaucucgaucuccugaccucgugauccgccugccucagccucccaaagugcugggauuacaggugugagccaccgugcccagccaacagccucccuuuuaagccaguuuguuuccuuuugucuggcuguuuuauuucccaguuccucaauuacugcugugagaagggucccccuuucucugugagucagccuaggccccucuccuaagcugccuccucccccaggacaagccaagcuucgugcgggcucgggugaagaagcugcuggcagcggguguggugucggccauggugugcauggugaagacggagagcccugugcugaccaguuccugcagagagcugcucuccaggugagccagccuugguaggagccaaccuuucccaacuccugagccucagggcugcagauguggcuccagagggugcagguuccagugcugugggccucuuagagcgacgggggcugccugcguggcugccgucuuugcugagccuaggagugcagcgucugccugccagagucccagagcugccugcccaccaccgccuucuccccacagggucuucuuggcuuuaguggaagagguagaggaccgaggcacugugguugcccagggaggcggcaggguaagcugguuuacacaccccuuccugauggcugagccaucagccuauaaaacaugacucagcagcugccacgccagagcuggguguuagauauggaacagaaaaacauuaauggccagaggaacaccgucccgcugagagagugacgcggaagcaggcaagcuccuuggccccuccacacuggugccugugaagguccuaggcucuacuguuccuuugucucauuuacccccauggcccuggugcucagcacaauccauguccagcccuuauuagguguuucaggaaguguuuggaugcagagggucugcacagggagucaagccuggggagagggaggaaggugaggguggcacggucagggcuggggagcccgauggucggggucuuacucccagggauguccugagcagugacgggcuuguuccuacaggcgcugaucccgcuggcccuggaaggcacggacguggggcagacaaaggcagcccaggcccuugccaagcucaccaucaccuccaacccggagaugaccuucccuggcgagcggguacgugucuuccugccccggccuuuccacucccucugucccugauggccugugggcugggcuguagcuccccuuugggaccagcaggaaguuucagcuuugucaaggccuggggcagggaggacagccugagacagcaguacucucuugggggugggcuucucccugcaggguugguggggcuugugggggcugcggcaaguaccccugacagguggggugcacauugcagaucuaugaggugguccggccccucgucucccuguugcaccucaacugcucaggccugcagaacuucgaggcgcucauggcccuaacaaaccuggcugggaucagcgagaggcuccgguaaggucccuugggauugcggggccuggaccaggcaucgggauucggaauaucccccacagcaguuuacacauugggaaacacuccuuggucaugggcuucugugagccucacagugacugcuccgcaucauuagagaggaggcgacaggccaagaggcagcacggcacggcagacucuagagucagacugccucgcuucccugauugcaaaugggcaaccucaagcaaguuacuuaacugcucugucucaguuucucccucugugaaaugggaugauuauaguaccuaccucauggcauagugaugaggagaauaaaaugagaaaauacaccuaaaaguacuuacuacauggguaccuggccccuagcauugugccauaucaguauauuuuaguuuuuuuuuuucuuugagacggagucuugcucugucacccagccuagagggcaguggcaugaucucagcucaccgcaaccucugccucccagguucaagcgauucuccugccucagccuccugaguagcugggauuauaggcacgugcuaccgcgccuggcuaauuuuuguauuuuuguagagauggcgcuuuaccauguuggucaggcuggucuagaucuccugaccucgugauccgcccaccucagccucccaaagugcugggauuacaggugugagccacugcagcuggccagcauguuuuaguuuuauuacuaacugugacuuugaacauauuacucauuacuuagcccguuuccuauucugcaaaacaguagugaugaugaucacacuugcaccuuuaguauagggccauggugagaauuaaguaagaugauccaggugccuggucaggguaaauacucaaaugaggccgggcgugguggcucacaccuguaauccuggcaauuugggaggaugaggcaggaggaucacuggagcccagaaguucaggccagccugagcaguguagcaauaccucgucccuauuuaaaaaagaaauuaaagagaauaucaggaagaauagcuaaugcaugcugggcuuaauaccugggugaugggaugaucugugcgguaaaccacaacggcacaugguuaccuguguaacaaaccugcacguccugcacauguaccccugaacuuaacaguuggaaaaaaaauuugcaaggugugguggcgugcaccuguagucccagcuacucgagaggcugaggcaggaggaucacuugagccugggggggucaaggcuacagcagugagcugugaucaugccacuuuacuccagccuaggugacagagugagauccugccucaaaaaaacacagaaacaaaaacccucaaauguuagguguuagccucaccaucacgaccacccuggucuucuacauccuaauuuugagcauuucccacaauccuaugcuauuuccuaggccugguuagaaggcuaagaagcacuguaguucauaccuggugcaagaggguccuuggacauugccaagggaaauccucagcccaggacuugauugcaugagggugugggugcagggguggagcagauguagaaacucugaugaugcugccgguguuagucuguucuugcauugcuguaaaggaauaccugagacuggguaauuuauaaagaaaagagauuuaauugcuuccuggcucuacaggcuguguaagcauggcauuggcauuugcucagcuucuggggaggccucagagagcuuuuacucauaguagaaggcaaagcaggagcaggcacaucacauggugaaaguaggagcaagagacagucgggggaggugccacacacuuuuuuuuuuuuugaaauggagucucccucuguugcccaggcuggagugcaguggcgcaaucuuggcucacugcaaccuucaccuccuggguucaaucgcuucuccugccucagccucccugaguagcugggacuacaggcgcgcaccagcauacccagcuaauuuuuuuuugucuuuuuaguagagacaagguuucaccauguuggccaggcuggucucgaacucuugaccucaagucaucugccugccucggccuuccagagugcugggauuacaggcgugagccuccacgcccggccgagaugccacgcacuuuuaaauaaccagaucucacgagaacuuacuaucacgaggauagcaccaagccaugagggacccaucccaugacccagucaccucccaccaggcccuaccuccaacauuggggauuauaguucaacaugaggguuagaagggaaaacauccaaaccguaucccugcugcuuccuccuguggcccugcaggcagaagauccugaaggagaaggcugugcccaugauagaaggcuacauguuugaggagcaugagaugauccgccgggcagccacggagugcauguguaacuuggccaugagcaaggaggugaggguuggucugggugcucaugacaggcggggaugcagagguaccugugcccuggcugggcuuuacacccaacugacuugguccacuccucacaucuggccacaggugcaggaccucuucgaagcccagggcaaugaccgacugaagcugcuggugcuguacaguggagaggaugaugagcugcuacagcgggcagcugccgggggcuuggccaugcuuaccuccaugcggcccacgcucugcagccgcauuccccaaguggucagugccucuucucagugggggaggagggacggaccaggaacucccagcagcagcugaagggggcaguccuagggugugugggugugucccuugccaagguugagccuguugcccaggggucauaucuacccuguuuuucucacagaccacacacuggcuggagauccugcaggcccugcuucugagcuccaaccaggagcugcagcaccggggugcugugguggugcugaacaugguggaggccucgagggagauugccagcacccugauggagagugagaugauggagaucuugucagugcuagcuaagggugaccacagcccugucacaagggcugcugcagccugccuggacaaagcaguggaauaugggcuuauccaacccaaccaagauggagagugaggggguugucccugggcccaaggcucaugcacacgcuaccuauuguggcacggagaguaaggacggaagcagcuuuggcuggugguggcuggcaugcccaauacucuugcccauccucgcuugcugcccuaggauguccucuguucugagucagcggccacguucagucacacagcccugcuuggccagcacugccugcagccucacucagaggggcccuuuuucuguacuacuguagucagcugggaauggggaaggugcaucccaacacagccuguggauccuggggcaucuggaagggcgcacacaucagcagccucaccagcugugagccugcuaucaggccugccccuccaauaaaaguguguagaacuccacug

SEQ ID NO: 15242 - RNA, 19891 nt, Homo sapiens
gccggggcgggcggcgcggcuguccccgccccgcacgcugcugggcccggcagcuucagaggcuggcggacccgcgcggggccggcgcagcggagcgcgccggcggcccggggcccagcgggagcgcggcagcggcgcgcggagcagggggcuacgggugggcgggcgcccgccuucgccugcgucgcugccugcacgcgggccgccguccccgggcgugugagagccggcagcucggccgacugggcccggagcggcgcggaggccgggcgcugacgguaacgggccgggugcgcgcgcgggagggcuccggcugccccgacagaggccgggcucgggcggcgggagugcgagcgccacugcggcgucagaggggccaggaagggacaggaggcugccugaggcccguaccuggcgccugucucugcgguccccggggccgacgaagucggagcggguggggagggagccgggcgggcggccagagaccuggcggcaggugccugcccucugugauccaacucucuccccagcuccacccacauuggccuagacccagucucuaagggcugaaaauauugcccggaagcucccgagcagaaucagaucgcgcuaaguagggcacaacgcagaggcgacaaagcuccucggccccagggcccgcggagcagacuccggagcgcggucccgcccacgcucggcuccgcaguuagcguccuccuuccuccugagcaggcaagcggagcccgagggcgguggcggcggggggcacggguccccugaaguugccucgcagcugagcacugggccccgucucucccuucccagggggccuucggcgucacugcaggcuuccuagggguccccuaagugcucugcaaaccgcggcuggaaguuucccacugcagugaacaguagagaaacagggagaacacacagggcuugcuuuaugcuagaaacacaagcaucuuucuucuuuauuagaaagaaacucauucuguguuucugagaaaggaucgugccaggcacuguuucuggugagugccaguuugacccgaaagggcacugagaaaggcuuuccuaucagucucuuuggguucuggcuaaacuuuuaaaucaaacaaaauagagacuagcuuauucaccugaaacuagaagcacauggccgaggagccugaacaggcaccuccuaucuaggcagggaagcuguguaaucaggagcuuguguggugcgcuccagucggagcugggacucuuauccugggcccguuuuucauagcaccagccaaaggagagcguccucuccacccuagcggcagagcugcuaccaggaccaggugggccagccucagaugugcugcuugugcuacuuggagccaggcaaauggguguuccuuuggaacagcccucaggaacucacugggguauuugguggaaagacugccacgggcauuuugcauguuggagcuacagaugguguccuuccugccagguguguguggaggccaguaugaagcugaaaaagcaggugacaguguguggggcugccaucuucuguguggcagucuucucgcucuaccucaugcuggaccgagugcaacacgaucccacccgacaccagaauggugggaacuucccccgggugagucgugccugguugcuaauuucuuuguauacaagucaccugggcucaggguaugcaccucccaccccgccgccuccccucccaccccccgcuggaggguaaugucaguacaggacaggagccuuccuucccaauagucagguuuuguagaaacccucagcuaaaaacagugauggcgaaaagaaggaaggaagaaaaaaugucaauggcaaugaguauugucacucuguucuccugaauucuuuucuuucuuuuuuuuuuuuuugagacagagucucgcucugucgcccagccuugagugcaguggcgcgaucuuggcucacugcaaccuccgccucccagguucaagcaauucuccugccucagccucccaaguagcugggacuacaggagccugccaccaugcccgacuaauuuuuguauuuuuaguagagacgagacgagguaucgccauguuggccaggcuggucuugaacuccugaccucaggugauccacccaccuuggccucccaaagugcugggauuacaggugugggccaccgcgcccagccccuccugaauucuuggcagacauugcuaauugauugcagcauucuuugccauuaagccccgcugaaauccucagcacaggcaacaccgauuguugagaauagguaggugaaaggaaaucuuugccaucccugagcuagagagugaugguucucccaacccaaguggaguguaguccucaguggugaucugcacagcucccuuuaucugaacggugucaucuaucccucuaggcucauggucuggcuuugacugaugagggaagaauuguacucaggccucagcugguagaccccaagcagagacccucccuguggcauaaggagcugugugugauugcuuucugguuuuuuggcagagccaaauuucugugcugcagaaccgcauugagcagcuggagcagcuuuuggaggagaaccaugagauuaucagccauaucaaggacuccgugcuggagcugacagccaacgcagagggcccgcccgccaugcugcccuacuacacggucaauggcuccuggguggugccaccggagccccggcccagcuucuucuccaucuccccgcaggacugccaguuugcuuuggggggccggggucagaagccagagcugcagguaagagucagagcuggcagggacguacaguggccacgacugggguacugagcugcaguucaccuggcagaugcucacugugucggaggagcugccguuugacaacguggauggugguguguggaggcaaggcuucgacaucuccuacgacccgcacgacugggaugcugaagaccugcagguguuuguggugccccacucucacaaugacccaggugagggcccugcagacuccugggagcuggaguguggagugggauuucugauggccaauacaagggagggacgucgaagaagaugguggcauccucaggggacccuacauuggcucccuaggcuggaucaagaccuuugacaaguacuacacagagcagacccaacacauccucaauagcauggugucuaagcugcaggaggacccccggcggcgcuuccucugggcagaggucuccuucuucgccaaguggugggacaacaucaauguccaaaagagagcggcaguccgaaggccaguaccaggcggggaggcaugggagggcauugucugagccccaggcuggguggacgggucuuaccuuaagcuaugggugccaagguggcagggagaggcccagagagcuguggaagagaugagugaugguggagggagggaaggcaaaaacagauagguuccgagauaagcggggccaggauagccuggagguuggcuguaaggaaaggagggcaaguguguguucucuugguccugggauugggagaacugguccagugaggccagugcacacaggcccugacauuugcugguuggcaggacugggcagaguguccugcuccguccugagugugaguccuuaacuauaggcuggugggaaacgggcagcuggagauugcgacaggaggcugggugaugccagaugaggccaauucccacuacuuugcauugauugaccagcucaucgaaggacaccaguggcuggagagaaaucuugguaaguccaggcccaggcaugggggucugcccccugggcuguaaggcacaggcaggggcuguaaggcacagggaucggcagggggugguuccuuucuaggcagaucccaccaugugggccuggugugauaucaucucuccacucacuaccaggacaagagcuggggucccagcaccuggaaggccggggggccagccccugagguguguucagggccucucuggcuuccaugcccugcccaggugcaaccccccgcucuggcugggcaguggaccccuuuggauacagcuccaccaugccuuaccugcugcgccgugccaaccucaccagcaugcugauucagagagugcacuaugccaucaagaagcacuuugcugccacccacagccuagaguucauguggaggcagacaugggguaaggccggguaggguagaggggguuacugcagcauagucuucacuggggaacagcagggauaucagaacuaagacccccacuguucuucagagcagaccugcaggcacugguguggacugccagaaauggucgcacccucugguuaggggagggccauauugaccucuggccucuacagggccugcugucccaagggcuucagcgugcccugugugcccguccccugagggagccccucaugucuuucucccuggccuacacacucucuccagcccuagguccaguuacagccucgcggucuaucagggcugccuuuagccugaacagauccuugccccccuggcguccagaggcugccugcugguggugaccacguggugugucuccugcagacucggacuccagcacagacaucuucugucacaugaugcccuucuacagcuaugacgucccccauaccuguggcccagaucccaagaucugcugccaauuugauuucaaacgccugccuggugggcgcaucaacugcccuuggaaggugccaccccgggccaucacagaggccaacguggcagagagguaucugcuuccagcccuuucacuucacagaggaaucgggaggccuggcucuggucugggccgugccacguggagggugggcucagguggugaguugaggcuccuagccucugcagcagcagcuccuuacuaagucuccugaaaaacuggaauggcucuugcaaccaccuuucacagaaugcuuuuagguucucacaugaguacuucuugaugcccuaacaaacugccagggccagcugacaacuuagaggugaaggauucccagguuagauguauguuacaaacuucaggcucaugugccuucacuuagugccaguguucugacuuggcuuuaagucaaccacgagaauccuguucagauccacauucagucccacgagauagccuccagccucugagaaaacagaccugucccuuuugagagaauuuagggaccccuaaagauagcacucuugcugaaaucaggccccgggggaaaguguuagguaagaguugauccaaacagcaauuuagucagaaccuuaagaauacgacaaguuggauugguuuuuauguugcaaugcucugauuucucccugauguccaagaguugaaacgugaccaaaagggaaauaaaguggucuuuuguuuccagaagucuaaauggcgauuccaggcaagaaucuagggcuaugagggcgugacuuuucuuaaagcagcaguugugaucagugaggcuggccuagguuuacaagaacaggcccugaaagguaaccauuuucuccuuugaaaggcuuacuagacugauaaguuaggggaaagugguauuugaggaauccucucaugagaacagaguagaaaaguacaagcugggccagcgccgcuaaguagauuaguugacucuuuggacugugauauuuauaacaugccaauuaaaguaggaaagggcuucugcugaugugccacagggcuguuuuucuacugauuuugccaauaauuuggaugaaaagaaaagaaauguuuauauauaguucccauuauguaccaggcacuauucuaaguguuuaacaaauauucauucauugauuuuauuuuauuuauuuaauuuaauuuuuuuuuuuuuuugagauggagucugucacccaggcuggagugcgguggugcaauuucggcucaccgcaaccuccgccuccuggguucaagugauuauccugccucagccuccugaguagcugggauuacagaugugcaccaccacacccggcuaauuuuuguauuuuuaguagagacaggguuucaccauauuggccaggcuggucuugaauuccugaccucaggugaucugccugccccggucucccaaagugcugggauuacaggugugagccacugcgcucggcccauucaauccauuuuaauucucauaacauuauauggguaccuacggauguuauccuuauuuugcuagaaauggaggcucagagagguuacuugcccacagucacugagcuaguacuuguggagcuggugugauauggcuccgggguccagacccuucacuuuggugcugcaucgcuaacuggugggcaaaaugaggcgggagugucagaaccaggaucccaaaagaucucaacagccuagcauaaaaaauaacaugucagcugucagaacugcccagagagcaccggacuccccuggggcugggauucaugugcaggaggugucuguuugcgcugaaccacuccuugguggaugggaugucuucuaggggcuugcuggcgggauggcugugcguggugcucuuuuacugaugagacuucguggugggcccauguuuuuuuuccugccccagggcagcccugcuucuggaccaauaccggaagaagucccagcuguuccgaagcaacguccuccuggugccucuuggagaugacuuccgauaugacaagccccaggagugggaugcccaguucuucaacuaccaacggcucuuugacuucuucaacagcaggccuaaccuccaugugcaggugugaggggcacuugacuggggaggggccucacagugcugcagcccaucccuucccgugagaccgugcccuggguucccaacucgggcagggugccccccuuuuuuuuuuuuuuuugagauggagucucacucuguugcccaggcuggaguucaguggcgcgaucuuggcucacugccagcuccgccucccggguucacgccagucuccugccucagcugcccaaguagcugggacuacaggugccugccaucacacccagcuaauuuuuuguaguuuuaguagagaugggguuucacuguguuagccaggguggucucgaucuccugacuucgugauccacucgccucggccucccaaagugcugggauuacaggcgugagccaccgcgcccagccgaaggugccccuuuuaugucagaauuaauucccaggcuccccuacuucuguuaagucuagaauggcaggauguacaguuccugcuucugaggccagagccccugccucacccccaacugcagcacuguggccacaauuugcaggaggcucuagaacugaugggaguggguuuuugggguucccacaggcccaguuuggcacucuuucugacuauuuugaugcccuguacaagaggacagggguggagccaggggcccggccuccaggguuuccugugcugagcggggauuucuucuccuaugcggaccgggaggaucauuacuggacaggcuauuacacuucccggcccuucuacaagagcuuagaccgaguccuggaagcccaccugcggugagacccuguccccgcuuccaggcuggagggggagagucagccuuugggguuuaaggaggggcuggauuggcucagaagggaauagauaggcccagaggccagggcagguagaggaggggugggaaggaaggaggcugcacuggcagagugugggugggcccuggcuaguggugcaggcuggcagcuaacuucucucucugggcaggggggcagagguucuguacagccuggcugcagcucacgcucgccgcucuggucuggcuggccgguacccacugucugauuucacccuccugacggaagcucggcgcacauuggggcucuuccagcaucacgaugccaucacuggcacggccaaggaggcuguggugguggacuauggggucaggugggagccuucucuuuucccuuguaagcuccccugcucacugucccaaagaaaggacauuggguggucaggggguaggccggccuagggcuuguccugcugacaaggcagacagcuucccuauggucaucuucucuccuucccucuccugcgccacccacaggcuucugcgcucccuugucaaccugaagcaggucaucauucaugcagcccacuaucuggugcugggggacaaggagaccuaccacuuugacccugaggcgcccuuccuccaaguggugagccccuccugggucugcauggggacccucuggugugugcaggucccaucccaagagcugcuggaugggggugccgcuucucuuuuuccuuccccauccggaugaguucugugcccagugcagccgcugguccacaccugggacagguggggugggaggaggcugagcccaugaugguucuucccuuccggcucacugaauuccaggaugacacucgcuuaagucacgacgcccucccagagcgcacggugauccagcuggauuccucgcccagguaaccuggacuacgccaugugcagagaggcagagccauucccuggcucucaggccccucugccccagcaugugcugaaccagugcagggcgcuugcccuggucggaagcagcagccuccugggucagcccaccuucuacgcacagguuugugguccuauucaacccacuggaacaggagcgauucagcauggugucccugcuggucaacucuccccgcgugcguguccuuucggaggagggucagccccuggccgugcagaucagcgcacacuggagcucugccaccgaggcggucccugacgucuaccaggugaggugugggcuugucaggugggccuggcccucugcccgucgugggccccuccccgcccggcgacgccagccucccacccuccugcuuguggcccugcuacucuccaggcugaggacaaguguccuggggaggggguuguccagaagacaggcacucuugggauuugagcguguccuugaaaagaaggggaagguugguaugguaauaguaaugguaaaaauagcaguuauaaugccccaucauucagucauucaauguuuaucgaaagcuuaauguguuguuaccgcuucauacuuuuucaaauaucacuugagaaucauaaagucugaugaggaagaaagggcaaaucagaucaccuccacuuuggaggaggggcagaggcccagcgggugcaggggcuugcucaagcccucuguuaguaagcggaugccucagcaccccuguggcgaaagccgugcccccacuuccucaccccuccugugcccacaggugucugugccuguccgccugccagcccugggccugggcgugcugcagcuacagcugggccuggaugggcaccgcacgcugcccuccucugugcgcaucuaccugcacggccggcagcuguccgucagcaggcacgaagcguuuccucuccgugucauugacucuggcaccagcgacuucgcccucagcaaccgcuacaugcaggucugguucucaggccuuacugggcuccucaagguaaaaggccagggugguggggaagggccaggggccagaguagggcguguguggugguggcacugugcagagcggccucccggcccugugagcauucugccaccugacccacaguggaccggggccugggccaucucagcuccagccugacagcauggggaagcagggcacggcuccuuggggaagcuauuccguguccucccaggaggcaggccugacaugcugguguggggccaggggucagggcuguguuuuuuggcagagcauccgaaggguggaugaggagcacgagcagcagguggacaugcagguccuugucuauggcacccguacguccaaagacaagaguggagccuaccucuuccugcccgauggcgaggccaagguauccuaaagaugccuugaacaaccuggcagggagggcaggagggggcacaggccuucccacagguuuauugcugccugccaggggccuugucuuuccuguucagcccaggggugucugggaauaggugcucucuugcccagcccugggcuggcaccuuccugcuuugcccucugugcuguaguuucaacagcaaucugcucuuucucuagcccuacguccccaaggagccccccgugcugcgugucacugaaggcccuuucuucucagaggugguugcguacuaugagcacauucaccaggcgguccggcuuuacaaucugccaggugagcccugcauaugaggaagggucuggaaggaggugugggcuccacaacuguggcguauucuuccuucugcugcuucucuguucauaccucuguuccguaucauuugagacagggaugcuccauucucuuggagaaaaagucauccagaaaugcccuggggauuucuugggagguuggacagagccucuccccagcucggcucugaucccccagcccagccucuuagcugugcuucagccucacaccuguccaugcccccacuuuguuccuguacccagggguggaggggcugucucuggacauaucaucccugguggacauccgggacuacgucaacaaggagcuggcccugcacauccauacagacaucgacagccaggguaucuucuucacagaccucaauggcuuucaggugacuccugggccugggucucggagaccccacagaguagaacuuggacucugcuuuugccccugucacaggcccugggggaugaucugcccugauggagaaagaugaaugagaggcgaagaguuaucggggacuccuucagucuggggaccgcuugggcccacauggugcccgggugcccuugaucugcuggccuugcccccacaggugcagccccgacgguaucugaagaagcucccccuccaggccaacuucuaccccaugccagucauggccuauauccaggacgcacagaagcgccucacgcugcacacugcccaggcccugggugucucuagccucaaagauggugaguagggcccaggaguucugcagaggguaucagacaaaaagaagcccguccccacccucaagggcuccccgcucuguuggccucccuugccucuuucuggacugcaucaccuccaugcuuggagagggggcaagccauucagagcucuuggcacaggaggcaggcaucugcuguccccauccccugguggaggcagcaguguaggcaacuggguggaguguccuacuggaugcccugaagaaccgucaggguuacaacucuuggggccaaagaaaggaaaaaaaaugucaaaaagcaaagcuaggcacagugguucacuccuguaaucccagcacuguugggaggccaaggcagaaggccaggaguuugagaccagccugggcaacaaagcgagacccaggcucuacaaaaagauuuaaaaauuagcuggauuugguggcacgugccuauagucccagcuacucaggagacugagaugggaggauugcuugagcccaggagcuggaggcugcaguaagccaagacugugccacugcacuacagccuggugacagagcaagacccagucugaaaaaaaaggcaagaagcaucaggguauugaacagugguucucagcugaggugugcaacccucuucugggcggggcugagaguagggacagcuuguaaagugcacucaguguuaugaaauauuaaggaaaugagaaaauuacauacuguuuuccuuccagugaucauuaaaagacagacugacguucuuuuuuuuuguuuuuuuguuuugagacggaguuucacucuuucgcccaggcuggagugcaguggugcaaucuccgcucacugcaaccuccgccuuccgauuugaagcgauucucuugcuucagccuccugaguagcugggauuacaggcgcccgccaccaugcgcagcuaguuuuucuauuuuuaguagagaugggguuucaccauguuggccaggcuggucuggaacuccugaccuugugaucugccugccucggucucccaaagugcugggauuauaggugugagccaacacgcccggccaagacugacguucuuaagaaucaagacgggcauggggagcacuggccuggagucagacccggguagcuggucacgcuggcagcucuguguggcccccauauccucagggcaaaacgaacaguuugcacuugguggcaucugaggcccuugagaucugucucugggaagagcccuugugaagggcugagccgagagcacccagucaaggcuaggcguggcccaauggcuggcaaguucgggggccugacucccugcugggaggagugugccuuucucugccaggagcagccccugguccaucugugucaugacuccuaacugcagcccaauaucccucacuggaucuucuccucucccccucugggauaugguauuugaaaaaaugacugucuucuauacaagggauccguuuuaggguuuucagacaucuuucugugguuguucuggguuaaaagacugagcaacuacacaagucaguaaggacuggagaggugaaagggagaauaaggccaucugucccgguggaauguaggggcagcuggugugguuucccucgagaucuuguacaagaacagcugcacccaccuccaacaccugcacacacuggggccucuguccccaacacaucagccaugcaccgagccccugcuccaagcauacucuagaaaacagagcaaagguggucacuugccauaucuuuuuuccagggcaacccagaugacacuuaauaugagccucugccugacuugccaucuggcuguccuuuccagagcccuacuuuuaacacacagacagucagagcuugagucugaccugcuggggcugucuggcuguccaguguagaacaagggcaggagagccuguguuuuagucacaaccugcccaaccugagcaaaccugccccagauuacggaggugugcagcaacacuaccgauggcuguugaucuaaguuuuucauuucugguuuauuuuguuguauguaacccguccugauucgguuuccugccugggccccuaggcccguucccuacuccugagucccagagcgugggggguaaacugccagggccagccuuccccuuucuggaccucaugcuuccucaucugcaaaauaacggcccaggacgagccccucaucagguucccucccagccgugggaacccgugaccucuccugagugacucagcuucugucucucgagcugcgcuuuuccgucagggccuguggcuugggauucuccuuugaaaggucagugccugcuugggggugggggcgggccagcacucacuguuugcuuccccaggccagcuggaggugaucuuggaccggcggcugaugcaggaugacaaccggggccuaggccaagggcucaaggacaacaagagaaccugcaaccguuuccgccuccugcuagagcggcgaaccgugggcagugagguaacaucuggggcugacgcccagggagccaggucuggcuagucccuggggguggccgggggguccagccuagggcucgaggagcguaguuggaggugggcaagagagagagaguagggcugaauuccugggguggggggaggcagucuggcguuuugugucccaucucacgcagccuggcaccuuccucucccagcagcgcucugucaccugugccccucauguucgucucccacuuuccucugugcugcccuccucugcccugucccagcauucucuaagccugugcuccaaccccgcucaucucauggcuuucuuugccccaccagccugacuuuuucuccaaacuggcagccauguuuaggggcuugaucuuucacagcagcaggagcgguaaccgagagguaagggucggcucugggagcggggaacuaguacgagcaagguguagcugcgccagagcccaggugacagagcccgccacucagucacucgugcaucagauagauauugagcaccugcuuuacugugaggacccagagggacauaagugcagacagugcugacucucccaggaguuuacucgugaguagggguggcagagaagccauguguguaaaaaugcaagguagaaagggcuuugucucacugauccugaggagcaagguaauaaugugggcuaaggagaucgaggucaaggaggugucacccagguguggcuuugaugaauggggugugauuugaagauaugaaccagggcacaggauaggaggcaggaaagacaacaggcuggggaauagcagugaguuccuuaguuaugcuggagcuaugcuauccaguacgguggccaguagcccuauauggcuauuuaaauuacaacuaaaucaaguaaaaaauuugcuuucuuauuccuacugaccacacuucaaguacucaaguggcuaaguggcugccguauuagaccauguggugucggauauuuccauccuugcagaaugcccucuuggcuggugcugggcuagagugcuagggggagaucagggcagacggcagagcaccuugagugccugcuaagggaucuggacuuuauccuggcuaggaaagguccaggcuaaggaaagagcugagcaaggagggacaccgucagaacucuggucucagcaugucacgcugacaguacggagcagguuggaucugugggaagggagacuggaggagggugacagcgggaggcuguucaggcaggacaugcuggcugcuugaacuaggccagaggcuggagaaguugccgguggcuaugaggacacugcccaggugcgacggaagaggguuuagcauuaccugggaaugcagagggaagugagagaugcugggcgcuuggaagaagggggaugccagggacagaaguccagaauauucagcccaggccugugagucugacguccaggugagcugcuaaggaguagcccugcuggcagagccccggccgcgcugggccugagagccaggcuggcacuguggauguggcaucgcucgugaagccgcagauuacccagagcacucuggauuggagguccgugcuccauggugaggccugcgucugccuggcugccauccucccugcacuguggauccaugugugaggggagacauggcugaugggaguggguugcucaugauaguguuaugugagcaaggaacuaaaaaguagagaagaaacagcuuagugaaguagcccucugcguuaggggagacggcaaauguccacacuugaaggguuagcggaaccucgccuggagccaggcgugcccuugaguccaggcacaccaggaaaggucuuuccaaaacaacugaccugggugugcuuuuauccugccucguccucuccccucagccuggcuuuggucccucaccaauaucucgggucaauuuugcagguccaagauagccacucuaccagcuacccaucccuccucagccaccugaccuccauguaccugaacgccccggcgcucgcucugccuguagccaggaugcagcucccaggcccuggucugcgcucauuucauccucuggcuuccucacugcccugugacuuccaccugcucaaccuacguacgcuccaggcugaggugagugucccucagcgugacaugcugagagcagaguucugauggugucccucccugcucagcuccuuccuuagccuccaggaugagguccagaccccuuagcagguauucggcuccaaaccuccaggaccagguuuuggccuuuccuuacccacacgccucccugugccagcacugccucugggcagaggcgcugcugcaucuccgaucucugaaagcccugcgcccacuucccugggcacugucugucauccaggaggacacccuacccucggcggagaccgcacucaucuuacaccgcaaggguuuugacugcggccuggaggccaagaacuugggcuucaacugcaccacaagccaaggcaaggugaguaggguggggaaacagagcaccuaggaauggcaggcaugagcuugguaagacugggcugagauucggugacaggcugggagaagaaagugucacuccagggcuuucuggagagaaggggggaagcuguagacauguuuucagagcuccggaggccuggcagggggaguuccagacaagguagaucgcuugagaacuuuuguucccugagcagggaccucuaucaagcaaaguggaaaacaccagaaauagaaaaccagaacccauccuguuguuacuuuguaagcucauaucagccggcacugauaaauguccccgggugccagguccucugcugggcuccaguguuucagaagugaaccaagacauggucacuguuuucacagagcucacagcucaguggaacgguucuuacccagagaucuguaggcaggcuuuaggguugagcaaaucucagcaagcccgugagacuggaugcacacucauguguaagaaggcaugguguugcugagaggggccagccggaacuggagugcaguggcgugaucgcagcucacugcaacccccgccuccugguucaagugauccuccugccucagccucccgaguagcugggauuacaggcgccugcccccacgcccagcuaauuuuuauauuguuaguagagacgggguuucgccauguuggccaggcuggucucgaacuccugaccucaggugauccacccgccuuggccucccaaagugcugggauuacaggugugagccacugccccuggcugagauucuuaaagagguaccaaauuguagaugaacagccacauucuuuagugucucggcaccuagcacaacccugccccuucucugcucuccacagguagcccugggcagccuuuuccauggccuggaugugguauuccuucagccaaccuccuugacguuacuguacccucuggccuccccguccaacagcacugacgucuauuuggagcccauggagauugcuaccuuucgccuccgcuuggguuagggcuucuuguggccugaagagaaaguucauucacagagacugccucuuaacaugaagaucauuggacaagccacacggguaucccaucccgaucugccucccagaacugugacacacugggcucugcccucauuuucuguuuauugcugcugcuguguuuucggcgcaacccacaaacccagugauggguaaauagggcagacgccagugagaucagggagagaaggcccuuggucagagugggcagugccaggcucugcuuuggguugugaguggacacccaacugggcacaggcucaggcacccauccuuuuuccaaacagggauauagaagugguggaagcagacagaagagguaagggaggcuaaguggguaacagcccagcaucagggucacuguggcaacagcaggcucuaggggaauccugugguuauguagagacuccauguccuggugugaugagcaggaucagagugacucugggaggacagggguggggacccagaguuagcaguggggauggagcaguagaaggaaucacuguuucuccuaggagucugaaggccucgcugcuuucugugauggcuuugcaguaagugccgccuggccugcaugcauuggcuaacaggcugcagaauggcaggaaggacucgcuagagauugucauggccagagaucauaggucacuucagguagcaagaccccuggcaaacugggcacuuggccuauguacugauuugugggaugguggcaggggugugggguccuucacccugccugaauucucuuuggcuucugugcucuguaugcugcuguccccaagggcucuuucuuauuauggcagggaguggggauugguccuacuuucuuucucuggaaaggaaagccuccaagacuccaugugcuugggcagcuugagaaggcguucagcaccacgccuagcaggcagaccuugaagccucaccuuuagucuaucugcagagguauucaguuccuggcacaggggacuaggggcauguagaguauaugaggaggcaguauggcugugcaggagccuucauuucagcuucaauuaauagggaagaauuuaugauagcucuauagaugcugaaaagguauuucguaagauuuaaaauccaucccuuauuaaaacucuuaguaaauuaagucuggaaagaaacacccuaaucuagauaaaggucuguuucagaaaccaacagugauggcauucuaaagagucagacgccacaggcauucccauuaaagucagaaacuagccaagggcaagcuauuauucagcagugucccggcacuacuaaccccugcaacaagccagaugaggaacauaaggaagaauuauaauugucauuauuuguagacaauaaaacugccuaccuguaaaaccuaagaaucaacugaagaccuguuaagaguauucuguaagucaacccaaugauacacaucauguuccuguccacauacugguuuuccccaaaucagcugauaaauucaguguaauuccaaugagauugaaacuuuggaauugacaguucuaaagugcauuugggagagugaaugugugagaacacuaagaccacucugaacgaugauaaugaguugggggguggacugcucgggggugauccugccagauucccagaggauucucacgccaccauuaccucacucagugugaccuggagggggucagacagacgggagaguccagaaacagacccagggcuacaggaauuuaguauaugguaagagggauguuuuaaguggggaaaaagguggauuauuuaauaaacagcacuuuuagacaacuagcuaucaaagcuagaucucagcugggugcgauggcucacgccuguaaucccggcacuuugggaggccaagguggguggaucacuugaggucaggaguucgagaccagccuggccaagauggcgaaacccugugucuacuaaaaauacaaaaacuagccaggaaugguggcgcgcgccuguaaucccaguuacuuaggaggcugaggcaggagaaucacaucaaccugggaggcggagguugcagugagcuuagaucaugccaccaugccacugcacuccagccugggugacacagccaaaaaaaaaaccacuaaguuagaucucuaccucacaguguccauacaaauuaguuccagagggaagauauaccacaaaauuacucaaaaauuuuuauaccucuggugugggacggucuuuucuaaacuuuaacaugagacuuaaaagauauaauaagggaaaagauaagcagauuucgcaaccaaaaaauaucgaaagucucugugugauggaaaacaucaagguuaaaacacaaaugacagauauggaagaaaauauuugcagcacauaaaaaaaucaacgaguacaauuacuuuaggagaaaagcuugcuucaggguccuuagagaaagucacuggggccugccaagcugccaccuaaagacaagagugagagggcugaguucuuccaggucaucagaguuguugcugcccguauuaggccacacaguggaaccccauuuauaucauagcagaagaaauaggauuaucaaugugaacugcuuagcauggugccugguauauacgagagcuccacaaaugugagcuauaauccuacuaguaaaggaugcuaagcaguuccacuguggcaggugucauuugcuaguagaauuuguaaucaaacaauaggaggggaaucugugaacgccuagaaaaugagcagaauaaaggauauuaucuuuggaagucuuagau

SEQ ID NO: 15243 - RNA, 15494 nt, Homo sapiens
ugguuuagccagaacuggaagggccccgcccugugaagggauaggagccugacuguugcagcugcagugaguggcggggaagcagcagcggccaggaugaaucccaggugcucuggagcuggauggugaaguauggacaugcuuuauucgauuuugcauugacuuaaagguuuaauuauuuuaggaguucuuguagacauuccugaaaaaugcagguaggcaaaaagaagaaaacaaagaucgcaaaugugacccuuucauucggagagaacaccaauggaauuuuguugugcacccuucuaugcacgucugaauguuguguagacauucugcuuacaacuaggugugggugcugcugccgaaggcuuuauuugcugugccugagguggaccagagauuucagagaagacucccagagcaccccaaggagacaacaggagugcuuggagucaggaugacuggguggauuuaggacuaugugauucucaggagccucucuggauuagccccaaaucaaggauaaagagaggccuagcuggacucuuccucccagagcccugcugggaaaauggagccccuuuacagcccccacuuacccaucaggcccugcuccucucacucaucuccagacuucugucacaugcccaaguccugcuaacugcuguguaaaacugguaaggugggauccagaggaccuugggccccuagggccccaggucaggagaccugggcuccagggccaguugagagugauaaagagaacaauaccugcccacaggacuuguugcaaugagauaaaggcagaagucaccaguuguggucaaaugggauuuuuuuccagagaagucucacagagaguggcuuucaaauucuuuuuagcagcagaauuguuguaaaauacaaucucaugugaaacccuaaaaugugagacacucugggugaagcagagagaggugcucaacugcccaauccuguccucauuccucccucucagggaggcaccucugagaacccacuuuaaagaauuuugccuuaugcagauugaagaggcaagcuggcuggaagaaacugggaagcuccacuucccaccgccucugccuggguggcagucaucugagccuaggcuagccccucccccuccaaagacccacugcgggcuccccuggggccagucuccaggauggguggggcaccugaagcagcaaguauugcuauuuuucugggcugaccuuucuucuaggccugaggacaaguggguagguggggccagcccugucccuguuuccccucaauggaguucucuugcucacagccuaaggaagaagcgugagucacuuccugccucagucugacugcuggaguauuguucucccaacuguggcuggcgcuacccaguguggccccuacaagucuuaguuccuuggcggaggggaaguccccacuuugggacaaggccaacuggacuuaucuucccgcucaacuuugaggacccagcauuguuccuccaguuuccaguucuugcaguguuuguaaaggugcccgaaucguaccugaucccauucacuaaauauuaucuccauuuuauagagggguaaauugaggaagucccugagaaauuaacuugucuaaggugucccagcaaaaaauagugccccagggauuugaaccgguuugcugauugauuuuucaccaguugccuuaagaauuaucaugauuuaaccucucugggccucaguuuccuccucuauaaaaugcagacagugauacaucaaagguacuuaaaggaaaauguacuguacccaccucauggggcauguggugaggauaaaacggguugacacaggaaaagagcucucaauggugccuggcucauagaaaacacucaguggauuuuuuuuuucccauuacccgggaaccuguguuaaggaggccacaggcugauccugugcagccagguuaucucacagggagcgagaagagaugggcacaggcuacucugcgaccuuggaauaacccagccugggaagcuccuggccacauuuuccuucuuuucuuucucagcucaagcagcgucggccucagccaaguagcacaaacguuuucuagggcccagggagggagaggcuccggcugguauauugcaaguagcuuggauucaggcucugccaaacaccccagucucuugcaggaucugaggucugcugguugugggacuuugcgcaaauuauuuaaacguugugcgccucaguuuccuuaucuguaaaaugggauuaauaaucucagccugaaaggauuauguggauuaaaucauguacauaagaaggagauaauguaaagugacuggccuggugccuggcaagcgguuggugucuaaaaagaaaaaaaagcuaaaaauauuaaaaggaggugggcuacuucugcucauauauccaccugucuauacaaaugcagacgaagucgugacuccucuaacaguaggccaagaggaggcugguccugccgccgugcaguccucccucgaccugggaguggaggaccccagguccgccgucccugggcacuuaacccggucaggcucaaauucgucgcccaggaguggggaagcgggggacggagagggccagucccccaagaguccggcugaggcagggcucggagugccucccccaagccuuucccuuugguuccgaguucgggucuccgcggccgucuucccggggagcucgcggggcgaagagccgagcccgggggcgggggcacggcagcggggccugagggacgcgccgggcggccgcgaggacuuugggaucgccugccccacuuccuaccugccccuaccaggagccggaggcagcgggcgccccagaaggccccgcagggccgccgcgcggggccggacgcgcuggggcccacggcgcugggaacgcgggcccgcagucgggcccgggcggcaugggcggccgaggggcgcccgagccgccgcggcggucgccuggaaaaguuuccccgccagggcuccccaggguaaguagcgagggcgcggggcccggggcccggggaaggcaagcgcgucugggagccgggcccgaggggagccggccgggccgggccguggagcucugccccaggagcgggcuccgcggcccgggugcucgggccggggagggucggggcacuggcgccggugcagcccugacccgggucccccggggcccggcugcccgccggcuuuccggaacuggccccggggccggccccgaggguggagcugccgggagcagacagggcgcuccgcagcccaccugagcgcgccgggcccgucucggccccccggccguggcugguacuuuuccgcguggggccagggcgagcccucugaccucaggaagcgccugcggggccccugcugggggcgggauggggagaaaauuccgcaggcgccgggugcuccagccuccccgccgccaccggggcugccgccggcucgcccacuccgcggccgaggagggccugcguuccgcccggggaggggaggagcggccgggggcgaggcgggggcuccuucgcuugggccucgcccccgcccgcacaccugugcggccaggacucgggugcgggauccgcgggcgccggcggccggcgcagguaggucccugggcugccuucugccgcggccuggccgaggccccugugcccccgcuguguggcuggaccaaggggcggccugcuugccagacaggucugacggcagucacuugucuggucagaacccgcuuucccaucauccucuacccccuggccccuggggugcagacccucauccaccggagaguguugggauuccuauucugacuugggaagugcgaggagaacccgggugauauggccuggugagggcgggugcugagcagguguggacacagcauaggagauuagccaagccugaccucuucucaagcagggcagcccucguuuuacuauuuccuauauugggcuucuacggagcauuugauuuuuaaaaaggauucuguggcuuuuuaaaaaguuugaaagccgcugguccagcaguuuuuaccaccaaggaaacugaggcccagggagaggaagugacuuguuaagaucauccagcaaauagugggcagggacugggagcgauaaauucacgggagccucccagggcugguaacaggaccccgcguggugucucugcuagagggagagacugauuggguguccgaguggcccucccguggccugcucuguggcugugucagagccagacccccagugucugggaaacagcagucgguccuggggugaggcgcaauuugaguggcccagaguggcucucugugucaggagguucuggugcuggagaaaagggcuuugcccaagaacacagccaggaagagcacccacagcucucucuggccacagccuggaacagagucccaugugaaacaagaccaugagaaauacagcaagccuccagguuugagacaaacugggacuagagggugagucagagucugggauggggguggggagaaacccauucauucauuguuuucaguucuuacucuuuucggggauccucccuugucccacaugcuguggcagagccgucugugggggucucauuuucuggaagccauccccaccccucaccauggcugggguuguuggauagagggaggcuggcccucuuucuuuggggggacuguucaguugcgccugacgccugcuuucuuuccgagugcugcaagguaauuaaauaguugguuaaucacuuuuaacgccaaacagcugcggcuccaucuacagugugcuggaaucugggcuagacccagaugaacccagccucgauuugggggcuccagcaggacucacagcacggugguuggugguggugggggcaggggggugguugcaugacaucuggacccaagaggcagcuguuguggcagcaagagagaggagagagaugaggccccguuccuauauggcucugcucccagggucccacauccucuguuaaaugagggacuugggguggggggggcgguccuuccauccccuagggcuggggcgccuagcugcccagccauugaucaggccagcuuucuggaaccaaccacccaaagcaccauggggcugugguuccgaggccugcccuggaaguccuguggagucugcccgcagggaugugcaggagcuguauuguagaugucuccugccaucagcugucagguuauuuugguccaaacugaaaauacuccaggaauuguguguggaguacccccagccugcagggugggacugcagcagucagggaggccgguugugucuaagggcagcuucuggagaagcaaggaguuuucuguggugagccugccucucuagcuccccagggccuacgugagcuggggugccuuccuuuugguauccggcagaguggccuuggcuauggaagugcuaagggcauccagggcccugcugcugcucagggagcuuggcacugauaugggauacccccagcagcacugcugggaccuccccuagcuucccccccuuccuccagggccuuggcuucuggcuagucaggggcacuauguggggacaguuauguggccccgggcagagagaggucccgccgucuguuugcugaaggaggaaaaacaacacucggacuauugauucagucucaccuuggcgcuccuggcucagcagccaguguuugcccuggcugccugggcucggauuacgcaaggcuggugggcguggagcaagcaagggggcagcugggggccuccaggcccaggcagggcagggcuuggcggccccagcguuccccaggaaacuguaaaaacgagucuggggcccugacuuugcugauagcggccaucucagccauagagggaggugaagccucugugaucuccacccccgcacccccucaggacauggccccuaaaagcaccaucccauuuagggucacccauuuucuuccuaggagcuguggggcuuugcgaauaacucccuauggcugaaucugcuuugcugaacuaggaaacccuagugaguuguauagaugccauucauuuaagaaccuugaaaagccaacaucuuauucccauguaaaacauaccuaggugauuuggagaauacagugacacaaagaagaaaauaacaauuacuuguaauucucaccaucuugagagaaccaccguuaacauuuuuuagcguguguauccuuccagauuucgcuuuaguuuguauaaauauacauguauaaauaguuuuuaaaaaauaaaaugggauuauguguacauacugcuuuauaaugcaucuucuuuaccuugaucauggugaacauuuauucauuuguuguuucugauuuugagugacucagggcuugauagucuucauccugcuucuucuguuacacuuuuuuuuuuuuuuuuuuuuuugagagggaguaucguucugucgcacagacugggaaugcaguggcgcgaucuuggcucacugcaaccuccaccuccugggcucaagcaauucuugugccucagccucccaagucgcuggcacuacaagcacccgccaccacacuuggcucauguuuguauuuuuaguagagacgagguugcaccauguuggccaggcuggccucgaacuccugaccucaggugauccacccgccucagccucccaaagugcuggaugacagaagugagccaccaugccuggcccuucuguuacauuucuuauauucuugcauggagaaaggauugggggggauugugagggcauccaucuguccaucuauguggcuggccuugggggcuagauuucuucuggggaggacuaauuuuuuuacccuucucccccagaucucauuucaggccccaauugaaacuuggggugggcagggcagcuuuagugcguagcaggggaggaacugacccucucuccccuuuuccccucuuguuccucucagggucggcacucuucacccucccgagcccugcccgucucggccccaugcccccaccagucagccccgggccacaggcagugagcaggcaccugggagccgaggcccugugaccaggccaaggagacgggcgcuccagggucccagccaccugucccccccauggagcugaggcccugguugcuaugggugguagcagcaacaggaaccuugguccugcuagcagcugaugcucagggccagaaggucuucaccaacacgugggcugugcgcaucccuggaggcccagcgguggccaacaguguggcacggaagcauggguuccucaaccugggccagguagguguucccccacaggacacugccagggggugggaccagagaagacagggauucugggagcaggagcuguuggccuuguuugcucaggggcaucuggguagccggcauguucuggguggccaugagcaaagcacaggugguucaggcaagcagcauaucccagugagagugaguccucaugguccccgcauuuugcugggucccggacagggagcagaugccccgcacccccgaccguggcgagccucccaugaagccguuguccacccccgucccccgccucccggggacugacagauggaaagcccagcucagucucccugcucuauugcagaucuucggggacuauuaccacuucuggcaucgaggagugacgaagcggucccugucgccucaccgcccgcggcacagccggcugcagagggagccucaagugaguguggccccagcccccuccugcugccacccucccccuccugcucucaggagccccucucgccuccugcuccacccacaccaucucucccucacucccccacagguacaguggcuggaacagcagguggcaaagcgacggacuaaacgggacguguaccaggagcccacagaccccaaguuuccucagcagugguaccugguacguggccuucuucgcugcugggaccuccuccccagaugcaccauccacccacuaugagcucuuggauggaggaggcugucuucgaggccuccucugauucguuuccuuuccuccugcugggcagucucuccuuggcccauccuaauaagcaagccuggggguggcccucccagaguccucuacauucccauggaguccagacagccaguggcggccuuucaggagcagggaugguacaggaggagguuuuacgggggcaaagggauucuucaagaugcuccuagccucacaaaaccaaucaugucucauaagugauggggugggugucuccacagucuggugucacucagcgggaccugaaugugaaggcggccugggcgcagggcuacacagggcacggcauuguggucuccauucuggacgauggcaucgagaagaaccacccggacuuggcaggcaauuaugugaggaagucggggagggaggccgugaucccugcugaggugugucuagaggcugucuuguucuaucagugaggucagccuucuccugaugguggccaaauccuucuuaggauccuggggccaguuuugaugucaaugaccaggacccugacccccagccucgguacacacagaugaaugacaacagguaagaaguggcaggccccggucucugccucccuucuccuuucuuccacuaaggaacagggcugagccugggugagaugugccuugccuaaaaggcugaggcuuuucccacaguccuggcccaccuggggcucugagggagggcucggucagaguggagauggccacaggcccaguggagugugggagaugggggcuggguacucaggggaugaugggugucggaugugcggaucccucgugcuccucaggccacaucugccgggcccuguucaccccauuuguucuacucaugcuacgugcuuggcccuggcaggcacggcacacggugugcgggggaaguggcugcgguggccaacaacggugucugugguguagguguggccuacaacgcccgcauuggaggugagugugggccugggccacccugucuucaggagggcccuucaguggaauuuuucccgcccacuucccaucuggccaaugccugccacuuucccacuguggauccuuugaucacguggcuguuccauggaggguucccaaagggucaaagacugaaagagcuggaccccuguggagugaggguuuccuagcaggagucuccugaaauccucacgacccacugugaguccucacguggcagauccuugaucaccaggcucuuuugggaaccagagacucuuucuaguccugaaugugugguugggggcaggagguguucucuuuuuccuucucugggucuugucuuugaaaggcagaggcaaacagguaguuggggguucaggguuucucagcaucagccuccacccuucccuuacucauccccuggggugcagggcugggugugcuccuuggggugggggcccugacagcuggacccaugcagcaucccucuucgugcccccccuucacggccaggggugcgcaugcuggauggcgaggugacagaugcaguggaggcacgcucgcugggccugaaccccaaccacauccacaucuacagugccagcuggggccccgaggaugacggcaagacaguggaugggccagcccgccucgccgaggaggccuucuuccgugggguuagccaggugagguggggaucuguccagccccugcgggcagguugggugcugucuuccguaccuaucuuguguuuuuugguuuguuuuauuuauucucauguuuaacuuuacacaaagcauguuuauugaaacauuaagggacagaagaagaguagagugcauauaccacuuggacuugccuaauuaaaaaacacauuuuuuuuagaaaugaggucuugcuguguuacccaggcuggucucaaacuccuggccucaagcgauccucccgccuuggccucuuggucugauuuuuugugugccuagauagacauauuuggauacauacuugauccaccagggaucucacaggggacaggagguucccagagaaugaggcuccagccuucccaguuuuccagcaguguccuccugccagcccucccucaagucccaaucuugaaugaccccagcccacucuguccacagggccgaggggggcugggcuccaucuuugucugggccucggggaacgggggccgggaacaugacagcugcaacugcgacggcuacaccaacaguaucuacacgcuguccaucagcagcgccacgcaguuuggcaacgugccgugguacagcgaggccugcucguccacacuggccacgaccuacagcaguggcaaccagaaugagaagcagaucgugagucuuaccugggggugggggcuggggagauggggcugcuggcuggcucuguccagcacccucuuuuggaggcugucugccuccacccccauguggcugggugauaguggcucaggcaucaugcaacaugaacucuggggcucuguagguucuuggaggccauggagccaucucugaagacuuugaaaagccuagacucucucuaaaaacauacuuuguucuuauucaucuccacccucuaguugaacccccuuauuccuuuggaaaaugaggcccaggaggggcucgucauuagcauguccacggcaaguuagcaaggcagcagcugggaccugggguucuuggcccuggcuccccauaccaucuguggugcccagggccuguaugcagagggaggguaggcagguggcuccucuagcccccuccacccaucacaggccccaauaugauucucuuccuggcaggugacgacugacuugcggcagaagugcacggagucucacacgggcaccucagccucugcccccuuagcagccggcaucauugcucucacccuggaggccaaguaagugggugggggccagcggcaacccugucccuaccagcacucucuguagggcagcccuuagggcagcuggagagcugcucccaaaaaagacugauccccagccucucccuuccuucuuugcaguaagaaccucacauggcgggacaugcaacaccuggugguacagaccucgaagccagcccaccucaaugccaacgacugggccaccaauggugugggccggaaaggugagggcaggcuggcccggcaggcuggauguggaguuagguagaaggcacucugugccugacagcugacccuaccuucccuguccccacagugagccacucauauggcuacgggcuuuuggacgcaggcgccaugguggcccuggcccagaauuggaccacaguggccccccagcggaagugcaucaucgacauccucaccgagcccaagugagggcuggacccaggcugggagggggccagugggaccugagagucgcagggggugcccgcuggucccucugggccaggcugaccaucauggugcucuccugcacagagacaucgggaaacggcucgaggugcggaagaccgugaccgcgugccugggcgagcccaaccacaucacucggcuggagcacgcucaggcgcggcucacccuguccuauaaucgccguggcgaccuggccauccaccuggucagccccaugggcacccgcuccacccugcuggcagccaggugcuugcucugucccugcccgcccugcccagcgccgccgccucucacagcccgcgugcuugccuuugcucgcucacacggcccagggggcacugagugcuacucaguggggcacucuuggcauuuugggagggacaauuuuguccugugggacugucccauguugcaggaaucccuggcuugcaaccauuuaaugucaguagugugccccaccuugugcggugccuguguaccuuucuagaaucccccaguugagcacgucuggcucacugagaaacagccaagccagcaggcacuucuggccccaugggguuggucugcgugggggaaggguguguggcccaugugcuguggguuagaugucccuggcuuggggucccgcagaggccucagggcugugugcacuccccuccccaggccacaugacuacuccgcagauggguuuaaugacugggccuucaugacaacucauuccugggaugaggaucccucuggcgaguggguccuagagauugaaaacaccagcgaagccaacaacuaugguacugggggcacuugagggguagggguacgagguggagggcuggcaggaucucgagcacuggguguggugccagcacugucuuaacucuugccuccuccccgcucuggaacagggacgcugaccaaguucacccucguacucuauggcaccgccccugaggggcugcccguaccuccagaaagcaguggcugcaagacccucacguccagucaggccugugugggucaguagugggugcuguugggcuuugggggccugagucuggggguaaggcgggugccuguccugaagcccagcucuaacagaaaaaagucucaagagaccuagggccccuggggcucuugggaugaccacaguccuggggcuggaggauccuggggauguggugacuuggcuuggggcugcugugguccuggggcuacagucuguuuagcugacacacacuugcccucucucccacgccggcagugugcgaggaaggcuucucccugcaccagaagagcuguguccagcacugcccuccaggguucgccccccaaguccucgauacgcacuauagcaccgagaaugacguggagaccauccgggccagcgucugcgcccccugccacgccucaugugccacaugccaggggccggcccugacagacugccucagcugccccagccacgccuccuuggacccuguggagcagacuugcucccggcaaagccagagcagccgagaguccccgccacagcagcagccaccucggcugcccccggagguggaggcggggcaacggcugcgggcagggcugcugcccucacaccugccugaggugguggccggccucagcugcgccuucaucgugcuggucuucgucacugucuuccugguccugcagcugcgcucuggcuuuaguuuucggggggugaagguguacaccauggaccguggccucaucuccuacaaggggcugcccccugaagccuggcaggaggagugcccgucugacucagaagaggacgagggccggggcgagaggaccgccuuuaucaaagaccagagcgcccucugaugagcccacugcccacccccucaagccaauccccuccuugggcacuuuuuaauucaccaaaguauuuuuuuaucuugggacuggguuuggaccccagcugggaggcaagagggguggagacugcuucccauccuacccucgggcccaccuggccaccugaggugggcccaggaccagcuggggcguggggagggccguaccccacccucagcaccccuuccauguggagaaaggagugaaaccuuuagggcagcuugccccggccccggccccagccagaguuccugcggagugaagaggggcagcccuugcuuguugggauuccugacccaggccgcagcucuugcccuucccugucccucuaaagcaauaauggucccauccaggcagucgggggcuggccuaggagauaucugagggaggaggccaccucuccaagggcuucugcacccuccacccugucccccagcucuggugagucuuggcggcagcagccaucauaggaagggaccaaggcaaggcaggugccuccaggugugcacguggcauguggccuguggccugugucccaugacccaccccugugcuccgugccuccaccaccacuggccaccaggcuggcgcagccaaggccgaagcucuggcugaacccugugcugguguccugaccacccuccccucucuugcacccgccucucccgucagggcccaagucccuguuuucugagcccgggcugccugggcuguuggcacucacagaccuggagccccugggugggugguggggaggggcgcuggcccagccggccucucuggccucccacccgaugcugcuuuccccuguggggaucucaggggcuguuugaggauauauuuucacuuugugauuauuucacuuuagaugcugaugauuuguuuuuguauuuuuaauggggguagcagcuggacuacccacguucucacacccaccguccgcccugcuccucccuggcugcccuggcccugaggugugggggcugcagcauguugcugaggagugaggaauaguugagccccaaguccugaagaggcgggccagccaggcgggcucaaggaaagggggucccagugggaggggcaggcugacaucuguguuucaaguggggcucgccaugccggggguucauaggucacuggcucuccaagugccagaggugggcaggugguggcacugagcccccccaacacugugcccugguggagaaagcacugaccugucaugccccccucaaaccuccucuucugacgugccuuuugcaccccucccauuaggacaaucaguccccucccaucugggaguccccuuuucuuuucuacccuagccauuccugguacccagccaucugcccaggggugcccccuccucucccaucccccugcccucguggccagcccggcugguuuuguaagaugcuggguuggugcacagugauuuuuuucuuguaauuuaaacaggcccagcauugcugguucuauuuaauggacaugagauaauguuagagguuuuaaagugauuaaacgugcagacuaugcaaaccaggcccagucuccagugugguaccguugcuccugcaucgcagcugaggauagggggccaguuaggccuacacaguggccugccugccuggaugugggcccaagucagaaggccaaaguccuccaaggggcgggaggaugcgccagccccuaguggaggagcuggugccccugggguggggcuggugaccccugguccucaggagcugagcacuaaacucccaaaguccugguuuccagcagugugaagaacugggccuauugugucuuccugggcugaagugaucuggucgccacaggcuauagggcugaggccuaagguggagggaggccugacugaaucaagaugacuucuuguggggagccugagucccaaauggaaaacuccacgccuguccgcuccccaaccccugccccuugauuuccccaggucucccuugggacaggaagccccugccuggggguaggaggauggggacaaaaccacuaggaucuguauccgagaagcagucucuguucgggauauuuacuuggaaauuuuauucaaauggaagcuggcgccugagccucuccuuagggaauuccgugagguggggagggcugggaccaggguucccucuuu

SEQ ID NO: 15244 - RNA, 647 nt, Homo sapiens
cgaggagcuaauaaucuaguagagcaagaugggcagaaacaaauaagcaaagcacagcaaaagucauguguggguaaaugcacugaaggagacgcaacuguggcagguggacaggcagccaccagcgggcguugaggaaaccuuucugauagugugaagcgacgcagagagggcuccaggcagcaggaacagcaagugcaaagaccccaaggcaggagugggccuggaguucaaggaggcuuguauugcuuggaucugacgcagagaagaugggagucguuagagggucuugaaccggggggcgcauuacuuuccuuagaucaguggugacuccguuagguaguaacuauauuuggaaaggaaccaccuguauuucucccagcugcagaggaauugugugaacguuacuaaugaccuguuucacaguggucacauuuuuuccauccuugcucugugcuguuggacgcuucucccugccgcgccccugcucucucugccuucacucccaccugaucacccauggaucuuucuucucagucagaaagcccaucugcugucacguugagggcucugaggucucaauuuuauuuuucuaguccuugaucuuuaacccuauaaacaguuccauacuuccagccaucuaagac

SEQ ID NO: 15245 - RNA, 520 nt, Homo sapiens
aagauggcagcagcaaugauuuaccagcugugggcuggagcagcauagugguguugagccugcccucaggugccagguguuuugggguaugggccuugccaacuggagagaaggucaugcaugccagccagguugaugauaauaaagacuccagaaaaauucaguuuguggguugucagaaagaggugaauguaaacuuugccacugauuugaugacagagcaaccuaugagugaaguagagaguuggauaauauuguguaacugguuggggagcucuuggcuacccaaaaguguguguaaacauagacaaagaaacaaaaacugggauaugugguuauuguggacuauaguugaaaaaacaccaucauuagaaugaauugugaacccaugguccucugaaguauguggaugagcauuuugauuuugaaaauaaagcaugugaaaucacuaguucuguauaaaggauauuccuauugcuaaauaaaggguaaugcuaucaagaaaaaaagacacaaugaa

SEQ ID NO: 15246 - RNA, 159373 nt, Homo sapiens
guggggcggugcacacggggcuuuucaggccagcugaucccccagcccuaguccccaacuccuucauuuagugcauggcccaaggaccaacaagggaggcgggacgccgagguccugccuaggaggggagggccgagaggacuagagcugcuuggagccccagaagcggcaaggucagcgccgggagucgucaaggccguacuucucugcagggcggggaggagaggucgcgcuuuaaacuuccaugaacucuguugguuccaagcauuuucuccaugaaguauccuuuauuuacaagagcuccagauucuaccuggaaaaaagaccucuuaaaauugcagagcaaaggcagaaaaaaauuauacgauuuaggcggaauaaagagugauguuuaaaaaucuuuuccuuuguuuuuuaagacaucuucaccaagccaguaguacuuuuauaaggcagagaagcauaaauauuaauauugcuuaaugggcuuaaacuugguaauagagccacgugccagugguucggggcaguuucgccaguaacgugcucucggguuacccugcucgggccagagaucgaggcuccggggacccggcaccugaaccugugcugcagucccagcgcgacagcagggaauccagcccgcagcacgccuccgggucuuugcaguagccgggccaaggcgggagcggcugccucucagggucgcuccagggccgcgcuaggaaagguguggacggucggagaggacaggaaggagccggcugcaccgcgccagggucuccgcaaaccgggagcccagggagggcgggaagacuggcggggguccgaggcagcccgcuacaggauacgugauggacgcccagagacaccgcccuccagcuggugggggaggagccccagccaccaagaaguuaagugacuggcccaguucacacagcaagcuaguggcugugugcguguccgggguccucaugggccccaggccugcaaugcguacgccccuuccccuggcucugccuuuggggucucggacgcccgacuagcacuuugguuaaaaugagaggaggacgggcgccugcagccugcccggugcuguagcuuugcggccgccccggcgccuguguaauccgaggcguggcgcgccagguuuuggccugcgagggagcgcacgugggcugcggcuucucgcggacgcccaggccccacccacccgggacccggcgcgcggcgccccaguuugacuuucacuacccccaaaggaggucuuuccaccggccucuuuucuggguaacagcuccagggcucacacuuggugaccccaccgaggucaaguagccgcuaaguuacggagccggaauucgaauuuggcggucgggcuucugguggccucgggacggagguggcugugugucccugggcaagucucuuuccuucucuggguagcccagucgggcgccccgccugucgucgccgcgcaugcucaguugcgggcggcguccggaggagguggcgggcgccccagcugcuuugcauugacgccagcacccgcuggaggucaccgcugggggcucggcgcggcacgcugccggcaaaacccggcccggaucacggagccggagccggagccguaccgccagcaacuccugggugcgcgcagccguuucugcgcuucucgacggugcggccccaggccccgcuggagccgagcugcuccccucccuacccuggcggacguggcccggccgcuccgagggguuucccucggaccccgcgccuaaaccccggccagcgggagcgucuaaggcuagccuuguaccccaccggcacucggccugggggggcuuuuccgcgaggcggcggcccagcgggcggagcggcguggguguccacaucuaggcggagucuggagccggggaggcggcggcggcggcggcgggagcggggccgggcgcggccgggagcucgccucccccgggggucgugccgcagcucggcgagggcagcguggcucgcgcggcguggacucagccgcuccuggguaaggagagcgcaaaucuccucccccuauuuccccggaagcgcggccgaggcgagcccggcgaugugagaggcggccgucggcuccugccucaggaagggcauguucggaggggcggccucggcacgccacccgccuaagcgcccccuucccaccgcagccgccgccgccgcagcgcccgcaccgcgauaaaaggggcggccgcguuuccugacgcgagauccgcgcucgccgccgcccgcccaggcggcgaugacacggcgcccgcggcggcccggaggcgccgggugggccguuugcugaccggaucgcggcuacccgccagcguguccgcggcgccgccgccagcaugggcugugccccgagcauccacauuuccgagcgccugguggccgaggacgcgccuagccccgcggcaccgccgcugucguccggcgggccgcgccucccgcagggccagaagacggccgccuugccccggacccgcggcgccggccucuuggagucggagcuucgcgacggcagcggcaagaagguaaggggcgccgggcacucuggggccgccgcgaaacucgggcccggccaguaagcaacuuucccgcaggggccgggcggggucccccccacccggccucggugcccucuugucccgcuuuggaugguucugauugacgccagucucccgccuugccggggcagcguucagagaaggaccgacccaggucccgcgacccugauuuccuaggguugcgauuaggacgccgccugugucgcggcgucgguuuuuuggacacauccgacucccggagcggcggggcccgaugugaaguugacugaggcgcuugcaucaauuuccucuccaagagcggguguuugagggaaacccccaggauauucuggcgcgccccugcaauguuaaaucagugugaacuuuguucuuuuccugugguagaaagggaagggcgacuggccucaccacucuuuucccucugucagcuuugcacaugcaguugcagguuaccauuuucuucgggacugcuagaauguaaucuggaacaucagcuuugcuucauugcacauguauuugagguccacguuuauuagcauacauacuguauuuaaagcauauguaauuagaaaauacugugaaacgcgauuuuugaagcauucagcagaacaaaguuaaucuuuuauuaagccgacuuacugggacauuuugugacugggguuuuuuguuuuuuuacauugcgugucuucuccagcgcauguugccuuggcuuauguuuugucaaaguuucugggcuuagucuuuguugagguuuucuaaaggaaaguuaaaaaggaaaaagaaaaacgugaucauuaaggcacacagcagcagcuuuccaguucucucauuucagaauuuaaagcuggaacucaugcguugguuuauguuuuguuaaaccaguaaaagacaacaacaacaaaauucgugcauggcugcagauuguuggcugucaucccucucaucacgaccaguuuuugaaagaguaauuugcaaaauuuguuugauuuuuccuugcuugcugagaacugcugaaccuccgaaguuugagggauauaguuugauguacuuucugucuuacauuucuagcagucgucaugauacuuuuucuguacgaaaggggaaagucuuuuucaguguugcauaacaguugauuuccccaccauucccauacccuaagugaaaauucaacuuuguucugauuaucagaaauugaauuccuucuccuauagauucuuuaaagaaaccucugaugguuuaggcuuacuaacucaaggugcucuuaauaucaguguuaagcuguguguuaagccuacuuggcuuuaaaaaaguguuacacaggugcauauggaaacuuuaacagcuuucaaguuuucaguccaaaucuaacauuuugcagacuaaugugauaauuucagauuaccaaaguagcccuuuuauagugaggggccuuugugucuuacaggcuuuuuuugugguggauuggguguccuaaaauucaccuaggugucuuguaagccuccccagugcagcagcagcuugcucuugugcuaucgcagugccguuaggucccugaguuuuuaaguacuuacuucaaccauucuucuguauuggcagaccauugucuuguguugggggcucagaaaauacuuucauccuuaaagugccuaacccaguggcauacacauaguagguacuaaauaaauguuuacugauuucuuaaaaaauuguuaacugauugaugaaacuuuuucagucauuggaauuugauuucauaaagccuccuauguagacuucaaaauaauaguauuuccagagcaggagucaaauuauaaauuauaacaccacaaccacagaaauaauagccccauacuuguuauucaugaacuguacauguugauaucucauuuacaguuauuugcauuuaggcaugucagauaguagagcagagguaaaugucagcauuuuuucuagucuaauauuuuuucuuugaaaaugaaucuuuuuaaauuuuaagauauuaacuaugcucuggaaauucauguuagagaaggcaaacugcuagcaauuuagcaaaauuaaaucauaaaauuaguuucuuuguauuaucucaagaugcaauuuaauucauuacaaaauuucuuauuaaaacuguaagucagcauaucuuuaagugaauuucaacaagaaauucauugggggaugcuuuuauaguccuacagcauuuaguaaauaccaguuuaucagugugggugggagauugauaacuaauugcauuuuuagguuaagcaguauguacuuugcguuaaaguguauccugcauguguucuauggaacaauauguggacuguuaguauuguaugagaaaagaguuccguggucugguaaguuuuugggaaauacagguugaauaucccuaaucagaaaaugagaaauguuccaaagucuguuuugagugcugacaugaugcucaaaggaagugcucaauggagcauuucagaguuuggauuuucagauuagggaugcugaacugguaaauauaaugcagauauuccaaaagccaaaaaaaaaaaauccaaaacacuucuggucucaagcauuugggauaagagauaugcggccuauacuggcucagacuaaguucaacagaguucuuuuauguagggcuugucagagaaccuaauuucugaaaguaaucugugagucuccaagugguuuuuagagugugcaucauuuccuaaacuaguugauuguggagcccuuuucuugagguguaugucaggcaggccacauguuaagaccugauucuuuaugugagauaccaauauucaaaguacaagaaauauaauuaacaguaaaacucaacgaauguaauuugcuucuuaaugauuccaaagguacuuuagaucuugcaauauauuaggcuggguugucuguaugaacuuauuuaaguauuacuaaaaauacccucugucuguuuauuccuuucgggaguuuaaguuuaugugguuacagauaaugaaugcuguguucaguuugaacacuuagaguuuuguuuauuuuuaaucagugugagugagccuuaacuguaacauuuuaauauuuucuugccagucuuuggauuuaccccauuuccacuuucccuagccaggacuugaguugcccuugaaagauuugcauguaguguuagagacccuaugcucacccccuaucuuccuuuuugcaaacacccacugcacugcuaaugauugaugcuccccacaccccaacuaaucaacucugugagauggcagucauguuuguuuuguucacugcuguaucccccaggccugaugcacaguaggccuuccguaaacguauguugaauuagagaauuuugugaaccaggcugucaaguugaaaauccacccaggccagguaaguagaaauagaagccaguuuuaaccagaguagaggcuguaaaguuuggauuugguuuuguggaaaucucugguuauugcucuucagagcacuguacccagggaauaauauauuucuacccuguugagcagaguagauuucccuguaaagaaagauuaaagaggcugggcgcgguggcucaugucuauagucccagcacuuugggaggccaaggcagaaggauugcuagagcccaggaguuugagaccagccuggacaacaucucaagacucugucucuaccaaaaaauaaaaaaaauuagcugggcauggcaccgcacaccuuuagucccagauacuugggaggcugaggugggaggaucaccugagguaagaaguucaagguugcugugagccgagagugcgucccugcacuccagccugggcaacagacagaaacccuaucucaaaaauaaauaauaaauaaaagauguaaggauuagugcagcuaaggugauagauaauaguacagcugcaagccaaccucuaaucgaguguuacugcugucagcacucacuuaaaaucucagacauucucuaguugguccauuucuguuucccuuugcuucugucauucacuuccuucaaccucuuuucucuuacuuugcaucaccucccgucccacuuccaucuuccuccuugcuuuuuucugcuagcccaccuuccugcacaaaacuggccacucuugccaucuuagucaacuaaaguuuagugguuuccaaauguuacuuaaguaacauuuggaauggaauaaaauuuauugccugcuccuaguuuacaaaguggauuagucaaaacuuuuuuuuuuuuuuuaagacagcgucuugcuuuguuacccaggcuggagugcaguggcacaaccauggcucacucagccuugaccuccugggcucaagugauccccccaccucagccucccaaguaacugggacuacaggugcgcaccaugcauggccaguuuuuuaaacuuuuuuuuugucgagacgagaucuugcugugcugcccaggcuaggcucaaacuccugggcuccugugauucccccagccucagccuaccaaagugcugggauuacagguguggguuacugugcccaacugauuacucaaaauuuuacauuuggcuaaacuaaagcaauuuucucuuugugugugaccugacugauuuuuuuccuccaguaggggucuuugacccuugcuagauuauauggaauuacugaaaguuuccuuugaaaguguaguugagaaaaaugagaccaaacuuucugcugccauaguaagugacuacaguuuaucucuagagcucagggguugugaguucccucauuguguucuugugcuuuucaguauauagaaagauauuucuuuauucauuuucuugaauuccuuuuacauacauaaaauacuuugcauuuauagcauauguuuuuuaguacuuacugucauugccaccauaacuuuaagugugauucuuaagauagacauugucacaauucuguuaccugaaaccugucccugaccagcuuugacccucgccuugcugagguaagguuuaugauagggccuguggucccuucuggcgcaaauguuuccugugaaguggcuuaugacugguuuucccuuggauagcuuacccauuuggauugguuccuuuuuuuuuuuuuuuuuuuuuuaaagacaguuuuuugcucuuguugcccaggcuggaguguaauggugcgaucucagcuuaccacaaccuccgccucccgggucgaagcaauucgcaugccuuagccucccgaguagcugggauuacaggcuugcaccaccaugcccggcuaauuuuuuuuuuguauauuuaguagagaugggguuucuccauauuggucaggcugguuuugaacuccugaucucaggugaucugcccaccucggccucccagagugcugggauuacaggugugagccaccgcgcccggccuuggauugguucuuaaauaggagaagguucaugaugugaggacacagggugaggcagacaucccagaguaaccuuaaaggacagaauauuuuaaaaaauuuuaaaaaaaagaacagagggauaaguacuuaggacaugaguaagcccucagucuuacccaagcuuaguggcuucauccugguuucucaguacacugaggcaguaggaggugauggauucugcaguucuuagagugcaaacuauucauauuaauaauagccaccauuucuuggaugcccucuguguugcaagcaccauguuagaugcuuuaaagauguuaucucauuuaauccuuucaacccugugagguggcagguaucauuucccuuuagcagauaagacaccagagguuagaaacuuguccgaggucauacauuuaagcugagauucaaauccacugguccuggcucucaccuguuagguuguugcucucuguuaacuagcuauguucauugcauuucccauucuuuggucuucugcuaagcuacagauuucacaggacaacuggguuuuaagcaggcaucuugaaucugcauuaucaggauuuuguuaaguuucgacuuacuguggaaguugguuacagcucuaccuuagguuccuguguuugaggaaguugaagucaucuucagcccugugccaguuaacuccugaagcuagauauuuugugacgcccucugaaucugcccucuuugcugucugaaaugaguugggagggcaucccuugggaguuuuuuuccuuuccccuuucuccugcucagguuucaggcagccugcccuaccaagaguuccccaggagcugguucuuuccauugcccuuugccuagagugcuguucccccaccagugcugcauguaccuaucuucucaggaguuagucaaggcccagcugaaagcuuccuugagcccuuggcuggcuugcacucuuuucucugcucuugggaccugcuccuguauccgugugagccuaggauuucugucuucagccuucugcuggauuauaugcugcuugagggcaagcacuguguccuaguuuccuuauaguucccaaagugcuuggcacacuugguaaauauuuggauaaguacaccagucucuaaggcugaaagggcuuuuauucauguuccacgagucuaucucaccuuguuuagauuuaacaaaaguuguugggguguauucuguguuuuaacagaaagcuaaaauacccuuaagccagugauuaaucuguggggugauuaguaaagcuuuugccuccaauuuugucugaguuaggguuaagcaauguuccugaguccccuccuucuguucuacuuuuguucugcucugugugguaaagagugguagaguaucaugucagagagcuguuuugacaaguuuauauugcaugucuuagcuacaggcaccauguguaguuugcccauccacacaggaaggauguugcagauuucccagaacuuugagggugaccuccaauaauuugggauggggggcuuugccagugcuuuuauucuguauugguuggaaauagaccuuugcuguuuugaauucauccucuuucacugcuugccuucucccuuucauguccuauuagggaguacaggagcugcuucacuuccucuuacucugcuuauaggauaacccaaagcgcugguggcacaucagcaguucccagguugucugcaaagguuugguguugauggcagcucccuagugagguguuaaaagacuauaggaggaggagccagaagauguguguuuuggguccagcuccaucaggcuuuggcuaugugauacuuggcaacuccugauccugaguuuucucaaguacagagugaagcuagaauaccuggguucugguaaggauaacuaaaaauaaucugugugaaaguguuuuguaaacuccaagacacuaucgcauguaaggauugaccauuuucuuaugagaaccuuucucaaaggcaaacuugguucaaauauaucuauuuuuuaacgcagaucucauuuuuaauauaguuuuucuccaauauuuugugaaaauuuucauagagcaaaguugagagaauuaugcacucauaugccugccaucuggauucugcaguuaacaguuuucuauauuugucuuauaucuguccacuccuuuauccauccaucaacccauuuuauuuuuggauucauuucaaaguaaguuccacacaucaguauacucaaccccuaaauauugcaguauguauaucaaguacuagagcgcaaaauuugaacuuugggcaugguaacacacaccuguagucccaucuacucaggagcugaggcagaaggauugcucgagcccagguguucgagaccagccugggcaauauagcaagaccucaucucaaaaaaaaauuaauucaaaauuaaauaaauucaaaguuuacauuuuuaaaugugaaaugccauaaaguaaaauguguaaauuuuauguguaccauuugugagauaugacaaauguauaugucuauguacuaugaaucucugucaagauacagaauuacacaauauuauaaucacccccaaaaguucuauugugcucccuuuccauucuuacccccagccaccagcaaccacuguucugaauuuuuuccauuauaaauuauuuuugccuauucuagauuucauguaaauagaaccuuacagucuauucuuuuuuuauaaggcuuauuucacucagcauaauguuuuugagauucuucuaugcugcacgagucaguaguuuguucuuuuuucuaauuaaaguagucuguuacaugaagaaaccacaguucacuuaucuauucuuuuguuauuggauacuagggcuguuucuaauuuuuggcuauuaugacuaaagcuacuaugaauauucuaguacacauuauuuuguggacaugugcuuucauuccccuugguuaaauaccaagaggugaaauugcugggucauaggauagguauauguguagcuuuuuaagaaacugcuugaccuuuucccaaaauaguuauccaauauuacacucaugccaacaauguauaauaaaaguucaguugcucuacauccuucccaucauuugguguuaaucaguauuuuaauuuuagccauucugguggguguguagugguaucucauugugguuuugauuuguauuuccuugauggcugaugauuuugaguacuuuuuccgugugcuuguuguucauuuacuguauugcugucuuuuuaaaguuuuuauuuuaauacuuuuuuauuaaaaggaaauauaaacauuaugaccucuggguagggaaggacugauuaagcaaguuacacaaggcauuuacauaaaggaaaugguugauaaauucaacuacguuaaaauaaagaacuucucaucaaaagagagugaaaaggaaagcggcagacuggaagaagacauuugcaaugcauaguaccaauaaaggauuaguauucagagagguccuaaaagucaauaagaaaacaaccgcccaguugaaaaauuggaaaagguugggacaggcacagcacuaagaggaaaccaaauagcuaauaacuauaugaaaagguuuucaaccucauuggggaaaugcaaauuaaacccacaaugaaauaacauuuuauacucaucaaauuggcagacauuuaaaagguuggcaguauuuugaggaacugcucaacauuaaguagagguguaaauuaguucaacuacuagggaaaaacccauugucauugccagguagaguugaauaugugacccugugacauagcagcuucucuucuagaaacucuuauauaucuuuacuggaaacauguacgagaauuuucagagcagcauuacuuuuaauuccaaacuuuccuguaaaacccaaauguccauuaacaacauaauggauaaaaaaguuaugauauguucaaagaaaggaauacuucacagcugugaaaaauggauuauaguuuuagauauuaacuuugauaaaucucaguggagagaaagaagaagccaucaaaaaaucuguaaguuaugauucuuuuuauuuaaagauugauaggcugggagugguggcucacaccuguaaucccagcacuuugggaggccgaggcaggaggauuacuugaggccaggaguuugagaucagccuggacaacauagcaagaccccaucucuaacaacaaaaaaaagauuaauagcuaaacaauauauaguaauacacacauagguguuaaaacuuaccauaaaaucaguucaggcaaauaaaguuuauuuuaaggacuuaaauguuuagcauguuaauuugagugccuaauauagaggcuguaggaggauaacaggcccugcucucagggaacaauuaguccuuucuggaaaggugggguaggucucugaccuggaagugaugauggcaccuugggggauggauuguggaggcaagagcuuggucuggauuggucauaagguauagaaagaggaaaggagggagagguuugaccugggcuuaaaagacugggaggauguggauaaguggaaaauauaucucuggauaaggggaaggaaggguacggggguugggugcauguuccaauuaugaggaggcugaccagagauaggacgggaggucuaaaagccagguugaggaguuugaaguccauccuauaaaccucagagaacucccaaaggcauuucauuuucagcgggguagucaaaggauaaacauguuucaugaagauuagguuucaggcaaaaauugcaguagguggggugagggacagcuagagguggggcacuaugcaggaccuauugcagugguucaggcacaagguaugaccagguaugacuaacuuagugcaguaguuugggagaggagggaaugagagaaggaaaaacugacuagugacaaauuggacuuggugagugaaagggcggagaguggagggugacucagagguugggguuuaccagcuuagaaggacugugauaacaugccacaauuuguacagugcuuuaugguuuaccaaaugcuauuuuuguaccucaucucauuugauguuccccaaaccauggggagguggaaaggagggauuuuauuuucccuguuuaaggccuaaagaagcagaaauucagagauugaaugacuuguucaaguuuguggugaccacuuacagaaacagguucacuguaauagcauaagggagaagucacaggaaagcgaauuuagggaguuuuuaaaaaaccuuucuugucuuuugguucugaguucaucuuauaaaaauaaacuuuuacuuuuccugauuguaaaagucauauucauuguagaaaacuugaaacauauagaaaagaacaaggaucggcugggcgugguggcucaugccuguaaucccagcacuuugggaggccaaggcgggcggaucacaaggucaggagaucaagaccauccuggcuaacacggugaaaccccgucucuucuaaaaauacaaaaaauuagccgggugugguggcaggugccuguagucccagcuacuugggaggcugaggcaggagaauggcaugaacccaggaggcagaguuuguagugagccgaaaucgcgccacugcaguccagccugggcgacagagcgagacuccaucucaaaaaaaaaaaaaaaaaaaaaaagaacaaggaucacuuaaauuguacaaucacuuaaauugcacagucaggagauaaugucucuuaaaauggugguguguuuccuuccauccauguagauugcuuuaaauaacuauaauuaaaaacuuuuuugggcugggcguaguggcucaugccuguaaaucccagcacuuuugggaggacaagaugggagaaucacgugaggccaggaguuugagaacagcuugggaaacauaguaagacccccauucucuauaaaaaaaaauaauaauaaauaaauuagcugggcaugguggugcacaccuguaaucccagcuacuuagacugaggugggaggauugcuugaggcugggaguuugagguugcagugagcuaugauugugccacugcacuccaaccugggugacagagugagacccugucucuuaaaaagcaaaaaacaaaaauauuuuuuaagcaguuuuguuuuuuaguucuaggaaacauuuaacuauuauuuauuuaaauguuguccccuuaaguuuucucauuuucucuucugcagcucccuccaaaagauagauugagacgcaucuugaucuguccuccgugucucuucacuuuucuuuuacuuccccucucugugcuaucuucugggaggauuuuuuagcucaauauuuuaagucacgaauucauuccucaaggucuacucagcucuuuagcccacugaguuuuuaaauuugaguuuuugucuucagucuaugguuugcucuuuuuucuuaauugcuuauucauguuuuaugguugcagcauacuuccuuaucucuuugaggauauuaauuacacucacuuuaaaguccuauucugauugcuguauuaaaaacacuuuuuauugaguuauaaauguaaucagccaagguguacaaaaucccuaaguguacagcuugaugaauuuuccucaugcucccauguaaucaccagccaaaucaagacagaacauuuccagcauuccagaaggcugccuuguggcuguuuacuguuuuuuaguauuuuuaacauuuuaugaaaaaucucaaaauacagcaaucuugaaggauuuuucacaggguaccccuguguacccaaugccuguauuuuacauuagcauuuuacuguacuugcuuuaucacauauauccauguauccauucuucuaccuaucauacuccuuuuucuuugauauauuuuaaaguaauugcaagugaggacgggagcgguggcucacgccuguaaucccagcacuuugggaggcugaggcagguggaucaccugaggucaggaguucaagaccugaccaacauggugaaacccugucucuacuaaaaauacaaaaaauuagcugggcaugguggcaggugccuauaauccuagcuacuagaggcugaggcaggagaaucgcuugaacccaggaggcagaggcugcagugagcugagaucacaccauugcacuccagccugggcaacaagggcgaaacucugucucaaaaaaaaaaaagagagaaaaagcaauuguaaauguuaguauacuauacuuccccuuaaauauuucagcaugaauuugauauuugcuuagguuuuuuccuuuugaagcaacauuuacacacagugaaaugcacaaauauuuaguguauauuugcugaguuuugacaaacgcauacauauaucugcguaauccaaaccucuaugaaguuauagaacauuauuuucauuccagaaaguuucauuaugcuccuuauuggacaaucucuucuugcaaccacccuucugauuuuuuucuuaccacagauuaguuuugccuguucuaauuuuaauauaaguggaguuacacaguauguaccuuuuuuuuuuuuucugaggcagggucucccucuguugccuagacuggagugcagugcugugaucauaguuaacugcagccuugacuucccuggcucaacugauccuccucccaccucaaccuccuggguagcugggacuacagguacgcaccaccacuccuggcuaauuaaaaaaauuuuuuuuguagagacagggucucauuauauugcucaggcuggucucaaacuccugggcucaagcaguccuccugccucagcuucccaaaguguugggauuacaggugugagcuaccacgcccaguguauguacuuuuauauaagacuucuuucccuaagcguuauguuuuugggauucaucuauguuucaugucucaguaguucauaauauuacacgauuaacuuuuaaaagcucacgauaaauauuguuaaauugcccuccaggaaaaugugaugaaauuuuguaauuaaaaaaucccugaguggcugggauuauaggcaugcacuacuuuacccugccuuguggucagauuuuuauuucauaaggagcaugugagagugcuuuguggugcauucaucaaucugacugugagaggugguauuuuauugguauuuuaguuuaaacuuacuucauuuauuauuuguuacucuuuauuucucccuaguauguuuuggacauuugaauguccucuucugugaauuuuucauguuuguugccuauaucucuauuuugguuuuagaaguuaaauuauuacuuaaaagaacuuuuuaauaaguuugaauguuaaauuuugaccucucaugugcauugcaaauuuuuuuccucaaguaucuuuuucuuuuuuuuagauaguguuuuuaaaauuuuuuuuaauuuaauuauuuuuagagccagggucuugcucuguugcccaggcuggagugcaguggcagccucacugcagccucaaacuuuuggacucaagugauccucccaccuuagccuccugaguagcuggggcuauagauguaugccaccaugccuggccgauuuuuaaaauuuuuaaaaaagagacaaggucuccccauguuguccaaguggucuugaacuccugggcucagaggauacuccugccuuagccucucaaaaugcugagauuacaggcaugagcuaccgugcuuggcagguauuuguguaucuaaacauagaaaaaguauaauaaaaauacaguauaaaagauaaaaaaugggcugggcaugguggcucaugccuguaaucccagcacuuugggcggcugaggcgggcaaaccaccugaggucguaaguucaagaccagccuugccaacauggugagaccccauuucuacuuaaaaauacaaaaauuaggcggguauaguggcacaugccuguaaucgcagcuacucaggaggcugaggcaggaaagucgcuugaacccaggaggcagagauugcagugagccgagaucgcaccacugcacuccauccuggacaacagagcaagacucucucaaaaaaaaaaaaaaaaaaaaaaaaaaaggugguacacuuauauaaggcacuuagcaugaaugggccuuacaggacuggaagcugcugagugagucagugaaugaguggugagugaaugugaaggccuacgauauuacuguguacuacuguagaccuuauaaacacuguacacuuaggcuacacuaaauuuguuuuaaaaauuuuuauuucuucgauaaucucagcuuacuguaacuuuuuuacuuuauaaaguuuuuuuaacuuucugacacauuugaaguaauacuuagcuuaaaacgugaacauauuguauagcuguagcuaaguauuuuuuuucuucacauacuuacucuauaagcuuuucuccauuauguuuuuuuuucuuuuugagacagggucucacucugucacccaggcuguaaugcaguggugcgaucuuggcuuacugcaaccucugucuccugggcucaagugauccucccaccuuagccuccuaaguagcugggacugcaggugugcaccaccaugccuggcuaauuuuuuguauuuuuuuguagagauggggucuugcuauauuguccaggcuggccuugaacuccugggcucaagcaauccacccacuuuggccucccaaagugcugggauuacagauaugagccaacgcacccagccuugauuuuuaaauuuaauaauaaauugcagccauuuucccguuuuauuaauuucuucagaacauuuauaugaugguacuaaugcugccauguacaucuuuuuuuguuuuuuuuugagacagaguuuugcucucguugcccaggccggagugcaauggugcgaucuuggcucaccgcaaucccugccucccagguucaagcaauucuccugccucagccuuccgaguaacugggauuacaggugcaugccaccaugccaggcuaauuuuuuuguguuuuuaguagagacgggguuucuccauguuggucaggcuggucuugaacucccaaccucaggugaucugccugccucggccucccaaagugcugggauugacaggcaugagccacugcgcccagccauguauaucuucuuacaacagguuuaagauggguacaauuuuauaaggcuuugugcacaaagacuuggauuuauucuuagaaucuacuuuuaagucuuaauuucagguuuuaaaacauuuuaggguagucuguaaugaaaaagcccuaaauuaaaaauuuuuuauguauaaacuuggcuuuagauaaguuacauuuacuuauugaaaucuuccauuuucuuaagaaaucauuccugagugggaccuuugacuuuaccauauccaacuuacuuucucaauuuauggaggaggaaaucgaaacccuaaggcaguugugagacaggugcaagaucacacugcaaguauuggugaagcugggacaagaaccccaagcuaacucuuguccuuuaucucauggcaccuuuuauauucaugggaagugaaccaguuacuucacucccuuuggucacugagauggccuggccucagacucugcaugcucuucuaauucagguuugcaaaguguagccuuguccagcaggcuuuacuauaucagaagcaauaaagaaguugaacacuuggaauuucuaaacuuggaugucauuagaggaguugcuagauuacugcaaaauggcucuguuuucauuuugaaugcauguacagauaccuauuuuuucaucucaguuuguaacccaugcauuugggguuggaguuggcaugcagugaaaccuacaguauuuaucaauauguagucaguaacuguauuuuugaucagcuuccuuuacuucccuaacauuuuuagguaaaaacaggaagucuuguuccuuuuuucuccccaaaucauuaugcccugucuuuuuguuauucuagaauuaagaaauagggucuuaaaaagccaaaaacuucccaugaggugaauuauaguaaaggcuuuccuugggaugaagaagucaggguuaaaaccugugggccagcaguauuuucaaaaggcacagaacaccucuauggagauaauugauaguugacuauaugagcaaacauauacucguuuucaauauugcuaaaaaucaguucuuccauuagacacuaaucucuaaugagauuaguuuucagacacuaugaguuagaaauuauuuuagugguuuucuagucugacuucuugaacuccauaguagguauucucuugucaauucucccaucuacacagagaacuccaguuugguaaauuuuccugauaggucacauucuuuuuuuuuuuuuuuuugagacggaaucuugcucugucaccuaggcuggauuucaguggugcaaucuugacucacugcaaccucugccuccuggguucaggcgauucuccugccucagccucccaagcagcugggauuauaggcaccugccaccaugccuagcuaauuuuuguauuuuuaguagagaugggguuucaccauguuggccaggccuggucuuugaacuccugaccucaggugaucugccugccucggccucccaguguacugggauuacaggcgugagccaccgcgccuggcccauauuccuuauugaacaauaaaauauucccucauucauucagcaaaccuuuggugcuuaccaugggcuaggaacugcacuggacacuugcugguaaugugaugaugaauaagacauggccucccuuuuuuguuguuguuguuguuguuguugcuguuuuuuguuguuuuugagacggagucucgcucugucgccaggcuggaguucaguggugcaaucuuggcucacugcaaccucugccucccggguucaagcgauucuccuuccucagccuccugagcagcuaggacuacuggcgggcaccaguacacccagcuaauuuuuuguauuuuugguagagacgggcuuucaccauguuagccaggauggucuccaucucuugaccuugugauucaccugccucggccucccaaagugcugggauuacaggcaugagcuacugcgcccggcuggccucccuuuuaagaugauaagcucacaagaccacaggcuugccucuaauuguguguguuuccacugcccccuugauuuuauaaaaccuguauagaaaucuaaacauauuguugcugcaauacaguuaaaaagagcgggggaauugaaaucugaaaacuugcguucaaauucugggcuuucucuuuggcuuugguacuuauuuagcugugugagcuggagcaaauugaauaacuugucugugagccacgguuccuuguauauaaaauguggacaugagagaagguauaggaagauaccuucuaaucuguuaaugcaccuuagaagugacagacuuuucuuguuuuucuuugccuauuaaccagaauuuuguuuucucaccagugggucacuggagaaggaagcuguguuauaauccuuucagugcugcugaauauacugauaauggaaaaauaaacaggggugcacugguuuucuggccuguaaaccaaaaaacaguuuucagugccaaaagcuguguuugucuugcaaggccaagaauguuucugcaguguaggacagcuucagaucccacugaaucucuuggguaaucacaugguuuugguuuagguucaguuguuuauagggcuagcuuugcuuacugugcucaguuucugcuguaguaaaauaauguaggcuggcuggagguggucucuguucaggguuauuaugaacuggccuuguucuuccagugugcaggcccuggcuaaucagagaaguguaccugucccauagcuaggcucuggaaagaccuucaagcauggcaugugaacugggcccuggcuccuccccaccagguccauuuggagucagugguuucuaaaugguggcagugagugcuuugcucuggcccucagccuucuuagcuuucuuuaccacuguagagccagguagcuaaaauaaucugcccuguuuuucuuccuuaugaggacauuuucuggaauuuuuaucccaccuuauccauucuucugaaaaacuugucuucagaccucauuuuucuaacucccagauaaccagaaccuacaugcagaggucuaggagaucucuacccugcaagcagagguucagaaaaggagcagagugagcaaaugcagauaccauuguucuguuccccugucuaacacccccuguaacucccaguugccaaauucagacuccuuucuuuggucuguaaagcccagccugauggguuccugcgcccucuccagcuucuuccugugccucacacacugaaugccucgaguacucacauuuccagggacuugauaaccucuggacuuuugacggugcaguuuccuugccaaugcuccgcaagaauuucuucccaauuuaaucaguguaauuaaccaaaaaaaccucgaugaagguagagcacuaagaaggaaguagguaacuguuaaaagauuuuaugucuggaaaaaaugcccccuuuuuuuuguauuugcaauauuccauuacaaaaacaaaaacaaaaaaaggcaagacuaagauaugauaaaggguuccaacugucaaagucaugcaugcucagaggauggagagguuccuguggucugcuguaggacaguuuuucccuccugacuguuucacuauggccuugaggacccagagaguggaagaaggucacggagaauggauggauauccuagggacuggaagagcaugguggcugguacuggguauccuuguugaacuccaggagggaucugagguuguugaaguggcuucaccuuguugggcaccugaagacgucauuacaaaucaaagaucuucuggauuugauggugcacugcugaguguuggauuaugagaucacagugaguguguggcacaaacacacuuucuaugaucagcuugauacguuucuagcugugacaccuuauuaaagcgugggucacuagccuggaaauaacuaagacugguauaacaauaaagcugucauguauugacuguuuacugcauaccaggcacuguucuaaguacuuugugcaugaacuaaguuaaucuuaugacaauccagggggcuugagguuaccuuaaagguucaccuuuucaaaauucuaccuuuuuuuuuaagagauggggucucgcuauguugcccaugcuggucuugaauuccuggccucaagugauccuccugcauuggccuccuaaaaaacucccacacacguaaagcagcuuuucaguuuguggacaccagcuugggugcccuaaaguucaauucaauucugacuggaauuaguguagaccccccagguuaaggaggcugcccccccaguucagaugccaaucgaaaguaguaggucuuuagguugccccuaauuguugucugacuuggcuacgaauuggaaguucucaugaccacccucuugggauugaugauuugcuagacuggcucacaguuuacuuacuagauuaccaguuuauuaggaaggauauauuuauuaaaggauacaaaugaacagacagacaaagaggugauacacagggcuaggucuagagggucccaagcacaggagcuucagugccuguagaguugggugcgccacccucuggcauguggauguguucuuguucaccaaccuggauggucccugaacacaucuuucuggauuuuuauggaggcuucauuacauaggcaugguugauuaaaucaucggccauugguuaucagcucaacucucaacccauuuccucuccacuugaucuuagccaaaaggccgagaagcgauucccauuuccucucaucuuuccugggggaggugggggagguaugcugaaaaucccaacccuuuaauccugugguugcuugcugugguaaccagcaccccaucuugugguuaucuaggggcuuuccacaaaucaccucauuagcauaaacuccgguguuguggaaggggcuuguuaggaauaacagaagucacuucuuucaccuuuauuggccuggagcugcuccagagcuguuucaggacaaaagaccaaauauuuuaacaaaagauaagcuaugagugaggaauuguggaagaagaccaaaauauguauuucuuauuauaucacaacuauacuuugguauuucuguguuuuucauuuuacuucuuugaguuuagugagaugucaugaauuuuuuuuuuucagucaaguuuccugauuauauuggucagguuucuuuugacuguaagugacauaaugcauucuaaacuagcugaagccagaaguggaauuuguggaucaccauauucuggcuuacauaaccagaccaagggaaggacauggguaugcuggccucugguacaaaugaaaccaggacuuuuuuuccaucuuucccugucauuggugccaucuuuguuuccuugggcuacuuuuugcuguucaacaggaaacaauguccaucaguagcuccuggccucacauuuuauaacuucaucaguagagagcuucuucccuuaauuccaauuugaaaauccuggggaaaaaccaagaugggccuggcuuggaaacaccugcccaccccagcagccaguggacgaccucugcgaugggcaacaacuuucacagaacaggauaguugcaaugagggggagcgccccucagaggaggugaggguacugaucagaacaauagcugucccugcacugggguucagccaaggccccaaaacgcuuuuucagcauaagaauuaauacuacuuuuauauguaaugauaguuuuuauuccuaaucuuacccugaggcaguuuguauucugaauuguuagagaacuuuuccacuuacucuguuugcuaagagaagaauagguaauuuguaggaaaauuucaacaaggcuucccaguugacguucucccuuacuucguguagccugccuaagagauauuuaauuacccugcauugcucaucacuucucauuuuacccuguccuuagagaagaguggaagacuguucucaaagcagugauucagggacuaaggcuccuucuaucuguggcucuuuuaucuucaacauaugguugccaagguugccaugcuugucuauauggacaagcucccaaaaggagaaaagagcauggagggucaugagugagagguuuuuaacggccaggucuagaagugguccaugucagauuacuuacuuuccauuggccacauggccacacuucacugaaggcugggaaauaugaucuagcugugugcccaauaagaagaggaacugaguuucaguagccagcaagccagccucugccacagcuucuuugguaacauuuguugcuuccccuuuuccccuuugccaugcauaauaguuguguaguuugggugggauugagcucauuuccagcucuagggugggccccagcaacauccuugccucauuuauugguucaguaauagauacauaacccaggcccaagcugagcaggacauggaauucaucuggucccaguuacuaauucaggggcaggcaugucauagaaacugucccaaucagacuauggagugguugggggaagauguuccucccaccucccucacagccccccacagugaggacaaagccaacuccugggugagaauaggcuuagagaauugcaaacccguauugugaaguccuaccaaaccuuuccugaagcucgcaagagcugacccuggacucugcguuagcaugaggcaguaaauccacucuaucgccuaauacuuuaagauuaauuuucuugacuugcaaccacaagcauccuggcugauacaaccaaugaaauggaagaggaauagggagagagaaaggauacaaucugaaucucuaaguucugcuuccguucauugcugucaguucuaugauguuucuuugaauacuugaacacaaccaaguugggucugaauggauguaucuuaguuucacuuccccauucucuggaauuagaguggggauaauuacauuuuuuaauauucuuuuuuuuuuuuuuuuaccuuuagacaauguuuucucucuggauugaaugauacauaguuucuuugaagaauacauuaugacauuuuauuucucuuccaccauaauggaaucauauggacucaacauaguccauaugauuuuuuuuccuguuuuguuuuagugacuuuucuaaaguuugucuuuucaucuaggaaguauauagaauacauuuaucuuacacauugcaguaugcauuuguuuuauagcuggguauuaucucuauauuacuauaggacuuuuuuuuguuuuuuguuuugaaacagggucuugcugugucacccagacuggaguauaguggcaugaucacagcuugagcuccugggcucaaaugauccucucaccucagcccccugaguagcugggacugcugccaugcaccaccacaucuggcuaauguuuuaauuuuuuuguagagaaagguucucacuauauugcccaggcuggucuugaacucccggacucaagcaaucuuccugccuuggccucccaaaguguugggauuacaaguaugugccacugugcccagcuguuauuacaggaacuuuuaauauuuugaguuaaauauuccaggccauuuuagaauuugaauagcuugucaaauuuguugauuuuauagcaccuccgucuugaaaaauaugcccccugguguuccuaaaagaacauuuugagagaauuauaugguauuuaguaaggcaauuagaaaucaccaaguauuuagggacuauugcuuaagaagcuaauuugcacaaucagaauucauuagcccaggacacagacaccuuauacaccuguggugacaaaugaaaacugugaaaguccaaucugauucauuccucucagaauauggaggacaggagaguggggacaaccucagcauuaggacugcccucucucguuuuguuucaaaaagaguuuaaguaacuuaaaaaauacauauaauaaguuuaaaaaaaaaaggaaauugggccaagggaacauggcgagaacugaccaauuaagucaggagugaggucaguauguggaaacacaugccacaggggcaugcaugauugccauggggcugggucacacguucggcucugagcuuccacagccucaccaaauacgaaaacaguugcagaauucuggagauuuaaaaauggcaaaugacucaggagaaguacaguuucugagcucagaccuaaagaaauuauucucucaggaaggggaacaucacacucuggggacuguugugagguggggggagggauagcauuaggagacauaccuaaugcuaaaugacgaguuaaugggugcagcacaccagcauggcacauguauacauauguaacuaaccggcacauugugcacauguacccuaaaacuuaaaguauuauuauuauaauaauaauaauaaaagaaaguauucucauggguccuuucagagggacaagguucugaacaauguugccaucauaaaugugguggugaaugucucucagugcaagcugagggcaggaugccauacacagauuccagguggggcuaaaguacaugguccaggcacucaguuaguuugauuugggaauuaacauuuagucuaccuggaagaaugugguauuacccauuuuuaaucuuggccaauuuuauuugcauuaaguugauuugaaacggauaucagucuuuguccauauguuuaucaaccauuuguaauuuuuuuuauauugucuauuacuuuggcuguuuuccuauuggagaaauagaguuuuucuucuuguguagauuuuuuaaaaguuaagaauguuaaucuuuuugucauguguggugaauaacuuuuuuuuuuucccugguuugccuuuuaaacuuaccccugguaaacauuuuuaggauugcucacugaaauaggagggaauuaggcuacuguauugcgagugggaggaugagauuagggcauguauaugaugucccuucuggcauuagagacuuuugacauguacuugagaagagggaauauuuggaauuuggacuagucccuacgaagaggagaggaggagugguuggggacauggagaaagcaccuucggcagcacuugguguccagcuguggugggacauugugcauuuaauuaccauucugcaagcugugugaucuucagcaguguuuggccauucuucuguacaugggugaaagauagacaguuagauugaucuggaauuggaguuuugcauuucgcagaauguccaguagcuacugaugagagagcaaaagugugggauguggguuuggguuugauagaagggaaaagcauuagagggggacuaggagaacagaugauauagggccaggcagugucaguuaaaggggccaaaugauuauaugcuuagagcagugccuaauagguggagcuucucaacacgauucagcaugggugguggugguaagugaagacugaagaagcagccagccacaguagcacaaaagcaggcaaaacagaucugugcuguuagaauucagcacagugguacugggaggggacacagggcggcuucuaguaugccgguaauguugcuucuugaucugggugcugguuauacagguacguucaguuugcaaaaauaaaucuauuaguacaguuacgcuauauguacuuucuguguauguucaauaaaauguaaaaaauaaugaaagagagcacauacuucggugccccaccacauuguuuucagaucucagcucugcaacuuuauagcugugagaccuugggcaaauuacuuaaccuguuugugccucagauuucaagucauauaaaaugagaauaauacguacaucacaggagugcugggaggauuaaaugagucucccaauaguguugaguacauaguaaauacucccagaguguugcguauuauuauuuuuuaaauaauuauuauaaaugcgaauauguaugagggagaacugaugaauuggaaauuuguggucagagagagcucuuggacauucugccaaaugacauuccuaaguauggccauacaguggugccuguaguggagugggguuggacugcagcucauagucagaauuaaagggaagggugaggugguuguguugccauaugaaccuugaccuugcccagggugaugguaguacuuggagugagcuugaagcacugagguccuuaauguaugugagugacuuagaggucaagagaagguggcagggguggcauugcuguguguuaugagccucaggguaucuaggagugacagugggagagucagaagcuggcucccucuaauagggaguggucugggcagcuguggccuuugcagaaaguccuauuccaggacuuucccuacagugucugugccugcauagucaguggcucagggagggaucagaagccagggaacuuugcaauguugugauggugaaauauggguuaauuauauuugcuucaauauauuuucagaauuccacgugcugauacccguaauacucugucagaccccauuacugccuuucuccuugaaccuuagcuauaucugcuuccccucaccagacccuuccuccauacuguguaacucaucccccacccccaguucaguuggagaaaguugaagucauucuaguuccacacucugggccccauuuuuaauaaccggacccuguggcuguggacacauucccauuuuaaauucugcuaccagguauaggucuugcucuuauaccuuauccuggcuaccugccaguacuccagcuuccccacagcugaggucuucuuugcauucggccaaacccuuuucugacuccaggccccaagggugcgagccuaucaccugauaugaacuuccucccuccucuagucugccugaauccuccauuaccaccuucaucccacccuauuccaccuugccccugucugcugagccaucugcauuugcugaaccucgcuaaggcauagucugccaacauugucugcuggggguacagagagagccucccucucccugugucucgaguucagcaccuauuccaccuuaguaagccugugaggcuuuccaggcaucucucccaagcuggucugucccuugucuucagggcuccuguucugacacugggcccaugggagguacaaguuuugaguccuguaaaaagaaaaaagaaggaaguguccuucacacaacuucugaccuuuuucuucacuuccugguguguuagugugugagagagagagagagagagagugugugugugugugugugugugugugugugugugauguuuagggucugaggauauucaaaguggaaaaggguauaagagcuagguaauuuuuauuuugugacuaggcaaaggcagucuaaaaaacugaccuauggagacaauuuuaguucucuucuaccuguuaauguaagagauguaaaaacuaaagucuuucuuuucaaagugacuacuagaaaauccuuuuggacuguagguaauacagaauguuuauaaucagaccaacaaaauacuauuccuacacauuguuuucuaugaccuagaaauaaggauguuacagauccuucuuuguaauggaauuuguuguccuaagaucauacccauuguaaaauuuaggacuuuucguugguaaauaauaaaauuuguggaaagaaguacucacaaggauuucaggcuggagaagggacuauuggccauuguauuuuuccuggccaguuuucaucaaaaguuuagauuuucuccggacugugguagguuaucuugucuguuaugacaaaaacuaaccaaacaaaaaacaaaugucacaugcuguuagcaggaauguaaauuagcaagauuacuuuggaaaacuguuggcaauauuuacugaaguugaaaauaugcauguucucucaccaccaguucuacuuccaguuauauagccagcagaaauguguagauauguucaccaaaagucacuacuagaauguccauuguaguauuagucguacuagcuaaaaacuagaaauaaccccauaguucaucagaagaauaagcuguaauauaagcauauaaugaaacacuuuauagcaauggaaaugaaagaucauugcuacaugcaacaccaugcaugaauuucauaagcaucguguugagugaaugaagccagacaaaaaaagauuacaugcuauaugauuuaguuuauacaaaguucaaaaucaggcagaacuaugguguuggcaguuaggacagggcucaccuuugaggaaggggagggguagugauuuggagaaggcuugagggcuuuugaauguucuauuuuugaccuaggugguaauuauaugggugaguucacuuugugauaauuaaccaagcugcacacuuaggguuuauauucuuuucuguaaguauguuaaccuucaauaaaaauguccaucaaaaaaacuuucaguguuuauuauacuugagccacauguucauaugcaccugucccuucuggucuuagggacuuagcaugugcuuuagccucagucucaaacaguuugacuuccuuuuugcaaaauaauacucaucauuuuggaaaccuuaucugauaagcugcuucccucucuuccuuacacacagaagggaguguguaguuucccuguuauauccucugugggcaccauguccugaaccacagcuaggaguucacaugucuguauguauuugauugccucuccugauguuuaaacuugaggacgcugggccuauuuaugccagucauuaugucucuagggaccacuacagugccuacacucauugguauuugucaaaugaaugaacugacuucaaagggaacagucuuuuuuucugucacccauuucaacuuuuaauuaggguuaguaggagguuggagccccugugagguugcauggaacauuuuugagauaauagugacuuuaauagccuuaaaguaugaccuguaggaaaacucagcugaaggaggggagcaguuauuggcuaaucagugucccuuaaccuaguucuguguuucccccagucguguuccugagagugaaguuuauauaugaugacuucauuuguucuggcuuuucucaugacaauccuaaggucaagucuauuuuaagucugagaaauauguccuggaaguuaguuucagagucccuauuuccuuuuucucuccuuuguauugaaaucuuggcuguccuccccauucccuccuuccaaacuguucuuagaaacgacuuugcaaguaucauaaauauccucuauguugauuuuucucugaacuuuagcuguucuuuuucaguuagauauggggaaguggcacguucucacucaccauucuaaccugacagaauuaagccaaaagcaauguucagauuggcccaguaggaagacgaauugaagaugagacauuuacauuacacuuuauuugcuggaugauuuuuguaggguuuuuuucuucuuguguaauguuguuagaagacagguuuggagccagagaguacugguccaaaacucaacccugucucucccugcuuuuugaccuuuggcaaguuucauaaccuuucggggcccuagcuuuuucuuauuuguaaaguggugguaguuguccaguuuuaauuaaauuuugaauguaaaauggucugucaauguguaaaaaauuauaaaacacucaauaaauugcaguugccuaaaagggaagcuucaacuuuauuguuagaaaaauaaugguuuuccuagaagaaaaccuaggcauuaccauucaggacauaggcaugggcaaggacuuuaugucuaaaacaccaaaagcaauggcaacaaaagccaaaauugacacaugggaucuaauuaaacuaaagagcuucugcacagcaaaagaaacuaccaucagagugaacaggcaaccuacaaaaugggagaaaauuuucgcaaccugcucaucugacaaagggcuaauauccagaaucuacaaugaacucaaacaaauuuacaagaaaaaaaacaaacaaccccaucaaaaagugggcgaaggacaugaacagacacuucucaaauuaagacauuuaugcagccaaaaaacacaugaaaaaaugcucaccaucacuggccaucagagaaaugcaaaucaaaaccacaaugagauaccaucucacaccaguuagaaaggcaaucauuaaaaagucaggaaacagcaggugcuggagaggauguggagaaauaggaacacuuuuacacuguuggugggacuguaaacuaguucaaccauuguggaagucaguguggugauuccucagggaucuagaacuagaaauaccauuugacccagccaucucauuacuggguguauacccaaaggacuauaaaucaugcugcuauaaagacacaugcacacguauguuuauugcagcacuauucacaauagcaaagacuuggagccaacccaaauauccaacaaugauagacuggauuaagaaaauguggcacauauacaccauggaauacuaugcagccauaaaaaaugaugaguucauguccuuuguagggaccuggaugaaauuggaaaucaucauucucaguaaacuaucacaaggacaaaaaaccaaacaccgcauguucucacucauaggugggaauugaacaaugagaacacauggacacaggaaggggaacaucacacucugggggcuguuguggguuggggggaggggggagggauggcauuaggagauauaccuaaugcuaaaugacgaguuaaugggugcagcacaccagcauggcacauguauacauauguaacuaaccugcacauugugcacauguacccuaaaacuuaaaguauaauaauaauagaauaaaaaaaaaagaagaaaauaaugguuuuaacauacaguauuguuagacuccgaaaaguagauuagggcuuucuuuuuaagaauuuauuuggaaauuaauuuugaugauuuauaaaugauuauauaauacccaguuauacaauuuacccuugggaacaaagaaggaaauauaauauuauauuggcuuguauaaucacccucuuacuuuggaaacaaaagagugggagugggagaauuuuggagaaccugauccacuguuaacucuaauaaucguuuccugaagaacagccccauccacaguuaaacagaaaucuggggauauuaaauggagcuuuguacucuugucacuuuuuucuuucuucaucaauuucuaguugcuuagaauuaagggcuacacuaaaugacccugcauuuguuggugagaacaggggaagcagagagauguuuuguaagggauggaagguaguauuuacauacaaaauucacagauuuggaccuuagcaacuuugauccugaugggcuugauagagaaauuacaagguuaaaagggcuuugagaugugguggaaagaacagagacuuccuauacccugccucuaccacugugcacuuuuaacaaguuauuaucuucucugagcaucacuuuucuuaucugcaaaaugggaauaaugaauucuaucuuuuagaguuuuugagauuaacugagauaaugugauaaaugauacuuuucuuaaggcagugagguagaaaagcaacaaauuuuuauuagcucuuucuuccucuccuucaauuuaaucuauuauauguguuugccagaauaaaggaauuguguuuaaaggauugucuguaauuacucaacuuaguauuuugaaauauuuuauuguggagaauuuauaacauguacaaaaguagaauuauguuguauuuguugcauaacaaauuaccccaaaguuuacuggcuuaaaacaguaauaagcauuuauuucucacuguuucuuugguucaggaauuugagagaagcggggcucaauaguucuggcucauagucucucuugagguugcagucagguguuggcugggucuuuggucauccaaaaccuuuagugggccagcggauucacuuccaaggugcuucacucauaugauuggccaaguuagugcaggauguuuugggguuugaggaaaggcccaauuccucuccaugugugucagcuucacagggcugcucagguacccgcuggcuucccgcagagaagugauccaggaagucaaagcagaagcuacaaugcccuguuugaccuagccuagacuacauauugucaguuccacuguauuuuaugcauuacauauaccagccuugauucaggguggagaugauacacgaucuugugaugauaaucacaucuuucuuucuuccuuucuuuuucuuuuucuuuuucuuuuuuuuuaaagucagggucuugcucugucccccaggcuaccaggcuggagugcaguggcaugauaauagcuuaaugcagccucgaacuccugggcuaaagcuauucuccugcuucagccucccgaggaguuggaaguacaggugcgggccacuaguccuggccacagucaucacauauuucauucauuaguggugauauggcggcaaauggugauauucuaauucucucauuacuuuuucauuuaauacugaauaccucuauaaagagaagcuccucucauuaacuaugugauaaaguuugaauagcauaggcaggauaaaugcuuguuucuuguucuccauuuauuauaccaguuuucagaauaaugguuugacuuccuaauauccuccaaaggggaccuguuaaauguuauuuguauuacuaugaaguuaaguauuuuaauguauuugauauguuucagucaauugcucuuauuaccuauauugauguucauauauuuauaccccuuuuagagaaaugguggcauacuguacauaguacucuugauuugcuuuucucgcuucacagcauauccuugggaucacuccauaguugucuauggaggaauuguucauucuuaaaaaaauugaaauauaauucauauacucgcccuuauaaaguagacaauucauugguuuuuuaguauaaucaaaguugugcaaccauuaccacuaauccuagaauguuuucaucaaagaaacccuguaccuaauaacagucccuccccauugccuccugccccuuuacccgcuacacccccagccucuggcaaccacuaaucuauuuucugucucucugaauuuaccaaugaacguuugauuuaaguaaaaucauauaauuucuggccuuugugucugguuucuuucaguuagcauaauguuuucaagguucauccauguuuuauuaauaguuugaaucaguuccuccuuccuuuuuuagcagcacagugcuccaccggcuugaucugucuauaccuuagcuaaccagcucauguuggugaacauuugaacauuugaguuguuucccuacauuauuauaugaccuugugcauaagucuuuuuuuuuuuggacaggguugcccaggcuagagagcaguggugcaaucacagcucaccggagccucgaccucccgggcucaggugauccuccugccucagccuccugaguagcugggaccacaucacgccuggcuaauuuuuguaaagauggagucucacuauggugcccaggcaggucucaaaacuacugggcucaagcaacccaccugccucagccucccaaagugcugagagucaucuuuuuuguuuuuuaaugugaauuuugcuagguguuguucaauuucccucuauaaggguuguaccauucugaauuuuuaccagcaguguaucagaaaguauuauuucucuacugccuugccauagaauauuuugugauaucucacuaugguuuuuaguuaucauuuuacuucucauaucgugauugagauugagcaucuuuucacauguuuaaacucugcauuccuuuuuuuguuaacuaucuguccauaucacucuagacucucuccaaagggucguuuguauuuuccuuccauuuuuggcaucucuuucuauauugcaaauauucuuuccauuucuuuauuucuccuuuuguuuuaagaugacuugucggcugggcguggcggcucacacuuguaaucccagcacuuugggagggugaggugggcaaucacucgaggccaggaauuggagaccagccuggccaacauggcaaaaccucgucucuauuaaaaauacaaaaaugugcugaguguguuggugcacauccguaaucccagcuacuugggaggcugaggcauaacaaucacuugaacccgggaaguggagguugcagugagcugaggucgcgccacucacuguacuucagccugggugaccaagcaagacuuggucucaaaauaaauaaauaaauaaaauuuaaaaaaugacuugucauugcaaauuuaaauuuuuauguaauuaauucuaacaauauuuccccuaauaucuucuggaguuugagucauaaugggaaagcuuuccauacuccauguuauaaaauauuuacccauguacucaaugguuuuauuuuucacauuuaaaucuucaauccauuuggaauuuaucuugguguaugauaugaggaauaaauucaguuuaaucuuuuuuuccauauggcuauggaauuauucccagcaccacuuauuuuguucauucccccacacuaauuugagauaaauuccauucauaauugaguucauuucuggauucucuguacuguuccauuagucucucuuuaauuaugugccacuaccacacuguuuuaauuauagagcuguauaagaauuaucuugcaaggcuauuccucucucuuuucuuucccuuuucagggucuucuggcuguucuugcuuguuuguuuuuacagaugaacuuuauaauuagcuugucuagcugugggaagaaaacucaaagguuuuuucuuuuuauugagguuguauuauauuuacaaauuaguauagggagaacugacaucauugugauguuguaucuucuuauacaagaacaugguaugucuuuuuacuuguuuaaaucucuugugguuuuuugggaguguuuuuaugacucuccucauagaguuccuuauugaguuuaugccagauguucuauuauuuuuugcuuucauaaguaggauuuucucuuccauuauguuucuaacugaauuucccuuuuuuuuuuuuuuaauaaaugaagccugggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcagagcuugcagugagccgagauugcgccacugcaguccgcaguccggccugggcgacagagcgagacuccaaaaaaaaaaaaaauaaauaaaugaagccuguugauuuugauauguuucuuauauagccugcuaaguucucugauuuguaauacauagcacauaaauucuuugggguuuuccagacauaucauuauauuauuuguaaauagaguuuuaccucuuuuccaauuuuuagaccacuaauugcagucucuuauugcauuggauaguaucuuuaauacaguguuaaaauaauaaagaagauaauguuuuauacaaaauagugugucuuguuucuaacuuugucaggaaaguucuaguuuuuccccauuaauauuuagcagacuuuuacacuuuuauuaaaggaauaagaccggacacgguggcucacgccuguaaucccaacacuuugggaggcugaggcggguggauuacuugaggucaggaguucaagaccagccuggccaacauggugaaacccugucucuacuaaaaauauaaauauuagccgggugugguggugggcaccuguaaucccagcuacuagggaggcugaggcaggggaauuauuugaaccugggagacagagguugcagugagccgagaucgcgccauugcacuccagccugagcaacaggagcgaaacuccgucucaaaaaaaaaaaagcaauagugggaggaaauuauguggagaaaguuuuuguguuuuuugcuucuuuucaaaguauggaugagauaugcccaggaugguggugguagauauugugauuauuucuacucucaauucuguaguuauaauauccagaauaaguaugguuugaugagcguuucaaaacaaccacuuuggcuaucaagugaaaaguagauuguagagcaacagaaguggcaguaggcuaacuacaggacuuuugcagcucuucagagaaguaguuuggauuucaugguagcaguagauguagagggauauaggcaaacuugggauauauuuuggaaguagagucuguagugguacuaauuaaaauagucauguagauaaacuguuucuuacuguuucaggacaagaugagucuaugccagauguaagucaccacacucauuuacugauuucuuccuugaggauuuuuuguuguuaaaaaauuuuugugguugaucugcauucugucuuaaacucuuuauuucauuguggauuauuaacaguugguccacgggccacacuuuaagcaacgucaaucucuaguauccaucuuaggggcaaaccaugaucuauuuaaccagucucuuacuauuggguagaugguuaacccucacaucaucuuuuuuuuaguauuaggaauaaguaacauugccaugaaaugcuuguuucuauaauuauguguauauaucuuaugcuuucuuuaggauaauuccuggaaauagaguaaggauuuuggaacauaaugacaaauuguucuccauuuuacacacuugcagagccacauuuuuaccaguaugaauucuuuuuucaaaaaaaucuuugcuaauuuggaugacaaauagcaaguuguuauaugaauauguacuuauuugauuacuaguaagaauauuuuaaauguauuuuuuggaauugauacauccaccuuugccauuuuuaaugcucuuggaucauuuuuacuuugggguguaaguaccauuuacauuaagguuauuuacucuuuguauaaugaaaauauuuuuccucuguuuuaaaaauggauuuugguauuuuugcaucauguagaaauuguccuuuuuuauagacucuccuagcaguauaguuacuugggagguguaguuggucaagccuugcugccucccugcuuccaucucuaaagagguugcccuuuggugguaagggcaguucacuauugugaacuugcugggguaaaagguuuuggugugaggaacuuaggaguuaaaaacucuucuguaagggaaauguauaugagugauggaugauauuaagagguuauuuuuaaauuuuguuaggugugaaaauggaauugugguugaguagaaaaaucugcauacacacauagauguauuuaggggugaaaaaugugagggauuuucuugaaaauacuacagucaaaaagauagacauagcaaauguaucaacauuuaaaaaauuuuugauuugagugauggguuuaugaguguucuuaacacuuuuaaaauuuuauuuuaaagaaauggggucucgcuguguugcccaggcuggacuagaacuccugggcucaaacgauccacguaugucagccccuaccgaauagcuggcauuacaggagcacugugcuuggcuucuuaauacuauucauuauuuuugugggguuuuuuuuguuuuguuuuggagucagaguuucgcucuugucacccaggcuggugugcaauggcaugaucuuggcucugcaaccucuaccucccagguucaagugauccuccugccucagccucccaaguagcugggacuacaggcacccaccaccacaccuggcuaauuuuuguauuuuuaguagagacgagguuucacuauguuggccaggcuggucucaaacuccugaccucaagugaucugcccaccuuggccucacaaagugcuggaauuacaggcauaugagccacuaugcguggccaguguguauguuucgaaaaggcucuugggucucuggagaacuuugggggaguuuuuuuuugguuuuuuuuuuuuuuuuuuuuuuuuuuuggcuuccugugacuaggauucucuucuuagucucucuucuggcacuuugcaggccgggugguuggugaucuacauuacaaauggagccaccaguaaagucagaaaugagucaaagaaggagguuuaugguugccccuuuauuuaaaugaucauggucauuggcaaauaauagguauucuuucuuaggcacaagauuacuaaucuucucaauucucugucuguguuuauuuuuuaugugaucugucugccaaagaaggagaguaguguuuugaaguccuucagucacaguugugguuuuggcgaguuuuuccucauacuucucacagcucugggcauuaagaaaacaacaagggcccggcgcaguggcucaugccuguaaucccagcacuuugggaagccaaggcggguggauuaccugaggucaggaguuugagaccagccuggccaacacggcgaaacccugucucuacuaaaaauacaaaaguuagccgggcaugguggcgcgugccuguaaucccagcuacuuggcaggcugaggcacgggaagugcuugaacacgggagguggagguugcagugagccaaaauuguaccacugcacucuagccugagcgagacugugucucaaaacaaacaaacaaaacaacaacaaaaaguuuuuuuaauuuugaaauaauuuuagacuuagagaaaauuuaccaaaaaaaguacaaagaauuccugcguagucucuacccagauugcccaaauguuacuaauauuuuaccaugggcuucuauuuauugccuguauguauccauauuauuauuauuuucuuaaucauuuaaaguaaguugcauacccgaugccccuuuacaucccuucaguguguuaauuccuaaaaauaaggacauucucuauuaucaauacuguuaccaagaucaucaaauuaacauuguuacaguauuguuaguaccacagaccuuauucauguugucccacuaauuuccuuuguagcugcuauggucucaauguucguauucucccaaaauucuuguugaaaccuaaucacuaaugcaaugguauuaagagguggggccuuugggagaugauuaggucaugggggcagagaccuuguaaaugggauuaguucccuuaaaaaagaagauugagggagcuuguucuccuguccgccuuguaagaacacauagcaggugccaucuaugaagaguaggcccucaccagacacugaucuuggaccucccacccuccagaacugugagaaauaaauuucuguuuauaaauuguccaagccuggugugguggcucacaccuguagucucagcaauuugggaagcugaggugggaggauugcuugaagccaggaguucaagaccagccuaggugacauaaugugaccccgucucuaaagacaaauuaaaaauuuagcugggcaugguggccuuugcccguaguccuagcuacugggguuggggguggugguagugcagaggugggaggauugcuugugcccaggaauucaaggaugcagugagcuaugaucgugccacugcacuccagccuaggcaacugagcaguacccuggcucuuaaaaaaaaaaaguuaccuagucuaagguauuuuguuauagcagcucaaacugacuaagacaacagcagaagaaaaaaaaauacuguuacuuucugaucucauauccaauccaggaucacacauuaaauuaucaugucucucuagucuucagccugaggcaauucuuaaguaccuguccauugagaucuagauguuuuugaagaguacggaacaguuauuuuguaggauuuuccuuauguuugcuuugucuccuguuuucuugugauagauucaggcugugcacguuuggcgggaauaccacaaaagggagguugcguguccuccuuacugcaucauaucagaaggcacauuccaucuguuuguuccauuacuggugauuuucacugugaucacuuaagguggugccugccagguuuccuuaguauuuucugcuuugaaaugaauaaauaucuuauggggaaguauuuuaagacuauauacaaauucucuuaaucauuaagcuuucaccaacuaguuuuaacauucauuggucauuuuugucugaaauagcuaauaccacggauaguugccaaauggugaauuuuaacucauggguagcauguuuugacagcuuguuauucagccauuugggguuugucuuaguucuuuucagcugagauguacagcagcuuuguagaaaagggcagcuagaucucagcauugguccaaagacaugggugcuucacauuuuguuauaucuguuuggacaggaccuggaugggucgaguucucacccaugcuggacggggcacccugccucugccugucugcucuucucuagcucuagcaccaguccacccaggcagcuuugucuggguauuggaaguguuuuuuuuuuuuuuuuuguaaugucugacauagaucauauuaacuagaauaaaccaggcaaggcggcauuuuucagaaggggcuauggcaugguagugucauauauaugcaaaauuuuuuuuuuuuuuuuugagauggagucuuguucugucaccccugucgcccaggcuggggugcaguggcgugaucucagcucacugcaaccucugccucccggguugaagcaauucuccugccccagccuccggaguagcugggauuacaggugcaugccaccacaccuggcuauuuuuuuuuuguauuuuugguagagacaggguuucaccauguuggccaggcuaguuucgaacuccugaccucugaugaucugcccaccuuggccucccuaagugcugggauuacaggcgugagccaccggaccuagccagauuuauaucuaaugggaucaagagaauauuuauuuuguugaauggaagaugaagauauaugaacauguuuacaugcuaaagggacagagucaguaggagagauuaacgaucaagacagaggggacuguuaagggaguuucccugaaaagguagaccuagguaaugggguuagcucuuggcaagagaacggacacucaggaggaaguuggaaggaaugaagggaagggaacaguacuguuuuucagguuaugaguaggcaaacauuugaaggaguuguucccuaauugccucauuuugcuuugugaaauaggagugagauuauguccuaagaguuagcagguacacgucuugaggacgucgcugaauagggaaaguguuguggggaauaagagcauugucugggguucaccaaaggauuucuaggcuucuggugguagagaccaugaauucuugguggccucagucugcaaggcucuguuauuuuucucccgcagugguuaucagcucagguggagaagcauaggaaauaauuggguugguuggggauggggcuuugccacauauuguggugggaaggccagggagguaggagaacagagagugggacaagaggguuggacuuuguuuggagacgugguuuaugacuccaugguggucuauacagaacuggggaggugggauuggagagaggguaaaagagugaaugucuugagaaggucagagaauuauuggaggaggaauuagguucaagauugcuagcagcauaggaauauuagagaguagaauauuggaguuuagcauuuucaucaugggacaguucuggcugaugaggggcuggaguggagcaggguaaggugaagaucacuggguugugagaaaacuugaaauugguggauggguuauuuauguggacauugacaccaccagguugaugggaggacauugguggaggggggaugacaguguuccaaguguucagggaaggagggagaguugagcaggaaugaaguauugaggccagauggcaugaacacacuuaaaagauggcauuuugguugccaagggaucagggaugguuuggaccuggagguuugguggaacuggcuguccacagccuccaaagaugucuugaugcuacgaagaguggaauuugcucagauuuccaaaaaaaaguuggucauugggccuuugcuuguauuucuucuuccuguagcucccuugccuaccuucucuaccuggcuaacuccugcuggcccuuuaagacugagcucugagaucaccucuuccgggaaaucuuucuugaacccucugauccgucuaucugucccuauguuccuuaugcuuaucucuaacuuagcagguaucauaccauaucaucgucugcuguccuucccuccccuagaccauaacuuccuugaugaaagcagggacuguaucuuugcaucccuggcacaguaccuggcauauauuugguugaacuauaugaaauugccauuuaagaagugaauuuggucuaguuuguaauuucucuccuuaauaggugacuuucuuuugucagcucaucuugaaucuuuuucugaaguuacaagccccuuucuuaguuuggccuuagccaaguuccaugcagguuguuucucuuuuagugaccaacuaauuucuaugugggccagucagucuuucaucuugcuuaggcuuuuuuuuuuucuuuucacccucuauuacuccuacugcguaggcuuuuuguuacauuaacuucccuuuugcuuuucucuacccucagcagagggggucaaaagaaacuucuuuguucuuagucuuccuuagcugcccaaaauuucccaguaguuugcccaugcauuucauuccccuauugacucuuacugagugaccuaugugccaggcaaaaauucggacuuguucauucuaguuucucugcuucuagugugucucaugcugguguuuguuggcucagauguguuaauggggcugccgcugcuguugugguuguuagucauucuuuugaacagcggcuuuagcuuaccaaugcuccagauacaguuuuucagaaacucaaugaucugugugcauuacacauuaaaaagugcauugaacaacagcauauccagauuaaaaacaaacaaauuagauuuaucugguguuuuuccauuauggguuggagcaaacaugcuguguauaaaucagauaaaccuuuucuuucacuguuucagacugagaauuguuuguucuugcuuuuguggucaccaagaauguaauauaacuaugcucuucacauccuaaggccaccauaaguccuggaucagaccuguuuuuuugaagucaccugaauuuugacuugaggcucccccaacccuuacucccacuaccccuuugaacuggaucacuuugcuuuuaaggggcacucccuugaagccaguucccugaagugaccuacuuucuugaggugcuugaagagcuucccuuucauuugggaggcuuccucagugcccccauucccaggcguuuuuuccugggaguccuguccuauucaugaauuuccuguuuuuuccagggggguggguagggggugugggggcaggcaguacuauguuauuaucguaacuagugacauuuaaagaaagaaacccaaagcccaguuaaccaauuacacuuaaauucucugggcccaggccugcuggaugcucuccaucuaccagaaaugcuucuuaucauccccccucuuuuuuagacugcuaauccuuaacagauuaaucugaguuuauauuuagaugaaaguuauucauuaauagaaaaaccugaaacuguagugagggcugacaguguugaaguggauagagguacauaggccaccuuuagaccaaaaagucuuuguaaggcacuggagucuuuaagugucugcuuuggcacaaggacaucagguuauccuuaggaagccaggaacaccuugagacucgggccagaacaauguggcccaccuuugagcuucagguuuggucccagugagucucacgccuuuuugaugcugaccauauauauggggcaaaacacucuguaaucugcuuuaccccacuacacccaucccauccaucccuaguugcaaaaauuucaacuuguaugaauaugcacagauucaauaguggaaacucagcacuguugagugccaggcuucaaauauggaauuagugaccucugaacccguguuugucaaacugccugcuaaugggucaugacaucaguuuagcagauuaugccuagcacuauuguuccaguuaaauugcugugaaacaaaccaccccaaacuuagugacauuaaacaguaaccguuuauuaugcucauggauucuguggcucaggaauuggacaggguacaaugggagguggcuugucuuuguuccaugauggcuggggguugggaucauuuggaggcucuuuuacuccacaucugaugucugggcuggggugccuugaaggcuaguggaaucagcugggaccaaugaccagaacaccuacauguagacucuccauguggucugggcuucucacagugugguggcuggguuccaagagagagguuccccagaggaagcauuuagagagccaguguuccaaaagaacaaggacauuugauaaccuugccucugaaguuacauggcaucacuucuguuccggauuuguggaugcuaucucaagccugcacagauucaagggagguggagauagagagauggagaucuauauccccaucucucaauggguagagagucaaaagauuuguggcuguuuuuaaaacuacuacaaguucauuuuaaaacaagauagaugcuugagcccaaaaguuugaggcugcagugaacugugaucauaccacugcauuccagccuggcccugucucaaaacaaaaaacaaaacaaaacaaaaaaacuaaauuuaaaaaauaaaacaaguuagaauauagaacaacagagugccucauguagucaaaaaaggcauugugaaacuuguguuucaguuaugugugucuguguguucugguuuaugagguaacguuuuucuuucuguggucuacaaaaacauuuuuuaaaacacugcuuaacuguaguaacaucuaauuugguuuaugaacaccaaauuuuaucucuuaauaccucaguuaauagguuacuauugugugguucuuuguuauaaagaugagaaccuaaggaauugauuguccuuugccuguaagaacaaaaaguccuuugggaccuguuuucuuugcccuccaggacucccugaaggccuuguuggacuguggaccagacuuggagagucagugugcugcagaaugggcuguggucugggccaggagucaaaacuuccuuaaaguuuuaguccaaucuuugccagucaguuuccuagaguagcaaacaaaugugaaaugaagaggacauacuucuuuuuagagacagucagaaaauauuuagccaucuggaagcccaagaacuauucauaauaauaaagagacagcuaccucgccugagcaagguggugucugugguaaagcaaucucaggaaaggcuuucuaccuucaguguugaaaucaaaaggaaauacugagauuggggucugcaagaaaagacaugcuauguguguugccaaaacaaucugccuuccuccccuugcugugacuuacugcguuuaguuauuccuacccuuucaaggaaaugugcaaagaugacugagcaauggcauuuacugucaucuuauaaaacacugcauugcaaaacaauuuuugggaauagugcgauuaaaugguaaauuuugcucacguauguuaggaaauuuacacaauucugugcuuuuauuucuucuuauuaaaaugagacauguuuauucuagaaaacuagaaaauacagauaacuguuauuuuaccacguagaggaggguauuauuuaccacugauuuuuuuuugguugcauauccuuccugucauuuuucugauauguauacauuuuaaaaaacaaaugggcuguugcaguacacuguucugaaaucuacuuuuuaaacuuagaugaacacauuccaugucaauuaauguacuucuauuauaaaaacuucauaguguuacauuguauagagauaguauuugaacgcuuaacguugcuggcaacauuuaacugugguaaacgaugcuguggugaacaucuauuaauauauaacuaaaucuuuuuuguaaucaugauuccuaaaauuuuuuaaaaaucuuuuuugaauauauauguacaugguacacaauguuaugauuuuccuuaggagauaccuauguaauuugaucugcuaaaucacagagcaugaaccuauuuuauuuauuauuuuauuagagacagagucuugcucuuaucacucaggcuggaguguaguggugugauuauagcucacugcagccuggaacuccugggcucaaaugauccucccuccuaagccucacaaguagcugggacuacaggugugugccggcacaacuggcuaauuauuuuauuuuuuguagagacaagaucuugcuuuguugcccaggcuggucuugagcuccuggccucaagugauccuccuuccucagccucgccaagugcugggauuacaggugugagccaccacgcccgcccagcauggacauuuugaaaacaaaaaauuuuugugcugcuaaauuguccuucccaaauguaccaguuuauacuccuacaaaaguguuaucuauuccuuguauuucgcaauuugauagagaaaaaagucacuugcuuucuuaguugggugauuuauuugcauuuuaacuucuuuagcauuuuaccucugaaaaucuugccuguuuuuuaauccucaucucaaauaccucccacccgaccccucccgagcaccucccagcacaaugaagacuucccaucugcucugucuuguggauuuuucuuguccuuuccaaucaccugugguuuacuugagagcauuaagcacugugucuaacucacuuuuuaaucuucuuuugcaugcagcauauuucauugcauauguuuaagacucaguaaauauugaguuaaauugcaguccaacaaaaaggauugauggcagcacaaaguaaucugucgagagagagaaauguaaagaaaagaaauguucgucaagcugaagaccaugugaagcuacuuuggagagggcauuuaguauuucauuuaggaauucuuauuugccuguaguaaaaaaagaaaggccucuccuuuuuuuugaaccauuuuuauuuauagcuaauacuuccauuaggcagcccagcccugaaauucuuguuuaauaauagccgauguuuugucaauauucuuauguuaaccguagguaguaggauccucugaagccaggacuauuuuuuuaaugacccaacuuauuguuaaaauauauuuucucaauaaguuaguguuggcuaccgucggaaacuuacaucucuuuccuguuuucaaugccuuucccuucugccauuguauuugguucagaccccuucagaucuguuuuguccucacgggucuuuuuuuuuuuuuuaaugacuuuauuuaaacuuggagcaucagucacaaauuugcagagacaaugcuauuuucuacugaaggcuuuugucugagcuuauuaccucucuuauguuugccuuauauccaucuucuucccaaauauacauuuuacuucuauuuauuucuuuucuacaugaauuuguauauauguggcgcugagugaaauuacaagaaaaugcaaugguaacacacaguuuauaaaacccuggagauagaaacauuuucuggugccugacacugcuggacuggacccuuuucugaagcugcacauucugccauuauucaucucugaguguuagaugguaucaguuaggacccuucagcugcaacuaacagcauucagaacuaaaaagcaacuuacuuuucucacauaagaagucuagagucuggaagucaagugucacucauaugacaaugucuaaggcaggugggaagggggacacucuuuuaacugggagaaagaagucuccaccucuccccagcgggcuuccccucaggucccacugaccagggguucugugugcgucugcucuguucuaaagaggguugcagaaggaacaucuaguggcuuccacugcugucaagggaaaaaugauguugagaaugugaccaacaggugcuguuagaggcauaauucucacuugcauugagcuccaaccucccuuugguuacuuccauaggucagcucuagcuguacucuaaauuagagucccacaaccauuuuauuucucuuucuuuuuguaaauuccuagaaguguugaaaacagaggguaugauucugccugaguuuugucuccugcuuguggaauaucuucaguuccuggaaccugagguugugucuugcccccguagccuccauugaaucuggcccaguuugguaugaucuccuagccacagccucuuugucucccagccacagucacuaguuuccuuuuccugugagaagugagaauuagucacucacuuccagugcuaagcauaaucagagugaggaauguaggagcagcucuaaaaaccugagagcuauuggugucuggaauuaguuuuauuguuuuuaccugguauuuguuccugggcacuuaagugcuugccuggcugcagcacuguuaauugaugagacccaacuaggcccucugucaucugacccugaccccucugcagccucaucuacuguggaauccuccauuucaaccauacuuagucauuuacuauuccuuaacaugcuugguggcuucacacuuccaugccuuuuugcacauaauauuuucucuuucuagaauguucaugucccucuucuuaucuggcagagcccuacuuuuccuucaagauuuaaccucagcaggcaucacuccacuccuuuggaaaacuuuugugauuuuucccuuggacagaguuaaucaguuacuuuucagucacacucucuacaaguuccuguuguuaaacauucacaaaguguuguaauuaucuguuuauauuuuuauauccuucuauauuuagcuucuggaagaugggauuuauguuuuuauuucuauaacaucaguacucaguauacguuuagcgcauaaaaggugcuuuguaaauguugaaaugaauaaaugacaauuuuacaucuaaaccugcugauuaauaccaacuucauauccuucuuguaagaaaucuguauauauuagaagauuauaaauuauaaaauacacaagcuacuauguuaucuaaaacugaaucugauagcccaucacauuucuuauuuggcagacuagacugaggccuggaguggauaagugacuagccuaggccacauaaugaugagaggcagagauaagacuagacuucuaugucuuugucucucacauagcuugucuuguaguuucuauaacaccaucuuaccagauaggugagggagauuugggauuagcaucaucugugugccgucaaaaacccugccauugcucuccucgccuguaugcuuuuguucacguggaccuuuggcucucugcuugccugaguccugcccuguugcuccagaccuacccugauucuugccuuuucugaccaucucagucagaaucacuuaaaccaucuucugaguuuccauagcuguuuauagcacacgcagcaauaccaugcagugacugaguacagcccucaguccacaccccugcuuccuagcugugugacugacaaguagauuaaccucucuguuuccaaaucuauaauuaggaauaauaauaacaguuccuacuuuauagaguugaugugugaggauuaagauguucugugguacauaguaaacauccaaauguuacaugcuguuauugguggugacggccugauuacuauucauaaaucgcuagaggcugauuacuggcugccucuaguuucagcucuuccugugucugacugcuuauugcugaauccaggguugcccaguuuuguaagggguauauccuaaccugcagguuacccucagacacuuguuggaauauuuuugcgaauaacauucacuuaggaguuuuguucccuggcacacaccagugcuuugucauguagagguucgcucauuuguauaggugauguuacuuugaaaaaguugucucuaaggucugcucagugaaagaacaggauguuuucucucuuuacuucacagccauagccagcuuugagguucaguguuuguauagcucuaagucucuguuaauuaaggaaauggacuagaaaagacaguuuaaugaaaacucacagacaguagacaauuugcacacauuccauuguuugacaccauaguagaagcucaccucuagauguaaaggagcagucuguaauucucuugacccuuuuccugauuaauaaccuguagauauuguccauccaugguauaagaguuggauaguuuuguuuggauuuucucuaucuuguaaaugagaaaccagggaaagaaaauacaguguauuuauuauacugggaacaaaggucauggaaacaguaacuuuuaaaaagaacccuugguuaccuaguuuuuaaagaccuagacuuccuuguucuauuucuaaaagucuguggaauaaaccccucauuuucucugauuuacaaggaaacuaaaauguggaaaauuugaucuuuaaggggcaugacuucugguuuaugggauuguuuauuuuaaaguuuaaacauuucagugucuuaugauacucuuaguuaaaaggaaguucucuugaguaucauauaacuauuaaaauuauaauuuagaucuguauuuucaagaaaauacucaguuuuaaguggaaaaaugcaugggaaaaggucaauuuaaaugcauuuuaaaaaaucaaagaauaugugcuuauguuaauaaggauuacuuuaggguaaugagauuucggguaaucacuuuuuacuuuuuuccucugcagccuuucuauauugucuggauuuuggagugaccauguguuacuccauauucaaaaaaauuuuuuaagccauuuuguuuauggaggaaaaaagugcaacuuaagauuugaacaugguaaagucagccuuuuucuaucuuccccagggaaguuauccccagcagcuaggagagaaagaaacagaaaugaaaacuccaucuuugaagaaauugggagauaucugaaaccccaaaccagaaaaugaguagaauaaguucuucaaagauugaaccaggguaugagaggaaguagacugaaggcacuugggacuacagaucucaggaaaagagagagacauuuuccaacguaagggacacacccugggauucaaaaccaaaugcuucauuugaaauaguggaaaugagcacacaagcugauggcaggagcuucccugcaguuaguuugauuccaggaugcagaagaggcuggauugaaugaggacuuagacaaguaguacuuguagggagaggucugaccuuguagcaggaaggagagacuacacugugaacagcuccacagcugccuuuugcuuuugguugaugggggagagaggcucaagaauaccuuccccaacccugugugcauauauacacacaggcuugcaaguaaaagaaagaagacuucuacucuccugaauauggcccuggcuccucucccaaaugaaucuucaaauagcugguccaagccaggcgugguggcucacacuuguaaucccagcacuuugggagacugagaugggcagaucacuugaggucaggagcucgagacuagccuggccaauauggugaaaccccgucucuacuaaaaauacaaaaauuagcugggcgugguggcgggcgccuguaaucccagcuguucgggaggcugaggcaggagaaucgcuugaaccugggaggcagagguugcagugagccaagauugugccgcugcacuccagccugggcgauagagcaagacguggucucaaaaaaagaaaaacaaaaacacaaaaauucccuaaagaaggaaacaaauaguggagaaaacaaaaguuuuguaguacaaaucaagaaguuuccagaaauaagagaaagcuugaaucuacaguuugaaaagacacacuguguucuggaaaaauuaacauagaguggccagccuugcaacaucucccaguaggguuauuagauuuuaaauguaaagaaucauucaggcagccaggccaaaagaucaagucacuuaguaaaggagaaauuuugacuccuccguauuauuaacgaucaugggaggacacuggagcaacagugagaaacuccguaaggaaagucagugugacucaaggauuuuauauucaaugaaauuguuuuuuaaauauaaaaacaacaaaugcauuuuucuauguuagaaaucaagaaagaauauucucgugaacgcuucuuggaaucuagucgaagauaaacuucaguccaccaagagauaacuggaaaaacuacagcaaaguagauggcaaugaguguugacccucuaacuguagguuaaaacaaauguggagauugauacaguagaacagaauguaaagguuauaugaccugacgguguguggucauauaacuaaccaccugugggaggagaggggaaagaagauuguagguaaaguaagagugcuguucccucaucguuaauagcuaagguucaaaggguaccauguaaagcugacaaugaacuaauagagguauagggucuauuuacagcuacaaagcuaaacaguaagaguuaauauaacugacuaaaauagguuagcaaaagaauggugcaggagaagaaaauauuuuauuuauuuaguuuuacuaauuuuagagacagggucucacuauguugccuaggcuggucuugaacuccuccuggguucaagugaaccucucaccuuggcuucccaaaguguugggauuacaggcaugagccaugaaaccuggcccagaaauauuuuaauuucaucauuuucauggggguuaaauagauacuaucuaaauaaauaaagguugauagauauuuauaaauaagugaccauuagacaaaauaucaguuaucuuaaauaucaaaauacaugcacaaaggaaaguagccucuacaagggguaacagaaacaauggacagauaccugacauaccaauaaauauaaaugggaguugggguuacaacagucuuggucaucaagaagucggaccuuauauuccacuaauauguuucucugagcaacucaaaaccugguauuucagaagcuuuggggucagcaggagcaggaccucaccucuggguauuuccuuuuuuuuuuuuuuuuuuuuuuuuuuuugagacaguguuucccucuugucacccaggcuggagugcaauggcacaaucucagcucacugcaaccuccgccuaccagguucaaccgauucuccugccucagccucccaaguagcuuggauuacaggcgcccgccaccacgcccagcuaauuuuuuguauuuuuaguagagaugggguuucaacauguuagccaggcuggucucaagcuccugaccucaggugauccgcccaccucggccucccuaagugcugggauuacaggcgugagccaccgcgccgggcccugaguauuaacuuuaaagugauuuucuuuuuccacucagccaacuauagugaagguacuuaguguuuuguuuaaggugauuaguuucacuccucugaaaaaauuaaaaauucaaaacuaauaaauaaaugaaugaaacuaaaaaaggaaagaccaaauuauuauuuauuuugaauaguuauguuggaguuuuugauggaaguucuuuucucaagagcuauucucaaggaccaggaaaauauauuuuguuuuuggaaguucuuggaauauaaacagaccaacuuucugaagugucauaauaugugguccccuaauauguguauuuaauguucuccuuuguuucacccucagaaccaaagcugccuucauuccuugguuucauggaaauagugugcauauguaacagacaauaauagcacacauggagauucuaguuuaaaugacaucuagcaguugcuaaugccaccuuuccaaauuuucagcagaucugagguugaaacugacaacaccaaaaaacaguccuaguggggcacauauuuagaaguuauggaacuggauugaaaaacauauuuuaaaacaggaauaucacccuuggcaauuugauagaaaaugggaagacuuaacugccuuccucaugguccacuccucauuaacccuggcagccauccaaauuccucuguuuauguggaugcuacuuuuaacagcagucagguacugcauucccugucuucuuccugcuuccucuugguacuacucuauucuacaucaauucaaagacccuggcugccagcauauaucugagcagugaaugugaugcugucucagaggcucccaugauuaaaaugggggcauaaacaggaaacaccccaguaguugaccguguuagagacauugaaggacagaguacauacgccaggaagcagagccacuuuauuccuaaagccuaguggacuugaaccuguauacaucaacccuucccucccaccaaacaaaacauuagugcucagagaguaaagcuaugagcccacauacacuuuggcuaugggcagaugcaggauccagguagaauguugaccuggggucauucuuaaggaguuccugcccaagauguuagcucaucaggcugagaggacuccagcaguaaagguugugggaucuauacuuugguagaaaaggagaaaggaccaagaaaagccagcugaggcacugccucagcugcccaucuaaaggaaguugcagcaggagggacacaguagaagaaucucuagagacaucacaaaaaugcuuuuuuagagaaagagcuuuaaacauccaucaggccccaagaaugagaagucgucuucuaacagcacuggucagggacuucucugacccuuuccuguccucccugccucagaaacagcagcuagcagauuggggaggaagugagggagauagaacaguccccacccccagcuucuuccccaguggcaggcugccccugcaacugguccugcuauuagagagaggucuuuucuucaaaugaagguugcagugcucuuaagauacuggacuaauuuuuuuuuuuuuuuuggagacggaguuucucucuugucgcccaggcuggagugcaauggcgcaaucuuggcucacugcaaccucucccucccggguucaagggauucccuugccucagccucccaaguagcugggauuacaggugcccacgaccacgcccagcuaauuuuguauuuuuaguagagacaggguuucucuauguuggucacacuggucucaaacucccaaccucaggugaucugcccgccucugccucccgaagugcugggauuacaggcgugagccacagcacccagccugaucacuuucuuuuugcaaauguaaccauccagauuaaaaaagagcauuccaggaccccaugagaugcccuuguauucccuuuugauuaccucucaccccacaaaauauacuauagauuaguuuugccugauuugaacuuuauuuaaauugaucauuuuuaauuacugaacugagccuuaauuauaaugugaaaugagcagaaagauauuucaaaauguuucaugaugguucuuuauggccaguauuuuuguauauccuguagaaauaugucauucccuuuauuuucaaaccucauuugugagauuuuagggauacgaaugccuuuuugggacugguguggcuguguucuucuuauuaauuauuacugaaguaaagaggaaaugauaucagcagaugugcagagcuuuuauuugcacugaauacacuauucauuuagacaaaaagaucauuucucaauucaaaucagaauauucuaauuuaaggcugaaaucaguugugucauaaucucuauggaaacaaagcuuucuacuguguaguaguugcauaaguaacucauuuccccuuguagauauacaaauuguagaugcaaacacuucuuuuuccauuuucucccaacaauacucuugaaauagaagauacuuuagucauauuuguuacguuuuacaaaauuuaaaauaucuguucaaauuuccugcugacauacauuuuaauaaaauuguuaaaacuuaaaaauuguugaugagcucacuuucuuuugcuaguugaauucagaaaaagaagauugaguuauccuucuuagcucuugcguauuagugucaucuaacucugcaaggcucucuccaauugggggguguguguguguguguguguguguguguguguguguguuuuacuaaucugcaggcauucuucguauauuguggguaugagcucuuugucaguuuuacguuuugcagauacuuucuccaacuucguggcuuacuuuuucauuccuuuacaugggucuuuugaugacccaaaguucuuaauuuugaaaucuaacuuaucagucuuuuccuuuaugauuagugcuuuucguaucugguuaagaaaucuuugccucaaugaaagcaaaaauagaaaaaugaaauugcaucaaacuaaaaagcuucuguacucggcaaaggaaacaauuagcagcauggagagacaagcugcagacugggagaaaagauuugcaaaucacacaucagauaaggggccaauauccaaaauauauaagaaccgcaaacuacuaauaacaagaaaacacguaacuuaaaaaauggccaaaggaccugaauagacauuucucagaagauauacagauggcuaacagauaaauggaaaaaaaugcucaacaccucuaaucaucagagaaaugcaaauuaaaccauaaugaaauauaucaccucauaccuuuggauuggcuguuaucaaaaaggugaaagauaaggcugaggccgguggcucacaccuguaaucccagcacuuugggagacugaggcaggcagaucaccugagguuaggaguuugagaccagccugaccaacauggagaaaccccgucucuacuaaagauacaaaauuagccaggcguggugguucaugccuguaauccuagcuacuugggaggcugaggcaggagaauugcuugaacucgggaggcagagguugcagugagccgagauugugccauugcacuccagccuuaguaacaagagcgaaacuccaucucaagaaaaaaaaaaaaaagaaaagaguggguacaguggcucaugccuauaagcccaucacuuugggaggcugagacgggaggaucgcuugagcucaggaguuccagaccagccugagcaaccuaguaagaccucauuucuauagaacacaaaguaaaaauuagcuaggaauaguggcacaugccuguagucccagcuacuugggaaucugaggugggaggauugcuugagcccgggagguugagacugcagugagcugugaucgcaccacugucucccagccugggugacagagugagaucuugucuaaaaaaaaaaaaagauggaaaauaaacguuggugaggauguggaggagagaagggaacuucacacgcuguuaguaguauuguaaauauauacagucacuuuggaaaacaguauggagguuccuaaaaaaaaaacuaaaaauagacuuagcaugccaucuagcaaucccacuucugaguguauauccaaaggaauugaagucaguguguugaagagaugucugucuguacuccuguguucguugcaguuuuauucacaacagccaagauguagaaacaaucgaugugcugauccacagacaaauggauuaaaaaaugcaauauauacaugcaguggaauacuauucagccugucauuugugacaacauggauaaacuuagaggacuuucugcuaagucaaauaagccaggcacagagagacaaauacccuaugauuucacuuauguggaauauacaaaaguugaacuuagaaguaaagaguagaaugauaauuaccagaggcuggaggguaggggagugguagaugggaaaagaggauacacuggucagagggcacaaaguuucauuuagauaggaggaauaaguucuggugguucauuguauagcaaggagauugcaguuaauaauaauguauauuucaaaauagcuaagagauagcauuuuaaauguucucaccauaaagaaaugauaaauauuuggggugauggauauguuaaagaaaaaaaagaaaaagaagcugagugugauggugugcgccuauaguccuagcuacuugggaggcugaggcaggaggaucacuugagcccaggaguuccaggccagccugggcaauauagcaagaccucuucucaacuccugaccucaggugaucugcccaccuuggcgccucccaaagugcugggauuacggcgugagccaccaugcccagccaagaccucuucucuaaaaaaaaaaaaaaaaaaaagaaaagaaaagaaaaaacauuuuugccuuaagucuccucuuuuuguuuuauuucugauuauguacacccuuuuccuuucugucuucucuaggcaccuguucuaguguguuuaauguauguaguuuuguuuuucuguguucauuuaaaguauauauuguuaugugcuuauguauuuuuuuuuuuuuuuugagacggagucugggucugucguccaggcaggagugcaguggugcaaucuuggcucacugcaagcucugccucccggguucacgccauucuccugacucagccuccugaguaguugggacuacaggcgcccaccaucauacccggcuaauguuucuauuuuuaguagagacaggguuucaccguguuagccaggauggucucgaucuccugaccuugugauccgccugccuuggccucccaaaaugcugggauuacaggcgugaaccaccacacccggccuugcuuauguauuuuuaauuuauguaaaugguauuguauuguagaucucauugucuuuauuuuuuuaauuuggcauguuuuuaagauucaucauauuauuauccccuaguuagauauacugagaaugcucguaacccccugccaccacacauaacccuagacagacaucuuuucauauguccccuuacagaucuuugugaauaggcccaggcucaucacuucuggguuguaggguaaugcaagugcaggcauuuuaggccaaaccucaguaauugguuccugaacaucagaugcuauacaugaaaaugucaaccagaagcaauuucuuguuacuuuuaaugggaaaaaauacgauucauuacaagucaacucaaccccaaaccuauuuccuacagcaugacugaaacuuaguaaaguaguagucuagucugguaggauguaaaaugcuuaaaacaucauuuucuguuaucagacauugcuuauuagcaaguguuugcuuugaacgcaccaacaagaaccguuugccugcucucucgugaccugccauaggaaggccaagagcagccccacagaggauggugcuggauguccucugcaccagcagcuguggagaugcacauccucuuugacagucugugcuuuucaaaauguuuaugcacuuaugacuacuacgauguucuaacaaguguauuuggauuauaauuugagacuuuccgcccaccauuuuguuaaaaauguauucauuuuggggcacauaaauacacauuuuuuucuuauauaaacaccagacaacuucuggucaagauuuugccuuuaaacccuuaggaagaugcaccccuaggaagagacggucucccuuacaagagguuuagguuuccuaaaccuucagccugggcuguugcugcuauuugcaaugaaggggcaggcgaugauuguccaaggcuggggccucaccuccauccccauccuaaugucccccauccuugaucugaaggccuucaucugccccaggaguucucacauucuuuguugauguuguuaguuccuuuacuauauacuuaccucucguuccaguaguuucuccucugaaaccccaaguuccguuuucuuuugaacguaagcaaaugacuuccuugauuuuucugagaugauuauuugaaauuuagaauuagacauaauuaguaguaaaauuccaaaaagaaacuuuaaagaaaccaauuuuuuuuuuuuaauaaaaaauaguauaggccaguugcuaguugcugagauacuuguauagcccucuuaaaagaagacucagagguuuguuuuuuguuuuuuuguuuuuuguuuugaggggacagggucuuguucugucacccaggcuggagugcaguggugcaauaauagcucacugcagccucaaacuccuuggcucaauugauccucucacuucagccucucuggucuuagacuacagguauguaccaccgugcccagcuaauuuuuuguagagacagcaucucgcuauggcuggucuugaacuccugggcucaagugaugcuccugccucagccucucaaaguguugagauuacaagcaugagccaccaugcccagccaagagaugguuuuaacaguacagccucagguugaggacagcauucagaagguccgaugguuuaauacaagaaggaggcugggguuaacaauuuacucuuuguugcagauuuuuuucagauagcuuucagucucaaaacucacuuucuacccaaagcuaugacagagauagcauguuuagcuucccuaccuggucaaggaugccuucuuuguucuagaaccaaaguaggggcuuuaugaaugguugugcauccacuuccaguaguaauggcuauacauuauggagcacuuaacuguguggcggguacugcacagagugcuucauaucuguuacucauuuaaucuucacaaucacuauuuuccaagugaagcuuagcaaagugaagaaacucacaguuuuucagaaagggucacaguucaaaccccauaucugucuaaccuccagaauacggguuaugggaacugugggugauucuagauaauucgauuguguggauugucauucucauuguaaucuccuuaaaucucauuaaagcucauuagccaacccaauaaaaccuaggcuggccuuugcagucaggaugcuaguagugaucagguaugcaggcaaacagcuguagaaccuccagacaaggcucucugucugaauauacaguguguuacagaaacaugauugacaaauguaaauauuccugaaauagauucaucugagagagaggcaugcugcuaauuuguuaaucaauugauuugguauccauaucacccaugccugcugaauucaguuuuucuuuagaagggaguuaaauaaauagcacugaguucucaaccuuuggcucccugcucccuggggcagccuguagaccccccuuuucauucugacagaugaauaggcaagugaucaguuuugucuuuugggaggguggagggaagagguagauucuagucuggccuccaugauuuuauaccucagauugccacauuggauuugaggauccucagaucucagugacauguuugaagaagaucucggauuggguuaucucuccuauaguugacuauucucauuuuucuauggguuaauucuuacuaguuuuacuuucaaagguaauuuuaacauuucgggaaaacuuacauuuguccccuguauuuaauacguuaauacgauauuuaagaacuagauccuacuuuguacaguauuucaagguaucaugaaauuaaugguuuuuuguuuguuuguuuguuuguuuguuuguuuuuuugaggcagggucuuacucugucgcccaggcuggagugcagucgugugaucuuggcacacugcaaccucugccucccggguucaggugauucuccugccucagccuccugaguagcugggacuacaggugcccaccaccacgccaagcuaauuuuugguauuuuuaguagagacaggguuucaccauauuggccaggcuggucucgaacuccugaccuugugauccacccaccuuggccucccaaagugcugggauuacaggcgugaggcaccacacccagccaguguguucugaaagaaauagugcuuuggaaaaauacaguuuaaaaaaaugccuuguaauauguaugugcauuauagaauuauaauuucauagcaaaagcuucuuggaaaauauuugcuguagauauuuagaauuuauugggcauuuacucauugucaggcauugugguaacuacuugaaauagcuuauuuaaucuggauaucauuuuuugcccaacacuacggguuugggaaaaaaggaugugcaugauuucaccccaguauauaacuagaauuugcaaucagucaggguaacauacacaagguucacaguaaauauuuacuguuuaaaucgacugaugggaaaaucaggaacagguagggggaggaaagagacuaugacagugggggacagauaaagagucugggagaagaaccagggaaagcagcugagaacuuugccucaagaguagaccuuggugccaucuuguggguggaucuggaaaggaccaagcagaugcacaucaguugcuacuaagaugccuugcagagccccaaauuuccaugccacaaugauagaaaacugcaaaucagauaaucagaacucuggucuaggaaucaguggaucuuagugauggaaucaguguccuguccaucagcaaguccugaucacucucuccaaaacacauccuaaaucuguuuaucucuguggccggccccaggccaagccaccaucuucucuuguuuggacuacugcagaagcuuccuuauuggccuugccucuacucucauccucccguaguucauucuccauuggcagccaaagacaucuuuuuuagaaagaagaaucagauuaugucacuucuuuguauaaaaccuuuaagcggcuuuucaugaaauuuagaauaaaauucaaaugucuuguccugccuuagaaaacucugcaucguaugaccccugcuuagcuguaacuucaucucaugaccuucuuuguauggccccugcuuagcuguaaccucaucucuugaccuucuuccucuuuguuuccuccagugucccaccuuauuuccacuguagguccugugcacuagcuguuccucugccugguacuccuuccuccaccucuugcaugguuggcuacuuccugucauucagaucucaccuccugcauugcugccucagaggggccuuccuugacucugauucaguuacucuccaucacaucuuucccuguuguuaaucagagauauugucugucuugcugucuauugaauccucaaugccuaggagaccauuuggcacauaguggauguucaguaaagaucugucagaaggauaaaugcuguuuuccaguuucuugaucuuuuuccagcuagauacagauuacggccagguuauuuuagacuuuuccuaauagagcaugaaaagaucacaggaauuaaauucagacagaacugggucccauuccugcaacuacugcuuaccaacuauuugaccauacuucucugagugucagcuucuucaucaauaaaauggaguuaaugagcuuaccuugcucauaagguaagaacuaaauuggacuuaaauaugauuggauccaaaguauuuacguguuagauacuuuuuucuauuaaaacugacuggaccauguuguuauuugcauuuuccucuccugcuacccaagggacaggauuagguucuuuguacuccuaguaucuagcacugcacuugucuuacaguaauaggugguccacaagugucuggauuuagacucuuccacaccuaagaacugguaucuccugacucuuuccaggcugugucccuuugaucacauuauuucucuuuguccagagagagaaacagauggucacugguuguacauggaaagccugaagggauaguaugguucagaccaaaauuggauuuaugucuuuacugcaguuccuggguuuuguauacaauuaauguaaauugaccccaggauaacuuucuguuucuaauaaaaggaugaaggaaaaaaagagaucgaucauaugauuguuuuguaguuccuaggacuuaggcucuucguaagauucuucuuucuguuucuuuuuuuuuuuuuuuuuuuuaagacagagucucgcccugucacccaggcuggaguacaguggcucugucucagcucagugcaaucucugccucccagguucaaucccuccugaguagcugggauuacaggcacccaccacaccuggcuaauuuuuguauuuuuaguagagacaggguuuuacuauguuggcuaggcuggucuugagcuccugaccucaggugaucugcccgccucggccucccaaagugcugggauuacaggcgugaggcaccacgcccagccauucuuucuguuucuuaauggaauaaaguaccuaugaaauuacucugaaaacuacaaguccuguauuacauacauauauuuauguaauaagcugguaugaguauaauuucuagauaaaugauugguuuaaaaagauuagcuguugacugcacauuaauuccaaaauauuuuuugaauaccauguacuagacacuguuuuggguguugggaauauaguaaugaauaaagcagguaaaucccuguuguuauagaacucuguauuccagugggagaaacagacaaaaaagaagauagauaauaaaauauguaguauaccaaauggugauugggagcuaagaaauaaaaacaaagcaggcaagggauagggaggguagaggggaguagaaauuuuacagagguuggaauuauauaucuauuuucuuucucacccaccccuaaucaagauuuguaacauaauaacuuugccuucuaauaccacaucuaaaugauguuagaucaguuaggcaaacgaaaucaaaacuucuaauaauuuguuucauauaucuguaaaccauauuuacaaaaaguuuuacuuuucaauauuaaaaugcaaaucaacaccaucauauugucugauauccuaauauuauaaccuuuuuaaauaaucuuaauacauucacaaauauuuaaaaguauaaaagauuaagaacguguauaauuacugauaucagcuauugaacauacuuuuguuucuauauugcuuaaaaaugucaguugcuuuuaaagcugaaagauaaaaucaaagcuaugcuauuuaaauuuauuugaaaugauuauucccuuguaaauauuaaugugaaaaauaaauuauuauuaagagggcugugaccugaaaccuuaggucaguuugauuaugauuuccauacauaaagaaaggauggauacaagaauuccagaaguuccaguccucuuuucuagagcagucaggaaguuguuuacucuuugagggcccacugcugacgucugcucacugaguaaugucaucagauuuccugguggugguuauuuuggggggagcaguggcaaguaguuguccggcuguuaggagacucugcuccauagagguccugagagccggauauaccccguagacaggauguaagguuaaaugcaaucuaguuaaguaaauaaaguaagcguucagugguaaaaaggaauugcugaaacaugaauguuuuaaaaugauauugcuaaaauuuuuacguggcaaaauucauagucuuaaaucuuuuaaaagugaacccauagcugccuuuauuucuuaaaauaaauccaaaggugaguuacuuuuauaaguucacaucauaaauuuaugcuguccuuugucuguacaaaucaaguuauuucaccagcuuuugguguagaccacauauucaggauuguuuaccuaggagggaugagccuuuugcccugagcuauccagacuuuuaucuuuucccucagcuugugaccaacacuauguaaauauguauauacauacuuuuuacucaugcuggucauuaauauuuaaacaauucauuauugucuuuauauuuauuuuccuuaccgguuuccuuaaguuuguacuguugauuuucucaaacuuaaugauuugaaagcuuaguguacuuauuuugugacaaaaagguuuuagacuauagauuuugccucucauuauaauuuagcaguaguauccuguaagucuuacuacauaauauucacuuuuauuuuccaaguuaacuguaggcauaguuugcauaucucucuuugauucauuacuuuugugaguuaauauuuuuaaguuuucuaaggaggcaggauuuuuuguugucgcuuaaacuuaaguuuuuaauuccuaguuugcuucguugaaggauaaaaacuguacaguuuuuacuuuaggaauauauuuuaaggguuuuuuucugguaaccuaguauaucauguuuuucuaauauuuauaaauauuuucuuucuuuccauucagacuuuauuuuuuaucuauuugauccuucuuaguaaauuucaugaguauucugucagagacugagacaccaauucauauaaaggacccagguggcucucugacccugcuuuauuguggcaguagcagcaucccuccaguuuaugcuuuuucugcuuucucuuacgaaacugugccccauacuguaggacauaagcaaaaugauuuucuuucucuucuuccugucauuuucuuccuuucuucuuccugagcaguuccacugcauucuccaagcaauaggucagucucauucauuugcucauugcuuuaaacuuguucauuaagugcuggugccacaaacaaaaaacucaucguucaaacuggucucucagagccucuugcuuuccuucuuccuguaccgugagaguaugaugauuauacagaccauuucaagcacuugaaaguugauuuuaaaaaauaacaaaacaaagccgggcgcgguggcucacgccuauaauuccaguacuuugggaggccaaggcagacagaucacuugaggucaggaguucgagaccacccuggccaauauggcaaaaccccgucucuacuaaaaauaacaaaaauuagccaggcgugguggcucaugccuguaguccuggcuacucgggaggcugaggcaggagaauugcuugaaucugggaaguggagguugcagugagcugagaucgcgccacugcacucuagccugggcgacagagugagacuccaucucaaaaaauaaaaaauaaaauaaaaaagaaaaugauuauacagaccagaugucuccuuuuuuccugauuuuaaaaaauaugguaaaauacacauaacguaaaauauaccaucuuaaccaguuuuaaguguacgguugaaugguauuaaauacauucauaauguugugcaacugugaucaccaucuaucuccagaacucuuuucauuuuguaaaacuaaaacaauauaucaauuaaacaagagcuuccccauucuucccuuccccuugucccuagcaaacacauucugcuuucucucuauauauuuugacuacuccaaguaccucauguaaguggaaucauauagaauuugucuuuuugugacuggcuuauuucacuuagcauaauguucuuacaguucaucuguuccauagcauauaugucagaauuuccuuuuuauggcugaauaauauuccauuuuaugcauauaccacauuuuaaaauacauuuauucuuuauuuuuuaaaggaagaaauaggaucucacuguguugagcucacucccaggcccgagugauucuccugccuuagccucccaaguaccugggacugcaggcacacgccaccacuccuggcuuuguuuauuuguucaucugucauuagacacuugggcuguuuucauguuuuagaaauuaugaauaaugcuguuaugaacaugugcauacagauaucugucugaaucacugcuuuuuauucuuuugaauauauacccaaaaggggauuguuggaucauauguuaauucuauuuuuuuaauuuuuugaggaauugccauucuguuuucugcagcagcuauaccauuuaauauuuccaucaacagggcacagagguuccaguuuuuccauguucucaucagcacuuguuauuuucugguaguagugugagguggugucucauugugguuuugauuuucauuucccuacugguuauugauauugagcaucuuuucaugugcuuauuggcccuuucuuuuauuaauauaucuucuuuggagaagaauguguauguucaaguccuuugcccauuuuugaauuggguuguuguuggauuauagggguucucuauauauuguagauauuacucucuuaucagauauaugauuggcaauuacuuuuuccaguucuguggauugcauuuuuacucuguugauguugucuuuuuaugcacaaaauuuuaaaauuuugaugaaguuuaauuugucucuuuuuucuuuugcugccugugccauugauaucauacccaaaaaaaucauugccaagucuaguguugugaagauuuugcccuauauucucuuuuaggaauucuguguauuaggucuuacauuuaggucuucaauccauuuugaauaaauuuuuuuauaugguguuagauaaggguccaacuucauucuuuggaugugguuauccaguuuucccagcaccauuuguugaaaacacucuccuuucaccauugaauguucuuggcucccuuguuaaaaauuauuugacccuauacacaaggguuuauuucugggcccuuuauucuaguucguuggucuguaugucugucuuuaugcuaguaccacauuauuuugaucacuguagcuuuguaguaagucacaaaaucaggaagugugaguucuucaguuauguucuuuucaggauuguuuuggcuauucgagaucccuugagauuccauaugaauuuuagaauggguuuuucuguuucuucaaaaaacauauuugggauuuugguaaggauugcauugaaucuauagauugcucugaguaguauugacaucuuaacaauauuaaguauuguaauuugugaaugugggauauguuuccauuuauuaaaucuuuuuaauuuuucagcaauauuuuguaguuucacuuguacaaaucuuucaccuccuugguuaaaucaauucuuaagugccuuauucuuuuugaugcuauuguaauuggaauuguuuuuuguaauuuccuuuucagauuggucauuguuaguguauagaaaugcagcuuguuugguguguugccuuuguguccugauacuuugcugacuuuauuaguucuaacaggcuuuuguguauguguguguggaaucuuuaggguuuucuuaccuauaagaucauacaaaugaauaaagauaauuuuacuucuuauuuucuauuucgacugucuuuucuuuuucuuaccuaauugcuccggcuaggacuuucuauguugaauagaagaaguaggcauccuugcuuuguuccugaucuuagaggaaaaguccuuuaccauucauuaugauguuugcuguggguuuuguucauacauggcuuuuuaaaaaauuuguuuaaaaaaauuuuuuuucuucaauuuuuaagucccgggguacuuagggaugugcagguuuguuacauagguaaaugugugccaugguguuuugcugcacagaucaacccaucacccagguauuaagcccagcaccuauuagcuauucuuccugaugcugucccucccuccgccugccacaggccucaguguguguuguuccccccacauguccauguguucucaucauucagcuccugcuuagagaacacacaguguuugguuuucugugccuguuaguuugcugaggauaaugcuuccagcuccauccguguuugugcaaaggacgugaucguuuuccuuuuuauggcugcacauacauggcuuuuuaaaauuauuauuauacuuuaaguucuaggguacaugugcacaaugugcagguuuguuacauauguauacaugugccgugcuggugugcugcacccguuaacucaucauuuacauuagauauaucuccuaaugcuauccccuccccccuccccacaccccacagcaggccccggugugugauguuccucacccuguguccaaguguucucauuguucaauucccaccuaugagugagaacaugcaguguuugguuuucuguccuugcaauaguuugcucagaaugaugguuuccagcuucauccaugucccuacaaaggacaugaacucauccuuuuuuauggcugcauggcauuccaugguguauauguaccacauuugcuuaauccagucuaucauugaugggcauuugcguugguuccaagucuuugcuauugugaauagcgccgcaauaaacauaugugugcaugugucuuuauagcagcaugauuuauaauccuuuggguauauacccaguaaugggagggcugggucaaaugguauuucuaguucuagauccuugaggaauuggcacacugucuuccacagugguugaacuaguuuacagucccaccaacaguguaaaaguguuccuauuucuccacauccucuccagcgccuguuguuuccugacuuuuuaaugaucgccauuguaacuggugugagaugguaucucauugugguuuugauuugcauuucucugacggccagugaugaugagcauuuuuucaugugucuguuggcugcauaaaugucuucuuuugagaagugucuguucauauccuuugcccacuuguugauaggguuguuugauuuuuucuuguaaauuuguuuaaguucuuuguagauucuggauauuagcccuuugucagauggguagauuguaaaaauuuucucccauuuuguagguugccuguucacucugaugguaguuucuuuugcugugcagaagcucuuuaguuuaauuagaucccauuugucaauuuuggcuuuuguugccauugcuuuugguauuuuagucaugaaguccuugcccaugccuaugucccgaaugauauugccuagguuuucuuccugggguuuuuaugguuuuaggucuaacauuuaagucuuuaauccaucuugaauuuuugcguaagguguaaggaagugauccaguuucagcuuucuacauauggcuagccaguuuucccagcacuauuuauuaaauagggaauccuuuccccauuucuuguuuuugucagguuugucaaagaucagaugguuguagauguaugguauuauuucugagggcucuguucuguuccauuggucuauaucucuguuuugguaccaguaccaugcuguuuugguuacuguagccuugcaguauaguuugaagucagguagcgugaugccuccaacuuuguucuuuuggcuuaggauugucuuggcaaugcaggcucuuuuaugguuccauaugaacuuuaaaguagucuuuuccaauucugugaagaaagucauugguagcuugauggagauggcauuuaaucuauaaguugccuugggcaguguggccauuuucacgauauugauucuuccuaucugugagcauggaauguucuuccauuuguuuguguccucuuuuauuuuguugagcagugguuuguaguucuccuugaagagguccuucacaucccuuguaaguuggauuccuagguauucuauucucuuggaagcaauugugaaugggaguucacucaugauuuggcugucugucuguuauugguguauaggaaugcuugugauuuuugcacauugauuuuguauccugagacuuugcugaaguugcuuaucagcuuaaggagauuuugggcugagacaaugggguuuucuaaauauacaaucaugucaucugcaaacagggacaauuugacuuccucuuuuccuaauugaauacccucuauuucuuucucuugccugauugcccuggccagaacuuccaacacuauguugaauaggaguggugagagagggcaucccugucuugugccaguuuucaaagggaaugcuuccaguuuuugcccauucaguaugauauuggcuguggguuugucauaaauagcccuuauuauuuugagauaugucccaucaauaccuaguuuaucgagaguuuuuagcaugaagggcuguugaauuuugucaaaggccuuuucugcaucuauugagauaaucaugugguuuuugucuuugguucuguuuauaugcuggauuacguuuauugguuuuuguauguugaaccagucuugcaucccagagaugaagccaacuugaucaugguagauaagcuuuuugaugugcugcuggauucaguuugccaguauuuuauucaggauuuuugcaucgauguucaucagggauauuggucuaaaauucucuuuuuuuuguugugucucugccaggcuuugguaucaggaugaugcuggccucauaaaaugaguuauggaggauucccucuuuuucuauugaucggaauaguuucagaaggaaugguaccagcuccucuuuguacgucugguagaauucagcugugaauccaucagguacgggacuuuuuuugguugguaggcuauuauugccucaacuucagagccuguuauuggucuauucagggauucagcuucuuccugguuuaaccuuuggaggguguauguguccaggaauucauccauuucuucuagauuuucuaguuuauuuguguagagguguuuauaguauucucugacgguaguuuguauuucugugggaucggugguuauauucccuucaucauuuucuauugugucuauuugauucuucucucuucuuuguuagucuugcuagcggucugucgauuuuguugaucuuuucaaacaaccagcuccuggauucauugauuuuuugaagaguuuuuugugucgcuaucuccuucaguucugcucugaucuuaguuauuucuugccuucugcuagcuuuugaauguguuugcucuugcuucucuaauucuucuauuugugauguuagggugucaguuuuagaucuuuuccugcuuucucuugugggcauuuacugcuauaaauuucccucuacacacugcuuuaaaugugucccagagauucugguauguugugucuuuguucucguugguuucaaagaaccucuuuauuucugccuucauuucguuauguauccaguagucauucgggagcagguuguuuaguuuccauguaguugggugguuuugagugaguuucuuaauccugaguucuaguuugacugcacuguggucugagagacaguuuguuauaauuucuguucuuuuacauuugcugaggagugcuuuacuuccaacuguggucaauuuuggaauaagugugaugugguggugagaagaauguauauuuuguugauuugggguggagaguucuguagaugucuauuaggucugcuuggugcagagcugaguucaauuccuggauauccuuguuaacuuucugucuuguugaucugucuaauguugacagugggauguuaaagucucccauuauuauugugugggagucuaagucucuuuguaggucucuaaggacuugccuuaugaaucugggugcuccuguauugggugcauauauauuuaggauaguuagcucuucuuguugaauugaucccuuuaccauuauguaauggcuuucuuggucucuuuugaucuuuguugguuuaaagucuguuuuaucagagacuaggauugcaaccccuacuauuuuuuguuuuccauuugcuugguagaucuuccuccaucccuuuauuuugagccugugugugucucugcaugugaguugggucuccugaauacagcacacugaugggucuugacucuauccaauuugccagucugugucuuuuaauuggagcauuuagcccauuuacauuuaagguuaauauuguuaugugugaauuugauccugucauuaugauguuagcugguuauuuugcucguuaguugaugcaguuucuuccuagccuugauggucuuuacaauuuggcauguuuuugcaguggcugguacugguuguuccuuuccauguuuagugcuuuuuucaggagcucuuguaaggcaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacccucuucuggcuuguagaguuucugcugagauaucagcuguuagucugaugggcuucccuuuguggguaacccgaccuuucucucuggcugcccuuaacauuuuuuccuucauuucaacuuuggugaaucugacaauuacgugucuuggaguugcucuucucgaggaguaucuuuguggcguucucuguauuuccugaauuugaauguuggccugccuugguagguuggagaaguuuuccuggauaauauccugcagaguguuuuccaacuugguuccauucuccccaucaauuucagguacaccaaucagacguagauuugaucuuuuuacauagucccacauuucuuggaggcuuuguucguuucuuuuuacucauuuuucucuaaacuucucuucucacuucauuucauucauuugaucuucagucacugauaccccuucuuccacuugaucaaauuggcuacugaagcuugugcaugugucacauaguucucaugucaugguuuucagcuccaucaggucauuuaagguauucucuaugcuguuuauucuaguuagccauucgucuaauauuuuuucaagguuuuuagcuucuuugcaguggguucagacauccuccuuuagcucggagaaguucguuauuaccgauugucugaagccuucuucucucaacucgucaaagucauucuccguccagcuuuguuccauugcuggcgaggagcugcguuccuuuggaggagaagaggcacuccgauuuuuagaauguucagcuuuucugcucugguuucuccccaucuuugugguuuuaucuaccuuuggucuuugaugcuggugaccuacagaugggguuuugguguggauguccuuucuguuuguuaguuuuccuucuaacagucaggacccucaacugcaggccuguuggaguuugcuggagguccacuccagacccuguuugccuggguaucaccagcggagaaccacaaauacugcagaacggcaaauguugcugccugaucauccccuggaagcuucgucucagaggugcacccagccguaugaggugucaguuggccccuacuggaagaugucuuccaguuaggcuacuugggggucagggauccgcuugaggaggcagacugucuguucucagaucucgaacuccgugcugggaggaccacuacucucuucaaagcugucagacagggacguuuaagucugcagaaguuucugcugccuuuuguucagcuaugcccugcccccagagguggagucuauagaggcaggcaggccuccuugagcuguggugggcuccacccaggaauucccugaccccuugugcuucccgggugaggcgaugccccucccugcucuggcucaugcuccaugggcugcacuuacuguccgacaagccccagugagaugaagccgguaccucaguuggaaaugcagaaaucacccgucuuccaugucgcgcacgcugggagcuguagacuggagcuguuccuauucggccaucuuggaaccuccugugcucguacauggcuuuuuaaauguugagguaguucccuucuauuucuauuuuguugaguguuuuuaucaugaaaggauauugaauuuuguuaaaugccuuuucugcauuauuugagguauaaugaaugaggcuuuuguccuuuauucuguacaauaauguauuacacugaucaauuuucauaugucaauacauccuugcauuucaggaauacaucccacuuagucaugguguauaauccuuuuauuaugcugcugaauucaguuuucuaguauuuuguugaggauuuuugcaucaguguuuauaagggauauuggccuguaauuuucuuuuagugucuuuuguuguugucguuguuuuguuuuugagauagagucucacuuuguuaccuaggcuggaaugcaguggcaugauuguuuuguuuuaagggauagggucuugcucuguugcccaaguuggaauguaguggcacagucuugucucacugcagccucgacuuccugggcucaaaugauccucuucccuuagccuccugaguagcuacgauuauaggugcauaccaccaugaccagcuuuuucuucuucuucucuuuuuuauagaguuagggucucguuauuuugccuaggcuugucuugacuccuggccucaaacaguccucccaccuuagccucucaaaagcgcugggauuacaggugugagcuaccacaucuggcccuaacuuugguaucaagguaauacuggcgucauagaaugaguuaggaaguguuucuuucucuucaauuuuuuguaaaaguuugagaaggauuguauuaguucuuuaaaugcuugguagaauucaccugugaagcuauuggguccagggguuuucuuuguugggggauuuuugauuacugauucagucuccuuacuaguaauagaucuauucagguuuucuguuucuuuaugauuuggucuucguacuuuuugcgcuucuaggaauuuguccauuuuauccagauuauccaauuuguugguguauaaguguuaauaguacucucuuagaauccuuuuuauugcuguagaauugguagcaaugucccuacuuucauuucuaauuuugguaauuugagucauuuuuauuuuuuucuccaucuugcuaaagguuugucaauuuuguugaucauuucaaagaaccagcuuuugguuuccuugauuuuucuguauuaucuauucucuauuguauuaaucuuugcucuaaucguuauuuccaucugcuagcuuuggguuuaguuuucucuuuuucuaguucccuaaauuauaaaguuauguuguugauuugagaucuuauuuucuaguguauuuauagcuauuaauguuccccuuagccuguuuuugcugcuacaucccauaaguuuuaguauguugcguuuuuguuuucauucaucuccaaguauuuucuaauuuaucuuguguauucuucuuugaucuguuaguuaagauuguguuguuuaauuuccacaauuuugugaauuuuccaguuuuacuuuuguuauugauuucucacuuuauccuuaagauacuuuguguuacaucuaucuuuuaaaaucuauugaguuuugauuuguggccuaauauguagucuguccuugagaaugucccaugugcacuugaggaaaauauauauguuguuauuggguagcacauucuguauaugucuauuagaucuuguugguuuauuguguugcuuaagucuagccauuauugagagggggguguugaagucuucaacuauaauuuuagaacugucucuuccuucaauucugucaguuuuuacuuuauauauuuuaauggucugucauuggguagauaauugcuuauaauuguuacaucuuguuacucuguugaauguuuaacauauaguguccuccuuugucucuuauagccuuuuuugguuuaaagucuauuuugucugcuguuaguauaacuuccccugcucuuuuuugauuacuauuagaguaucuuuuuccauccuuucacuuucuauuuuugucuuuggaucuaaagugaaugucuuauagaccacauauagauggguucauucugccaaucucugucuuuugauuggagaguuuaauccauuuauauuuaaaguaauuacugagcuugcacaacaaagcaaggcugugucucuacaaaacauuuaaaaauuaaccagaugagguggcauauaccuguagucucagcuacucgggagacugaagugggacgaucucuugagcccaggaguucaaggcuacagugagcuaugaucaugccauugcacuccagccugggugauagagcaggacccugucccuaaaaauaaauaaauaauuacugauaaagguggacuuaacuucugucauuuugcuauuuguuuuucuguaugucacauagcuuuucugucuuccauuucuuuaauuacugucuucuuuuguguucaguugauuuuuuguaaugcaauauuuaaauuccuuucucauuucccuuuguguauauucuguagcuacuuucuuuaugguuagcauggggauuauaguuaacauccuaauguuauauaaauauuuaauuugaauuaugccagcuuaacuucaauaacauacaaaaauucuacuccuauacugcuuuauucccacccuuuucaguuauugaugucacaaaauuaaagcuuuauguaguugguccuccauauugguggguuccacguccauggauucagccaacugaagauugaaaauauuuaggaaaauaaaaauaaaacauguaaaauaauacagcauuaagaacuguuuacauagcauuacauuguauuagguauuauaaguaaguagagacaauuuaaagcguagaggagaaugggaauauguuauauaagguacuugagcauccauagauuuucauauauauggguguuccuggaaccaauucccugcagauaacaagggacaacuguacauugugugcccaaaagcguacacuaauacuuucaaaugucucuuauuuaggaaauaaaaugcaaaauguaguuacccacaaaaguuacaauaauacuuccuuuuagaccaaugauuuuuuuuuuccaccaaacuguauucaucucuuaaaucauguaggaaacaaacaaaaggaguuauaagccauuuauacaauagcaauagcuuuuauaauuauccaugguuucacuuuuauugagaucuuuauuucuucagacagcuuugaguuacugucuaguguccuuuuauuuuacccugcaggacucccuugaacauuucuugcagggcauaucuagugguaaugaacucccuuaguuuuuuugguuuguuuuauuuuguuuuuguuuuuguuuuuguuuuucauucuggagaugucuuaauuccucccucacuuuugaaugaaguuuugccaaauauaggaucuuugauugacgauuagcugaccuccaaaguuucugaugagagaucuauugauaaucuuauugaggauuucuugugugugaccaguugcuucuuucuugcugcuuucuuuuuuauuuuucuucuuuuuuauuuauuuauuuuuuuugagauggcaucuugcucuguuguccaggcuggagugcaauggugcagucucggcucacugcaacuucugccucccagguucaagcaauucuccugccucagccuccugaguagcugggauuacaggcacccgccaccacacccagcuaauuuuuuuuuuuguauuuuuaguagagacgggguuucaccauguuggccaggcugguuucgaauuccuggccucaggugaucugucugucucagccucccaaagugcugggauuacaggcgugagccaccacgcccaguucuugcugcuuucaagauucucuuuuugucuuugagcaguuucauuauaaugugucuugauaugggucucuuugaguucaucuuacuuauuguuuguugagcuucuuuauguccuacaucaaguuugggauauuuucuucauacauuuuuucuuucccuuucucuucagcaucugggacucccgugaugcauauauuagcuuguuucaugguguccuucaggcacuguaagcucuguucacuauuuuuuuaaagguuuuuucucuuucccagacucgauaauuucaauuguccccucucuaagugugcucauucuuucuuuugccugcccaaauuugccuuugaaucucuuuagugaauuuuucauuccaguuauuguacuuuucagcuccagaaauuauuuuugguuucuuuuuaguuuuuuucaucucuuuacuuagauuuucauguuguucguacaucauuuucuugacuuucuccacaucuuucuuuaguucuuuuagcaucuugaaguuguuguaaagucuuugucuaguagaucugccauuagguaucuuucagggaugguugcuguugauuuaguuuuuuucauuugaauuggcuguacuuuccuguuugugugcuuugugaauuuguguugaaaacuggacauuugaauguaauaaugugguaacucuggaaaucauucuccgucuuccccaggauuugcuguuauuguuuuguuuuguuuuguuuuuaauugugguaggccaucucugugccaaggaucagucuaauguguaaacucaaggucuucucaggcauuuucuaagccuuucccuaggcuugcauaaucacuuucuaguuuucccuguauaugccauugcuuuucaaugccuuagucccuaaugucugacucucaaaggggauaaaagagaaaaaugaaaggagaggaagggcacuagcccuuuaaaucuccuagaagucucuucaacuggagggggaauggcuugcaacaaugggagaaagugcaacaaugcaccccuucuuugucugcaccucuguaucagugaucagagcacagaucccugauauuuggaggacaugguuguuuuugccuucccuggguccugcaaguuguguucagguugcuuuaggaacacaugcacagcugcccaccaugggccuggguaccugcuaugugcuaagagcuaaaauuaacugcgguuuaccauccaagccuuccccuggaaguugcacgucuucaauuguuccuaaaauaguugcaucagacauauucugccagugcaauauugucuagguggggaaacagauuccuggugcuucuuacucuacugucuucucuaaauccaucuuuuaagacucuccuguggaccucuuggaccaucuucccucauaaaaauucuggcuuuggcauccaguuacaccaguaugagacuggcccauaguuacacaacucaagagaauagguaauaaccaugcacugucuguucugacucuuucacccuacugaagaaucuuccuccucagucuuuggucuagaauauuagggacccucauucuuuuuaugccuucugagagauaaaauuauugcagagcaaugcagaaacugagccaguggcccauaauuacuagacaucagcuucucaugguuaaaaauauauguggauuuuucucccaucacuaagcaaacuucguaauguguuuacuagaauaggucacuguuugaggggagagauuggaggagggcagucaguugggaaacauuuuguaggaagucuuauggaucuaguucuucuguugcugugacgaaucauaccaucacacagaggcccagauugggaucucaucaacaccuacagagucacugggcaaauuacaaaaugugucucuuccccuggguagcagcccagugccagaauucaucaccuggagcugguuuucagucccaccuucucccuuccuugggccccuuuguguuguauacaggcuauucaaaucuucuggugguccugaguuuacagcacaguguauggagcuaaacaaaccuggguggaaucccagcacuaccacuugcuguguggucuuaaugcaggguacuuagaacuucaguuuucuagcuauaaacucucaccacauuacuaucagauucagugaaauaacaugugcagcccuuagcacaguaaccagaacacacuaagucuuccauuggugcugugauuguuauuacucacugggguuugguuaugauauuacauuuaucuuugauuuagcauuacauucucaaauggauaaguacuuacaguaagugcuauuaugcuccucuguaaaauagaaagugucaaccauuuuucaaugacauuccaugguucugacugcuggauugcauuauucaugugccauuuggguguaagauuucauuguccaucaggaaaaaaauggaaauaggcacagagggaaucagcguuuauuuaguaucuauuauuggggggcucucuauauugucaucucauuuggccuuuaacaaaugagaaguugaggcugaggaagauuaauucacuuaaagucacauguagcuaguaaaaggcaaagccagaaucacauucauuuuauuuguucauuuuauuucuccuuuccugcuccccacuuuuccugggggcuauaaggagauccuuaggauuccucauaaucauuucauuuaucuacuauuuacuuuauuugccucuagaauagaaauuuugcuuucauuuuuggcacuguuuagagagagaaaaaguuaagcuucucuuucuccguugucuuuucauuuuuaagccaaucucuuucuuacagguagcaguagcugaugugcaguuuggccccaugagauuucaucaagaucaacuucagguaauaaugaacgaugcuguauuuuucacaugcugauuuucuuuaaaaaggguggagguggagcuaaauuuacacauuuaaaauagucuuucauuuagauaauaguguuuggaccaauguuaaauucccugaacucuguaacaguauuauaguuauauaagagaauauccuguucuuagaaauacacauugugguguuuagagaugaagaaguguuuguagccuacuuucauugguucagcaauaggucaggcacgguggcucaugccuauaaucccagcacuuugggaggcugaggcaguaggaucucuugagcuugaggaguccuugaggaguuugaaaccagccugggcaacauagggagacccaguuucugcaacaacagcaacaauaaauuagauggacaugggggugugugugccuguggucccagcuacuuggaaggcugagaugggagaaucaccugagcccgggaggucaaggcugcagugagucaugaucacaccauugcacugcagccugggcaacagagugagacccugucucaaacaaacaaaagaaaaaaaauugguucagcaauaaauaaaaaauguguauaauuguauguauguacauguauguguuuagagagagagagaaagcaaagcaaagguggcaaaauguuaauugaugaauguagagaaagggcauguuuaguguucauuuucauucacguuucuguagauuugaaauuuuccaauauaaaaaguaaaaagauugucuuuucaauguugcugaaucagcucugucagagagaagauaucuguaauuuaucuaauucaaaauaugagacagaaaacaaccaauugaugaacaaugagaucacauggacacaggaaggggaauaucacacucuggggacugugguggggaggggggaggggggagggauagcauugggagauauaccuaaugcuagaugacgaguuagugggugcagcgcaccagcauggcacauguauacauauguaacuaaccugcacaaugugcacauguacccuaaaacuuaaaguauaauuaaaaaaaaaaaaaagaaaacaaccaauugaaauucagcgaaguuauccaugcuccccgcacaugaacauguuucauucacuauuacauuuaaaaauauaugagaagugcugacagaaaugugugcucuuaguucuuugcauguauggucuuuguguaguugaguaaacucggaagaaauaagccuuaggaggguuucugauagcuuugcagucuguuucacaggcugcccaucuccuccuuaccacuguugccccauuuucagucugcuucugaagggauggagcacgggugcuccugaaccagauugggagugggaauagcagggagagagagggaaggaggcuggcuggauaaggaagacgcuauggauacaggccucgcuugcuccaggccaggacugacgugauuggggcagccagccacuguccugggcagaggcacagaugcuaccucuugcaccuggugacugugucacuuaacugauaggcuuugaagugucacauuuuggucuacuuuaaaucuuucuucuuuuaaucaaagcaauuuuuuuuuuaacuuggaggaauuacauaaaaucuugagucaaacauuucaauacauuauuuauaggauuaaguauucuaauaauuucaccaagauauuagcauucaccaucugagaacuuacccaguuaacuuucuuucagcuaaaauaaauauuaauguguuuuaauucuuuuaguuucaagauaaaaugcuuaacuaaaucuuuguugaguucugccaguggguuucuuagcaaaaaaguaggcauauggccaggugcaguggcucacaccugcaaucccagcacuuugggaggccacagcagguggaucacuugaguccaggaguucuagacuagccugggcaacauggagggaccccaucucuacugaaaauacaaaaauuagccgggcaugugguggcgcacaccuguaaucucccagccacugggggcucugagguacaagaacacuggaacccuggagguggagguugcagugagcugacaucacaccacuguacaccagcccaugcaacagaggaagacccuguugcccacccaccauccccccaaaacacacacacacacacacacacacacacacacacacacacacacacacacacacacacagaaaugacgauucugaccaggcgcgguggcucacgccuguaaucccaacacuuugggaggcugaggugggaggauuacuugaagccaggaguucgaaaucagccuggccaacauggcaaaaccccgucucuacuaaaaauacaaaaauuagcugggcaugguggcaugugccuguggcccaacuacucggcagggcugaggugggagaaucacuugaaccugggaggcagagguugcagugagccaagaucaugccauuacacuccagccugagcaacagagcaagacucugucucaagaaaaaaaaaguguaagaaaugacaauucuaacaucuuuuuuuaaaaaaaguguuugugcucuuuugauucagguacuuuuaguguuuaccaaagaagauaaccaauguaauggauucugcagggcaugugaaaaagcaggguuuaaguguacaguuaccaaggaggcucaggcuguccuugccuguuuccuggacaaacaucaugacauuaucaucauagaccacagaaauccucgacagcuggaugcagaggcacugugcagguaagcccaagacucgggccuaaauagucccauuggccuuucugacaauacaugcagccuagaaauagauuaaauuagacucacucucuuuuaaguugcuuuccaugcaugugaaauaaacaaaauauuagaaccucacuauuuauaggacugaugcauaucucuuuuguuuugucuugcuucacuuuacuugaaacaguaagaaaaugugaauaauaagaauuauuaagggucaaagugaaacccaaaauguaauuaaccacaaguaucacuuguauauuagugcaguaagaauuauaauuuuucagauuguuuucaaaguuuuaaaaauuuugaaaauugucuuuuaauguucgaugaaugggcuuuauuuauuauacuugcaccuugucaauauuaugagagaauucucuguagugaccuaaaccuaaaaaaugccuuuuaaagaaaguuauuuguugcugauggaagcaaggcaaauauaaaauuuuaugacauauuaauuuuaaggacauuuaaaaucuugacuuuuaagagagagaaaagauauaagcuaaguagauuaaaaacccauggguuaaaaaccgaggugacaagcaaaugacaacauauuaaaagauuauuuaugggguauguggugacgucaacauggguuuguuuccuugguguugagaacucuacacuccugguagucagacuagguagcguuuacccuuccaugacuugccuccaguaguuucuccuguggccuugaucuagugccugaaaugugccuguguuccucaucuguuucaaucugcaugacuucacaauaagccaucaucauuguagcccagauuucuuuuuuuuuuucuugugacggagucucacucuguaacccagucuggagugcaaggcucgaucucagcucacugcaaccuccaccuccaggguucaagggauucuccugccucagccucccaaguagcugggauuacaggcgcacaccaccaugccuggcuaauuuuguauuuuuaauagagacgguguuugaccauauuggccaggcuggucuugaacuccugaccccaagugauccaucugccucagccucccaaagugcugggauuacaggugugagccaccgcacugugcccgcccuaccccagauuucuugacaugucauuuggccagucacccagcacauucaugggggauugcagcccaaaagaaauggagagagcuccggccaggaaaaagggagguccagguccuuguuuggcucuuccuggauagcugcuugucucuggguaacucugccuucucuggggauguuuuagcucagcuguaaauuuggaacacuugguuuccaguaucccuuuuaucccuaacauugaauagauaccacucagaggaagggaagaugauaucuaaauuacauggugcuugguagucaugguggaauguugcaaggcaguagaggugucuaaggugggccaaauggcugccgagauagaagagggaggacagggugaggggcuggagaaaauuuggccucuuuccuagucuuguccaggcccaagccuagccacagguaugugcuaggcaaugaaaguucauacuuuuaaaggugacuacuagagcaucuuguauuguaaaagaaaauuuaaauuguguugguuacgcuccacuguuaaaaauugugguaaaagaaacauaacauuaacuuuauguuccacuuuuuaagggaagaaaauguacuauugcuguacauuuuaggaauauucuaaacaaauaggguuaauucauucagcagauuuuuauugagcuauguacaagagaauguuuuagacugaaaguuauaaaaugaaguucuugucuucuaugagcuuauagacuagaggagcugaaauauuucaaugaaaaaaaguaauguuacgugcucaguuaaaaacucacacaaauaccaaauuccauaagcacuauaguuaaucagaguucuuucgucauguaaauaacaauuuuauauaguuuuaaaguaaagaaugggaacuggauugcuuuaauauaugguuuuagagaagcagagaaugucagaugugccucuccucuaugaagugccuagcacucuccauccagccucuccucaggaccuggggcucacuaagugaaacccugagauuuagaagcuuugcuuuauauugaacccaacuuuguccacaguuggcgcacaggauugcuagaacagagcuauuauuccucuuccccagaauggacuuccaacacuggaggacaggaauuguguccccccaccccagacaucuuuccuuuucugaacugagcacacccuuacugcuaugaguggcuccuaacagauccugguuucauauucccaccacaucaagggugcuuccccugaguacccuuuucugauugauagaccuuguaagcauggcuccagaaccgaaaagcucacacuagguuuaggggaaccagugacaaguaagcagaacaguccccuccacugugcuagccagagagagcaggccuuuacaaauguaauccccgaucacauuuauuuccugauggccacaucacagccuuggucaagaaucucaaguguuucucacaagcuguuuucuaccacgucaucuccaucuuguugggugaggauuugggguagggauggguccuugugcuaaucguagugaguuuucuagaggcaagagcagacccugauuuauuuuccuaaucaguuuugucuucauucuggcccuuaccuggcuuaucucccuuaagaucaucccuuuaaggaugcccgcccacuuuggacuguucaagaaaucuuuccaggcuccccacccccgaaccagcuugcccugucucugagcugacuuacauggcucuugagaccuuagcccugcagaauucuguccuucccuucaucuucccuuuugggauaccuaaucaacacugccuauggagagcuuuucaucgguuguugaccugucuaaaugacuagcauucaccuguaucucucuguugggggcauuuggaacuccuuacacuccuuaugagaugccuugcuaacagcaaauauucuaugucuauuauauuuccaaaucuaccaguuuaggaacccuacguuguaagucuccucaggucugggcacugcauuugguacuagagcuacauagaugaguaagaugugcuucuugucucugaggagcuaauacuuuaguuagcagggaaagugagugauuucgguauaggcuuguaagugcccgcagaagagguuuacgcagaguguugugggugccugugucaaagagggcuucgcaagaggauacuugaguugcaucuuaaaggaugagcaggaguuuugaaaggaaaaaagguggagaaaauguuccagguagagggagcggcauguguagaaacaggcaggacauccgggcaccucugcucagugcuagauggcugcuggucaggcagauguggaguaggugucaggggagguuggaacagcagacgugaaccaaaugaugaaggccuugugugcuaagccaaaggcuguggacucuaccccguagguaguugaaacacugauagauucugcgcaggaaaguguugagcaggauagaaaaauaacuuggcugccaaguggagaauggaguagaaaacuggaggagaugaggcaaaucaaucaguugugaggcugcuagaggccauccaguaguuccuaacagaguauagcuucauauucccacuguagcacuugauaucaaugucuccucccaacuuccuaucaaaaaacccaugaagagggaaaaagagacaaaaauugaccauagcaauaauaaauaaaaacccacaaagauaagaugauaggucagaagcugagagaacagaaaaggauaggaaucucuacuguaucugucguaccguggagacuaauaaagaagccuguuucugaacugugccucaagcacuucagucuuugaagcugaaauaccaguggccauaaaggaaggcaguggaaacaggcuuugcuuuacucccacuguguucugccaagccugggaugcuggaguugcucuaaccagagaaacagaugacugagccccagcagagcagcaaggcuuuaugagcugggcagaggccugcacucuugccccugccaucccugcugccccugauucuuuacuuucugcaucuacucagaaacccaagguaaggaagagagggauauggacagagacaugguuuuuccuacuauguuuuaagaagggacagagguauaaggaaccugaagacaguucuccacauacugcaguuucaaaacaacaaauugcaucaguucucagguucaguuugagaaucagagagaacaggccaggagccccgcucugcagcagaccugugcaugccugcuggcaguguucuccaagcccgaacugugcuuguugaugugaucuaccgcccagaccuaagaggaggacagcugcugacaccaaggguucagugaagaggugcuaaggaaacucuugugacccucuuuguuggcaaacucuuagccugcauagaugcgaauugcauucagggguguguaaacaggaugagaaggggggccugugaaaagugccaccacauaaugaggggggaaagaacagcccugaagacuaagaaaauuauuuuuuauaagacacuguagaaccuuuugaagacauaugcuuaguggacucagaagaggugcagcaguauuucuuggugcaacaggaguaggucucuguaauaaaagggaagaucucauaaagggauauagaggaaauaaaaaaaguacuacuugaaaacccaaaacgcauuaacagaauuaaaaucuauguugaaugcagaagcaagauugaacucagagcaccagaugcuuuuauacaauuucuugauucaccuuggugugcagauccuuuauaccauuauaaaucccauucuuuuucaucugaaacucauuccacauggcagagaaaaauagcaaagcacaaguaauggaguugugcuuuugugaaacuuaacucauuaaagggcugggcuauguucuuauagugagccuccauuauguggccuuuuuuccaguguuguguugagaccauuaucagaauuauuuguaguugccuagaguagcuugagucugguaguugcccccaguauccauuucuauucuuuuccuaauaacagaaucucugauguguagcugggcauauggcuaccuagaaaauagauugcauucccuaguuuuucuuacagcuggccaauggaccuaucauguguaucuucuggaaaguauacuuagggaaggagcauucccuuuuuccugcuaucuggaauguggacauuauggcuaguguucaguaucugucuuggaccaugaggaagaaaccucauguacagacaauaguagagaaacacugguaggagcuagguuccugauccugcagaguccauggcagcccuggacugucuccucugcacauuuuugaugugugagacagauacuguuuaaaccacucuucucugguguuuucuaucuuguguggccaaaaggauuccuaaugguaaaccaaguagcaugcuuuuaagacuuucccagugaggccgggcuugguggcucacaccucuaaucccagcacuuugggaggccaaggcaggcagauugcuugagcccaggaguucgagaccagcuugagccacauggugaaacccuaucuuuacaaaacaucaaaaaauaaaccaagcaugguuggcacuugccuguagucccagcuacuugagaggccgaugugagaggaucacuugagcccaggaggucaaagcugcagugugccaugaucacaccacuacacuugagccuggccgacagagcaagaccuugucucaaaaaaaaagugggguggguggggacuucccugaguacuuaacacugcuuucagaaucucauucuacaggaucgcacuccaucuuuuucgugaccuucuugaauucugacuuccugaacauucagguauacauuucaauaaugccaaguaauuucuuuccuaguuuucaugaauuccaaugcaaggauguuauuuuucaacucaguuuccugacauuucuguuuucuagcccguucuuccuucauaugcaccagaaaaggucccaguaugucucuaccuuuuuauacaguuuuagagcuguuuuuaagggcuuaucuccagguaaacaagguccucccuuccacuuuauccuuaauccagugcuucucauucuugugucuccagauaggaguaguucauucaaagcuccuuagugagaucaccuaccuacuugccuacuugccauuacaucacucccaucuugauuuuucuucuaaaaagcugaaagcugguuugaaauggcuacauacuuaaauuugcccuuucuccuuccaaaucucugugauaugauggaaauguaaacacaggacagauacagugucacuagaagugaugaaaauaccauuugugagucacgccuuauucccuguuugagaucaguguuaggaugaguauuagucagcaggugugaugagugcacuagcugugucugugagugucuguugugccagugaccccuccaggccuaagcagccuuucccauagcucuuccccaggaagcugagccugccugcucuccccagucagggggaccaggguugaacuggggauugacaccuggccaguaagcccugagguggcgugucugcaaggggucuuccagcagagccaugcagcacccuuagguuggcucccucuggagaggauaggcagguggaugcuagaggaguacagagugaacacagaaaagcagggauguugaggggguggggaagaagugaacaugagagagacuggcuggucgcuagagcugcuuuuccauuccugagcaacuucccuaccccuggccuauucugcauguguuguuagauucagccuuucucaaccuggauuccauaagaaaaugaagcccgaaucccuacaggcaagaaugggcaaaggagaacacagucuugcccauucauuuguguauuaugugugacugccuuugugcuacagugguagaguugaguaguugugacaagaguccauauggccugcaaagccuaaaauauuuauucccugacccuuuacagaaaaguuugcuaagacuggggcgggggcauuuggcugagugugcuggcucacgccuguaaucccagcacuuugggaggccaaggcaggagacugcuugaaugcaggaguuugagaccagccugggcaauguagugagaccucgucucuacaaaaaauaaaaaaauuagccaguggcaugugccagcuggucgcagcuacucauagcuggagcccaggaggucaagacugcagugagcugugauugcaccacuguacuccagccuggugacaaauaggaaccugucucaaaaagaugggggcauccaucgugcaugaugaaucucuuacgcaucuggaaugguuauguuguauaccaucuuugagagacuugagaacuagucacucaaauuauuuucuggauuuugugauucagaaguggcucuauaccuugaacuaacagcugaagcaaaugcagucagucuugacugguuucugugccauccuagacacauucuccaggaggccagcucaccuuugacuugacuagggcagucugguuauguuccucuacauucuccuccuuuuagagucccucuccaacauaagucgucuuccucugggucuggggugaguuccuuucuucuccaguggaguuguucuucucuagagucugcucgcuucucccaguguaggaugaguucaaagcuguugcauaucuccaguggagcacuucuuuucuuucuuuuacucuaugucacauuuauuucugcucugauauuuuggcuguauuuucauuccccauggccucuaaagcugcuucugcaaaaggguugaauuuacucuguaugggaagucuuguacucuuuggguaacuuuagucgaacagucucuuguacuuuucuagaccaguccucuguucuuaaccuuuucaugagguguugaugcucuucuuucugaccgauuacaauaucuugcauuuccuaguuuuggauuauuuuugguuauuuagccuccauuuuaccuaguaacucuucauccuuugugcuccuuagaaugcaguggagccagcccuugggcuccuuuauccccguuguaagcauagccaucaucuugugguaauagacauaaacuugcauuuuccuuuggaagaagagaccaacggcuucuuucauguaagcacaaagcagggaaaauacuccgccugaaacaaugcagguuaacaaagaucagaacaaguagaauacaugucaucuuaguuagcuguuaauucauacuccauaaucauuacaguuaacacaguccacugagugggaguuugcccccaaaagagagaaagaucaaguagucaagaaggugagugaauucagagagugaggggaucauuuacucucccuucuaccccucuuccaacuuuaauuguuguaauuguuuaaguauauuugguuuuuaaggauuauuuuuauauuuauuuuaaaguuuuguguuuuuuuuaaggucuaucagaucaucaaaacucucagaaaacacaguuauuguugguguaguacgcagguaaacuuucauuuuuuuaauguugaaauugagguaccaguguaauacuugcucuuaacagauggccaaauaacagcuugcaugcugugucaggcaugccccuuuguaguguggccuucucuucuuuauucuuuauuuuauuuugcugcuucaguuaacuuccuggaaggacuuugugcucucaugcuagauuuuugugauuuuuaaacugccuuucacuuuagaaacaggcgaacuaugagagaauuccauuccuaaaaguaugaauguuuuccagggguaucuuccuagggccuucuaacuccaaauaucucugaggggggaaucuuagguuuugucuuuaaauuggagguaaggaaagaagagaaauauauuaggagaagggcaaguauucaaauuaauguuauuuagcuuauauguuuuuauacauagaagaaauguuucuauguacuuuaaaguuuuuuccugagcuguaggggagaaaggaauuaaaaaaaaaaccuggaaguagaagaaaauaggaguaguuuaaauuaaaaauuuuauauauuaaaaagauauaugaacacuccuguauuccugcuauuaauguaguuuguguauuucaaguauuauaauauauaauuccaaaaagcuaaaugugaaauugaaacagaaaacaguuuucaacuuuauccuuuaaauuuguauauuaaucugauucaucuaaaaguacucauuacauaacgaaguauuauuuaaauuaguagaguaaaagaggugagauguaauugauaaaaacuaugucuauguucuuuacuguguuauuuugaaggguggauagagaagaguuguccguaaugccuuucauuucugcuggauuuacaaggguauguacucacuuauuuguuauacaaguauaauucaauuugagaaauuauuuuaucucaguucaguacccagcaaaagcuuuguauuaauuugaagaaaaaaaauugucuggccaggcgugguggcucauaccuguaaucccagcacuuugggaggucgagguaggaggaccccuugggcccaggaguucaagaccagccugggcaacauaaggagaaccugccucaaucguacuuaaaaaaaaaauuacuguccuuguuuuacaguuugguuuaacuuuauaaucugcuaaucuaaucuauaauaguucauagucucucaaaacuaugccugcuaaggucaucuaaacauaauaaaaucuccuuuaauggcauuuucacuaaaaauuauaccacaggauguauuguuaugaugcugacauguauacaugcaacuuuuuaagcuaguucaaggauucuggaaauaaggcagcccaaacacagcucucuuucucuccacucccagcuucaaucucuugguuucccuaagccaaaagguugcuuggggcuuuggucagcuggcugcaaaugaggccuuaggaaucauacagagagaacuuaaauaaggcugacccuugggcagauuuguagcccagguuaguauaagaaagguagucaagaaaucucaagccaugaauuuaguuucaaguuuucuggaugaguaggacuccuaagugccuggcagaagcaaauauaaauccuccccagaggaagacagcuucaucuuugcccgcagaggaucuccauaaauaauugcucaagggcagccggcagcagucagucaaagcuggagucaauccaccaggugacagggcaucccaaggaaaaacuaggagggaaaaaagccuaguaacagacccucacaccccucagagauuaguuaugagauaugaauuauaaagcaaguaugcuuacuauagguaaagaaauaaaagauaaaccaggaaauaucugcaaggaauaggaaacuauuaaaaguggcauagcaaauuuuaugaggaacaaaacugaauuguaagaaaugaaaacacaguaauugaacaauuuaaaacuuaguaagucacauguagcacagaaauacaaugacaggaaauaaguuagacaggugaagaaauguggaggauagugugugaaguuuuaguuguguauauguaacuggaguuccaggagaagaggaaggauagaacagaggaaauauuugaagaguuacuagcugaaaauuuuccagaacugaugaaaaacuaauucauagauucaugaauucugacauauccaaaguagaguaaauuuuaaaagaggacacauccuagugaaacugcaaaaaaaaaaaaaaagaaaaggacuuaaaaucagccacagguaaaagauuaccuucaaaagacugacacacacacuaacagcuagcuucucagcagcaacaaguggaaaacaagacaguggaauaacauuuucaaugcaauaaaagaaaauaacuuccuugggaggccgaggugggcagaucacgaggucaggagauugagaccauccuggccaacauggugaaacccugucuugacuaaaaauacaaaaauuagcugggcaugguggugcacaccuguaaucccagcuacuugggaggcugaggcaggagaaucgccugaaccagggauuuggagguagguugcagugagccgagauugugccacugcacuccagccuggcaacagagcgauacuccaucucaaaaaaaaaaaaaaaaaaaaaagaaagaaaagaaaagaacuuccuagaauuuuauaccuagcauacauaucuuucaacaaugaaggugaaauaaagacuuucagaaauguggacauugagagaauuuguaacuagcagauccucacaaggaaaugcuaaaggauauacuucaaccagaaggaaugugaauuccagguggaaggucugaaaugcaagagaugaguaaagaaaauggucuguauaggguaaauauaaauacauauuuacuguaugaaacaauaauaaugucuaguuugaugagaggauacagggagaaagagacuacaaacuaaucauauaucuagccaaguuauuguuuaaccuuucuuuuggggauauacauaaaauucagagauauaguuccccaaggaaaauaauucagaaaaggacucuaaccauauaagaaaugaacuacaacagaaauuugaagaggagaggagggaaaaguagugagcuauaaacccugccaugugcauacuccuucauggugccuccugcuuucucuggcucucugucuuucuuuauagauguacccacacuuaugcauauauguauaagauuagucccaaacagauaaacauagacuagaauauauaauauucuuuuaaaagaagggacauacucaaagaggaauuuuaauaauagcucacuuuuaaauucuagacuaucuuagucaacgcuagguguuuguaagguuuguggggaggaugcaggcauucuuacagacuuaucuaagagguagagugagaaugagcccaagaaguauucaucuuugugggaaauguucuaugugggaaauacuuuauucuggggguaauugguaucuuguuuucaaauaauaguaaagaaaucuaugucugcuuuugagaugaugaaaaggaggguaaccgcugauagaacaggaaacuuaaguaaaacuuccaaaauaacaagaggaaauagggaguuuacagcaacuugaucaaauugagaagcugaagaaagaugaaacaacaguguaaaaucagugagaaacacaaagucagauagaaagaauagaagcaggcugggcacgguggcucacgccuguaaucccaacacuuugggaggcugaggcagguggaucaccugaggucaagaguuccagaccagccuggccagcauggcgaaaccccgucucuacuaaaaauccaaaaauuacccgggcaugguggcgcacaccuguaaucccagcuacucaggaggcugaagaaggagaaucccuugaacccaggagguggagguugcagugagcugagauugcaccacugcacuccagccugcacagugggagcaagacuccaucucaaaaaaaaaaagaaagaauaaaagcaaauguauaugaaugggcugaauucuuccuuuaaaagauaggcuguuagauuggguugaaaaaguacaauucuauaacaguuacaagacacuuaacaugauaaaaggagcuuaaguaaaagaacauagagguagcaaguaaaugcagacaaaaagaacacagauauugauauugauauuaauaucagaugagguggaauuuaagauuuuaguuuauauguaaauacaguuuuauauaaaaagcacacauuagguuauugauuauauagcuguggcuuucuuguguuucccccuuuuuggacaacccccacaacauacauacacaucagcaccuaccuccauucccugaccucuaguaauuccuguuaaauuguaugagaacaguuuacuuagccagcaguaaggcgucccagguuggaagucagaaguccccuauggaucuuuaugucaucccucccuaagcugcuugcuuuugcaacuaaggccgcaaaacuggcuauuccuuuuaacaagaaccuuagaagcuuccacuuucuagugaaacuuaggggauagauuauucccucugccuuggguuauuugcuuaccuacagccgcaugaggucauuaaggcuuguguuuguuugaggucucuuugaaaguacauagaugcacuguuggaaauuugugccuggugacugccguguuugaaauucugcccaagaagucuaucagcauaguucuguggaccagaaagagcauccugguagaaggucaaguaaaucaugguccuuauauuuucuuaguauuacuguguuaucauggagcuaacuugaaaaguaacugacacacacacucuugcugccucaagccugcacaccuuaaucaaaaucaaggaacccccugaagacuucaauggaaccacuuuuaggugcacgccccugugaggacacguccaugcaaaaagcccaaaaagcuuuacaguagucacuuuagaagcaccugacuuaggaaauguagagguaguggcaggcucuccauuuuguaggugaggaauucaugcggucaaccaguccucagagaccacuaacuaauuagugcuaacuaaucucauccagagucucuuacuuuugugugacaaaaggaugcucagguuacugagaagaagaguuagaccuggaggaaggggauucucccagucauggcuguaggcgguggugccaaggcuugaaucugaaagcuaacaccauaaugauaucucugguacaggggauggggcauaggaaaggccaugagcuauuuuguguuuuagccauguuucaggauugaaaaguagguggaggaccugcuagcuuccucaauuggauuuggccauugagucgguagacucacugcugggugcacauuagaaucaccugaauaacaucccuagggagucuguuucaguuggucuggggaggggccugcaugcugguguuuuuucaaauugcagauaauucuaauaugcagcugagaguugagaaccacugggagaggccuagcaaagaugggcucagguccuagccgugggugugauaugcuuuggagaaagugagguuaaguuagcuuagaagucuaggauuuguagucccagccccuuucguggaagaagguuaagggagaggagacuaaccgcuguuuaagcagagggaauaagcuugcuuucugaggaucccuggaccugauucuucacccuccaugcccugugggauccuugggacagaaacaaaaguuggcaaggggcaggaaagaugagauguuuagauaaagagaacaguguuuaaacacgcauagcaaaacaaaaguuuugagggagggggcaaacaggagcaagaugcuguacauuuggucacaugcuaguuuuuuuuaccuugauuucugccuuugggguaaaaaaguuugguggauacauaacauucagaccaauuaaaaagucugauugcaugcaugggaauccauuuguggaaauggauaaauacacauucccuccacagcccucacauccccuccacagcccucacaucccagaaucuuaccugcggaggaacugaggaccccugucuaucucaaggccccgauuccaugucuccuggaguggcacaagcacuaugucaagaaaucucuuuucccugucccugcccaaucagaaguggguuccuguccaguguuuuuggguguucccauggggucuuggcugauggagguguggacagcaggucuagcauacuccucccuucucagucggugggagcuggcaggcaugucaccucugucagaccucuggguaagaaaggggcucuguuuuggccuauagguauaagguuuaucaugcuccuggucaacaggucuugccuuccccugugggggugacaguagcuguucuuuacauuuaugcagcaguuuguacuuaaaaugcuuucucccaucaugucuuuuuauucucggugaccuucauuggguaggaacaguauuauuuuucuugcuuuacaguugaggaaacaggcucaggaauguuaggugccucauauacaaucauacagcuuuuaaggcacgaaccaagggcuagauuuuuagguugcuugacacccagacaagacccugaucacaguucagacgggucauuugcguucaccgugguaguagaaggaacucuuuaaggggaccccugucccagauuggucuggcuggggcuuauagauagugauaugcagaggcucugccucuuaggcaucagcuuccucuucagccagguagaguauuguccacuuauugugcagguaaaaagcaaggagcucuuuagaaaugggggaguaauguucacaaauauuuuuacauuugaauagaacuauaugacagaacacaguggcugcuaagaugucuuuauggaguauuuaauuugaugguggaauggguccaucuucucagaacuauguaauucacuuugucgugagauauuuccacuauguaaagguuauacaaaauacuuaauguccacggcuauaagagacacugggcaaauccauccauggcuucugccagugccucugcuguggaagauaauccucugucggcuucacugagccacuguuggagguuaguucaggaaaauguugcccauguugggguucccccugugaaauacaggcgcaaauagaaaugcaaguauauuuucgcuuauuguaaacuuacaugacuuuaaagcggaccaaauacuguuguugaauauacucugaaagccuaauauaaguaggacuuuaguuaaugaauuuccuccuccacauguucuagccuugcuuugucagugacaugaaaacaaccaaaaugcucuuaacggaagaugcugaaagaaaagccuuuuuuuuuuuuaaaaaaaugaaaggcuacuaaaugauagaaggaaaagcauucuuaaacccuauuuuuuaaaaagcuaaucuggugcccauaaaguuucucucuuaccuucuguucaucauuaaugauaaaguauuuuuuagauuucaguugccaaguugagaaguuuguuuaaagaguuauuuuuauuggcacaaauaaagaagcacuuuuguuuauccacaaaauuccucuuucuguuuguagagguauguagaaaaccccaacaucauggccugcuacaaugaacugcuccagcuggaguuuggagaggugcgaucacaacugaaacucagguaauucuaccacuucuggaaagcccuccaggccauacagggcagcauggcaagugagaacuuugguuguggggaauacuuuugaaauggccucuugcagaaaugggauuggagagaauggaguggcaacuccccucguacagacuuucuggagucugccuggaugucuaauaaggggucauuuuagugauuagagacucacauuuaaagauggagcccccaaauaauaguaaguuuaaaaagcagaauacaaacugcauaugcuggauuaucuguuuuguuuucuaaggggacaaaaacgguuuuaauauacacccccccaaucuauuaacauuaguuaucucugguaggugacauuuuuuucuucucuacaauaagcauuuuaucugcucuugauaaacaggguuuuuugguuuuuuuuuuuaagugacaugaguagaggccucauucuuuguagaguaagaaaagcagaaaaauuaauauaauuuuaucagcuugacaaaagaaaaauaaagucagcagcuuccuaucauuuuagguuucuuccuuggguguucaacuauucuuuaacauuuccuuuacuagggaucaaagagagaauuggaucauuucauuuguaugugcccaagacagucaaaggggaucggaaugagaguaccaagauuaauaaggaccaguacaggguuccacguguagggaagauagguacuuuauagacaaaaugaaaugaaugauuagcgggcagagugugaguuagcagagaagugcugcugagcagagguguuugaaggcuggugugguauacaaaagagauuuuuacgcugcuagauuuugcaaggaaacuuaagguagaugguugcccuugggccugcuuuuuucccacuccugggucaucucagccuggcugcagcacucccacagugaauuaggcuacuacccucucucagaggagaguagaauuuuggagcaguaggugauguuggagcuuauuuuauccaaucaagaaucagaaacugagacccaaggaaguuaacugacuuacacccaagaucuuguaagcagcaaauggcaaaaauagugcuuuaaacugaaaucugcauuuucgaaacugcauucauucuuucuuccaucucuaaaucugacuguaaccucaaaccuuuuccuccuguguaccuuagcugucaucuaccuugugguccuaaacuaaaaccccugucucuucuacauacgucccuaaauccagucacugaccaaguccaauugaucuuacuaauuuuuggaaucuguccacuuaaucuucaucucuacugcuacucuuagucuaggucccucucuuuuuaccuggauuauugaaaccaccaguuagucucccuaugucuagucuugacuccuucuucauucuccacacagacguaacacaauuccauuuguguuccuguucuaugacaccccagauaggcacccacugcguucaagaugaaguccaaacuccaaaauguagccuacaagggucuccauggucuguacacugcuuaccucucuguccucaucucccaucaugcccugcuuuguucucugugcuccagcuggcagccaaauuaugauguccauuauacagggagauauaaaaauauaaagggaaaggaaaugugaggcuagagaauugggagaaauagagucuuguucuuucagauacuaaaaugcacuaaaaagcuguaacaagcagggguguuacugcuagauugguaaacuagaauauaaaaaccagaaacaggccgggcacgguggcucaugccuguaaucccaccacuuugggagacugaggcgggcggaucacaaggucaggaguucgagacaagccuggccaacauggcgaaacccugucucuauuaaaaauacuaaaauuagccgggcaugguggugagcaccuguaaucccagcuacucaggaggcugagacaggagagguugcagugagcugagaucgugccauugcacuccagccugggcaacaagagcaagacucugucucaaaaaaaaaaaaaacagacuuggauauauuuaagaauuuaguagaugaucggcugggcaggguggcucacgccuguaaucucugcacuuugggaggcugagguugguggaucaccugaggucaggaguucgagaccagccuggccaacaugaugaaaccccgucucuacuaaaaaaaauacaaaaaauuagcugggcgugguggcgcaugccugucaucccagcuacuugggaggcugaggcaggauaaucacuggaacccgggaggcgaagguugcagugagcugagaucgagccacugcacuccagccugggcaacaagagcaaaacuccaucucaaaaaguaaaaaaaaaaaaaaaagaauuuagcauaugauuacauggcauuuuaaaucaacacgggaaaaaguggacuuuucagugacuagaguugugauaguugguugacuagcuggaaagaaaguuaagcuacguuccaaucucauguccuacccgcaaaaugaacuccaaugaauuaaagacuuaaaugugaaaaaguagggcuacguaaguacuaaaaaauaaaaguggacauacauaauuggaugacgaagucauuauaaacuaacacuuauaaaagccacauuuuauaaaggaagauaaucagauuagacaacauaaaaauguuaagcuuaucuacaguuaaaauaaaccuuaaauaauguucaaaauuuagacaaaugacuaacugggaaaaauauguuuguaacauauaggacagacauuagguuaauauccucauaaauacaugaagagcuuugauuaaucaauugaaaaaugaucaauuaaaaauuagaaaaauauuaaaagacauguucaagugguucacaagagauauuaauggccaauaaaugugaaaagauguucaaccucacuaauaaagacaugcaaaugauuuaacauuuuuuuauuuaccguaucugcgaaaguuaaaaaaaaguaugauaaaacccaguagggcuucucacagauccaucuccgccaagcuuguuauauuggaggugagaacuucuuacuguuuuuugcuuuuuuuauuuuuuauuuuuuuauuuuuugagauagagucucacuccguugcccaggcuggagugcaguggcaugaucucugcucacugcaaccuucaccucccagguucaagcgauucuccugccucagccucccaaguagcugguauuacagagguaugugccaccaggucuggcuaauuuuuuguuguuauuguauuuuuuaguagauacgggguuucaccauuuuggucaggccggucucaaacucugacuagugcuaggauuacaggugugagccaccaugcccagcauguuuuuugcuuuuuuuuuuuuuuuuaauaacaacuuuauugagcuauaaauuuacauauuaucuccugguuuuuuuuacaugcuaaaaaugagcuaauuuuuauuggcuaagcuauugucuuuagugagacaguuuaguaauaccagcaauaauguaaaggcauuguuuuuuuuauuuacuuauuuagagacagggucucacucuguugccugggcuggagugcaguugugugaucacugcucacugcauccuugaccucuugggcucaagcaguccucccaccucagcuucucaaguagcuaggacuacagauguauaccaccaggccagcuaauuuuuuauuuuuuguagagacaggguuuugccauguugcccagcuggucuugaacaccuggacucaagcgaucugccuacuucugccucccagagugcuggcauuacaggugugauccaccgugccuggccagcauuguuauuuuuagaguuuacuuaguaguaucucugcacuuuauaagcaggcaguuuucuuuuuuuucaucuucugaggccagagaaucuuaaaaucauucuuugggagauuacuuauacaaggaaaaaaccuggaagcaaccuaaaugucuagugauaggggauuuauugaauaaaucauaauauaaucuuagaauauuauauaguuauuuaaagugaugauaaagaaugaaaauuauugauauggaaagauuaauguauagugugccagugagaaaagcagauuauaaaacuguagaguaugaucuuguuuuuguaugcauauuacauaugcauuuguacaaguuaaugccuagaacauuuuucaaugcuuauugaaaauaauuagauuuuuuucuauaaaauagaauguugagacgucuggguauugggauuucagguuauuugaucuuauuauuuuuaaacagccuuauuaagguauagucaaaggauuuuaguauauucauagaguugugcuucagucaucacaauuuuagaacauuuuuauuauccccagcccaggcuguagugcagugaugcaaucucggcucacugcaaccucugcuuccuggguucaagagauucuccugccucagguuccugaaguagcugggauuacaggcgccugccaccaugccuugcuaaucuuuuuuuuguauuuuuaguagagacgggguuucaccacguuggccaggcuggucuugaacugcugaccucaggugauccacccgccucagccucccaaaguguugggauuaggggcaugagccacuacccccagcccaaucuacuuucugucucugcagauuugcguauucuggacauuucauacacugugugauccuugugacuggcuuacgguuuucaagguucauucauguuagggcauauaucaagacuucguguccuuuuaugucugcauaauauuccauuguauggauauaccacauuuuguuuauccauucaucaguugauggacauuuggguuuuuuccauuuuuuggcuuuucugaguaauacugcuaugaacauuugcguauaaguuuuuguguggacauaauggggcuguuucccaaaaaggggcugcacuuuuuuacauucccaccagcaguguaggaggguuccucacuaauacauguuaucgacugucuuuuuuauuauucaagugggugugauauaguguuccacuuauuuuuguuaauguuuauuuucuaauuuuuuucaauaaacauugucacuuguauaauuuuaaaaauguuuucaaacacgaaggaugugagaaaaugcucacagaagaaggcuaagugaagaaagcaggaagcaaagcuagucuuuccagaugcccucaauuuugugaaaauaauuuguuuaaaauaauagguagaaaugauugccuucucuuugccaggcucugugcaguauucuugacucuauucucuuauuuagucuucaugaagacucuaagguggugaaagggaaggcuugaugggguucagucacuugcccagggucccacagcugcugaagagcugugauuugaccgugguauguggccacccuggcucacuggcccaaugugucuuuccuucauauuggaaggaaagauaccgcaguguguacauaguggugauuccaguggaggggcuugcagggggguguuuauuucuuuuuauguuuuaaaauauuuucucccuuccuuauaaaucggacaaaaaauacauuuaaauaauguaauaacccaagauuuuauuuuguaguauuuacauuaaucauuccuuuuuuuguuuacucauaaagggcuuguaacucaguauucacugcauuagaaaacagugaagaugcaauugaaauuacaagcgaagaccguuuuauacagguuuguuauuuuggaaaucugucuuucuggauuucuuguuuugcuuuuuccaacuuuuaggauugaaccucuccaauaugauuuuuuuuuuucuuuuugaaguuuaggagaccaguuuuuccuucgaggauuaucagaacaaaaucaaauauguaauuuaaaauaagcucucuauagauuagaaaacauacuaauaauuaaggugcuagaaaaugccuguagaaaugccacauuugcauucauuauuuccacuaguuuguuuauuuaacaaggagagacucacugaaaaggaugauugcugggggcuuggggguagugcuguuguacgaaggggaaugcccugaccauaggucugcaaguacaagucuuucaccuuucucacuguuuuugaagauaauuugcacuuacagaaauauacuagaaacaacuaaaaguuucagaaauaacauaccuaguaagugcugaauaaauuacacauuauuagcaaaguggguuuauaugagugacuuaaggcaacauagcuuaauguuuucagauaacagcaaaaaagggaguugcaccagaaaaagacauucauuuugucugagaauuagcuccacuuuggagcucuccagucuuucuuacuucugggcucuccagucuuucacuuuaauaugacuugugacuuccuuguugaagaggugaugguguugacuuugaguuggugcccugagaggcagcgugggccaguguuugagggcacaggcuuuggugucagacgggccugggcuccauccugcuucagcugaacaacuuugggcaaguuguuuaauccagcugaaucugcuuucucaucuguggaaauggaaauaauauuaguaagaacaacagccugccuuuuguaaggaugucaugaggacuaaaugaauuaauguaugugaaguguuuacuauagugcccagugaggaaaauggacccugacagauaguaucaauuauuguuuuaucaucaucaucauuagcacgugcacaguuuucccauguauuuucugcuuaucuuacagucauaucugaaacuuaaccauaaagccuuacauuuguaauuacuucuuaguucauagccugcuuuccauacacaucauuuauucgaaccauaugaaagagacaagagaacuguuucauucccauauccggauaagagucucagagggauuaagugacuugcugaggucaauguguggagggggaggacagccugaguguuuugcacucuaccuggugcuuuauuccaucauccccccacccccacccccaucuaaacagcccuguuguagcagcuccugguuuggcgcugugcacaucccuuccucugccccuguugaagugggagugggccugcugcccuccuggagccucaggagaacauagcagaaagcccagccggguaucacccaagcagaagcucgucugggcuccagaauucuucguggguuaugugcuuauggcuucacaacugccacggugagguccaggcuccugagcuuuuucuggggaaaaaccugaagggcuuaggucgaagaccuuugauuguccucuuuuucaaaaugacuuuuaauucacuuuauguuuuuucuuuugucucccuucaguaugcaaauccugcauuugaaacaacaaugggcuaucagucaggugaauuaauagggaaggaguuaggagaagugccuauaaaugaaaaaaaggcugacuugcucgauacuauaaauucaugcaucaggauaggcaagguaaguaagaggucagugccuuuuuuaacuuucacaacacagagagaaggaagacuuaguguucauugaguacuaccagguaaucuuaaucuuacuccucccagcagcccagggaaguauagggaauguuaucccuguuauauccauuuugcaggugaggaaacuggggccaagaaaauauauaauaugauuagccaauaagcaaaguaacuugaauugacacuuaacaaucauuguuuuuaucuuuguaguaaguuaauaacuugauauuucuaauaauuggucuucuuaguuguagauguuggcaaaugguucuggguaaagaauugccaguaaggcaacacauucucagaaaacaucugagcccaagauuucuccaagccucguuaauucauugagcauuuuaaaaaugccuucuguuagccagacacugugcuagauucugguauggaaagaagagcaaaacaaaaauuccugccuuagagagcucauauucagggguuggaaacagacaaauaaaaguaacuauuauucaauaauguaagaagucacauaaucauggugcugaaggaacaggcagaagaaaggcaggcucagucugaaagguuauuucugugaaccacagccucugauagugccucacugugacagauuuuaaaauaugaugagaaggaaaaggcuacugcuuuucacaaucauucaugguccuuucugcuggacuuuuuuuuuuuuuuuuuuuugcuuuuggaaguuggguagagacuauuaaucugauuauuucaaacauuugaaaaauuggugacuugugcagccugcucuguggaggcacugauggaagugauacugucuccccuauggcauuuggcuaguuccuaucuuguagcacaaaacagcagcuuaccacaggggcagggugcugugcaaagcuuauacuccgcucaucuuggaccccaugaagacaccaugaaugggccuguuuuucuugccuuuccuaugccucugagcacacaacauugccuugaagugagaacaaggaaauaauaggccagcugcaggggcccagugaagcccugccaggggaaugacaaaaguaggcacugcucuauuuugccuucaacuuuucugucaaggauuuuuuuuguuguuguuuuuuuuuguuuuguuucguuuuuuuacuagagggaguggaagguccucuagaaagagagguaugaaggcugagauggaugaagagacccucaggugcucaggugcaccauguaggugagggcaaguauuccuuuccaugguugagaagagcauacucagaaggaggccacagagcagcagucauccgagaccacagcagccaugguggggguguuaccaugaccaccucaauccuggcauuuagguuccuugcugcuacuggaugagccagugguuuuguugugagguucaacuggguaugaaccaggaugggccuuguacaccuugauguggcagaacuuccacugaggcauuccaugucccucucacugaggaggcaaguagagguaaggaagggaugugcuauaagugcugggcuccauccaguucugugugaacugugucucaccuuugcugggguugugcucuugggcaccagguaacaaaagcccucaaacuugaauagcaagagaccugcucucuaaaauuauacuuauugugagcaaggaauaggaaacaucaucaaauuauugaccccuauacugcuuuccuuuuuuuuuuuuuuuucuugagacagggucucauucugucacccaagccggaaugcagaggugcaacagccuugaccuccugggcucaggcaguccucccaccucagccuccugaguugcugggaccacgggcacaugccgucaugccuaauuuuuuaauuauuuguagagacggguucucuguauguuguccagguuggucucgaacuccugggcucaagcaguccgauaaucggccacccaaaguuuugggauuacaggugugagccacugcagcuggccuguacugcuuuauuucuaaaaagagccuggguauuuguuucguuuuucacaguuuuuggggagcauggaaaagcaaccuuuguccuuugucaggaaccugcuggucuaugggcaacauggcagcagggcaggccgcugagcuggccuguguuuugaggugaaagaauccauaauuccaucuccggggaacagggcuuguugaggggucagcaggccuuauggaacaguggcacugugaucaggaaggggaauucaggcaucugcuggagaccagcauugcagaauggagacuuaggaaauggccagauggcuaggaguugggaccuuggagugucagaugcuagguguuggauauugaaguuugaccuuggggcagaagagaaauuuugcugauguucaagcagggaauauuauaaacauuuuccaucuccacaaacccugcugcccauuguugucaguggcuccucuuuuggguaaaaauaacagguauguugauuuccagcccccgcacuuaggcuucuuugcauccuauauguauauccaccugacucuucucuuuuuucuucuuccccaagacuugucuaucagggcuuuagaacccauagucucccaucuucucagauaccuaaacuuuauauugucaauucucuuuuagagaucuuuuuuuuuuuucuugagacauggacuugaucugucacccaggcuggagugcgguggcacgaucuuggcucacugcagccuugaucucccaggcucaagcgauuuucccacuucagccucccaaguagcugggaccacacgugucuaccaucacaccuggcuaauuuuuuaagcauauuuuuuagaaauggggucucacuguguugcccaggcuggucucaaacuccuaggcucaagcaguccuacucccucagcuucccaaaguacugggauuacaggcgugagccaccaugcuuggccucuuuuaaaaaucuugauuuuuuuuuucccucccucagaaacuguguguucuucuuuugucauuuaauggguaccaaguaaaugguggcuacuuagaugccuaagaugaugaugugcagcugcagaaaucuucagcauuucaaaacuuuuaccuucauuagcuccugugccuuugcuuuccucucacugucuccccuuuuccuacucuucuuccauuuccucccagauuuaccagaacucuggccuuugcccccuacuguugucccucagaauguuccuuuguuguugaaguaucuuuucugcucuguguagaaaucucacacuucucugguuuuagugucagccucuuuuccaaggucugguucagcauccuacuaucaucuuaauugucuagcaaugguuuucucucaucucccaaaaacccaaucucucuuccaaauccugcugucucugcucauggaccuaccucacaguugcuuugacuuagauuccugaaaugguuuugaucccuuccuccccguugguccccuccaucaaauccacaagcauugauggcuguuaaaccccuguuuugaggguccauugccugggccugaccuugcucagggccuucuucccacacucuggaguuacaguguguaacucugucuccuuguccggaauccuccaucuccacucgguccaccauacacuacugccugauuagucuuacugagucaucauuuugucauguugcuuccucagcauagagcucauaguccucagcuuggcugccaggauucuauaguugaaccucagccuaccuuucccauucaguaacaaaagccccaaguguucuuugacaguuuaucaugugcacacacugugcccacccuggggauaggauggcuggaugaugaugauuuaauucucaagacagcgggugccaagagggacugcaucaauagcuuggugcauagcuuguagcagacagaagggagguaauagucuuacuccuguucugaggggagcuuggccuggagaaagaggccuaugcaaaccaccugcacccaaaccagcucauuuacugaauguuuacuguuaugucaggacuuugcuaagaguuuaugugaauuacccaaccuaaucuucaugguaguacucuaagguuguacuauuauuauucucaggaacuaaauauauauauauuuuuuuuccucaagacagagucucacucuguugcccaggcuggagugcaguggggugauaucggcucacugcaaccucugccucucggguugaagcaauucuccugccccagccuccugaguagcugggauuacaggcgccuaccagcacgccuggcuaauuuuuguacuuuuagcagauacgagguuucaccauguuggccaggcuggucucucaaacuccugaccucgugaucugccugccucggccuccagaagugcugggauuacaggcgugagccacugugcccagcuggaacuaaaucuuauaugauauuuauguaaguaaauauuuuuuguuuccucuggugacuggaaaacuuauugacucuguuacccuagccaagccauugccuaaauuguccugcuccuuuagauggacuguggaacuuugccuggaauggccuguuagccuugacuugggaucgcucagucacccaagucuauucagaaaggacaagaagauccugaauauauauauauauauuuuuuuuauauauauauuuuuuguuuuuguuuuuguuuuuugagacggagucucgcucugucaccaggcugcucacugcaaccucugccuccuagguucaagcgauucuccugccucagccucccgaguagcugggacuacaggcacaugccacuacacccagcuaauuuuuuguauuuuuaguagagacaggguuucaccacguuggccaggguggucucaaucucuugaccucgugauccacucgccucagccucccaaagugcugggaucacaggcgugagccacugugccuggccugaauauauuuuuuuaaaugcugacugauugaauuggucccuguaauuuuuuucucucucuuuuuuuaauguaacaguuuuauugagauguaauuucuaugccauacaagucacccauugaaaguauacuauuugauagcugggcauggugguaugugccuguggucccagcuacuugggaggcugagguaggaggaucacuugagccugggagguugaggcugcaacaagccaugguugugccacugcacuccagccugggugaauggcgagaaccugucucaaaagauaaagaaaguauacuauuuggugguucuuaguauauucacaguuuugcaaaugucacaauuaauuucccauauuccccuugauagugagcuuuagaaguaacccuuagaccugucugcugaagccuuccuucuaagguagacaugcaaguuguggacauggaggacaacccacuuauuucugccuagggaacccuguuuaguccuugguggcuuuggacuacaagccucguccugugggcugagcucccccucagaacuguaccaaggcccauaccucccuucuacuccagugugaccuaaggacucagcugggcuuucuggcuguuuuuugauauagcccuuuuuuggugcccauuguuuucagaauuauaucaguaagcaucaguaaucauccuuugauucuaucggaguauucugguuucuuuuugaucugcuuucccagaggagucugaagaugagcucuuaucauugguauuuggaugcagguugccauguaccaaacaagaauauuucagaauugaccuggaguagggcucuggauagcaaaccucagcuaagccaacaaggcugccauggugcuuaacacccagccugggucaacucuagguccugagggacucuggaaggcuaagaaagguuauggaauacccuagggguucaguguccuguuguggguuuuagggauuuccauaguuuaagggccuuggugauuuucuuggaggaauucauaacauuuuaggacggugacaaaacccagcuccauccuggcuuucccuaccaccccaagauaaagggagucaccacagcccgguucucuugcuguggucuuguucuguguagcccucuuuccccaggcugcacuuccugucugaaagaauccccacguucugugucugaucaggagagcacagcuaaugugauuucagcccuggguuuugaggucucgucguuuguuuuacuugagcuugguccuggcuguuaucucauccuccacacccuauauacagggggugaagccuucacacaucccagaagggccucaagccauuuaguucaccucagaagccgguaguggccacauaauggucccuucuggcccccagucuggcuauucuuccccucccaaacacaggggcagaggcuaagcccccucuuccacuucagcaggugggaguuaugagaggaggaaguaagggggagugcccuuuauuuggggguccaggaccccucuugucugcagauggccacugaaaauauaugaccacuuagacuauggugaccugacuuuugucagcaacucagaaggagguggacuuuggaaguuaagaaagaauuguccuauuaccugaaaucaguuugggguugggaucauuuuuuaucuuaauugcuuuagcaauguaagugaaucagaacugaaguggaaaauguucuuggguuuauguuuucaacacaaaguaugacgaugcuuacauuccauuuauaggaguggcaaggaauuuacuaugccaaaaagaaaaacggagauaauauacaacaaaaugugaagauaauaccugucauuggacagggaggguaaguggaaaaaacaaguacaucaaucaacauacaguguuuuggguuauugcagaauuugcuuugaauauuuaaguuaaggacugcugacagaagugucaaggucaggugucaucacagaauggccuuccagcauaguguuuucuuggugacuuccucauggcuacagucugacccucuacuugcagcccagagccaacauacucugggcagucuuguuuaagcugcguggauacacaagaaacugaaguauuuguuuaagucagaaugucacuuuaguaaguugugugauaauacugacugguagacucccuauauugaaaagauuuuuuaucuaauuugauaggcuauguauuauuucugcagagaccuaucaaauuagauaaaaauauuuuaaauacuaacaguuauggacauuccuauauaaaacagaugugacuguagauuggaaaccaguauauaucaggagccuaaaacuuucagacaguuuaucucagaaaccuaucuuaaagaaauaauaugguaagaugaaaauuaugaauaugaauuauagaacaccuaaaauauugcagccauuagaaaugaugaucauauucacagguucuaagaugagggccaaaaaaaguagaaaugaugaucauagaaaauuaaauuaccucaugccuguaaucccagcacuuugggaggccaaggugggaaaaucccuugagcccaggaguuugggauccgccugagcaauauagugagacccccaucccuacaaaaaauguaaaaauuagcuagguguggugacacacaccuaucaguuacuucagggggccgaugugggagaaucgcuugaucuugggaggucgaggcugcagugagcuaugaucaugccacuguacuccagccugggcaacaaaguaagacacugucucaaaaggaaaaaaaaaaauaaaauaugagaaagguuaugauacaauguuaaaugcaaaaaguaaaauguaaaaugauagcuaguguuuaaucucaaucauguaaagaaaagaaggaaaaaagaacaggagaaaguauggcaguggccguuguaguaaccgcuguuguuuaauugagccccucccuuccuggccaguucucaaugugugguaaaugccacuucauuccauccuaacugcagcccugugagguugggacugugaucgucuccacuuuacagaugaggaaacugaggcuuagagaggucagguuucuagcccagggguccagcugccagcgugaggcgcagccaggcugcagaccucagcacugacugcacagcucacgugcuuugucaccaggcuuugcugccaguuggugaucgccucagggagauggaucuguguggguucucuguucugauucuuugcccuuuuauguccuuuccaauuuuuuugugguaaguauauagggauuugauuaucaaggggaaaaagugaaaaaacugaaggaacaauaaauaaaugagaagagucagcagccucugagcuaagcccucguugcuuuguuuuagacaucuagcuaaccacguucagugugaaccucaacucccaguguggcccgcggcuguggccaccagugaccgugagcagauuguuuguuggaacuugaagaaaagcaucaauguaaaggguugugaaaauaaaaacauguuaaggaacuaaaggcucucaguugguuaacaugcaguucauuuuaaaaaauauguauauuugauugucucaugauuaauugggaagaauuuugucauuuuuacugaagucacuuguacagagacgccaaaggauguuugugaucucuucuuuauuuauugguggccuuggucacagugagaagaaauguucucagagcguuuuguguauugcaaaagggaggugccauuuucguaaugaaaaauuaacgacauauccaucaaauuagagacucagaagagaaauaaugcauuguuuuuuacuugcagaaaaauuagacacuauguguccauuaucagagugugcaauggcaacaauaagguacguaaggagagccccccggggccccaggaacaccccagcaagauuuucagcaaucagaacuaauggcuuuuaaaauucacuuuuaggcugagaaaauauccgaauguguucagucugacacucauacagguacggugccccguauuuauucuuagaguucauugaguuuuuggagaaaaaaaauaaaaacagaucuuuaacuagcuugccugguguaauggugggauuuuccucagacuguggcaacauuucucuccuugacuccccaggcuggcuuaugagucacuuguacagaggacuugagcgcuugugagcauucugaugggugcccuggggcgggucucugagccugcgagggaaagaaauggucaacugaaaugcaugaacucaugugaagugugguuuuauaaccugauuuauacuuuaagaggguugaguguuuaucccacaguccuuuaacagggaugucuucaucuguccugacacuuaccacugccagccugcagggagguagccaggccccucgcacuugccucaccucuauguuucuuaaccaugccuuggacaccaucuguucuuccccauagcuuucuuacugcaaaugcauuucccugguuuggagucaccuguuuccuucaaacgugucaugacuucagcaagccacuuccuguucuggcccucacagaugaaggggcugggcugggauggugaagcgccacuccagcuucaggcaggaggugcuccgucaagugucuguguagacacuuggcgugccacccugccuugccugaguagugugcucugcuugcccauguggucuguaagagccucuaaggagaagacuucccuucaugcuguuggugacaugcuuucugccuuaccagaacaguucauucuuucauucuagaaacacuuacuacauauuuuugugagcacuuaauguguacaagauaccuguccuaagugcuuuagguacagcuuauuuuaaugaagccuuagaauaacucaaggagguaagcauuuuuaggugaaauucucuuuacagguaaggaaacugaaaguuuaaguaaucugcccaaggaucuccauuuaggaaguggcagagcuagcaccugaauccaggaggacugacacuagggcucugaagcacaguuuuuaugggugccccaggagcaaucagagauuuagucugaaaagagagacacauugacacaaaggaacacagcaagugauaagaagugauccccaggaaugagaaagggcaguggguagucuucuagacagggagagguggauuugaauagaaaagaaaugugagcgggaaagcauuccagcaauaaaaacaggcauagaagggggaaaguacagggcauguuccagaaaaagcaaguacuaaauuuugacuuguauaaaaggucaauggggaaagagguauuugggucaauaagaauccuuaaaugcuaggugggaaguuuccauuuucaucuguggacagugggagucugaggauuugugagucagggagcagcgugaugacaucugagcuuugagaagcucuuagagcauguauguaagauuacauggaaggagacaccagagagaagaauaccagcauugccauggucgagaggaaagaaaacaauggccagggaauaauaaggugaugacaguaggaagagagaagagagaccagaugugaugauggugugggacuagagagagaaaagcaagaaaguccuugaaaagguuguuucugagccuggagauucaggcaguagcaguagggcuggggaggaugaauguggagagcucuaccugugagguccuggugggcagucagguggguuuguuuguucaccccuuugcccauuuauucuacagauuucuguugaguaccugcugagugcuggcuucuguguucugcaaagagguuaggucuagagaugaaaauguuucuggccagccaagcauuagcaaguagcacagauguggaagugauggaaaccagggaugguaaaggggaauggaaacuuugagauuacaguggaagagaacagcaagaaaaggagaggaggggugagguggauuccuagagaccacccaccuccagagaaggaggaaacagaagcaggaaaagagggguuagagggacgagggagucuggagagcguugcugaagcugaaggcggggagaacgggaagcaucaagacuggucagggcugaagcacacauagggagggagggggauauggagccagagauggauaaaaacuugugcuuugcauucaagagcucgugugugaccugcagacaugcaguuucaggagaauggcgagggcagaagccagauugcaggggcuggaggagucagaguagaaagcagcaugugugggccuguuauggagaguccuacaccacaaguucacagggggcuuuuacuugguuguaagcauuuuuuuuuuuuuaacucuuaagaagaguaccauagggcuggacgcaguggcucacaccuguaaucccaccacuuugggaggcugaggcaggcagaucaccugaggucgggaguugagagcagccugaccaacauggagaaaccucgucucuacuaaaaauacaaaauuagccaggcgucguggcgcaugccugucaucccagcuacucaggaggcugaggcaggagaaucacuugaacccgggaggcugagguuguggugagccgagaucgcgccauuguacuccagccugggcuacaagagugaaacuccaucucaaaaaaaaaaaaaaaagaauaccacuguaaaguagguaugacuauuauuuauauuccuuuauuacagaggaagaaacugaggcucagaaaaguucaaugagccaggugugguggcucacaccucuaauccuagcacuuugggaggccaaggcagguggaucgcuugagcccaggaguuugagaccagccuaggcaacauggugaaaaccugucuguaccaaacauacaaaaaauuagccggguguggugacacgcgccaguagucccagcuacaggggaggcugaggcacgagaauugcuugaaccuaggaggcagaggcugcagugagcugagaucgcgccacugcacuccagccugggcgacagcaagacucugucuaaaaaaagaaaaaaguugaaagacagccuagaguugggcagccgggauauggcagagcugggacugagaggcagagucagugaugcagucagaggaaauguucggcagggggagcaucucccaaacugcauuuguaccagggcauuuggucguuuuacuuggucaccguugacuuaggaguuuuacccaucccacccaggugagccacuugcccauccuaccuacccccuuagcagcauaaccaccuuuauguccaaaggucucaacuggccaucuucacuugagaaggcaggguggagcuguuauaggccaugggccagccaaaguccuugguuauacacaacagaaaucaauucuucagcagaaaaggaguuuuuucuggaaggaaauaggguugcuuauagauuggacaacaaagcucuagaacuaguuuuggaaaaggaagcaagaaccuggggaagcugagcaauuguccccacugccguaggcaugccauaggagcacugugcuuagggggccacugcugucacuacugagcuuugagcaccacuggcccuguugagaucugguuauaggguguugcuguucucaccacggguagcauagcuucuucacaccucgcuuccuuaccucacucaaaagcagacucuuggaaggaagcacucauuugucugggccugugucaccuacucugucacuaacuggguauggagcaguggagucucuggccuucucccuccccuacugagaggacuuaguacucccagacaugggaaggaagguucagggucugggcauccaaaagaguaauaaaaucccaauacaugcucccuuuucccuggcccauguguuguuuucacgugacacugucucacugaggacaccaaauuguagugacaacuguccagucuauugacuuguucuaggucaggcccugagccugacuguaagcauacagaaaugaacaugaguuucgcugucugguggcaggagaaaauaauuugaauaugcugugguuuguaguaccacacuggagaaaagcuggggaaugcuucccagcaaugaugaugaugaugguugaccuggugucugaagagaaguaggggucaugcagaggacaagaugggagaagcagcacccauaaaggcaucgcgaagcgaggcuggggcaggccaguuuggauucauccuguaggcagaggaagaccaagggaaucuuuauaaauagguaaaugggaaagggucaggucuuaggaagacagucauggagaaaagagauugaagacaaaguaacuccugaauccagccucaggagcccaaucagagacuggauucaggaguuacuuaaguauaaucaguaggauuugggaaccagcuuacugugugggauaaagagaagacuucagaaugacaccaagauaucuagcuuggccacuggauaacauuaguuaaaauaacaagugcaaauaagaucguaagaaagagcagguuuguacagggaguggauaguaaguuuagauuugaacuuaccacaucugaagugauaagccaaaacuuuuggcccugggccaacuauucugaagagagaaagugaggcaggaagacugaguaccaagaaaggaguccagcaauaauagacgugaauaauggccaggggagcacugaggagcaggaugaauucauucauucaucauucauccaaacucagugcaguugugucucugcuugcaagauauguuucuaucugggggugagguaaacaguaagcaaauaaacauacaguauaucagauggugcuaaguucuguggagaagaauaaagccaggggauugggcaugcaggggaugaggagguggucaggacaugccuugccaguaaugugacaggcucugguucuuguucaggugguauggaauggaacccaggccucauacuuugcagguguucucaugggcuaccaggguuggggccauuguuagaggccucauagaugauugaaaagaguugggagauuuggucugugccuggagaaagugagcuuucuugggaggaagagguaguuaccagaggcccaugugcagagaguccugugggcuuggcaguuuggagguggcccuguugcagaguaagugcucugcaaaugcuuguugauagugccugaggagauguuccgacagucagcuguggucccggcagaaugacuuuugggcaagucacauaaaauacuggggucuggacuuccucauauccaaacuggaacucauacuuccaggcugcagggcuaaugcgaguuggaggaagcugcuguuuuugagggguacugauugguuauccucucucaucacccccacuguuuuuccaggguuuccuggauuuacccagcaggucaaggaaaugcuauuaauuuuucuguauugaaagggugggcagaguuuauggacccuauuuuacagaacaggaagccaagagcagagacaugaaguugcaggugauccugagcccaagcccuggcuauggaggccuaguuaguguucucuccacuggcaggccggauaccucaggaugaguauguguuuucugagcacccaguaagcaugaggcccugggcgcagcacgccuucaggagcugguagucucauugggauguaagccucacacuucaucuucaaccucuugguguucccugaggagagcuucugagagcugggugcuggggugacaggguggagacgugguccaucucuacccacugggcgaaaauugcuagaaucaucuauaacgugcuacagggacuaggggagcagugagcuuagcagggcuuuugggaacaagaggaucuuguauuuacauaaaguaacuuugaaacagucaaguagaaauuaaagccugguuagucucccuccacuuuucacagugcguccuucauacacccucugcugcuugcuccucuccagccacacugcuccaucugcacaagcaguuuccuccuccuggaaaugcugucguccuccuccucaucuuggcugcagcuacaagacuccauccaucuccuuucugcccccacucccuugagaaucugccacuucccccuccaggcuccuccugaacuucagaauuauuacuguaacuccuaguuuacccacccuuuuccccacugaccaucuccuuucgaguucauggacuauaccucauucauuuucaccucccuaaugccuagcuuagggcaucacacauggugggugaagguuuguugaguggaauaaaagagagaagaaugaaggaacaaauaaucauaaguucucaguccaggcucaucagguggcuauguggacauuacucaucaugaagcucagaggaaggagacacauuuccagcuccaugugguugagaagaggggaaauuugaaggaaugaacacuuggagagggugcaguguugugucucagacagaaggagccggugucaaggcuguuccagagauggaaggcggagcaguugugcugaugcaguacauucaugggaaacagugagagaugaaaggcaggcugcugcaggccauccuuaccugcccuugaaugccaggaaguucuuuaucucugagacgcugaaggauuuugagcaggggagccacagaaucagaguggcugauuuaacagaacuuugauuugugcacaggaaggugcagguuuuuggugaagcagauguguauuuauugagcuucuauacacauaugcuucuuccagcagaugguaggcacagagcuggucaccuaggaaagacaggaaaaacugucccugcccucaagucauucauguuagcaaggaaggcaagaaggcaagacaauaaagcaggcuguuacccagcacuguuggggugguguggagagacuuuaagggaagguuucccaaaaguuaggauaccugaacugcaucuucaaagaagaucagagguaaccaggcgaagaagguggcaggggagaggcacauuuccaaguaggugguuuguaccaaaucauagagguuugggaggcaaauuaacaaaucauaaauaguucaagguggauagagauaggaggugcagaccucauaggacucugggugccacacugaggaguuugaaucuuauccuaaagacaaggaugagccauugaaguguuuugauugagagaucugguuggauuuuuguuuuacaacgaucgcuuggcugccugcagagaauaaguugaaagggauaagguugguguuuuagaaccaaucugggaggccauuaauccagggaggaugacaaaugucugagcuuggacagggauagagcaggggauagacuggagguguuuaggagguagaauccuuagauuuggcugacccaguggaaggagaggggagggggagaagugauggaugacuucugucuaccuuaugguacaugcuguucagugaucuggguuaaagagcagauuuggagaaagauaaggacuucaugguggauaaugaauucauuugcagugccugaggagugucuaagugaggugguaaaugguaaguuaagauguaagucuggagcucaggagagaggccugggguaagauggcaacauaggaauuaauuaaaacuauaggaagaaugagaucucccaaggagguuuuguugacugagaagggcuaaggauagaaccuuuugaaaaaccaccuuuggaaacaccagggguacugaggaaggaggaaaucaugaaagaaacuagaaaggaguaguaagaaguggaaggaaaaccaggagaguguggacucugcaaacagaaguguccagaaagggaucaguugugucuaguaccacaaucaagucaggucagguaaggauugaguuguagccuucagauuuagcaaaaaggaggucguuggugaccuugacacauucacucuuuagugcccacagagaagaggauuuaguuuaauugggcaaagaagcaaagagcaagugaagagccuuuucgauggugcaaaggaagugcuaagggccuacauucggauccuguacaugagcagggagagaaguuccaagugaggaagccaagacaaggcagagaagcuacuccauggcugugggaagagcugagcucagcgcccacccugcuaugcacucaucugcaaagcagcuccuaguuuccuugucugugaaauggggaugcaugguacccagcaggugcacagagaaggggucaggaagguaagucagaguugccuugucagugauugguuugggggucaggauuagagaagagucaaagacaguccccguuugaagccuaggagaguaguguguccuucguagagaagagggggugaaagggaggcagaugagcuaucauuugaaauauaccucaaacaguguucaccauacuacccuaggaaagagaagaauguuuucccugggauauuguaguccuuauuuuguagagaaaauaaaagauuuuuuuucuuuggggcaagaugaguggggaucaaaauuuucccaucauuuuauucaauuauauagaaauauaauaggagaaauucuccugaggucauuucuaucaguugucacuuuaugucuugggacucuguaauuacauaaucuggaacuguaaagcccuuguuuaucugugcaccuggugggacauuuugagaaacucuacccccauaaaacugguuucucauagucuucaucucuguacuguguuuacuuuuguggcauuuaaaacauuuaaaguugagaguuuuaaaaaaauuuuagauugguaaccuuccuuaauauguuguuuaaauaucuuugaagaggugauuuaucauuuguuucuacagauaaucagacaggcaaacauaaagacaggagaaaaggcucacuagacgucaaagcuguugccucccgugcaacugaaggugagugacaaagacaagagaaaaaaaugugaucaaaucacuguugaacacauggagcccugcccugccuugcccaggcucauccugucuaccuccaauucuugggagaggagggaacccucuggaaacuaguguucccuuucucccucucuguggacuccugccaaugggcuccauucugagccuuuuaauggaaucagaaaauaaagaaaaggaagaagauacauuucccauauauucuauaguugcuuuucuaaacuguaacagcagaagaugucaguucaucugcuauaauuguuugaauuugauaauucuuaaagaucuaucccaucgugguuugcaguuugccauggaaacuuuuagagagaggugagcucgauuuuggaauugugaaagacccuuauucagcaaauauuuaaguucuaauugaaauauacuuuuuaaaaagaauauguaagugcauggucugaaugacuuaguuuuugaaauguagucaacauuguuuauacagaguguggaggcagguauugcugcuagcuguauacauucuuuggcccaaaaaugaauacagaaggauacagagcugguuguacugguucaaaagacaaacuuuuccaaggugauaucagcuaagauuauacaguagggaucaaaugcuacccucucaucccucacagauuugugguaaggcccagaugacaugcuguguacuccuugcacuggaaagaccauacagauuacaccccugcuuugagggcaggauugggguggugccagugaggaagcgguaugggguuaugggaagacuguaagcuuuggugucagaaugaccucaguccaagucccagcuucaucuacucucuguguagccuugaggguggacuucuguguuuccauugccuuaucuguaaaguggggauaauuugcugucugcagaggauugugugaggauucaaugaguguguauggugccugguaaguaaggguagggacucaguuaguguuagcugccaucgucaucuucauuguagcugucgugauuacagucccagacccucugcaguccuggagcagcacagagcagggcugaggucccugcccagaacagucuucacucaccacaugcuaauguuuguugauccuuuggauuccuugguauauuucuguguuuuaauaaacaucuuuuucuuauaacuuuuuaugauuuuugaguuauaauuuauauacaaugaaauucacuuaaguuucauuucagugaguuuugacaauucuguaugcucauguagucaccacccaaaauagauauagaaaauccacacacacaaacacauuauuaaccaugcagaagcaaccauugauggcuagcaccguaaauuaauucggccucuccuugugccucauagaauuggaaucguacaguauggcuuguuugugucuagcuucuugcacuuucauguuuucgagguucuuccauguuguuagguaugucauaguuccuuccuuauugcucaguaguauuccguuacaggaauauaccacaauuugugugcacaucuucuucuuguuuccauuuugaggcugcuaagaauaagaaugccaugaacauuuuuaugcaggucauuuuuuguggauguauaugcucaucuucucccuagaagugggauugcuaggccuuagagcagcugcaaauggugcucuccaguuuuauucuccaauaauagcuccaacauauggcaccauguuacucuccucacucaucugugagaguuccaguuguuccauguuuucccacacuugguaauaccagaauuuaaaauguuagccacuccagugguuuuaauuuuaauuuuccuuaugacugaaguugagcaccuuuuuauuggucauuuggauaauccucuucugaagugucauucaggucuuuugcccauuuuuauaauuggguuguauaucuuguugguuuguagggauucuguauauugucuagauauggguuaucuguguaucacaaauauauuuuuuuagucuguuguuugccuucuccccucuaaaucauaucuuuugauucuuaaucaaagagcagagguucuuaaggaaauuuauuuuaucagguuuucuauuauuacuugcgcuuuuuauguccuauuuaagaaaucguucuuuaucccaagaucgugaaaauauucucccuuguuuucuucuaggaguuuuauuguuuuaucuuuuguuuuaggucuuugauccauuuaaaauuauuuauaucuggugaggguagagaucaaggaugacugccccugacccuagggaaauccaacucgucuaucaccauauugaauaaccaucuuuugcaguagcaccauuauuauaaaucagcuuacuacgaauaugugaucuguuccuggacucuauucuguuccacuguucuguuuguuuacgcuuguaccaauaucacaaucaguuacuuauauaguaaguguugauaucugauaccugguaguagguagcuguucuucuucagugccuuggccguucuagguccuuugcauuuccaugugacgcuuagaaugagcuucuuaguuuauacacacauccuccugggauuuguuuucagagugccuuaaaucuguagaucacuucagggaaaauugaaaucucaauaauggugagucuuucaaaucaugaacaugcuaugucuccauuuauuuaggcugucuuuguuuucucucagcaguguuuuacauuuuuguuguagaaaucauacaaaucuuuaauuagauuuauucuuagguauugaugguuuuuuaugcuauuguagugguguuacuuguuuaaauuuccaauugcuuauuguauauaguuauagaaauacaacugauuuuuguauauugacuuuguauaucuaggagcuuggguaaacuuacucacuguaaaagaagaggagugcauuuauagauucuucugggcuuucuguauacacagucaugacaaucuuuauacuuuuuuucuuaccuuauugcucuguuugauuuuuuucuaauuccuuuauuuuuaauugacaagaauuauguguauuuaucauguauaugauguuuugaccuaucuguacauugugaaaugacuaaaucaggcuaauuaacguguauuaccucauacacuuucauuuuuuuguggugagaacacuuaaaaucuaccuuuagcaauuuucaagaauaccuuguuauuaauuguaguuaccauguuguacaauagaucucuguuguuuguuacaagcauauaucaauuauuuuuaaaugaaaacaaguccuuuuaugacagugauaaaauaggaguuuuuauuuuugguuuaaugaccuuguuggguaaaauggaaaguuggcaauccuauaaucaccaaaauuuuaagaaguuuaguugggcccccaaauuuaaaacauuugagacccccugaauugguuaacuuuggacggugucucuccuugggccucaguuucuucauugguaaaaugagguugacacaucagucucugggacagccccugguccuguaacgucuuugggaagcagcauuuagccugauaggauuguucguggagauacccaggacuggauguuaacguuuuuucugccuauauugccugggcuucuccucaccccaaaggaaccauaucuugacaggaacaacagaaauuaacaaacuuuagagccuaagaauugcugccugccucauugaagauauuuaccuaaucaguccagauuaaacauaacagugggaagcaccagaggguaccuugaaaaauuuaaccagaaauuuguguauuucaguuauuggugaguugaauguauugcuccugccauauaugaaacaaagagcauuguguggcauugucuuccggaacauuuuuacuccuagagaauggcaagcuaaguaauuauaaaggcuuauugucauagacacaaaaagaggcuguuugacuugggcuugcuagauuguuuccucuguuuucucucuggccugugacaucagaaguucaguccaugggggcauaugugcauucuagugccuagaacugaaggaaacagaauugguuaugccagaaccccaggcuuguuaggaugggaaggaagcucagcaaacucaguucuauccugccccuucaucaugcagccgagcacacugagcccucugcugucaagacaggugcccagaguugugcaugcccugauuugugcaucccuuucuccacaguuuccagccagagacgacacucuuccauggcccggauacauuccaugacaauugaggcgcccaucaccaaggugaagcaguuuguggucugucuccauugagcacacauacuccuuguucuccccaaggaucauuuccaaugagaagaaacagggacccgcaguaaugagcaugcugucauaguuguguggugcuaguagccuccucugaagagagaggaugugugacaugggcauuuuaacuagucuuaaguuaguauuaaguacuauggccagacugaguccuguuggguuuuguuuuguuuuugcuguuauuuguuuuuuagagaugugcucucucauuucuguugcccaggcuagucucaaacuccugggcucaaguaauucucccaccucagccuccugaguagcuggaauuacagacacguacugccaugccuggcucucccacuguuuuuaagguuaugaaacucaaguauuuucuuuccauaauguagguaaucaauauuaucaaugcugcccaggaaaguagucccaugccugugacagaagcccuagaccgugugcuggaaauucuaagaaccacugaguuauauucaccacaguuuggugcuaaagaugaugauccccaugccaaugaccuuguugggggcuuaaugucuguaaguauauuugacuagacucuuggcuagagccugucuguucuugguuguuuucucagagguuauucacuuaaacagauauugaagaggcaggcagggcucuguaggguucagucaagaccuaaacucuccuccauugccuggguucugcuauucucuggccaagcacccaccugcugccugccuccuagggagagcuuagcuuggagcagagcagggaggaauguaauccugacagucugcugagcaccaguucuccaguguugcuuagggcuucuacaguaguuuaucuaaauaaagcuuguuuaguuguauuaaagaucuucaaaacugggacaguguagaacagaaagauugucuuucucccgccauauguauuuaaaauggugccgggggugcaacaguuuggccuucaaagcaucccacacacauuuagaugacuguaggaaagagggauuugggaaucuuucacuagaagggggcuuugugucauagacucuugagggguccuggaugccuccuucagcaugucugguguagagcucucacaagagagggacaacuuugugcagcacagauuauuccauugcucucugucagcuuuugucuuggucagaagcaaaauccaccucccucccaauuacugcuuucugaagucacuggauuuuauaaaaauaagguuccaggcagaaaucuagaagguagaguguuuacaaugcugauaauaucucacuguggucuugccuauuugagacagggucuccuccagacugcagguaagaggugaaaaugaugagggauggggguaggauaguguccuggaggcgagcagaugagaauagccacaggacuggagaaaaggggcugcugagaguacggguuugggccagguggucuggaagcaguggugaggagcccaggagagucaacuguggggaaugaggucacuuaugaggugagagaggagcuaauguuuccaggaaagccucguguccucagagugaggaggguugcacgaaaauggaggagaaggacugagggcagagcacaguugucccuaagaaaccaaaugguccuggagugcaagcaagaaugcugggcuuaaagaccacccaccccucaaaagaugcaggcucaccucccggguguugaccuugcuccugaguuuagcuuccaacagggccaggaccauccuucccagcauuagccuguugugcucuccaguaagugacugaggucaguggucaaucacagggguggaccugcugggcccagggcagccuugagugcauugguggagagggcugcccugaguuguccugugggaggaccaccuggaguuuccaggaaggaaagaauaguugugacuuuucuuuuucuuguuuccuugauuuuuaucaggaugguuugcgaagacuaucagggaaugaauauguucuuucaacaaaaaguaaguuuuuccuuuuuaauuucuuagaucacugucuauaauacugcagucuagcuuaagugaugaaaauaauuuuucaccucauuaagaaguuucuugguaugucauaaagccucagaaacaaagcagcugucccugaggcgguacuguccucccuaagaaacaguuaauccuggccgggagcgguggcucacaccgccgagaugggcagaucacaaggucaggaguucaagaccagccuggccaacauggcaaaauccugucucuacugaaaauacaaaaaauuagccaggcaugguggcaggugccuguaaucccacuacucaggaggcugaggcaggagaaucacuugaacccgggaggcggagguugcagugagcugagacuguaccacaacacuccagccugggcaacagagugagauuccgucucaaaaaaaaaaaaaaaaguuaauccuuuaaagccuauuuguucuccaaauuacaucacuuuacagacacucaaaugguuucaagcaauauaaucacucccaucucccuugaugaugucccaccacggauagcucgggccauggaaaaugaggaauacugggacuuugauauuuuugaacuggaggcugccacccacaauaggugaguucaugcagagcucagcagcgggagaacuagauucccagggccugugugaggaggcuaccugaggaguauggauugugcacaagccugguaccuggucaggguggggcccuaaggaaggaguaacagggcaccagguggcucugagucaccagggccugggggagagucugcuggccacagugauggcacauucauggaaagcaugcaacugagccagugacuucuccaaguagcacaggacuuuuuucugugaaauaaagguauuucuccuguaggugguaauauguuaagauugcuguaagagaucugcucagagccuagaaccaaaauuuauuagaaacacauacacaugugauaagagcugcucccagcuuuugguuguucuguuggugauaggcauagggacacccaaagccccagucauccucaucugggugugaucacagagagugggagcaggaaugggguuuugccuugaguuuuuucccuugcgggagaagagcuguuaaccaaaggugguaguuggcugggcacacaagaaagggagguccacagagcugauuccagccaggacugcccacuagggugucuaggcagaggugugcucgguugggccaugggauggcuccucaggucucaucucagucugggugaccuguccccaagauaacucccugacuuuuucaggcuccccuugaguuaaccuucugauacguucuacuucccuaucucccagcacagccaaggagaguugaaaagaauacucccugggcacaugagucuuugagcaucugguuuacaugcuagugacauuacauccaugugaauugggcuaaggcaggucaguuuaaguccugugaucacuucuggauacugccucaacacagccaguuucuuggccuucacaggcaagggccagaugcugggucaaggugauuucucaaguaagaaccuaacuugguggccagcuggaaaccucaggggaaauccccucauacuuuuaacgcccaccuccagaaagguggguguugagaaaauuccauugcauacggcagugucuggcuuauaugacauuuucaggaaauguuuucuuauaggcaggaugucuggccaauggcauggguccagcaaguccaaaggagaggauaguguucaaggugguacaagcuuagccuggagaaaggguuauuuugaggaacccacuagugcaaguaggaagcugaaccuggaaggacagaaugagcaaacuccccccaacaaaucgggagccccaacgaggcugaggucagagcugcugugggcagccagcucucacccgugcaucaugguccccugagggcaagaaguggaaccagaguugguuggccccaccagagagaggccagcacagcccaagcaaucuccacuuugcugcccugcacucucugaaauuuggcuuggaaccuauucaggccuuaaacacuuggccuguuuguuugcuuuguucuaauauugugggguuuuuucugucuauaggccuuugauuuaucuuggucucaaaauguuugcucgcuuuggaaucugugaauucuuacacugcuccgagucaacgcuaagaucaugguuacaaauuaucgaagccaauuaucauuccuccaaucccuaccacaauucuacacauucugcugaugugcuucaugccacugccuauuuucucuccaaggagaggauaaaggugagcuguuguuuaccugccacauuuaaugggcaggagcaguggggagagucuagugcuucugccuccacuaagauacauagcaugacugcucacgugugcagccuggcacaggaagggcaaggucauacgaggaaucaggcaggaggccacauuagcuuugggaaauugauguguuaauucaugacauaaucccagcuauuccaugaggguacaagaggcagaauuuggucccggaggagaaaccuaacaaggacaggauagggcuauucuucugggggucucacuccaagccuguacacuaguagagccaaguaacuguuggauauccccacuuuagggccuccaucuguacaugaaagucugcagggcucuaaggucagguucaucaucucuguucccagcacugcucccacccaggguuaucuaccuaauccaggguuccauuauccaaccggauacccagauuagaaaccgagagucauccuugguucuuuccacuccucaaccccccacaucugguugaucaucugaccuugccuccugucacaccuaaauguucucagauucaucuccugcugcugucccagugaggccccccgcaauccuuucgcaucugggcaguuccaaacuagaauucuugccugcccugccucccauggaaugcccuuacccuacugccaaugugaucuuucugaaacagcauaccugauauugucauucccaggagcagcuucccaccucccucaggauuuaaacuuuaaacucuacagcucuccacacucaccucaacaaugagcuccucucaucauuucuucuccuuugucccagucacaggccacuuuugggccaugccaaaccacuuuaguuucugaagcuucugcccuugaccuguugcucccuugacuggggccuaagaugacugcagucaugcagggccagggcaaguggcuccuggcugcauuuccuccucuguaucacgggacuagcauuuggcagagagcaaagcagaagaugacaucuggcacacacagggagugaacaaguguucauuccucaccuugaaggguaaaccuucucagaacuuuccgugcucccucugguucuuauuucuguuuuuguuuuuuguuuuuuuccagaaaaaaucaaaucagacuguagguaaaauaggguguccagagaaggggacuguuuucuaaauuaugaaaacaaguaacaacagagggacaucugugucaauauggcucagcauauaaagaacccaauuuuugcuguauugcuuuuaaacuacucuauagacaacauacaaauauauauuuagagagcuaacugaaaacaguuuauuagagcauuuauugaaaugucaugguggcucacaccuguaaucccaguacuuugggauaccaaggcagauggaucaggaauucgagaccagccuagccaacauggugaaacaccaucucuacuaaaaauagaaaaauuagcugggcaugguggugcaggccuauaauccagcuacuugagaggcugaggcaggagaaucacuugaacccaggagguggagguugcagugagccaagaucaugcuauugcauugcagccugggugacagagcaagacucucgucucaaaaaaaaaaaaacauuuauugaaauguaauucacauaccauacuauuugcgcacuuaaaauuuaaauuauugaauuuuaauuuaaaucaauuuaaauaaauuugcaaggcugauuuauuagcuauacaucucaagagucuguaggguauuuccaaaaaugaucuuauacugggacauaauguguugaacuucuaaacuucauaggcuauauuuucuaaccacaacacaacaaaauagaauaacuaaugguuaaauuuaaaauaucagcuacaacaaaugagaaaauauucugaauaauuugggaaucaacaaagaaauaaaaccaaaaaugacauuaguuagaaaauaacaaaaaugagaagcuuaucugucaaaaccuauagaaugaagccaauuauauaguuaaagguuuauguuuuaaaugccuuaauuacuuuuaaaagggaagaaaaaaaacaugggaaaagcaaaaugauaauccaguguggcucuuggaaauaaccaagaaaauaggugaaguucuagccaaacuaguuaagauauaaagacacaaaaauauacaaauuuacagcagaaaauagaaguacugcacacauauguacuaaaucaaaagcuuuaaaauaguuuuaauggaauguuuuaaauuaaauugauguaagaaguaaaaaaacaaaaaaaaaaaacaaaagaggccaauaacauggaaguaauuuuaguaauuuuuaaauuauuauuuaauuucuucaaaaguuggcuccugacccagauggacaggugaauucuuuagcccuuuaaggaauuuuuccauguuacauaaaacuuuucagagucuugaaaaagauggaaaacuuccagaucauuuugucaaacucacaaaacucugacaucaaccugacaaagauagcacuaaaagggggaagaaaacuaaaucaauucccaguuaauguaaguggugccuauuuuaaauuuuauuuaaaauuguuucucuccuuuauuaauauuaguuuaugcuggucuaagucaauaucucagacuaaggacuuuuuuggugaugggucuagagaaagacuggcugaggaggugacuccuaucuguugagaacaccuguauuuugguaaguccuuaacuugugugagacuaacaaauaugcagaaauauaacuguuucaggguggagauaggaaaacuagauuugcucacguaguaugcuuuucuuagaaaucugaaauauucuuaccugaaaguaauaggggagaaagaaaacuauacagaaggcuuccuugccuucagugucauaccccaguuuuuaaaagcucucuuguuuucaggaaacuuuagauccaauugaugaggucgcugcacucaucgcagccaccauucaugauguggaucacccugggagaaccaacuccuuccuguguaaugcuggaagugagcuggccauuuuguacaaugacacugcugugcuggagagccaccaugcggccuuggccuuccagcugaccacuggagaugauaaaugcaauauauuuaaaaacauggagagguaagaacaaugauugggaaguguguugaucccucucuuucuuuuuuaaacagcuauauugagauauaauucacaucuuauacaguucacccauuuaaagugcacaaaguauacagugggccggacauaguggcucaugccuauaaucccagcacuuugggaggcugagacaggagaaaucacuugagcccaggaguuugagaccagccugggcaacguagggagacccugucucuacaaaaggaaaaaaaaaauuagccaggcucggugguugugucuguagucccagcuacucgggaggcuaaggugggaggauugcuugagcccaggaggcugaggcugcggcugcagugaaccgugaucacaccacugcacuccagcuugagcaacagagccuucccugaucucucaugcuaaguuaaacccucuaauuauucaaucccagauuucuucauagcacguaucacauuucuuauuuaauaauuacuuuuuaauuauuugcguaaugucugauuagauucuuaagcucuguaaggucacaagggucauaugucacugugcccucggugcccucagugccacagugcuugguacauacuagagcgagacccugucucaaaauaauaauaacauguacagugguuuuuaguauauucauagugguuuuaguauauucauagaguugugcaacucauaguauauucaauuuuagaauauuaccccuucgauagaaccucaaauuuaugagcaguuccuuuccauucccccucaacuccccuaguccuagacaacuacugugaucuacuuucugucucuauagauuugccauuucuggacauuuuauguaaauggaaucauacacaauaugugaucuuuuguaacuagcuuuuuucacuuagcacaauguuuuuaagauucagccgcuuugugucuggauguuucaaggugaaguauaaugcugauaucuugagcucuuagagacucaaagaagcagucaucuaucucucucccugaagcacuccacucugcccuccugugcucagcauacaucuccuuggcauugucucuguuuacaugucacuuccuuggggaagccuucccugaucucucaugcuaaguuuaacccucuaauuauucaaucccagauuucuucguagcacguaucacauuucuuauuuaauaauuauuuuuaaugauuuguguaaugucugauuagauucuuaagcucuguaaggucacaagggucauaugucacuguguccucagugccacagugcuugguacauacuaggaacuuagugaauaucaguugaagaaagaaaaaacauugugucaugaagaauacuuauuaauauggauuuuuaaagaagaggauuuuugauuuuguaaaacuccuuucugccauguucuaggauuucagagguggaguuaaaguaguuucuauucauauuugcuuauaguuacaucaguuaucaauggaaaacuacaugagacccuauuaacuuuccagagaaaguuuucuacucaacugcagaaaagggauugaauagagacuuuguuucauauucauaccccuucaaauuuugaauuacauggauuaccccuucaagaaaugaauuuuuuaaaguacuaaaauaaaagcaaggguuagagguggagguaucaaguacucccuaugauuucgcagcuuucagaagaucgguccucacauucuaugggcacuaaaaugguugggccucaagacaccuccaugugggguauauucuuucuaaccacagauuucuaucuucauugacaagauaaacacugcaacuauaaguuuugccuauagcuuuugguuuuaacuucuuuugagguucuccuugcuaacgaucuaggcacuaaccccuaacuuccaugucuuuuuaaaaugugccuuguggcuuucaguggcauuagauuuauagcugcagaggacacauaccuggauaacagauuguuuucaggaguaccugucuggucuggaucaguaauuuguagcagccucuaauuugucaucgaaaacaggaaugauuaucggacacugcgccaggggauuaucgacauggucuuagccacagaaaugacaaagcacuuugagcaugucaacaaauuugucaacagcaucaacaaacccuuggcaacacuagaagaaaaugggguaagggaaacuuauugcaaagagaaccuguguuugggguccuuguacuguuguguuauggagacacaugggcuaugauaucagccacagaaggguucccucagugagucuauuagacucuuacagggacagaacuaaugggauacacacacacacacacacacacacacacacacacacacacacacacacaaaggggaguuuauuaaguaauaacuuacacgaucacaaggucccacaauaggcugucugcaagcugaggagcaaggagagccagucugagucccaaaacuggagaacuuggagucugauguucaagggcagagagcauccagcaugggagaaauguaggcugggaggcuagguccaucucuccuuuucauguuuuucugccugcuuuauauuugauggcaauugauuugauugugcccaccagauuaaggguggaucugccuuccccagcccacugacucaaauguuaaucucuuuuggcaacacucucacagaaacacccaggaucaauacuuuguauucuucaauccaaucaaguugacacucaguauuaaccaucacagugggcucacugaauuuaguuuuuauugguuaaaaaauuauuuaaagugcaaaaacuuggcaggaaaaaaauuagcacauccaacuagaugggaaaacucgaaaggaaggucagauuuuagauaagcuaacuuuagacagacuauuccugcacccuuccucacuaauaucccccucccuucuucuccauucugugaucaguuggagcccuugauauaucuuucuagccacucccacugggcacauaucaugguagcagcagcuauccucucuugguccucacuuagaggagcauguggauugagaaagacacuguauuugugucacaagggugacauuauuguugccccuguuucuacauuugaggcauggaguccacaacaacugcugggcaaggauaacauuaacccucucaccaggcaggagucuccagcugaggaagcauacaggcccaaguucccaucauuugcuuaucuguagaauggggauaagaagucucaaggcauaggacugaugagcaugguacaugguaggcacuuaagaacuggugccuauuauacuagauucauugugucaucagcaacuuaaagaauauguucuuucaugaaccucuuccuuugaggcccacauuuacugaacauguuggcagcagcucacagucuucucucccacccuccuccccagcuccuaucaccauccugagauauuugccacacacagggaugacuuauccucgcaggcuaggaucauaauuccuugacuucuaacuccauuuuacuucugcaauucauuuguuuggccauggccuuugucugcccccugguuuucuagcauauuaccccaugacacuuacuuugguuuaaccugauguugagaacuguuucuucacccuuuccuguucucucaauuugucagccugccccugacuucacucucuuuccaaagacuuuuaacagaggugccuguaccagccuguuuuauuggcuccugcccugccauucuggauagggcucauugucaccuggccaccacuccuggcugaccucaugccacagaaggaaaccauacacccagcagacuugguuuccucugucuagucuggacagccccuagagcugaguucucugcuccacuuaacauuaugguucucaucucuguugucgguacaugggguuacuucugagagacugaaaaucaauauccagugggucagagcaggagaaaggaagaugaaagagaauaguuuccaggcuggcaguaugaaacuauagucacacugcagguauuaacggaucugaagaaagaagggucagcacagagcuggucacaguggaaaccuggagugaggagagcuacugaagugucaccgguguaguauucauuuuggcacucuccaggaagugugggaagccuagagucaggaugccacccguccaucuugauggcagucuguucccucugagcugggaccaucagggcuucuuaggcuacugcuauugcauauugaaauauaugacuaacuccuuuggaauguugcuugaugggcacagaaucagacugaggagaccugcuugccuuuagucuuuuucauugcucucugccccaauacccucuaaccugaauucucuucagagagccuacaaauagugguucuauuacaucauaaauugauccauauccaguggggauccuuggaugcagacagcaugugguacugugaguggaaggcaugcugggacuaaaggcagaacugaaguucuuauccuggcucggcugguugcuuuggacaagucacuucaccucccugagucucaguguccucauuuguaaaauguaauaaauaauacuuuucaugcuuaccauuagaucuucuugugagugcagaucaacagagaaugacuguuaaguccuuuauccaucaaauauguuagguguuaucuugggaaucugcccuaucacaggacuggguugagaaguacggaggcuguugggcugcaagagcccauuuguugugagggcagagaaauuuauuuuuuucagcucauacucuuuuuuaauaaauauaauaaaagacaaaaccagucuuugaguucuuaccaagggggagagagagaguggaacagaaaaaaaggcaacugugagaaagauuuagugagaggaagagaagaaagaggcaaggaaaaggggaagggcagauauaccaaccccuagugcuacccuccacuucuagguccuguugcaaucucacugagccucgguuuucuccuggguaaaaugagaggccaagcucaaugcucacaguauccuuggcacuguuuugugagauccuuauagauccugacuagugcucuuuuuaugcuuacagugggacagaccaguaagagagggcuuggcaccaagggauccauuuugauugcuuugaauuccacucauguuucaggaaacugauaaaaaccaggaagugauaaacacuaugcuuaggacuccagagaaccggacccuaaucaaacgaaugcugauuaaaugugcugauguguccaaucccugccgaccccugcaguacugcaucgagugggcugcacgcauuucggaagaauauuuuucucagguaaguugcugccucuuuuaaguuucuagagagagagagaguuaaaacccauaaaaucauacgagauaauggacuuaacacuaggaaauaggguucuaaaaaaauucuguccuuguuuugcaagguaacaaaugguaacugguaacaaauuuuuuuuuucuuaagaauauuuuauuuucccuuuauucuugcaggauauuuuuguuagauauagcauccuggguugaugauuuuuuuccugaaaguacuuuuaaggagucaucuggucuucauauucuuucugaguagaaaaaaccucucuuggggcagaaaaaaauauuaggaaauauacuggcuaagauuuuuccagauuugguggagggcauaugcacaugcauaugcauacagauucaagaagcccagugaaccuuagcccaugucagaugugucauagucaagcagcuaacaggcuaaagauaaaucuugcaaucagccagaggaaaagcgacacauuacuuauaagaaaacagugauucucauguccucugacuucccaucaaaaacuaugaaggccagaagacacgggaacaucuuuaaagugcuguuagcuuugggaggaucacuugagcccaggagucuuaagagcagccugggcaacauggugagaccuugucucuacaaaaaaauuaaaaguuagccgggcauagugaugcacuccuguagucccaagcuacuugggaggcugaggcaggaggaucgcuugaagcccaggagguugaggcugcagugagccaugaucaugucacugcacuccaaccugagcgacaaagugagacccugucucaaagaaaacauacagcuaacauuauauuuaauggcaugagauauugaauacauucuuaagauuggaaacaagguaagggugcccauucuuaccucuucuguucaaccuuguauugguguuccucaucauugcaauagacaaaggagagagagguuuaaagaacaaaaaguaagacauacauuugcuucuguuugcagaugacaugauuuuaugcagaaaauucuaaggaauauacaaacaauuauuagcacuaauaaguggauuugauuuaccaaugucauaggacacagcucaauauacaaaagugaguuguauuuuauguacuagcaaccaacaauuggaaaaugaaaccaaaagcccagucccauuuacaguaggaaauaaaauuuaaaaauuaaaauuaggaaaaaauuuaauaagagaugaccagaacuuuacagugaaaaccauaaaacauugcugaaaauuuuaaugaacacuugaauaaauggugaggcauaucauguucacauacuggaaggcucaguguuaacauucacuucuacccaaauugguguuucaauucaaaaauuucagcagguuuuuuuucuguggaagucuacagacuguuucuaaauuauauaugaaaaugagaaggaccuugaauaagcaaagcaaacuuuaaaaaguuggaagauaugcccuguuuggcuucaaaacuuaaaauaaucaagaaaguguggugcuggcauaaagauaacaaguacaaccaugggacagaauagaaauccaagaaacagaucacauuuauaugaucaguggcuaaugugaaauuuuugcaguaagugguguuaggauaauuggauauuccuaugcaaaaaaaaaaaaaaaaaaaaagaaccacaacuccuaucucauaccauagagaaauucauagaccuacauacaacagcuaaaaccauaaagcuuuuagagagaaacauaccagaauauccucaaugacuugaaaguggacaaagauuucuuagaugcagaaagcaacaaccagccaggugcaguggcuuauacaugucaucucagcacuuugggaggccaaggugggaggauuacuugaguccaggaguucaagaccagccucagcaagauaaugagaccgcaucacuagaaaaaaaaauuuuuuuaauuaguugccuguggugguggcacgugccuguggucccaguugcaggaggauugcuugagccucagagguugaggcugcagugagccaugauuguacacugcacuccaaccugggugacagagcaagacugugucuuaauaaaaagaaaagagcaacaaccauaagaagaaaauuugauaaauuagacuucuucaaaauuuacaaaguuugcucauucaaaacacagcuaagaaaaugagcaggcaagccauacuggaggaaaauauuuacaaauuauauuugaaaggacuguauccauagauauauaaagaacuauaacucaguaguaaaagauaaaccacccaauuuauuauaggcaaguauuuguccagacacuuccccaaagaagcuauuaugaaaagccaauaagcacaugaaaaaagugcugaacaucauuagucaucugggaaauucaaauuaaaaccacagugaaauaccacuacacacccaaugggauggcuaaaaaugggaaaggcugacaacaccaaauguugaagauguggagcaacuagaaugcaugcauuugugauagauguguagaaugcuacagucacuuugggaagcaguuuagcaguuucuuuuuucuuccuuuuuuaugguaaaauuuaccauuuuagaucuggguuuucuucccuucauucucuucauaugguauaucacacugaucuucaugugcggaaccaaucuugcauuucagaaauagauuccacauagucauuguguauaauccuuuaauaugcugcugaguuuggauugcuaguauuuuauuaaggauuugugcaucaguauuuacaggggauauuggccugcaauuuucuuguagugucuuugucuggcuuuauuaggauaaugcuggccucauggaaugaguuaggaaguacuuccuuccuuuucaguuuuucuggaagaguuugagaaggauugauauuaauucuucucaaaauguuugguagaauuuaaccagugaaaccauccuuucuugggagguuuuugauuacugauucaaucuccuugcuagucauuggucuauucagauucuguuucuuuaugauucaguccugguagguugcauguuucuaggaguuuauccauuguguuggcauucaguuguucaugguacucucuuauaauccuuuuuauuucuaugaaaccuggaguaauguucccacuuucauucugauuuugguaauuugggucuugucuuuuuuucuuaguccaucuagccaaagauuugucaaucuuguugaucuuuucaaaaaauuaucuuuugguuuuguuuuuuucuguucucuauauaccucuguucuuuauuauuuccuuccuuuugcuagcguuagguuuaguuuauucuuucuguagcuccauaacauguuaaguuagguuguugauuuaaaaucuuguaggcauuuacagcuguuaauuucccccuuaucacuguuuuugcugcaucuaauaacuuuuggcauagugugcuucauuuucauuugucucaaaguauuuucuaauuucccuuaugauuucuucuuugaccccuugguuguuuaagcguauauuaguccauuugcauugcuauaaaagaauaccugaggcuggguaauuuauaaagaaaaguuuauuuuggcucaugguucugcaggcugugcaagcauagaacuaacaucugcucagcuuccggugagggcucaggaagcuuaugaucagagcaaaggaagggggaagcagauguaucacauggcaggagagcagggggaauugccacacuuuuaaccagauuaccuguaaacucagagcaagaucucucauuaccauggggaggccacuaagccauucacgaaggaucugcccccaugacccaaacacaucccaccagaccccaccuccagcacuggggauuauuuuucaacaugugauuuggaggggacagacauucaaaccauaucaaagcauaugcuauuuaauuuccagauacuugugaguuucccgguuuuccuuccauuacugaguuuugguucauuucacuguuauuagaaaagguacuuuguaugaccuuaccuuuuaaaauauauacuguuuguuuuguggccuaucauauguuguauccuggagaauguuccauuugcacuugagaaaaaaauguauacucuacuguuguuggguggauguucuauacauucuguuagguccaguuggccuagagcauuguucaaacucuauugucucauuguucuauucauuauaaaaauguaguauugaagucuccagccauuauuuuagaaguaucuguuucuuccuucaguucuauaaauguuugcuucauauauuuuggaacucugguauuugaugcuuauaugcuuauaaucauuauaucuuccugaugaauugacccuuuuauuaauguccuuccaggcuggagugcaguggcacaaucuuggcucacugcaaccucugccucccagguucaagcaauucuccugccucagccuccugaguagcugggauuauaggcacguaccaccaugccuggcuaauuuuuguguuuuuaguagagacgggguuucauguuggucaggcuggucucuaacuccugaccucaggugauccgcucaccucaaccucccaaagugcugagauuacaggccugagccaccgcgccuggccuguaacaguuuuugacauaaaguuuauuuugucuuuuaggauacccaccccagcucucucuuggauauuauuuucaugagauaucuuuuuccauccuuucauuuucaacauauguaugucuugagagcuaaagugauuuucuuguagauagaauguaguuggaucauguuuucuuauccauucugacagucuguggcuuuugaguugaaucuauuuacacuuaaaauaauuacugauagggaaagacuuuugccacuuuguuaguuuccuguaugucuuacagcuuuuuugucccucuuccuccauuacugccuccuguugugcuuauuugauauuuuguaauggcacauuuugauucccuuuuucuauagauaguugcauuguggauaccauagagauugcauaggacaaccuaaaguuacaacaguugguuuugaugucaacuuaacauuaauugcauacaugaacucuuauauagcucuaccaccccacuccauuuuguaaaugucacaaguaauaucuuuauacauuauauguccauuaacauuuaaaauuauuuuuaugcauuuuuaaaaguaaaguuacaaaacaaaauuguaauaaugcugcuuuuuauauuuucccauguauuuaccauuaucagagaucuuuauaucaaguuacugucuagcuuccuuuuauuucaaccuaaaggauuuccuuuagcauuuuuuguaggucaggucuaaugguaaugaauucccuuggcuuauguuuaucuaggaaugucuuaauuccucuuuuuugcaggacaguuugccugaaucagaauuuucaguugacaguuuuuuaucuuuuagcacuucauauauauaauuucacugccuucuggccuucaagguuucugcugagaaaugagcagaucaucuuauuaucuccuauaugugaugagucuuuucuuuugcugcuuucgagauccucugucuuuugacuguuugguuauagugugucucagauagaucucuuuggguuuauccuacuuggaguuuauuuagcuucuuggauuuguagauucauaucuuuccccagauuauggcauuuuuuggccaagauuuuuucaaauauggggucucacuauguugcccaagcuggucuugaacuccuggguucaagaaacccuccugccuuagccucucaaguagcugagguuacaaauacugugccuguuggcuauuauuucuucaaauaaucucuguccuucucuucuccucuucuuuuugcugaacucauaagauguguauugguccauuugaugguuucccauaaauucauuagguucuauucacuuuucuucauucuuuuuucuuucuucugucugcccauaucugauacugaaccccucuggugaaguuuaauuuguuuuuuguauuuuucagccuucaaauuugagauggaguuuuugcucugucgcccaagcuggagugcaauggugccaucuuggcucacugcaaccucugccucuuggguuuaagugauucuccugccucagccucccaaguagcugggauuacaggugcccgccaccaugcccagcuaauuuuuguauuuuuaguagagaugagguuucgccaggcuggucucaaacucuugaccucaggugauccacccaccucagcuucccaaaaugcuaggauuacaggugugaaccaccgcaccuggcuuguuagguuacuuuucauaauuucucucuuugcugauauucucacugugguguucaccugucauuuccuauaguuccuggucuguguguguguguguguguguguuuuuaggucuuugagcauauuuaagacaguuguuuucaagucuuuguccagugccuguacaucuuuagggacaguuucuuuucuuccuuugaguguaccauauuuucuaguuucuuuguaugccuugugauuuuuguugaaaauuaggcauuuuaaaaaacagccaccucuccuagucuuugaaaacugucucucagccuuacaauuaacccaucaugaaaguuuaaaguuuucucaaacauuuucugagcaugucuugucugggucugcauauacauacucuucuuaauuccccuauauacacagcugcuuucagaugucuuaauuuccugaagugucuugucugagguuauccucagggccuuagaugaucuguuguuggucuccgcucauaaucucuugucuucaggcauccauauuggucaucccccugcagcuuuccugagcaguagucauugcuuuucuaccugggagcuaagugaaacagagaccaauccuucaggcagcccacagacuugucagaauguugcaaauaaggucugcucugcucccuccgguucaagggacacagcuggaaacugggccgcugccuccuccagaccaagauuguaccacacuggggaaguguggugcaagguugagugaaaauacccuuaaguuuccugcuguuuugaauguggcuuuucuugagugggcauucacuugguugcuguagacuuuugacuguuuuccagaguuccuguaagguuauuuuagccagucucucauuucauggagaaaugaggacuuggagcuuccuagucccccauauuacugauguuacuccggugcucaggcuuugauuuuaaagucauuaagacauuaagauacaguugcuucuuguauucagugggguuagguuugcaaguucaccccuuauagccacccugucucuugaauagcauggauacuaagagugccagggccugaagcaaggugaagaggcaucucugguuugucucuggcuggggcugcuugacuucauggggaguggggcuugaguaccacuugccuggcucugugccagguguuguacagucuuuuauuuucgcuuggggcacagcggugaaaugugaaacuuguagacccugccuugcagguggggucacagaaaggaagcaucuacagguguggaguucucacuggugacuuagaugagggcaugggccacaguuugcuggucuccaggagggaacgggggccccuggacguuccaugcacuugucacauugggccaaagagaagaaaucuaagcacgagggucuucacugaccuucagccagccagcugcuuacaugugaauagggagggcaggcccugagagcagaaagacagaacagccucuggaugacugaguggcugagcuaacggagccuuugccauggcugcccagagagagcuggcuuagggucuagcgugaccaagggagggcacaucaggagagcgccccgcccagggcacugcuguuugagcuggacaggcccauggggugugaacccaaggcccucccugcgcccccaccccuuccucucuauaccauggcagagacucguguagggcugacugcuuuucuuagacagcaguggggcugccaacagcagggccuucaccacagccagcggaugcugggccagcguuccccacuccucuuaccaaagcacgugaaucccauaugcugaaccaccagaacagcaggaacucuucugacuuuugcucagucccacagucuagcacuguucaccugacuuucuuggcacuuguccccagcaccgucaacacuuaccuagcauacacgcaccucugggcacugugcuagguauggugccauccuaggaaaaccuccagagguucgccugcuucucucaaguagagagcccauauggagagccggagugaguuguugugcacagggcaaggugcagaaauacuugguagagccaggccucugggugucacucugggagagccugaggugcugggccagguguaguaaggaagaugggagaagggugacugagugcacagaaaaaaggcaauggagucagcgacuuuagggagcuccacgcaagugccggagcuggugccguagagcugcgguggggggagagagaugcugggacgagagaacuuucugaccuggcauccccuggagggccugugagugcaagcaugggaacguucugggcgaggugcugcagccauggugaggcccuguggagcaagggcuaaggggaggagcugcgagugaguucugccagcuaccagagccuggcugugauggggugagcucugcuggccauuugggagcuggaaguucggcugugaguguagaagacacgucuugugaguggccaacagugggacgagacuucagugguuagcaagugguuagccuuucuucugugcacucagcuacccuucucccuuaccacaccuggcccaacaccuccucaggcccucccagagugacccccagagggcuggcucuacccccuccagcccuggcacuggggagaaaggcuaguguucaauacaacagccaccaucccuucacccggccccacacauguacuagggucccaucuagaagagcugcuccccccagcccacuccuaccucacuccaucugcgcucacccuguucucauccugccccacuguuugacuugacucccagcacaggcgcccuggcacagcagggaucuugcagcgauuccgguugcacauccacaggggcuucuaaagaaugcacucaggacuucuggccucauucccaccccauggaccuuaccucacccuuuucuccagcaccauugggccaaaaugagaccuuaucaaagaaagaacaggacgcuugccuuuuuccucagguucuuaauuauguuuuuaguuuuuugcgagucucucugaaauccugaagauguggaagaguuugacuaaaguacauaaauacucagagcucuuuuuuuuuuuaaacauccaggaucucaaggguguucagaaccuuuucaaaaaaauaauuuagccauagaugagaagcagccacuaggcccuuccuuguaaaguggccccuguguggggaugcuucaagccagguggaaggacggcuggacugugauaggagugagaaaagaacagaucuuuuucuuugagggaugugagcccccuuaguugucagacccagagaggcauugaaaugugacagcaguuacgucucacuccccacccugaccuaaguaaucgccugcucuguggacucuaggccaguagccuguaaacucuguauauuaauuuugccucaguuucuuuaggucaauacgaacaacagagcgguggcugacuacacauaauguuugggaucuuaccugaagagcuucugcaaggaggcuuccagauguuuaaaguuuggcuugaguugggguguccucagaccccacugacauggaguaguccucauucugagaacuugguaucuguuaugagacaugguuuggcugcgugagguggugauuggcuucucaccaugacaagccaccuuaggcugccaggagaagcucuuccugggggaggggcugccccuagguggaguggaaccagauguuggggucuccugaucacauuuucugcuuuacagacugaugaagagaagcagcagggcuuaccuguggugaugccaguguuugacagaaauaccugcagcauccccaaaucccaaaucucuuucauugauuacuucaucacagacauguuugaugcuugggaugguaagaaaucuuccuuaaaauagcauauuuuccucuaaauaauggggaaccgcguaugaaagagcagagugcauuugacuguagaauaugauuuggggccugggcuuucaagaacaagagcgaagugaaccaucaccgagggccccugagggcuagguguucuuucuuaacacuccccgcaggcauaggugucuuuaugccuguuuuauagaugacgggauugaacuuggggccccacagcuuguaguagagcagcuaggguucaaaaccaaucgugcuggcuccaaaacccaugguguuucuacagcagcccuuugcccuccacuguccccugcuucucccagccucacucuacacaagaccagaaggacuggucugucucugacugaugcaugucacccuccuuuaacuucagguggggcacaggagucugucaaauaaaagaauaucggagaacugauauuccacgugcaucuucguccugagggcugcaccuugaaggaggggcuacagggcugauaaauguccagauccagucaggaaauaaacccaugucucaagaaggccguagaacagggguaggcggcuggggagaaggacugaagcaguggagcuagauagcugcagcuuugggggacacugcauacucugcagcucacugcuucugggacugagaccagacgcguguguccccaggcugcacguucuucauguggugcaggugaaaggagaugcugguguaugugaagcaugcgugaagggacagugagcacacaagggccaggccaucgguuggggcgggggggcaggggcacacuacauacugcuuucugacaccccaggcccaaaggugcugcugguuuaaugguaauuaagcagauuagccaccuucuguuuuauuuaccacaguuaccagcucagcagguggucacagaggaggugcuggcauugaggacaggguuuaacuucagucagccacggcucguugaagcugcuggguguguuugcccgggucuguuuagccucacgcagaugccugcucccaucugucacucuuuaaaaugcucuuagugaaagccuaaaauguaaacagaggcugugaaagcauaucacauuccuaucuuucucuccagccuuuguagaccugccugauuuaaugcagcaucuugacaacaacuuuaaauacuggaaaggacuggacgaaaugaagcugcggaaccuccgaccaccuccugaauagugggagacaccacccagagcccugaagcuuuguuccuucggucauuuggaauuccugagggcagccagagcuccuugguccuuucaguacuaggcagaacagcccccgaucugcauagccugugaaagcccacggggacaucaguaaccuucugcagccaccauccaaugccauuacugucaagugagacuuggccacuguagccugggccugcugcaggagcucuucagaaaggcacaugaggaccacgguuugccucaguuucugguaaaacacaaggucuggagugccccugcaaaggguauugauggacuuccugccagugacagagcaugucuauugcaaacaauucucucaguuacguucagcacuuaagaacggcuaauggcaauaggaucuuuagcaacuuuuucacaucauagaaggugcaaucgcucacuugggaacacuacugagagugacuucucuuuuaaaauugaguagcagaugaaaaauuaaaauuugaacuugauuauuaauaucaauuaaaauguuuuauuuauuuuauuaaaagcucaauauuuucuaugaauucaaaaauacuucagagccaaagccaacuucaaauaccgugaccaaauuuacaugauucauauucauuaugcauuacuugguauacagacuuauuuucauaaugcaaauuaauaaaaugacacuuuuacugcacuauagaaauauucauguauguuaaacuuuucugauugaggcuaacuggaaaaagcuggggucguauucuaagugcuaaagaaggcugcuucuacuguauagaacccagggcucugaaacagcucuagccgccuaaugcacuucacagguaacuccccaagguaaaacuagacucucuuguugguucgcaaagaaaaguuaggacuuaacacuuuuuucuaaaauuuuauaauucaauuuccaaaagucuacucuauuuuauacuguuucuacaaaauauuccuuauaaaaacaaagaacaaaaauugaauauuuaaugaauugacauuuuauaaccaaccuguuuuuaucuacggugggaaucuuugaugccagaaauuuauaaagagguucuguaucuucacaccuugaauaagcauaauaccauaaaaaaugacacuugacaugucaauguauuugucauuucauuuuaaacucguauuugugguuuuuuucccagauaaaaaugaaauuaaaccauuucuuuuuaagaaauca

SEQ ID NO: 15247 - RNA, 814 nt, Homo sapiens
uggaagaacaugcuagagaggcucgccccccagcaaggcuaugugggggccuuuacaacaagcaccauugguggugguaucuuucaagcaauuaaguuuucacaauucuccaguaggaguaaaucacaaacuccaaaggaguuugacagcuauuaaaauccauguuccauaauugggagguagcuuugcauucagagaggucuguuucccaugauugacuguaguauggcucaagucagaggaaaagaagaucccuggaacucuauuacaaguggugccauaacgggagccauacuggcagcaagaaauggaccaguggcuauaguugggucagcugcgaugaguaacauucuucuagcuugaacugaaggagauauuaucuuguucacaaaauuugcuucugaauauuugcugaagaacucuucuaguugucuucaaccgaguuaccauccucacuuuuuggagacuauggacaauaucaguaggacuccuuucccagaauuucuuuaacauaaugaacuauaauucaagaagaauuccagaagaucuggcuaaagucuauuuuuaaaaccacagaugcgacagcuacggccaaauaggcuaugaagacacauuuagacacauuuaacacuuuuuuuucuauugaaagaaacaugguagagcaaagggguagcuacaugauaauauauuuauuuauuaacacuuggaguauauuucuuaucaaaauaaaagucuaauagcauuaaaagaaaauauaauaaaugcuuagaagaugaaggaccaaagggcaaauaacagugaaauguaaccauca

SEQ ID NO: 15248 - RNA, 7194 nt, Homo sapiens
cuuuuccgccggaaagagaguggauuuacuaggaaggugggacguuggagggguggccgcauggagugaguacugucucuggccaccgagcagagccagugacagcagcguccugguaggcaggcaggcguaucagguuucagaggaugcggcugggaacgggaguagaggugaggggucguugcaucugucgcgguguguaucuuuuggggguucagcgccaccagcgacuugggccucauucaucgcgcuuacauuucuccaccucauuugaagaacgagcuucguagcccacggagcugagguuaguauaaauguggaagggagaaguaugcacucaccagacuaaaguuuacaguuuucacauagguugugcuguucugugucccauaagggccugcgagaacccagacauucugaaucggugacgccugcuggaggcagcaacaccuguugcauuaauuuuagaacacacacacacggaguugguaauucuuaagcuuccugaaucugcuggcggucauuuggugucagaagcagagcaaagccaucuuggucaucucccuccuuuuagcuuaaaccgaagcaugaugggggagauaggccgaaaguuauacagcuuguuaauaacagagccgagagugaaagcgcgauuucuucauuuuuagcccggaauuauuuguuguacaccauacuguuucuuugcauugcuagacaauucgucuuuuuuuacgagguugacggggaguugcaaggaggagugaaaagggugguaauguacaucuacauacaguauaaauccaugaaaggcaaaauccguguguguuaggaguuagaacugugucagucaucuacaucuuccauaguuuguagauggagaugagucugucacgucgcucugucauuucccuuuuagcaacagauguguaguaacaauaugugaagaaggaacuuucauugccuguuacauacauuuacacagagcggccugggguucacugagcaagcuaugugcucacccuagaaaacugauucuguagagugcacugcagucaaaccucagcuguuuuaaguaaucuuacauuuggugcuuguguggcuuaagugucuugugcauuauugcagucaucucucucauguuaugaaauggaaauguguuguaggaaaguggcaagccugugaagaaaguaagugagccugaggcccagaaaaccauacauuagcaaauacugaaaaacuguucacaucacauaggggguaucugaaguacugaggagcucauuuaaccggauguucauuguggggaagccaugaauagccucccucuccuggguucaagcgauuuuccugccucagccucccgaguagcugugauuacagguccaugccaccaugcucggcuaauuuuuguauuuuuaguagagacaggggucucaccauguuggccaggcugaucucgaacuccugaccucaggugauccucccaccuuggccucccaaagugcugggauuacaggugugagccaccgugccuggcuccuauauaaacaauuuucaaacuuguuggucucaagagccacuuaacaguuauugaagacuccaaagagcuuuuguucauaugaaaauaguuuugacuucacuaacccccagaagggcuuucagaagcccccacagaaaccaacuuuuaagaacuacuuuaugcagauguuucaaagacauuuuagauuauguagaggaaugauugcuguugugauugugacauaagcagaaguaucaacuuaaaaaugcaacaacaagcacaguagcuuguauuuccaguagcuguauaauuccaggcacagagaacacaaacagauguccauuuuuaauucuuuucuuguuuuuuuugagacaggaccucacugucacccaggcuggagugcaguggugcaaucacagcucacuggcagccucgaccuccugagcucaagagcuccuccaccucagccuccugaguagcuggggccacaggugugugcuaccacccuggcuaauuaaaaaaaaaaauguuuuguagagacagugucucucuguguugcucagacuggucucaaacuccugagcucaagccauccucccaccuuggccuccugaaguguuggaauuacaggcgucagccacugugccuggccugugauauuuuucuaugcuuggaaaguuuauuaaucagcuaggauacuucucuacaaaaauacacauauauaacuugagauuuaaacuuuucucagccagcuguggugguucacaccuguaaucucagcacuuugggaggacaagguggguggaucacuugcgcucaggaguuugagaccagccuggggcaacagggcaaaaccccaucucuacaaaacugcacccagcuauuuuguauuauuuuuaucucguugcuuuuuuuuuuuuucuuuuucuuucuuucuuuuuuuuuuuuagugguuucaggcagugguucagaccagcugcuagagaaucaugggcuaagaagagaagacuaccaauuuaguagauuuggacauggacaagccacaggcaguuucucuucucacucucuuggccagucaucucuugcucaccuuccccugccaguagccaguagcaugugacagccucuauauuccaucucccuuuucucccucuuccagaacuaagaugaguuuucaauggauaacuguacagaaacauacccacugcugaguuuauaauaaauagguaaaugguguuuaaaaugccuucuguaggaauccuugguagauaguuauaugugguuguuuuuugggaaguuggcuugagguucuuugaagggcugggaacguguauuucuuuugcgugugccugugugugucaaaauuuuauauguucaucagugcucuacacguucagagaaacguuuccaauaacgaaccauagaaugaucccuggagcauaggaucccacuguuugaaaauucuagccaucgaucacuuuauaagaaaaggaugaaauuucaaacaaggaguuuguuuaucugauuuccacccuacagauaauauauaaauuuggccaaaguuguuuggggaagaggggcuguuguuagguacugagcuauaauacuuuguugcuuuguaucacuuuuaaaagugacuuuuaaagauacuugacauuugaaaaggaaucaccuuugaucuuucuaagucccuaauuugacauuaccuuuauagcauauaauuuauuccauaaagucuuagauccugaaacuaguggaaagccaaauacucauguugugcuauaaauauaggauugacaguuaagcuuacucaguagucaagggggcggcuuucacucaccagccuccagggcauaugaaccaaauuuaugauucagaacauuuaaaauauacauuuugaagaucuuugggcucucuuaaguauagucuaacuauaauaaauauuaaacaugucaaaggucucuugcaguguugggaagagcauucuaaaccacauacaucuuucccauccccagauuguucuguguccccucccacucuucccagauuagaagucaccauggagcacuauuaguaaugggacucuguaucagaucuuuaagguguauugggacagaagaaagguugauauuuugggguuguuuguuuuuuuugagacggaguuuucacucuuguugcccaggcuggagugcuauggcgugaucuuggcucacuacaaucuccgccucccugguucaagcaauucuccugccucagccuccugaguagcugggauuacaugcgcccaccaccaugcccggcuaauuuuuguauuuuuaguagagacgggguuucaucauguuggcuaggcuggucucgaacuccugaccucaggugaucugccugucuuggccucccaaaauguugggauuacaggugugagccaccaugcccagcagguucauauuuuuaauguuuccuucuacuccccaagcacacacaaauuugaaagcugcuuugcuuucuaauaaagaggcuuuuccuuugauuuuggaagauaauuugaugucucuuuucucuuugcagguauaugagcucccugaaagcacaaagcaguuauuuccaucuucagaucauucagagauuaugaaggcacaaacccugccuucaauuugcuuauagucaaguggagcagacacaagucaaugauugcaguauagccacugaaguaaucuaaaagaggugaguguggcacuuaaccucuccugggagggggaggaauaaggcaguguuuccaagaggugauuuuggagcuauacaggcauuagguagacaaggaaggggagguccauucugggugccuaggacucuguggcugauuuauaaaucguaaaugguacaaaaaacaguguugaguaucuuuuaccuuucuccagaguacuguucuuacuuuuggauagugcuucuuguuuuuuccuucccucucccugucccugucaccuuuaaauuaaaugaauguuuggaaggaaguaggaggguaagaaucuuucuggguggcagaauaauagaugggucuaccaagagcgauguauauacccaguaaagccaucucuaaaacuguguuucugcauuguuacagugcauaguugggaaaucucaguuuuguuggcuguguacuuucccagugaauggauuauauuccuuucugcgagccagucuguuugaauuuaagggcaucucuuaaauuccuuucaagcaagagaccuaacauuuauacuuaggaaugagaguaguagagacagcaagauuagaauccaaguucauauaccaaaacauuuuuauuugcuaugucugagugacuacauguuguuugaaucaacugcaggcuaauuuguaacauuucaaauaaaugauaguuuaauuccuccaggauuugaguaaggugaaaauagagcuaaaaaccaugauucugucacagucugggaaaaugaaaaagcaaucaauuagugaguugggcuuaauuuuuuuuuuuuuuuuuucuggaacuggugauagcagaaaacaagcaguaaaguagucagacaugauauacuugacaagaaccaccaccuguucaguagcaacucuaaaauaaguacuaacuuaggggcaguuguugugcccaggucauagucauacuccuuccaggagacuuccugaugacagaaaagaugcugaccagcuggggucuucuuuccaaauaacuuuucucuugcauuuagauuaauuaaccauugguuacagugaaacaagcauauguacagaguuaaucuccuauagcuugaaguuauacaugaucuuuauuugaguaucuugacuuguuaaaggacaguguuuuaaaagcuggauuugguuauguucuucuggagacuaagaaaauagaguccuugaaaucaagcugacucugcuuuuagccuccuaaaugaaaagguagauagaacaggucuuguuugcaaaauaaauucaagaccuacuuaucuaccaacagcaauuacacgcuuuccauugucuuccuauagaaaauaggaguaguacacuuauagaugagaaaacuggagaaagacauagugaacaugugagaaucuugcucuacuaauugauaggaaggugacuagaaauuggcgaaguuuucuugguaaguugaggagaggacuuuucuuauagugcagucugguagcugaaccgccuugcaucaagaccaauguagucuuauuuacagaaugccacaucacagugaauugugcuguggacagcuuccagugugugaguuguggaagaugaugauuuuaacagauuuuggaggaugagaaguauuaagaagaaggccccacuguccaugcauuugcucugcuuuuuacuuuugaccaaguauacacuucagaaauaucuuauuggauguauacaaagugauugugugucauuugaaccagcaggaaguaauuuauuaaacacacuuuucuaaauaaaagucauuuaauuuuaucagaaaucagugucauuuuagauugcaagucucaaaccaacuuuccaauucugacuuguaagggugccuuaaauccugaauacuguacucuguauuacuaaacccauguuaguuuacgccaagauucuguggugguuuuacauauucuuuuuccccuuuguuaagguggggaggccacagcuuaugugaaugacuuucucaggaguuauaaagugauacagguaaagcuaagaaaagaacagauuuugauaacuuuuguuuuaacuguccaguguuagggauuguggcuacaguggucuaauuuuuaaaaacucuuuuuuuugcuuuguuuuuuaacagacuuaucagcagguugcaggugaacauggccuugagguaaaucugucccuugcugaauacaguuucaguagauuguuuauaguaguuucaggaauugagauuuuuuacaaaaauacaaaaguuuugcuugguucuguucuagauguuuucuucuaaauaaaugagaaagauguuucaacaaaggcucuuuaugcugaauaauugugaugcuugaaguugcuaaucugcuuuaaguggauuuuaaaugucaggcaauucuagacaguuuuuucuuggucaaauaaaaauuuaauuaaaacuuuauacguguugaguuuuuaauccauuuauccguguucauacuaacguguaguauuccauaaagccuauuagaacccugaauucaaacuugccuucucugugauauccuguuucuuacuugguaguuucuauuucaguagcugagaacuuuuuuuuuuuuuuuuuuugagauggagucuugaucugugagccaucucggcucacugcaagcuccaccucccggguucacgccauucuccugccucagccucccgaguagcugggacuacaggcgcccgccaccagucccggcuaauuuuuuuguauuuuuaguagagacgggguuucaccguauuagccaggauggucucgaucuccugaccuugugauccauccaccuuggccccccaaagugcugggauuacaggcgugagccaccgcgcccggccgagaacauuuuuaaauauacaugauauguaucuuuuaauuguuuauaacuggaacuauuucugugcuuacaucugcugucccuuguuucagaguagacaguccagcu

SEQ ID NO: 15249 - RNA, 5211 nt, Homo sapiens
cguacauaauugacucauuaccuuuucugguuuuauuuucuuucuuuuuuuuugagauggagucucgcucugucacccaggcuggagugcaguggcacgaucucagugcacugcagccuccugucucccagguucaagugauucucuugccucagccuccgaaguagcugggauuagaggcgccugccaccaugccuggcuaauuuuuguauuuuuaguagagacaggguuucaccaaguuggccaggcuggucucaaacuccuggccucaggugauacacccgccucagccuccugaagugccaggauuacaggcgugaaccacugugccuggccagacucguuaccuuuucugaaccaaguuuuauaauuccucuuacugaggagaagauaaacuggaggugucagcccugucucucucagagugcccucccucagcauuucugugguucagugacccuccguggaggaaggggacccagaggguaggugagaaacagacuugggagauggugaguugcgccugcuuggaaguccugcuuccauucacauuauuguuucuaaacauguaaauuuggaguugagaaaaggauuauggugcuugaggcgugaggaggguaaacaggugcugaccuguuguacgcccucuacucuccgaccuugacauccuggcauuuugauuuguuugaaaaugcaccuguaaccuucccugucauuagucacacucuaguucauaaggugcuuuugggguggccagagaccccccauugaggucuugagguuucucugcuaaccuuguuuugaucaugguuaauccucccacuagaaacacauaggcuuuggaguaugcuccgucagugcaggguuuuagggggacaggucccauuuagauugguguucacucccccuugacccccuuuucuccccugcccugcccgaccuggagggccccugcaucccagcccucugucacacugucuuacuuucaugcuaaugccacauaaaagugucucgugucauuuuuucaucuuggugcugacgguugggcaccaggccaauugcugacuuugcacguucccacccgaggccuggcagaucugccugccagagggaucgauugcccuuucuugcauuuucaagaaaagagcugaguuucucacuuuggucucagucugauagccagcagcagugcggggggaguggaggaagagcaucacgcacaacucgcucccuuggaggcgugucgaccucccugagucgacaucucacaagcuugccucccaggguuggaggcggaaguuggugugguuuccagcagcagcaggggcugggaguucagaccccaaggcuuggugcagccugccucugggaaguguccucggugcccuucaugucaaggacugcugcugccuguucggggggacuucacuacagugcuuuuguguugcaugugggguccacgccugcuguccacucugcacacacauuuuggcccccagcauucaauggcagugugagagugccaagcccuugcaccccuguuccacacagguaacuguuuugaggggucagccuuggaaagggaaagaugcgguguagggauuugccauucagccuuggggaagaggcccacaggccaggccccuuccacgugcauucccaggggaaggucaccuugauuuauaauauucgaaaugucauugcuucccuuuucggcagccacuguaccaugagguugcuugauuuuucuacccugcuggcuuaaacccuugagaugaaacagaauaaugcaggacgugauuacagugguguaacagucauucuggagaaaagcagaucaauucaggggacacuuggcccuugcuugugauggauccuuaaagcaaaucugaaucuacuucuucacggccaugagaggaaaccagaagcccagagcaucuugaaggcaggcuuuauuacuuauuuggcucugcugguaagaugccucugguaaggcaucaugugcaaagcaggucccaugcaagcggugcaggcagccccaugauggagcugcaugggguuuguucauagccacaaagaaaaucuuauaaguggauuaguuuaggguuuauuuuaaaagaaaagagaagcauagcuguggugaucucuugcuuaaugacuaauguuaagcuggcgucccugcuuuccugugugguguguauugaagauugaugagcuggaagaacaaugcagugagaucaacagagagaaggagaagaacacgcagcugaagaggaggaucgaggagcuggaggcagagcuccgagaaaaggagacagugaguaauggugcuccgagcagggccccuuggcguccucuuggccuugcgggguggcacacagcaggugucuuggggccuaugacuggcccuggcagcugccuggauagcagcacggagagagagcugggagccacagcaaggugcagacaggcuggagcaaaggccuccccaugaccucugccgccucccuguuaccccuguucuauagcuggucgugcagauccacaagggagcugaacauuucacaagacacucagaugcguuugucaucuguccucagaaguugaguuuugcugccaaauuaaugccgcuagagacccaugauguaaccacuuauuuucuuuuuuaaaaaaauuuaaaauguauuuauuuuauuuaagauggagucucauuauguugcccaggcuggucuugaacugggcugaagcauuccgcccaccucagccuccuguguagcugggacuauagacacacgccaugagagcaccacacacacgugcccaccacaccgcagcccagcucccggcgccagccaccugcacucacugccaccaugccuggccuacagucauuuauuuucuagggggcagacaguuaagugcacacauguuggaggccgugcucauguuaccaaacucccuaggccucacuuucuccacuuauaaaacagaaaucggaaaaacaucugccuuguggugguguguacagacuucacgugacaaggcgugugacacacuucacccuugaaauucccugagaugaaguauucgcauggucacuaucacugucuaugcaaacaggacagggucccaaagcugcuuccacgagcgugcacacauuggugauuuucaagaauauauuuuaucugacuugcuuucauguucuaucucaaauuuuuuucauguaggagcugaaagaucuccgaaaacaaagugaaaucauaccucagcucaugucagagugcgaauaugucucugagaagcuagagguacguggguugggggcacagccauccuggcucagacaagaaggcacaaaugucaugguacucauuuuccugcuuccuaucacuuucacacugagaaugcugaaggagagauuuucuauucacaaaaagcuggcagugacugcacgccagauggcaccgcauccaccccugcccccggggcagacucagcaacguuugucuuuugguuuugcaaguucuaugaaggccccugugcaucaccacaguguagacgacuguuuccuugcagaucccuggugggggugaggagcgggggggcggccugagagcccagggucaggguguggggccacuucagccacuccccugccaguggccuugggcacugaccuugggcaggccuuccucccuauccucagauuucugaucacuaaaaugaggauuuucagggcuuccuccaccucggagcgccucuucccugcagguccucugauaugcacacggcgcuucauguaguuacaugacccuggaauugguaacugcuuccugugcacauguucagaaaggucucuguuuauucccucaacauaaagcucuuauuugauaugaagaguuaaaggcuuauggcucauuuaaggacucacagcuguccugucuuugggaaccugcuugugauuuaccuagaugugccucuguaggcuuguggggcccagcgccacagaacaucuccaugguaacagcaucagagggugcacagacuggcugucccugagucauuggcauggccaguccuuccucucugagggccagaggcuggccuggggcugaggaggccacgccucucugugggaccaggggaacgagccacucucccaucuguucugucucucaggauggaacugaaauguggucucugcuagccacucagacagggauuucagacuuucccugcugggcccugugugaggucucccucaggcaggacucugcguucugccugcuuuguugggucuuggguuuucaggcuggguguuggucccucugugggagagcaggcaggaaaggaggaggucacugaagugccugcugcuucccuucugaugucuuggucacaggcuugugugcugggguagcaugucucuaggcagcuuaagcccuggcccaggcccucagauuggauggagaaugguugguucagcuguagcagguuuugaaggaugacucucgucacucaguuuucuagacccuucucccuuuugcuuggccaggcggcagagagagacaaucaaaaccuggaagacaaagugcguuccuuaaagacagacauugaggagagcaaauaccgacagcgccaccugaagguggaguugaagagcuuccuggaggugcuggacgggaagauugacgaccugcaugacuuccgccgagggcucuccaagcugggcaccgauaacuagggcuggccgaggcccaggccccgcccgugagucccaagcgugugugcgagaccagauagcucuaggacguucuucugugugcauugcuucuguaaaugcaggcgcaguuugucguguuuccaaaccaguugugccguccacucacuccuuuucagaauagaaaucuccucucgcuucucuggccuugugagguuguggacaacuggaagauucugacucaggaauccagaacuaggucuaccuucaacauuuaugcagucagggcagggauguuuauaucuuucauaagggcuguugcaaccauaugaacugaaaaaacacgcauuuuguaauccaaauauugauauucuuuacaccaagccaucaggcuccuuuuaucaaauagcauucagaguauuugaauguccaccagacaccagccccggggggcacagagagaacaacauuccucucugucaacaucgaga

SEQ ID NO: 15250 - RNA, 7306 nt, Homo sapiens
agagcccucugcgcuugcgcagguagccggcaggagcggccccaccgcccggcgcauccgcucuggccagagggcgacaccuuaaggccggcgggagcgagucucguggccgcagaacaugcgcgagucucuuuuguucuggaacgggccgagccccaggaaguggagcugcggagcugaggccucaccgugucuuggcccacccugcucagcugauaggaaggugugucaccucuuuccuaaucggggaaagaaagguauugucacuucucagaauuggagagcgcggcaaggagugcacagggccaggugucuucucgcucccacagccaagcagcagaugcagagucccacgcgcugccuguggccaucaagucgauauagagccucguggcggcuuggcccuugugaaucuuccacguaucgauggcgcaccuaccuugugccaggcgcagcggaucccacaauguaaaagaagaggaaauacacugcgacaugugauauggagagacaugaaacaaaucagcagaggcaagaucauggagucacugaaggcuuucaagcaagggauuauuagcagcccaauuugcuggguuuuagaaagacaccggcugcacuguggccgacagaggaaaagccagagacagggagauccgcccccuaaaugggagaggguggccugaacuagaguaaccgcagggaggguggagcgcugaucauuucaaggaucuucaggaacugaaaugaucagaacuugggaaugacugcaugugcgaauaagggggaaaagucaaggaaaugcccagguuuggggcccaaggaacagguuugggaggccgaggugaggaguucagcuuuggacauaaugaguuugagaugcccacaggacauccaaauacaaauguuaaagggguaacugaauauaugugacuggaguuugcgaaaucaaggcuggugauagagauucuggaaucuucugaaagcagauggcaauugaagcuauggaaauggaugagagaguguguaaagagcacgagggcccagguuagaacagcaagggcagguagagaagucaccaaaggacacugaccagguaggaguacgguguaacggcagcuaaagaagggcgcuucaagagggaacaucaacagugaugaacacucuggagagaacaugucacauguaacgacugagaaguggccacaagauuuagaaaucaggguggugguggugacccgggcuacagcaguuuuaguggagagaaggaaauggagauaauuguagagaauaauccagugacuucacugugaaggagcaauugguaucuggaggggcacaugacauucagagacuuauuuuuaucauauuugaagauugguaggaaagagccaggagaagagagguuacagcagaggacgguuccugaagagguaggaucugagcucaaguagagauugaguucucuacaggaggccuuagacacuccuuccuuccuaagggaaagcuuagguggacauguagcuguguuuguagguuuggugaugggagguggaauuucuuucauuaacuaaggcgggggagguguugaagguauauugggacucuugagaauggcaaagggcugacuauugcaacucacccagcgguagacaguuaagggagaccgugaaaucaucuaugaucccaaucuauaguuaccuuauuuuauuuuuguuuauuuuugagacagggggaugggaagagccugucgcccaggcuggagugcaguggcgggaucucggcucacugcaaccuccgccuccuagguucaagcaauucucccugccucagccuccagaguagcugggacuacaggcgcgcgccaccacacccauuuuuuguauuuuuaguagagacgggcguuucgccauuucgcccaggcuggucucgaacuccugagcucaggcaauccacccacuucggccucccaaagugcuaggauuacaggcgugagcuagcgccuggccuauaguuacguuacuuuagaugccuggauucaccagcuaagaaguuuuuuuuuuaauuaaauuuuuuuuuggccccagugcuacuaccaaagcagucaggaaguugaagauaaggcagacaacuggauugauucagguauauuuaaguggguugaggguuauugaugaaaugguuaaaguuauuaaagaccaaagguggagagggguugagggagaccaaaaguagagucuaacuggguaaagaaggaaguaaagaagaaaagaacagagaggacaaggggcugcagucuuagguucaauaacggguguaacuggaaugugagugagagcuggaagaaacaccaaagguuguggccagagagugggaugucugaauuuccuauuucagauguagagcaauuccacaucaugauaggguauaugguguggccaugauaaggaauggugaagguugcuggagguaaagaagaaacuggaaaccuagguguagcuggguuguccacauggccacugaggccaugcaguauaaaggcuugagcagaagaaagugagccagguguuaaaccaaaaccauauuucccuucuuugaaaucaguuaagaauugaggcacaaaagcugaaccagcauuauauagcagucauuuguagaaucugcuuugggugaagucacgucagccucaauuagagguuuggcaguugucauggaaauaaaggggacgucugugaaggugaguuacgauggcaucuggcuagaugggugaggagagcuaagaggugcucugcugugaaccauucagccuuucccacacgugacucaggaguaggggauaugaggacuucauugcaccaguggggaggagaaaagccauccgccccaugugccaccaaacugugcaccugacuuguugcuccugcccacaucccugccuccugaagggagagagaggcagagugggaagacauauugccuaauggugagggaaaacacagggacugauucaaauggcaggaaaccccuuguaaauguuuguggugguucacauuuuauugagacaggaucucgccauguugcucaggcuggucucaagcucuuggauucaagcaaugcuccugccucagcuuccucaguagcugcgcaacuacaggccucauuuuaucuuguuuuaaauagagucccacuuaaaaacucgcaauggagaaacaggaaaagggauuuuuaaaagcauauaaacuagguguaugugaauaaauacacaguguagcucuggggcugguuguuggggcugggauugcgaugguaccauccuucuugugaaggauguguuuuuucuaauugggggauaauuccaggucucgaaucuggaugacuagaacaggaaguagaaagugguuugaagaagcacuaaaaagugggacaauguuucaaacacauugcgcauaucacauugaagaccuugcucucuuuaaugucuuacaaguuuauucccagguuaaaaauaauuuaaaaaaaaaacuaguuacuacuaucaauacucugauaaugcaaguaaucucgauuuguuggguagauacuggaauaucacacuuucuuaaaauaguauauuuuacaguaaauauagauuagucaaguaucuuucugggucucaaugcaaaguuugagaauagugacauguuauuuuuggacccagcaaaauauuuucucaacucuguaaauggguuuaaauuccaccucccaccacuuaauaaacuuuuuuuuuccugccccgacaggaucuugcuuuaucgcccaggcuggaguacaguggugcaaucauaacucacuguaaucuuggaccccugggcucaagcaauccuccccucaaccucccaagcagcuacaacuauaggcacgugccaccacaacccagcuaauuuucuuauuuuucagagacagggucuauguugcccaggcuggucuugaacuccuggccucaagugauccuucugucucagccucucaaagugcugggauuacaggugugagccaccgugcccagccuagcugaccuuuuaauuucuuugccugugaaauggguacuucccucauacugaugcugugagaaacaaguaagaauguaguaaaguacucauugcagagccuaguagucacuuggguaguuauuaauaaacagcuguaagaugauagucacacucuuaacaguaaauaagauuauuuauuggauucucccacauucaaccuccaccuccugauuagaacaggagaaaaaccugaggccacaagaaaugaucaagaaacaaaaggcugcggcaguuaucacugcaguuccuaugaacugguuuaaaucagcaaugagguauuuguauuuuguauugcauuacucccauuaaguuaaaccucaauuaacuagaaccuuuguuccaaaaugguguugacagccaggcgugguggcucacgccuguaaucaaucccagcacucugggaggccaaggcagcugaggucaggaguucgagaccagccuggccaacauagugaaaccccaucucuacuaaaaauacaaaaauuagcugggcgugguggugggcaccuguaaucccagcuacucuggaggcugaggccgcauaauagcuugaauccaggagguggaggaugcagugagccgagauugcaccacugcccuccagccuuggcaacagagcgaggcuucaucucaaaaaacaaacaaaaaacaaaucaaaauucuguuuauauucacuuuuagaagaaaaaggcaaaugacauaaaagaguuuuuuuuauauauauauauauuuauuuauuuuuaaaaacuccaggggaugucccaaaguuaguaaacaguucuguuucuugucccuuuuauggcugcaugcaguuucaauuguucaguacaacagaugaggcauuuaaaaggucuccaacgucaagaaacacuaacucaucucuggcauaucauauuuuuuaaggcagaaguauuuucuguaaugguuacuacagaguguuuacugguuaauuuuuaguuaaccagaaccacacaucccauagauaauuccauuuaacugagguuuauauccguaagagcauuaccauagaaaaauuucccuuuagcaauuucaagagaccucagccaccaauauaccuaccuucuuuacaauauaaagugaaauauuacuuuagaugaaaauuuuuuguaucuuacuuagaaaaaauuaaguugauauuuaaaagaauuuugauuuuuaaucaccuuccacaacgauuugauauaccuuaaacuccacuuucauuuuuuauaagagaaucacuuucaagggaaaaaaauggauguuacuauauuuuaaaaucugcuuuauaaaaaaguguauaaauaucaaucugccagauauacuuccuauccccaacacagcuguaacacugacuaauggggucaugaccaugaagcaaauuuuacuuccuaaauagaaauguguagguggcagaaagcguauuuuucagcaggagugauucuguuggaucucuuuacaaugucagagcaguuguuagaaauguuaguauuuuauucgguuucuugcugugaaggauuaucacaauguugaagugauggcuguucacccagucgucaucaccgucaucaucucaaucuugggaaucaucagcagugucccccacacagagagacagguauaguggugcaguuuagugacagggaauccagucuuagauccuguuuauaucacauuuuugugaauuuacacaaaauuccauuuauagcuuuaaaacuguacuacauaacacauuacuauacuacuacaaaauauccuucucuauaaaugcacugaauauuuucuugggcauuuuauuaggccuuuuuuagcauuauuacaaaugcuaacaacaagauacuucaaaccaccaaauauaaagucagcuucuuaauuuucugaaauuuaguuauuugaguuaauaagaauucuguaggaauacugacccaucucuuuucauccaaccuucaaaauaguuaagccuauuugcccaucucaccuaaccuucaaaauaguuaaaacaaaaacaaacccaaacuagcuauauauaacaagaaucuuucaauucccaaacuauugaaagacccuaagucagccaaucuaugaaauuauacaagaugaaggugaaaaagcugugcuuuuuuuuaaaccauuaaacccaguucuuuucucuuaaaguuguaagaaaauggaaaaucuguuuuuaaaucaugcaaagauuuaaauaagcauuuuucuaucugcucuaagaaacuguuucuuaucuuacaauuuuaaauauucauaacacucaaacuacuuuuuuguggccauuuauguuuuugacacuagauuguaugguauuauuuagccaagauguauuauaaugcuaaauuauguauaaaauaugauuucuggaauuuguccaucuucuauugaagugccauuauuauugccaggggaacuaaaaaagaaaaaaacagucuugcuugcagcaggugucucaugcacuacuuucuucaauccuuuugugccauagugggaaucuggacccuaaaugagaacaaaagguuccuuaguaauuuucauuuaauaagcacucaguuuaaugugguguuuuaauuagauuaauguuccauuauauuucacuaucauuccuauauaaaauuuuaugcugucauuuagagaaaaaugaaguuuuuaccaaaaaacuaauuaaugaauaaaaauacugaauguacagcccagcuauuagagaauagugaaaagauuuuacaaaaauaacuuuuauuuucugccaaacauucaacugcuuacugaaacaaagggcuacuucuuaagaagagcuauuucuuucagaacagagcuguggggagaaguacuucuuuucggaaggcaguggaauauuuuagcucccagcuucuuuuccccccucuuuauaaauggcucagcugucagugacucucagcuucuaaaacacacauucugcaacauucaagaggaaaccaucuggaacauagugcaugacucuuacuuugaguguugcacaugcuguguagcacacauugggcaggaucucuauggguuccuugaacaugacccugaauguguuagcugucccaucacaacuaaagccgguaucauucugucccaggguuugcuuuuucucauauucaaugaucuguaauuuuuaagagacaaguuacauuuaaguuaaaccaaauaaagcaaacuauagaaaauaauauaaagcccuuagcaau

SEQ ID NO: 15251 - RNA, 1228 nt, Homo sapiens
aguuugcuuacaaccucaaaucuuacucccaguacacauuccaauaaauuuauucuguaaaaacaauacauuuuuuuguuuuugauuuuuuuacaguaaacuuuucaacuacaaaccgugaauacgcgaaagauguuccaaggacaagcauuaacaggauugauaaaacccaaacugacuaaauguguucucacaauauaagcuggcauaaaaauaaauaaaauucucuauuaucacaauagcaacaauaauguacacauaauaaugguuuaaggaugaauauuaacuauucuaauuguaguuccaaaagaaaacaguuuauuuuaaaagucuacauuuaaaagucaaugcuuugucugguuucccauagggcuguugcugauuccagcuuuaaaauguaaaguauccaccuugagugcuuagcucaaaauuguauuggcacugggaaaaaaauaaaucauugccuuuauuuuggaguaacacaaaaagacucacuaacuucacauauagaaacuuaguuuguguacauaacaauaugaauuuugagaaguauaagcugucaacuagcuauuucuaauacggaauagauauuuuacaauaugguuaaacuuuacacauggccucaaaacugaaggacaauuuuaauuucgucuucaauauaccaacguuauguauuuaggaauuaauuccuggguucugucacagagaggaaauuccauucuuaagcauuauguugaguggucaucuaaaaaauguuaauuuauauuuaacugaguguuugaugaugguggggucaaggcaggaaaacgaugaucauaacugccuugauaaaaggauccuagacauguauaagucugcgcaaaaaucuugauaauccuuagugguuaagggcaacuucaugcaaccaaauaacaugaaauuaaaucaguaacuuuuaaaaaaggcuaaaaugucuuuuccccccgaaacacaacagagaggaauaugaauaauguacauacaaacugggguucugucaaugacaacaaggacuauguguugguucauaucaaauccaagaauauuagacaaccaaacauauaaccuucuugugguuucucuuaauaugcagcauucauuaugguaguuaggucuguaaaaaaaaaaaaaagaaagaaaacaagccuuuagaugauuuaggauacuaacaaugagagcuauccacaccuagauaguacauaauuggguu

SEQ ID NO: 15252 - RNA, 2796 nt, Homo sapiens
ugaaauaucagcuguuucacaaauucugagguaaaagaaaaaaaaaaaaagaaggggucgacccccacagguggaaacagcaaguccuaacguccugggcugaagccuggggugcgggcggcagagaguggcguguaggguacccgccgagugccgccgccgauuuccacaggcuggcccgccggcaccuccgacgcgcccgcagauccggcgcggagaccguuugccagcuccgggacgucgggcagggacgggucccagagccccaacccccccgccgccgccucccggccggagaccacggucccucccgccgcgccucggggccgcgcugccgcgcagguagccagcuggcccucgggagguggcccucggguacccacgggagccggagcccagcggcgucccgggccgccugcuccgcgcacagagaauccccgcgcccgcggagggcgccgcgcuuaccucggccauccugcgaccgcugcggugccggggcugccggcgcgucucccgggcccgggccgccccgcguccgccccggcucggcgggcgccgccgcauccacgcuccggccgucggggcgcgacccggcgaagugggcggcuccccaagcgcccaggcugcgcagcacgauggccgcccccgccgcgcaccgcgugugcccgcacgcccgcccccugcgccccggggacgccucuccgccccucccccugccccuccgcccaccgcgcggucgccccacgccgcgggcgcugcuucgccgcccgggaggccgccucccgccccgggaccggauaacgcccuaaaucagcgcagcugaggcgaggccguggcccccgcagaccgcggagaccucgccggcggccggcgcggaggugucugcccccgccgggcuugaaggcacuuguugguaaaagacacagacgugucgguguuugccucucccggggaagggcgaaacgcucugaaguucucuggcgcucuucucaggagaugauucggccuccccuccuacccuggggcgcccucggggucucacugccgcggaggaagaaggcagcgccgcccucgccugcagaaaccucauucccgagaaagugcgggacgagcgucuugggauguggaagaagggggucgccaggagguuuucuuaagaacucaaaacaagcgccccccaccgcacacgcacacacacacacacacacacacacaccccuucccuuggguggucugaagagucaaagucccagcuugaccacuuucccaggacaaauggcuuugcucucugggccucaguggcuucaguuguaaaaugggauuaaguuuuucgcgucuuauuggaugcuagggacggaaugaaaugaagugcccuggagaagccaacuggaggugguggccccgagaguagacgcggaggggcugaggccgcaggauccuggagcccaggagcugacggagaucgcccacagcugcugcagcagcgcccggguuucugcugccccggggcagggcaagccucucccaaccucuucagcuccuuaaaaggagucuguaaaggcuagacugggggggcggcggggguccugcuuccucuucccucaguuucuuccaccugccuugcugcugguggggauccuugaaaaggaaacaaagcucuuccuucccucucugagaggaaaaggaagaugaagugaguugcccucagccacccagagugugccugguuguggcuauggaaggcacaggcagguggaaggcuucugaagggaagagaagggaaaggagggaacaagguguacgaggaagaaugugugggugucugggcguccuggcguccugggguccagcggguccuucugccucuccugggguggacacacaggugaguguccugggccugauguguggcgccuuuccuuguaggcuugaagucuccuggccucacgugauggaccuugccgugggaggagauucuuuuuuuuuuuuuucacguggcuaacuucuugauguagcuuugcuagauucauuccgcaucuaaacugcuuaccucucauuccuccgugcccccguauugaggccuuucuucuaacaccuccuucucuguuuguuguaacacagugcaucuuugaaggacuuucuggaaugucaccacaucucagaaaccuucccugauccaccaagccuccacucgaugugcuuuugcccuguugugacccccaggcacuuuuuucugccucuuucaucgugccaguagcauuguguagccuaguugugaugugugcuugucuuaauuccuuuggugguuacucaucuuaguggcuucugugcuaugagauacgguagcagauaaaccucugguuuugcagucauagugacccagggauagcucauuccuagcaacuggaaacuggcugaggaagucagccuucuuggccccucuuuucuucucuauaaaagcagauaugaaagccugucucaggccagauugguaggacuaaauaaaauagucucuguucugcaaacccucucccccuuuccuuucugcugcaucuaaaaccaauuucuggauuaacuuaaauuuguuaccuacaauaauauuguaaccaagagagauccuugaugacaauauuacugaaugccaccuaugccuauuauaaauacaccacaaugucuaugucccaggcgguggcccacuucaauaacuuuaaucuguccaauugaaaguuuuggucauuaucuuuauauuaauugcaacuaaauuauauguguuuuaguaaaacuuucugcuagcaa

SEQ ID NO: 15253 - RNA, 329 nt, Homo sapiens
ggccacauccuccuuccugcccgucacaacaaagacaggcuccuccccgcgaacuggggucuugauguaaguauuggucuucgcccgcagcgcuuugauuuuacaaccuacgaaccagggugcggaggagggagugggagagagagacagacacgcccauuauccugggguaaccgcggggaccggggacagcccgcguccaggacagcgagacggcaggacaagagaugggcggaaagggggcgucucccucacugaccucgggccgcgccacgggcugggcagcggaucccacccgcgaggcgcucgaggaacagcccauuggcugc

SEQ ID NO: 15254 - RNA, 2340 nt, Homo sapiens
gaccacuggcuguggaggugacaguccucuggccagaaagaugagcggugccgcauucauguccuccagcuacgagcagcuuccuuuucuacuucuccaccccucugaaacgugucuuucugcagcaacaaaauaccagcuaacggacaccuuuuccccuaauuacuguuccauguuuuauuucuuuagguagaauagcucucaguggagguaggggaggggaugauuuugcaccccuccauuuuggcaaucucuggagacauuuuugcuuaugacaaaaauguguaauuguacugacauuuaguggguagaggcuagggauaccgcuaaacauccuacauugcacaggacagcccccacacacggaauuauccagcucagggaugagaagcccugauguagacgaagcaaauauaucuucucuucccuucauucauugccuugaaguugguggacuucuuccagcauuuacgugccuaaaggcguucuaggauuacccacgacccaguguagcucuauaucaggaacauugugggcaaggucaaggcugaugucugagcauaggaggucacaacaaagggacucuuuuuauucaccagagugguagauuguacccaaugaaugauaauaaugauuacauggaauguucaaagcacucucauuuccauucucuccugugagccuuucugcaaccaugaggcaggcagcccugagauuuuacugugccuauuugcaguaaaacaaauauuacucaaaacacagucccagcccccuuacccagaaucaaaccuccguuuccagaucuagccggccucuuucuguuuuguucgguucccuguaacuaugagauaaaauguacggagaaauuuccaaaugggucugugcuagcaucucuuccccuuucccuauuucauggguacuccuuauacuaccaaaaugggcucuugggaaaaguucugauaucuucagugaauuacagucacuaagugaugcagagcucuuaucucuuaagucuuaucuuucuaagaaauaugaacaaauuuggccgggcgagguggcucacgccuguaaucccagcacuuugggaggccgaggcgggcggaucacgaggucaggagauugagaccauccuggcuaacacggugaaaccccgucucuacuaaaaauacaaaaaauuaacugggcgugguggcgggcgccuguagucccagcuacucgggaggcugaggcaggauaauggcgugaacucgagaggcagagcuugcagugagccgggaucgcgccacuggacuccagccugggggacggagcaagacucugucucaaacaaacaaacaaaauaugaacaaagucuucucucaaguggguuuugagccugcuggccaaugcaauggcugggaguaguaguccagacgcuuuguuggagcaagguaacucgggaaggaagggaauuugcauugggcacauucacucuuuuucgccauaaaagaguaauucccucccuggcuagggaacaagggcccuucuaacacucaacacugccuccccuuuggcuuccucccuucccugaccuagucaaaccugaccuugcccacaagcgaugcuuaaagugcuaaaggaucucuuccccaaguguuaagaccaaccagcuuuccaggaagggagagugggaagaguuaagcaucacuuacauuggcucagggaaggucagugauaauuucuauaguuuacugagccucucauucugacccaggcacucuacauugguccaacccuaugggguaggucugaguaaacccauuucagagacaaggaaacuuagguagaaguuaaauuaccuaccuaaggccacacagucaguaaguguuggacuuaggacuccaaccuugggucuaccuaaauccaauguuucuaucuuuaccacuucagaaaaaaauggcuuuuauaggagguauuuugagaaaaagcaagcacucauuugucauaaaauagucaacuaagagaaugauguuccuuuuaguaauacguguaacugacuugaaaaauagagcccggcggaguugccguggugcggccaggccacgugaggagaaccgagaacaugaauagcaccuuaugggcacagggcauuucuuugacauuaauucuaaauaaagccuugacugucuugugaacaaucaaauauuauucuguaauguauucuuuucagguggacaaagaaaaauuaccauuggaugagaagaaaaugaauacagaauucucuguuuuaaaaaaagcucaauaaaaaugucacaugaaguaauuuagacagugacuaaaagaugccagaacccugacuga

SEQ ID NO: 15255 - RNA, 2340 nt, Homo sapiens
ucagucaggguucuggcaucuuuuagucacugucuaaauuacuucaugugacauuuuuauugagcuuuuuuuaaaacagagaauucuguauucauuuucuucucauccaaugguaauuuuucuuuguccaccugaaaagaauacauuacagaauaauauuugauuguucacaagacagucaaggcuuuauuuagaauuaaugucaaagaaaugcccugugcccauaaggugcuauucauguucucgguucuccucacguggccuggccgcaccacggcaacuccgccgggcucuauuuuucaagucaguuacacguauuacuaaaaggaacaucauucucuuaguugacuauuuuaugacaaaugagugcuugcuuuuucucaaaauaccuccuauaaaagccauuuuuuucugaagugguaaagauagaaacauuggauuuagguagacccaagguuggaguccuaaguccaacacuuacugacuguguggccuuagguagguaauuuaacuucuaccuaaguuuccuugucucugaaauggguuuacucagaccuaccccauaggguuggaccaauguagagugccugggucagaaugagaggcucaguaaacuauagaaauuaucacugaccuucccugagccaauguaagugaugcuuaacucuucccacucucccuuccuggaaagcugguuggucuuaacacuuggggaagagauccuuuagcacuuuaagcaucgcuugugggcaaggucagguuugacuaggucagggaagggaggaagccaaaggggaggcaguguugaguguuagaagggcccuuguucccuagccagggagggaauuacucuuuuauggcgaaaaagagugaaugugcccaaugcaaauucccuuccuucccgaguuaccuugcuccaacaaagcgucuggacuacuacucccagccauugcauuggccagcaggcucaaaacccacuugagagaagacuuuguucauauuuuguuuguuuguuugagacagagucuugcuccgucccccaggcuggaguccaguggcgcgaucccggcucacugcaagcucugccucucgaguucacgccauuauccugccucagccucccgaguagcugggacuacaggcgcccgccaccacgcccaguuaauuuuuuguauuuuuaguagagacgggguuucaccguguuagccaggauggucucaaucuccugaccucgugauccgcccgccucggccucccaaagugcugggauuacaggcgugagccaccucgcccggccaaauuuguucauauuucuuagaaagauaagacuuaagagauaagagcucugcaucacuuagugacuguaauucacugaagauaucagaacuuuucccaagagcccauuuugguaguauaaggaguacccaugaaauagggaaaggggaagagaugcuagcacagacccauuuggaaauuucuccguacauuuuaucucauaguuacagggaaccgaacaaaacagaaagaggccggcuagaucuggaaacggagguuugauucuggguaagggggcugggacuguguuuugaguaauauuuguuuuacugcaaauaggcacaguaaaaucucagggcugccugccucaugguugcagaaaggcucacaggagagaauggaaaugagagugcuuugaacauuccauguaaucauuauuaucauucauuggguacaaucuaccacucuggugaauaaaaagagucccuuuguugugaccuccuaugcucagacaucagccuugaccuugcccacaauguuccugauauagagcuacacugggucguggguaauccuagaacgccuuuaggcacguaaaugcuggaagaaguccaccaacuucaaggcaaugaaugaagggaagagaagauauauuugcuucgucuacaucagggcuucucaucccugagcuggauaauuccgugugugggggcuguccugugcaauguaggauguuuagcgguaucccuagccucuacccacuaaaugucaguacaauuacacauuuuugucauaagcaaaaaugucuccagagauugccaaaauggaggggugcaaaaucauccccuccccuaccuccacugagagcuauucuaccuaaagaaauaaaacauggaacaguaauuaggggaaaagguguccguuagcugguauuuuguugcugcagaaagacacguuucagagggguggagaaguagaaaaggaagcugcucguagcuggaggacaugaaugcggcaccgcucaucuuucuggccagaggacugucaccuccacagccagugguc

SEQ ID NO: 15256 - RNA, 25009 nt, Homo sapiens
uucacuccugccuguuggcagcucagucagguaauagcaccuggaguucacccaccugggugucccccacuucugcuaaucuccuccucuugaauccuucuugcuguucagcuuggaaacuagaauuuaggaagaaaagucacuguaugauguaaugcacagcuuuggccuuguuucugcacuguagugacccaaacauccccgauaaaacacccacugcuuaagaggcaggcucggauggacuauagcuuugauaccacagccgaagacccuuggguuaggauuucugacugcaucaaaaacuuauuuagccccaucaugagugagaaccauggccacaugccucuacagcccaaugccagccugaaugaagaagaagggacacagggccacccagaugggaccccaccaaagcuggacaccgccaauggcacucccaaaguuuacaagucagcagacagcagcacugugaagaaagguccuccuguggcucccaagccagccugguuucgccaaagcuugaaagguuugaggaaucgugcuucagacccaagagggcucccugauccugccuuguccacccagccagcaccugcuuccagggagcaccuaggaucacacauccgggccuccuccuccuccuccuccaucaggcagagaaucagcuccuuugaaaccuuuggcuccucucaacugccugacaaaggagcccagagacugagccuccagcccuccucuggggaggcagcaaaaccucuugggaagcaugaggaaggacgguuuucuggacucuuggggcgaggggcugcacccacucuugugccccagcagccugagcaaguacuguccucgggguccccugcagccuccgaggccagagacccaggugugucugaguccccucccccagggcggcagcccaaucagaaaacucuccccccuggcccggacccgcuccuaaggcugcugucaacacaggcugaggaaucucaaggcccagugcucaagaugccuagccagcgagcacggagcuucccccugaccaggucccaguccugugagacgaagcuacuugacgaaaagaccagcaaacucuauucuaucagcagccaagugucaucggcugucaugaaauccuugcugugccuuccaucuucuaucuccugugcccagacucccugcauccccaaggaaggggcaucuccaacaucaucauccaacgaagacucagcugcaaaugguucugcugaaacaucugccuuggacacaggguucucgcucaagugaguuucuacacccgguguuucucuuuaccuuucucaucuuuuucuuucucaucuuuauuuuuaaaaauaauccuauauauaauuuaaaaaauucccagauauauugauuaaagaauuguucugccucuuucuuuccaugugugugcagaugucugagugugugugugucugucuguagguauuacaccucugccuuucacauuaaggaggaguuuucacaacaucuggcuucaggagggcugggagguaggaggugggacuggcucccuggugaauugcucaugagggcugacauacgccuguggagauuuggaagguugaugcacaucugaaauguccugcgguuacucagaaagaccagaaugaggccaggaaauuauccaucaggaauucuuacucuccaaauggaauccacuuguacucugcacguggguucaacucccucgucagggaguuaggaugucuggguccuagucucagcuuaggcacugauucugacuaugagcagguucuuuccaugcucacccucagauuccuugucaguugaaauuaggagauggaugagaccuucuaugcagaaccaagaggaugucagacgugccauagggucccugcuguagggcuggggcuuggucuucccucugaucaaaguagcucugcauuuauuaguuuuauuuauuauucuuacacugcugggaaauaucuguagagugaagguaugcuaguaucuacucauagauuuguugcaucaaauaauaugcacauaagugcuuggcaccacaccugggacauaguaauuauacaaucacuguuaccucuuuuuaauauuguuguucauacuguguguuguuucuccuuaugaaagccuuucagagcugagagaauauacagagggucucacggaagccaaggaagacgaugauggggaccacaguucccuucagucuggucaguccguuaucucccugcugagcucagaagaauuaaaaaaacucaucgaggaggugaagguucuggaugaagcaacauuaaagguagguuuccuuuguaagcaucugcaguaaccaauggcuuauuauggcuguguggccaccuuaguugggccagaggggaaguagcuugaguagccugcucacaucagacccagguugcguccugugauggugggacacuguagcacuugaccacaguaagaccuuccauuugaagagagccuuuuagcuugugaaccacuuucaguagauugacuucuugcaucuucuuuugucauuuuauaaaugagaaagguaaggcucaaucaagguuacagaaccuggguuuucugucuccaaguucaaguucagugcuguuuccacauuccaugugcugcuguccuggcaugugucuguugugggaugcuguccauuguaaacaauguggguuacaagagcucucaccuggagcuuucauuauuuccacugugcauggagagguggcugaucccagggcucacaagucccccacgcuucagucaagucauucugaaagucucacuucccauauguuuucugagcaugacccaaagggguguggggaggaaguggccaggcugagcuggggccagcagucaaaugagcucaggcucauggguccugcacccucuaggugcugccccaggccuccguaggcuuuuggcacuagaaugauccaggcuaggaugagaggauaaggagguucucguuuuccauacaaggaggccucauagcugcaauuuccacaucaagaguguaggugagucugaugagcccaaggugcugcugugcugagauucuuucgcuguggcuuucacuugucaccugggaccaucaucccccaggaucuuacucagugcaaaugaaauaacagaggcagagcguguaaaacacaaagagccauccugccugagcugcucuggggagaguauuugcuuucuaacaugagaagagccuucuacaaggcaaguaaccugauacuuggguaaaaguugagagaguugggcuaguguuggggcuuggaggugagggugcagugagguacauucauccuuccaugccuuugggucuuaggggcuccaagucuuaggaucauagggacagcugcaagucaggugcucuagugacgcugagcaagugaauucuuugacauaaguuuacuccuuagugccaagguacaaacaggugccccaagaaccuguagguguacuuuauuuggucugcauggugaugaaaaaaauauugaauucuauacaugauaaaaccugaauugaaaccuggacuuuagggaagugaucugguagcgcuaguucuguaugccuacguagagcugacccuuugagcagauguacucguuggcgcucugcaguuccuaucacacaucugcccauuuggcucauuuuagggaccugccugacuccuauaggcaucugaguuugagaccccugcucuagacuggaauaggagucucugacuguguccuggcuccaugggaguccccgucuaggcuaggaaguaccguaguaaugugugugugugugugugugugugugugucacacuugcacacugugcauuggggcaggauguuagcugggcuuccuuagugcugcugcugugacccauggagaaguagaagggaagaaggagcaaccaauuccugcagaacagcacugaccccuguuuuguuuuuuguuguuuuuuuuuuuuguuuuguuuuaccugaaguccuacaaccugacuucaucucacacuguccaauaugcugauuucuggcugacuucauggcacucccccugcccggcuguggacagggugaaugagagaggaaaauaauuaugcuugcugcuuuacauacauuuuuuuuuucuucuaagcuucccaugacuccugaagguccauucuuuacagaugaggaaacugagguuugaggaggugauguaacuuggaggcuggccaagcugggguuugagauaacaaaucagucugaugucaguccgauguuaaauuguucauccucuugcaguaaaauguuuuugaauguauguauuuccucugcagcaauuagacggcauccaugucaccaucuuacacaaggaggaaggugcuggucuuggguucagcuuggcaggaggagcagaucuagaaaacaaggugauuacggugaguggccaagugaaggggcaugucacagccagaggcaaugguucugggggagggggacacacuugccaggaaggggcccugugcuggggaaaugaagaaugcaugacacuaggccacugggcagguccuguccacucagcacaucccagagccuggggcugcguggagaggguagcaggccuggccaugggcaucuuuuccugugggucccacuauucuggcucauccaaucugaucagcauuggcugcugccuucaggucaccuguaccugacccagaugguuucugguucugccaguuuuguggagccaugcugcggcugcucgcucucuaaagccgagugcauugcugucaucccagggcuguguugucucaggguauccuuuguguaggcugugcugggcucauuugaauuuccaugcccaacugaaaacaaauccuccaguucacagcaucagccagcauucaacauaccacacccccuugcaguggcaaucuggcauguuccugcgugucacuucagagucaaucaugucaguggugacuuccuugauuuccugauaaguuuucuaucacauaaaaaacacuuaaaaccuguaagucucuauuucucucacugagugcagcugaguauuacaaaaagauuccugaccguguaguuuacuuucuacuugaagaggaggaaagagagcuugccugugggaauggcacuuuggguauuuuucucuguccaugaguagcaacuucuguccacgucaucuggccagucacccuugagacacugcagacaacaggaaacuaggaggaaggcgcacauguuggcugagcacaugcacaaaagcuucuuucuccuucuguguuugagcauuucucuuccuuuccagaugauuaaaagggaacuaacguagagcaccauccacggccaugcugagcacucacugaccuguugucuaaauucauccuacccacacuuuggauugauaaauugguggcauuuaugcuucuuuuauagaggaggaaccugagguuccuccuuuaauuaacuuuaaucuucguuggccuaaaaauccucuagcauugaggaaccugaggcucagaggagagguucugcuucaugcuuggauguuacagccuggggauucuaaccauguaacagaauuuuucuaacaccaaaacaauuuagagaagcaaagagcuuugcuccuaucauaaaagcaaaacuacagguaccacauuuuagugguuuccaugcaugcuaucacucaguccucuuaauuauaauggaccucauuaaagaggcugaggcagagacaugagauauuuuuguguguuuguuuaucccacauaucuugcagaaaggggaccaagaggugacuggagguaaagagucagaauuucuaggggaggagcuauaaaaaugucuagacugccuaggagaguguuucucaaaaugcauucugccaaaugagaccgagaauuucucuaugagaaaagaauucuuuguugaaacacuuugggaauccccauaauacccugccaauacuuagaaaucugccaugcagauuugcauuguagacccucuaaaugccuuuugcuuagaaaucugcugccaugcaaauuugcauuguagacccucuaaugccuuuugcuuuuuaaaaguagacaaugucagagcuuuuguuucacccaguauuccucaaguuucuuugauuuuaaaaaauuuuucuuggccgggugugguggcucauaccuguaauuccaacacugugcggggccaaggugagaggauugcuugagcccaggaguuugagaccauccugggcaacacugggagacccugucucuauuuuuuaaaaaauaauaggaaaagccuuuuucuuacacaauacccguuaauaugccauagaaucagugccuugagaaaacuacucuggggacuucugaccuagggcaggugaagcaaaagauuuuauauggaaucccaacuagaaucguggugguacacuauaggacguuguguugggauggauucugagggcuuaccuggucauuacugcuggugaucucugcucuggauggagaaggagggaaugcuggccucugugccagcagcuccaaucuaggacacaauuaucuuuaaucuuuguuggccuaaaaauccucuagcauugacuaaccgguucaauccuccuccagcaaguauguggacuggacuugugugauuucugguccugacuuccuuugguuugcucagguucacagaguguuuccaaaugggcuggccucccaggaagggacuauucagaagggcaaugagguucuuuccaucaacggcaagucucucaaggggaccacgcaccaugaugccuuggccauccuccgccaagcucgagagcccaggcaagcugugauugucacaaggaagcugacuccagaggccaugcccgaccucaacuccuccacugacucugcagccucagccucugcagccagugauguuucuguagaaucuaguaaguucucccaacucaguggaagccacaugggccacauccucuuuggccauuuggggccagaccugauggggcuacucaguaauuugugaccccaagaauguguggcugccuaguacacugccugagacguguuuacaugugccugugugcaaacacgggggcuguaucaccccgggcucacuugaagcccagggcaucuguggccugggagaggagaggaucccuaacagagaccuuguguuuuucucagcagcagaggccacagucugcacggugacacuggagaagaugucggcagggcugggcuucagccuggaaggagggaagggcucccuacacggagacaagccucucaccauuaacaggauuuucaaagguguggggugugucugguucuuugcgugcucuccaguugugggcauguggccaggcccccaaaaggcuucugggcacuuucugggcuauguuguuucccacaacuccauguccucuucauaggcaugcugguccuuuuagggcucaauucugcuuuuucuacuuuuucuccuuugcucagacauccccucaauccccccucuguuuugaugggucuucaaaaauaccuaaguccugggcuugguucggguuggcagggccaggacucuagaguggggcagugaggcacuggccuguggggcagaauuuuaaaggggugccaaaacacucaguaacucagaucgauacuauuuuaaugcagcguguuuuuuaaaauuaauuuuaaaaaaacauguuggacaaaauauccaaguuuaaaucaagacagagucugacuuuguacugcacacuuggccucauuugccuuacccuaguccuggacacgucagcuccugccuuuauuuaaaauguugauagauauuuuguucaucagggauuggaguacaaaccagucugauaugggggucacuuggauuucccugugaaaaucaugaaugacuguggcuaccauguaaaaccaucccugauucuuugguguuccucaaauuggaggucuccaagccacagagcaagggguuguagagagaggaguacuggacagggaggcaggugggccagguucuagucccagcucugccuguaaugugcugagugacccuucccuucugggccugaggcucuucauccauaaaaggagguaaagagguacaggugugugucugagggcucuuaggacugagacccaaagggacucuuagcucugucccucacccacuaugagcuccugcugcugacugguuucguuagaggaaguucugcugcggcugcagaaacccagaagguagagugaggcuuacauggcauuccccccagaauccauguuaaccccaauucugggaaagauauuucuaauuuuugaaggucaauuuggaaggagcauuggguucaaugucaagaggacuagauuccaguguuaguucugccacaugaccuugguagcaugaucuuggacaagucacuucaccaccaugggcccauuugcuuaaauguuuaggaugagacugccagcugcagggugauguuggaaggagagaugcagauucuggagccagaaagucuggguuccagcccagggcccaccacuagcagcuaugaagcucugggccaguuacuugaguucuugguuuccucagcuguuaaaaggaaacacaaauaauacaccccucauaggauuacugucauaaaugcaaaacauuagcacaacgccuguuaaaauaauugcccaauacacuuuagcuauauuuucauuacuaucauuaguauuaucuucuacucuuaucaggauuugugaagaucacugugucaaauggaugggaaauuuuauuuuaauauaaacaguaaaauagcauuguuuucacuugcagcuuugaaauagugggggccauauaugguuguuuccuuuuuuauguggacacagaggacuucgugccagaggcaagaucccuguaaauauuguugcacaaaaaucucacuagcucucuucccauaccacccaaugcugauguccucaccacaugcggagaacaaaugugaagggaguaggauauugggucaguguccaaagcagggucugggcaggacucagcuccccagaguccucuaugaacuauggacggugcuccaggcaggcuaaggcguggagcugccugauauuucccuccccuggggacagcaagggcuaucccuuuccaaaggccauggagagcuggagccuggugcccuaaccucugagucaccaucuuaagagaugccucauuuuagaaccaccaacaagcaagcucccaagggauggugcccuguucucuaccaagcuauccuggcucuuuggagaucaaggagaggaggcaacuuuccuuguuccccaucaucuguggaacccauuaccuucucccucauuucaggagcagccucagaacaaagugagacaguccagccuggagaugaaaucuuacagcuggguggcacugccaugcagggccucacacgguuugaagccuggaacaucaucaaggcacugccugauggaccugucacgauugucaucaggagaaaaagccuccaguccaaggaaaccacagcugcuggagacuccuaggcaggacaugcugaagccaaagccaauaacacacagcuaacacacagcucccauaaccgcugauucucagggucucugcugccgccccacccagaugggggaaagcacaggugggcuucccaguggcugcugcccaggcccagaccuucuaggacgccacccagcaaaagguuguuccuaaaauaagggcagagucacacgggggcagcugauacaaauugcagacuguguaaaaagagagcuuaaugauaauauuguggugccacaaauaaaauggauuuauuagaauuucauaugacauucaugccuggcuucgcaaaauguuucaaguacuguaacugugucaugauucacccccaaacagugacauuuauuuuucucaugaaucugcaaugugggcagagauuggaaugggcagcucaucucugucccacuuggcaucagcuggcgucaugcaaagucaugcaaaggcugggaccacgugagaucauucacucauacaucuggccguugauguuggcugggaacucaccuggggcugcuggccugaaugcuuauagguggccucuccuuguggccugggccuccucacaacauggugucuggauucccaggaugagcaucccaggaucgcaagagccauguagaagcugcaucuuguuuauaccuuugccuuggaaguugcauggcaucaccuccaccauacuccaucaguuagagcugacacaaaccugccuggguuuaaggggagaggaaauauugcuggggucauuuaugaaaaauacaguuugucacaugaaacauuugcaaaauuguuuuugguuggauuggagaaguaauccuagggaagggugguggagccaguaaacagaggaguacaggugaagcaccaagcucaaagcguggacaggugugccgacagaaggaaccagcguguauaugaggguaucaaauaaaauugcuacuacuuaccuaccacaugccaagcacugugcucagggcuaaacgggcauugccuuuagugaucacagcagcuucuacgguguaugguucugugccaauguauugauaagagggcacacacuguguacaguaaauggcuuauccagcuggugagugaugcggcagauugaguuuucuucugugauucgguggagacuaucagcccaagaugcuuuaagugcacaacauuacagggaaugccugagugccuggccaaagggauauuugguuuggccaucucuggaugccugauugccaagcucaggaccaggcaaugugacuuugcaucagcaacaaccagcaucccuugaccaggccugggccagaguauuggucuccucucagccccugauccugugaaguaaggaugugggggaagaccuggcaaggacacagaugaaacacaaacaauaguaauucucaggccaucaucaguggagccauguuaauguaaucugauggcuucuccaggguccacaggaagugaagaaucuguuucccagcaguggacucaaaacccaucugggcuccuaaccuuccuguaaaccccuuuaguggcuucauuagagcaggcguucagcucacuguucuauucaucucaaggaauaaugggcuuagagcaguuucuguccugcugguuaacuuguuuggccuauuccauucuggauuuugucaagcaguagacaagcaauuagacaagaacuuggaggcaccauuuguauccacuuuuuagacuuaauagaaacauugaagaugaacauaaucuaccaacgaaagacgugauucaauucaacacucccuucccaugacccaggcugggcaaggaggccacgugauguggagggcacauuccuugccugcacaaacucaccaucugugcacgcaguggccuucccuaaaaucagggaauuguuuuaagucuuaucaagcagccaagggaugaaagagaagguggguuuucaucaagacuggaagguggggacagggaugagcauggagcuggccgugggccugggguaccaagagacuccuugagagaccaggcaaagcaagugauugggacagagguuaucugucccagguuaucugggcauagaugcaggugagcccauggcccucccaguaccuccugucucuggccuguuuuagaagguucucuccuccccaaggagacacaacaacuccuagggccacugaagauauaacuauugcccagguuucuggucucuaggcuggggaaguccucuggguaggaaucagcaagaagauccuaaaacaaaagcucauccauuugcguuccaugaugcugggauuuacacuugaggcuuagcuuugcucugccaacuucuucagagcugacacaggaugaaggcaaugccauccucaaacacugcaggcaucacagcuaacaauugugaagucgucuuaacucaccauaaaaaggaauccacucccaggcagcccuacuucuuugcuuugcccagcauuuuacugauucauacauuaucucacuugugccaacacucaagaagcaggcuacacugacacugguauuccugccuccauauuuucuuuaaaagacaaaucaaagcagauauauuaagugacuguucaagagcacacuuggcccaaguggcagagcuuggacuggaugcauguuuuccagcuccucauccagggcucugaccaguuuaaccugaugcagucacguggaggagcagugcaggcacaguaugucccauaggcccagugagaugcauucuugguuggcuggccuuccacuuggcuacacagggauguacaaggcgaucccaucuugauaagaccaccaccucagaguauggagcucagagagggcaggcaugaaguuuccuuggcuggugcaccuagaauuggcugaacucaugagaaguugauauagaacagugcuugccacagagcggggacucgguaagcacuuaaugaaugaaugaauucuaagucaauccaagagucugaugauuucuugaaaaggguguuagcuaaaggaucuuaggcaugacuguagaauuuguaguugcaauagaacagagaaagaggaagcuuucugucuccuuaacacugagcugucauguuuuaaagcuugcucacaucuuggcacauuuaagagacagucaccccaggacucaaaaauagggaaguaacaguaacgcaggggaaacguuuucuguuuggaggagcaaaggcugagaacacugugaaaacauuuugcgcgcacaauaguaaccuggguaaaugcagcgugaagggauuuuagucacacguggucuuucuuacaaggaagguggugggggugcagaugagguugcuagagaauguuagaggaucccucucuggauuggagauagggaaagaaaguugcacggcugcugaggccccuucuagguggcaaggcugugcucccugguucugaugaugugccuggguggacauggccccugugaguuuguacagucuugcagcaggaucuagaggggggauuuccagccagggcugcuagacggaggccuacucuuccaucuuuccugauggcaggauggccuggccagggccuggaagacagagaccuccugccuccgccucaguaagacgacaaggaaaggcaaaugcccaagggaaagaaaaggaaggcucuucuccccagaguuccccaugcagacaugagugcgugcucaguucagaaucacuucugagaacucaucccuaaugcugcagauuugggcuggaacagauucacacugucugguuucaccgaggacaugaaacuccaccuugcggggauaaagagagaaaaacaaauucaucaaauggaagacacauugaaaguguuuuuccuuaaugcuuauccuguuuuuaaaccauuauuuccaaguugacaccuuuuuuaaggaaaaauaaauauuuugcggcauuaaagccauauacaaggucuauaucagaaaaauauauuuggggggcugcagcacaggacugagggagcgguacaugcuuaaaaggcaacagggccugguuuucaguggcgaugaugauucucuaugacagucagggaaacguggucucugagagugaugggcacauaaagccuuggugccagagugcaucgcaugguguccaggccgagucucugucagaugguuagaggccugggucuacccugccaggagaggcguguuuggguaacaggcagauggaguuuggaacacaugaauggcucaucacacgccaacccugaguggggcaggaggcaggaagggugggcugccgccucugguuggcauucucagagaugcgcaguccaucagcuuguuccaaagagugaacacaggccucugcgugcucccaggcuccuuggugucccaacagcuggagcuccucgaugagucacgggaguucuuugccaagaaguaacgauagcauuacucauggaauugcuucacugcuuucugaagguuggcauaaaaccgggucaugcugcgggggaagaaggaguccaccacguucugugggagguaaccgcugaggucgguauggaagaaugugaccagguuggucuugguggguucccugugaaggcaacagcagagcuguguuaugaucugcagcagaggugcuggggacgagcgccaggcaggugagcagagcccagcccaguggaaauggccaugauacagugaucgcgucucaucccuugcugugcccuccacccaggaguccucucuggaccugcugauuuucaggauggaaacccauccugucggggaugcauuccacagccucucccggccuccagggaggaagaagucccuacucccagcccaaaaacccaguacccugcugcccgauucacucagcaaaugcuuucagagaacucacuuugugccaggcccugagaggaacgaagagaugcugcccuucacuauuuagggucugcaaccuccugggggcuccugggacccuuucaaggggucuacaaaguuaacacuauuuuuauaacaacacgaacaugugauucgccuucucucacaugcauacagugggguuuuccggagguuacaugauaugugauauugcaacagacuacacgcacaagcagguaugaguuucuguuaagccuggcaugaaagagaugggcaaaaauauaaaaacaaugccacucuuuucacaguauuuuuuguuuuaaaaaaauaguuuuuuaaaauaaaaauguuaucuauguuaacaugcagugcauuuuuauguuaaaauauuuuuaacauuucucaaauuuaccaguuacaauuucaaauacaucaaauaaugauagcuauaacccccaagaacaaaggcccuaugaagcccucaaauauauguaaggguauaauaaugccuuaugccaaaauuuugagaacugcuauuuagagaacuggcgaauaauuugagcaccuaugaagggauuuuggccaagggguggcagaagcucagaggacggcagguggcacagaugcugacuggaaguccagaaucaaaggggcacacgauguggagauggaacacaacuugguagggacaggaagcgaucuucacugugacaaacuucucaacggccaggacaacaaaggugguauaggcuuuguggugugcauuuggcauuuuacuugaaugcaacuguccacucagccucaccaggaaccccagguagcacuaugccugcccaucagauguuuccugacaucaugcaggcuacagguuuggaacuggagaccuuuuagaaucccacuccccagggccaagcacgguggcucaugccuguaaucccagcaccuuugggaggucgaggcagguggaucaccugaggucaggaguucgagaccaaucuggacaacaaggggaaaccccaucucuacuaaacauacaaaaguuagccaggcauaguggcaggugccuauaaucccagcuacucaggaggcugaggcaggagaaucgcuugaaccugggaggcggagguugcagugagccgagauuacaccauugcacuccagccugggugacaagagcaaaaccccaccucaaaaaagaaaaaaaaaaaaaaaaaaaaaagaaucucacucuucaagucauacagaaggacaacuggggcauggaacaggauggggccagcagauccacaaggugggagagcaugugcuccucugggcuguggcuuuucuccucugcuugugcccugcuuccccaaagagggugaacuccaggggacagagacuuccuuccaucucaaaguccuagcaucauccgcacuccaccuuucccucacccaccaaccccugcccaucccgccucugcuagagccuucucucuccucccugcuccuccucccaaugggcuuccucuggcccgcaucaccucucagcagcauccucuuuggaaacaugaacaggugagugagaaaugagacuccgugaucauguuucccucugggugaggaaugggcuuuguggugggcggaacgugugagaggccaugugggaugggacaaacucucuucgucacaguggccuuggugagugguagcucuugcauguacaccauuaugugacaacaacagaaagggcaaaagggggcacagaggaauuguaggucacccagucuccccucagaaaaggcugggaugaaggcauccacuacgguugcuagaaggauuuaaugagaguaggugugacgcacuuagcauccuuccugugcacagugcaagugcuccagaaaugacacuguaaugcugccucgaccacagauacaggcuccuccaccuuaagaacaccuuucccccgccccccgcgccacuuggagcucaaccaccaccaccucuggccucaacaccaccucacccccaaugaguccucuugcccucuugcucacagccucuuacucaagagagcaagaggagagagaaggcccuagcaaaggcgggaugggcagggguuggugggugagggagaggguggagugcagacgaugcuaaggcuuugagauggaaggaagucccuguccccuggaguucacccucuuuggggaagcagggcaucauagcaguuaagaccaaagucagaccauguccugcucaggccuccccaguggcuucccauuuuauucagaggaaaguccccaacaggcugcggccccugcuaccucaugggccgaauguccuagccucuccucuugcuaacacaacaccucccucugugcuguuccucaaaggccccgcucuugcuccggcuccugcucccacuucugggacuuugcaucugcucaucccccugccagaaugcucgcuccaccaacacgcccaagacucccugcauuugugccuugcucaaacgucuuauuagggaaacccccuagauaacccacucacaccuuucccuggcaccuuuaucuggguuuaguuuuccccaaggcacuuaacgucugauacuuacuagcacauccacgagauagaacuacuuacauuuguguuuugucugucuccuccugccuucauuggaaucuaaguucuaagagggcagacacucuagcuguuuugagacaucaauaucuggguuaagagcccagauucuggagccagauggccagaaugagacuguggcucucuuacuugcuggcugugugaccuuggguuaguuacuaaaccucucugugcacccaccauucuuauuuuaaaaaugaggaucacaacagugccuuacgguuguuauaaaaacaguuaauuuauaugaagugcuuacaauaguggcugacacacaguaaugcuguauaaauguuugcugcugcugcugcuguuauuauugucugcugaaucuaggguccagaauaggccuaucuucacagaauaauaagagaauaaucauugucacagauuucagauccacagccucaugagaauaacugcacacagcaggcucuggaagaaagcuuuacagagaacacgugauguuuuuaaucaaguggagaggaguuggaagagucaacacuugaguuaaaaccuucauaugggcaggguuuugugggaccccaaccacccucucagcaaaauccaugcaaucgggccaggcgcggugacucacgccuguaaucacagcacuuugggaggccaagacggggaucauuugaggucaggaguucaagaccagccuggacaacauggugaaaccccggcucuacuaaaaauacaaaaauuagccaggcaugguggcaggcaccuguaaucccagcuacucgggaggcugaggcaggagaaucgcuugagccugggaggcagagguugcagugagccaagauugcaccacugcacuccggccugggugacagccaaacuccgucucaaaaaaaaaaaaaaaaaauccaugugauaccuuugcuaccuggcaugagggcgugaugcuacccauuauauugugcauuccaccaaaaagaagacagcaaugggauucagccccucagaaggaaggacucugccucuuauucugaaaauuccucucugucagacccggcaccacugaaaggugagucuuagcaucugacuaccaggugggagaggacaaggaaaugagcccaggccaggggauccagggcaccuauauauugggagaacugaaacugagugcagguguguaugucugugugugguagagcacagcugugcuauuuucaaacucaaaauuuuguuacaucuaagaaaagucuucacaugaugucugaaaagccagcuuagcaaagaggguaacauaaaggugcuaggucugggcuugguauaaucccacgacaccgaggcccaccuccugggacaaugugguagaaggacagaccccuucccuccgggugucuguauggagacugcagggaacaccgggacacaccugcaaggcacaguuucuuuugcugucaacaugcaugauucccaggguaaacaagggaccuucagguaauucauuacacagaaauuuccuggcaagagccuggccaugaccuguggcaaaaugggaacagagaguccccggggucaauucugaggcugacuuacaguguggucucagaacugcccuuuaggccugaguuccgccacauuccuugccgaggagagaugaucacugagugaaaugugggguggggacugcuauccucaaagcugcuccugccuggcggaggguauucagggaggacucggagcacagacccugcccugccaaccuccuagccuuugagucaggacacaucacugaaccuccccaaaccucaguuuccucauuugcuaaauggaccaugacauuugcuuaaccuggaggcugcagggaaaauuuccugcaucaaaaauaagaguaacgccuccccucaauucuuucccacaugccagguacucucaggagguucugcuuaugcagaugugugugaaaguauuuuguaucgucacaaucuaaagagcuauaaggcauuuuucuucuuuugaaucguagucaaagugccccuuuucacagaagguccacagggaagucacaguuaggucugagccauguaccucaaugcaggaaauuauccuuacccuggaagagguucacagaagcaaccacaaggaugguuaaauccucucacaaaaccuggcuucgggggacauaacggaugcuccacauggguggcuggaagacagugcagaaucucggugaguuacaacuucagacggucaggucacugccauuggggugccauagagcacacagaccagacuaccugcagcccuggagucugugagggacuccugccucuuggcgugaguucccccuacucccacccuacugccccuuacacucacacauacaaauacacucucacaugcguguacacaaacucacacacagacacacacacacuugcacucacacacacucacucauccacauucacacauaaacaugcacauagcuuucccaagcuugucaagaauaucagagaaaagaacauucuagaacacaagguuuggucaugggaggaggcaggugccucucucaaaucucagccaggagaggcauggaugcauccaacucucccgcguagaagaauuggaggaauggcaggggcugugcagaggcaggagcccugcuccucacugggcauuaagggaguggacagcauccaaacccucaagaagacacggccauagauuuugcacacaaguuuuuugccacccaacuaacccacauguguacagcacacaccaugagcuuccgcaggaaaaaaaaaaaaggggcacuggcaaaaccgugacuugaacauagaauuacuggcauauggacugucuugcgucagacccccauggcccugaguccccccaaacccaaccagaugagguaggggacucagagugugaguuucuggugauuucugguugcuuggcuuuccuuaaggaacuguggggugcagaagagaaagcucgauaucgcaggaaggcauggcagcuccuccgggcaucacucaccguuggaacugauggucccauccucauaucucuugacuagcaccaaguccacaaaaucucugggagaaaugagcuucauggcagcggagggaguggagguucugcuuacacacagggucugccaaaccaaagaagcauguagcugugacugcuggccagacaucuucucccaacucccaccccaucccucaaggucugggaaagguacuagggcugacaguaggguggcacuauaaacaguuaagauccagagcgagucuucccaggaacugggugucauggaaauacacccaguuuguaagacgagggcugugacacaggcugcccacagcugucuagcugcagaccagugccaugcugaggucacgucucaugugaccauaagagguaccauuuauugagcaccuaguaagagccuggcuggacaaagcucucagcugucccuuaccuuuagaaauaggaaucauuaaucccuccuacaggugaggaaacugacacuuagagagacuaaggaacucagcacgaagcucaugguggagauaggauuugaacagggccagagcuagggagagggaagagaggccacucuuuuuuagggcugacccugcacuugcucagccuccuauguugugccuggggcaacucuuugguuuacccuagucccagccccaggagggaauaccuugaaccucacucaaucucagcauaucccaguaguccacacucucauuuuauaaaccaaggaugcugggcuuucucccauucaucccauccugcaagagaguggggcccaggcucucucgaggucacaguggagaaguacaggccaggccugugauggaacaguccuggagagaagucucgggguaggugagaggggcugguaaaggucuccaucucugugucuuuccccucagguauuaagacuuggggcaucguguguugcugcagaacuuuucaucagggacacuuucggccucaggaaauuaaucuucgaauggcaugagaugcaugggggcacuugagcacuuugcaaugggugcaaugagaauaaauuuccaggaaacuacuccguguuuccuucauccccuaaugaccugccugggaacaggcugcaccugcacacagggucuccuuucccacuugaagaaaagcacagcauaugcccauucaucuagaaucauccuaucaugaauugucccaguguguaaaauccuccaggguggcaaagggacaauuaggagugcgggcggcaauauguaaucaaggcaguacacacugguauuagaauuucauguuuuucccuuucuuaagcauauuccaaaacuugguguuaaaaacuaggcaauuuugccauuucuaaauucugguauuuuguaacaguaauggcagaagugaugaaaauuuugaaaaaaaaaucauacugcuuccaccccugaugacugccuccaagugcaucauuccugagguacagugucuggaaacuaagaugaggaggacuuuggaaagaaauuuugaagacagcagcagcacaugucauaaaugcgacaaacucauggcauggcccuguauccuauccauccauccaccuaucaucgaucaucuaucuauuuuagaauuaggauauuugagaguugccaaaagcaugcugagaaaugucagucugcaaggaagagcccuuucuccacauuuucauuguuucacuaaaugauaaagagcuaccacuuggcaauucuccacuuuuuuguaaaccugagcucaccaguagccugugcuuccccucuacuuugcaguugucuauugaaaaguuuguaucuuuucaugggcuuaugaguuaauuagaaaaaagagagcucccauucaucucaucuaaagacgcaaaauguuuuacuugucacguuuaauauuuaucagaauuuauaauauaaucauguuauuuuaaugaauuacacucguaccucaauccaauuuuuuaaaaaacaauuagucuuggccaggcgcaguggcuuacaccuguaaucccagcacuuuggggggucgagguggggggaucaugaggucaagagaucgagaccaucccagccaauauggugaaacuccgucucuaccaaaaauacaaaaauuagcugggcaugguggcgugccccuguagucccagcuacuuaggaggcugaggcaggagaaucacuugaacccaggaggcagaggcugcagugagccaagaucacgccacuguacuccagccuagcgacagagugagauuccgucucaaaaaaaaaaaaaauuagucucaugauuacaugaaauauaugauuaaaaaaacuucuauuucuaugcauauuuaugaugcaagaugaugacuuccaagaauaaacauguauuguauuaggauaaaauucagagggcuauguggaauggaaauuugaguuccaggaaaacagcuauauaccauuucugaugauuuaaaaaaccuuguucauguauuuuaaguaaaaauuuauauauuauuuagacacaucuaaaagaaugaugucauugcuuuguucaaaacugagauuuacaugucaaaaaugacaugcuuugcaacuuaugaaaauuuaguuguaaacuaaauguuauuaauagacaucaacuggaugugugaggaugaugcauaauuucucaaaaaucuguuggaugcauguaagcaaaaagcgugaagacccucauaccagaggguaacuggggucaugcagguacguggagcugcuacuggcccaggcuucagggaagugggugccaggggcugaggauccuguguugccuagugcagcagccccacacaaggaacagguaugcuccccgcagagacucuguuuggggcuucucucccucucugagucaugagguuucccaccgggaaacugggcugaggcaggccuccaaugcugcaagcagugggcagccugugcuugcaggacacacccccuuaacaaaagguaucacggaccccuuccagaagaaaugggaggggguuacuauagccuggcccagacacuaucuagagauaacaugcuuggaaagacuuacgucagugaugcuuuggauaauuucaaaaccggucacauucucaucccacuucacucguaggccuccaacagcuggcuucacacagucccacaccuccucuagugucccauauacaaugccuucuccucgguaccuggagcacgaaaaggaauuugaccccaacgcaucaaucaaacuuguuaucuugagauuguaucuaaggacuagaagguggaccaugccaugucugucacuacucuuuaggacagacuugcagagaaggggcugaaagucacuagccccgccucccuucaggccugcagaaauggacaguaagcuuucacaagaauacaguuugcuggaaaugauuucauuaaaaacaguaaggcuuuucuggaggacaagugaucacagguuauaggguugauuugaauauuuuaggaggcaggcccauaaagauaccaggaagggugcggcaccucugguaaucuuugaacgaggcaugcacuuacagguucccuggaaacuccacagauggccuccaggaaacugaaacuccauucugucaaaaggcacagaaccacagaauuuuagagcuagaagggcucuggucaccuggcuuaauccccuguucuacagaagagggguaagaggccucaagagauacgacucuccaaggcugugcaacccauacguggaaaagcugggacuagucuugggcaaagcuguccccacagcagaaugugaugaagaaaaagaucuuaacuggcugacuccaagagccgugggugguuuuuaaaauuaucuuaaaagccaccaggcauucuguuuccuugagcaacccagggcuacuuaaugaaaagucagaagggucaagcaaaacuacucccaugcuacccucuggcaacgacaaagagagggguucaugcuguaaugaaaagucagaagggucaagcaaaacuacucccaugcuacccucuggcaacgacaaagagagggguucaugcuguaaugaaaagucagaagggucaagcaaaacuacucccauguuacccucuggcaacgacaaagagagggguucaugcuguaaugaaaagucagaagggucaagcaaaacuacucccaugcuacccucuggcaacgacaaagagagggguucaugcuguaaugaacacagaagaaaaccuuaguaugcaucagaugcuggaucagacuuuacuggauuuaaacaacauguaaaaaccuccuuagcugcgaccacauucuuucauuuuguuuuguuuuuaaacaccugcuuaccccuuaaaugcaauuuauuuacuuuuaccacugucacagaaacauccaguccuaaacagcauucaacagccaggugaccuugggcaagucacugagugaaaggaacagauacuuaccaccugaagucauugugagcauaacaggcccaaucuuuuuuuuaaagaagaaaacaauccccauuggaaucccucucaaucggguccaggggauuggggagcagaaaacaacggggagaggaggcgcuugggggcuucuggggacccgggcuccacgaagccgucuccgcgaccccuucccgcccagcuccucacucacgccuucccggcaaaucuuccagccugcugugucccgccgguacuggagcaucuucucggccacagccucgcucaucugggcugccagcgccggguccauugcgucgggagcugcgcuuagcugcggggucgcggguguuaugagcggcggcgcuggaucccgggugccuggaggcuggagcucugggaggagcucguagcc

SEQ ID NO: 15257 - RNA, 1916 nt, Homo sapiens
uagguucacuaaauuuauuuuaaaaaucauaaaacguuucuuacaaaagagcauuacauucugcacacugcucugaacagauaccagggacauguggacuauuguuacuuuuccucccugucccacccccaaguguuacagugaccacaaagcaagguguucacaauaauuacauggggggaauuuuuuuaaaccaccaacaauaacaaaaaauaaaauccacucacucugcugcuguuucaaaauuucaguguuaguuuuugcacacccuucccuggcccaacccuguuuguaaggaacuaaaacauuacaucuggugaacagcaaagauuucacuacaccucaaaugcagaacaccugugaagcagaggcguguuggcuuuuuaaacagaagcagauaacaaaaaaaaaaaagacguaguucuucacuagucuuagaaaaacuuuccagaauacugcgucacacuauaaaaaagaaaaaaauaucuugcauuauacuccuucaacaucugcacacugcuucacacuguucugcagcaaauacugugcauucuguaucugguccuguguuucucuaaugguaaugauccaaucuuccaauccuucuaaaggcucaucaauuuugaucgaagcucccgacucaugacggauuuguuuaaucugcagaccaccuuugccaauaauagauccagccaaaucuuugggaaucguuacuuguguaguaauaauaaguccaccaagauuaccauaugagccacgacccccugcauaggaauaaucauaucuggagccacccugugguucauaagccaucugccauucugaugggcuccauguaucuauugcagagucccaaguuucaucagcacugaaaccaaccaugccaugguaacagucuccaggucucccucuucugucauaggccaugaggucucccccucuagguggugguggaggaggaagaggaagauuccgagcucugcuaccacccucaccaccuuguccuggaggagguggaggugguccuugacgagggcucauaucaucauaaucucuucuagauggaggcaugggacgcccacccugaccaggaggcauucugucaaaaccaccucuuccccgcaugggaaaucccacugggcguccacagcggucaucaaacauaauuguaaaaccaccauaaucauagguuucaucauaaaaauugggaucauaaggcugugcacguccuuugaugggagacucauauauaagaucaaggaugaucuuuaugcacucuacaacccuaucggguuuuccuccaauaagaacaacucuugucaguggaauaaggacagcauuccuggaaaagcuugauggugguuugaguguucucucgaaguucuuugauuuuagcaccuucgaccccaauaauuccuccugcuagacucugaugaaucaacagccucaacucgcagucaaagucacuuccuuuauaguguugguaacuuaagcauuccacagcaacagauucgagcggcagcuggcugguugcagugggugauggaaacugcaggcccucuuccaagguagggaugauuuucuucagaauuucuccaauugugucaauaccagcacugauacucaauaugugcucggggccacugcugucugggacugaaacacuggcauuguagucuguacggagagccuugauauucuugccuccuuuuccaaucacugccccagcauucuuggucugaagcagaaugcguaauucaaccaucucaucaguguuucuagaucuuuuaaaugcuuguuacucuuccauaucuucugcaggguguuuaccaaauucaccauugguuucaguguucgggaagguuucuuccggcuguucaguuuacauauucuuuuauuaaaugggcacaccaauc

SEQ ID NO: 15258 - RNA, 4725 nt, Homo sapiens
ucugcuuccuacagugcagaucccauccagcaauagccucacacucugcaucaacaccaccucagaauuaaagagcagccaggcgcagugguucaugccugaaaucccagcacuuugggaggccaaggagggcagaucacaaggucaggaguuugagaccagccaguucgagaucagccucuggccaacauggugaaaccccaccucuacuaaaaauacaaaaacuagaugagcgugguggcacucuccuguaaucccagcuacuugggaagcugaggcagaagugcuugaaccugggagguggaggcugcagugagucgagauggcaccacugcacuccagccugggcgacagagcaagacucugucuugggaaaaaaaaaaucaaagagcagaacagaaaaugaucccugagccuuggaauaaagccuacuuuuuaaggcaccugaaaccucuaacuaaaaacugcccucuggcugcacagaaaauacauucgauggaauucccaccuacauuauaugcggucgccuggcacugagaguaggaaagugggguucugaugucaacauccuucucccuggucagcaggauaauauauccagaugaucaaaucuagggacuaugaggccccaaacagccaaagaucuagauuagaagauccuuaggaacauaaauuauggcacuuauccuggucccuuguaauguguuuuaucuugcuaucacuuccacugcauucuaagcucuuauccauauucccaacacuuauuguuaaguacagcauccucucuguacagucaggcuuaagaaaggucuacugaacacuguugaaaaauccauggugaagaucccaguaucuugauauccccaggaggcuccaacuaauguccuauacucuguauggaguuugugagucauucuucucucagccacacacauacacacacagggaaaaacaaugcaaaaggaacaauuuagauuaggcaauuaggaaguucuuccaaaaacucuaagugaacucccaauagauaaugcaaaauucacuucuuaagcuauuuguaagaugguagaagcaucuagucucucagcucugaaaucugacaagaagccauagaaguucagaccauacaggauuucauggacauguuuaaaacgaaaaaaaaaucaaauaggcuuaguuuuuuuucaacauuuaaaacuuuuuccuuguagcauuuaaagugaauaauucucguauacccaggaaagaaucaacacccaugauacagucaaaccuaaaccauuuaucacaccuaaagagaagaugcucuggugcgucaugccaaugccuacauacuacuccccagucacccgaacaaugaguacucaaugcuacgcuuuccuaggccucuguuuucuccaguuacauaaauguaacacaaaaggaugaugcacuuggaaaaugucuucagccugacaaacggcaucucaaauugauuuuauuggggaagacaaaggacuggauuucuaggguuguuucuaguucuaggauuguuucuaacaguaguugugugacuuugaguaacuccuuaaguaagguaauauuuuaauacagagaacaugccuaauacugccccagacaccuaguaaauguuugcuaaaucagaaacuuuuaccauuggccuugcuaaaucugacacuauucuagacccaacuaaugaauggcauaguaagugucauuaccagcaacuugccccuaugugacaaugggcuaaugcauucauuuauuauuaaugugaaucuagaagguguuuuguggcugcccaggaugaagcaaaacgucccagugaagucaagaauugccaguguuucuagaaacuucugugggcaagaagcuuugcuugcccuccagaaagagagggaugaggggaacuggaacacuugagccaccuauaaggaugcaucuuuagugggcacugugguucaugcuuguaauccuagcacuuuaggaagccaaggugggcggauuacgugaggucaggaguucgagaccagcuugcccaacauggugaaaccccaucucuacugaaaauacaaaaauuagucccagcuacuuggcaggcugaggcacgagaauugcuugaacccaagaggcggagguugcagugagccgagaucacgccauugcacugcagccugggagccugggugacagagcaagacugucacaaaaaaaaaaaaaaaaaaaaaaauaagaaaagaaaagaaaagaaaggaaaagaaaagaaaaaggaugaaucuuuaaagugauuucauaucuauucaguugaguuuaccuauccauuuuaguuauguguauaauccagguagaaaaacucccauuucaauccgguuuauuagagucauuguugcugagccaaacggaauauaaagccaucuucauggggcucuccuucgucacagccacacuuacauaauaaucacagcagaaccaguuuaaagaaacaguauaauaaaaauugcuccagaguaguaugauuccaucaugaagacagcuaaaauaucaggugaucuauuugugucaguuuuacggacagcuuugcauugcauuucaaacacaaaaugcccacauaccuuaaaaaucaaauucaaagugauaacuaaaguagaagcaugcuuauguuuuuagaaauaucuucaucauggaaccugcaugagaaggaauguuuaaguaaaaccaagcugccaaguaaacacuuagaaaaaucauuaacacaaaauucuaucugaagggagaugcuagaaugacuugccaguuaauuuuagaacaggaagcugaugaucaucaaaaugagaaaaguuaaacugaaagggcaucagugaacacuaaauggaccuggguuuccuacaauaaucuccaauuucuggagguuuaucaucaauguaggucucuuaaaaaguugguaagauagccaagguaaccaaaugauuuuucacuuaaacaguaucuggcguaccaccuaauauuugggaaaauuagaacaaaaucagaagcuauuaaagcuuaggugaugcccuauaauuucagcaguuuuucaggucaguauguucauuaaacuugaaugcacagcauauauauuucccuuccugaaacauuggauuuaaaaaauuuccucucuaugucuacuucagcaaaaucuggauacauguuaucuucgacauuuaaacagacuugccaaucaaacuaugaauuauaaaguuuaaaaucaguaaauggauucacuuuuaaauuaugcuaacaaaucuuaauuagcauucaaaucuuaccugaagucuaaaauguuugacugacaugguuuuaaaauuauaagacacccaauguuuuagagaaucuggauaggagguuugaaaccacacagaauccuucccagagguagacugagaaaacagagcuaugcucaucaucugggccguccuugaggauguuauaguauacuugcugugucaaauuacuggaaggguaaaggcaagguuauuaagggaaacugacuuuaacauaguuuuuuuagaucauacuuuuguuuacuuuaugaagaagacagaacuagucuuuuuuuaaauuuuauggggggacagggucuugcucuauccucuaggcuagagugcuguccugagaugauggcucacugcagccucgacuucccaggcucaagugauccucccaccucggccucccaaguagcugggacuacgggcacaugccaucaugccuggcuaacauuuuguuuuuuuuuuugaaagacagagucuugccauguugcccaggugggucucgaucuccugggcuuaagcaauccacccaucucagcuucccaaagugcugggauuacaggccuaagcaaccaugccuggcagguacuugucuuacaaagcucaucacaagaucuuaaagcucaucacaagggcuuacauuucaugugaauucauuuaauuuuuauaaugggaaaggcaaggcacaaauguuuagaugacauccacgguaauaccugcccaccucacaagauugcacuaaggacccaauuacauaauaaacaugaaagcacuuuauaaaccaaaaagaucuaaguaaacauaauaaaugccuagguuccuacaguaaagaaugaaacuaugauucagucauggccacugcuuuuaucugcuucucaaauauuuaugggacagaaaucaccuagaggaccugucaaaaagagggcucuaauuggguagaucugggccagggcgggccaauagucuguguaucuaccaaguuccugggugaugccaaugccagcuucuggggccacccuuuugaggaaugagacucuaaaagaucauccuaauuccuggugcauggucagccuuagagaguauauuuccugaguauauugcagacuuugguuauccuuaaagugagcuuugggauaagucuauauacuacaucucauucugaauauaguacuuuacaaacucaguaucaaaguguucuuucuugggcaaccaaagagcuaaaggguugaauuuuaauuagcuugucugcuauuccguuuuccaggacaagcgucaacaacaugugaaagcauagaaagcuguuuugccaguucacuauuaaaugauuucaguucaucucaaaaggguggugggagguagggaaggacccugaacuuguaaucacaucccccucuccaaaagaaaaaccuggauucucaaa

SEQ ID NO: 15259 - RNA, 4803 nt, Homo sapiens
gguaagagguuucaaaauucacuuagugacuagcuaguuaacuucauccaaacagauagggaaagugauuuucuuuuuuuuaauuggcuugaguuguccugaaaaucgcuucugcaaggaaagaguccaggaaaaaacuggcaauucuuuuuuucuuaaucuaauaccaaauuuacagauuucuggcccuuauuuuacuuagcguuuguuccuuucaguuuacucuuugugaucugcauaggauaaaugaaaaugaaccauauaaucaaacuccaucauuacuuguguacauucaauaaauaaaaauuucuauaugcaugcaggauugucacuggcacaugaauuagaaucccaccucccuuucauccugaaccccaucccaacauuaaggggcagaggaaaggaauaaagaugcucaaggucauuuucaucuuuuaaagucuucaaaaacccgaaguuuaccaggauuuaacagagaaaaacugcucccauggucauuuuuuuaaaaauuuaaguacccuaccacuuuaagacuuuuucaaauuucaaauucaggguggugaaacaguccuacccuuacccaacacagguuaaagacuuuuacacguuguauuucaugucauuguaauaaaaacagcgauucaaacaaguaaaauagucaauaugacuuuuuucucucucucuuaauguauuacagugaaaaaugcuuucuuuucagaucugugggaacugcaaagguuuaagcacaacaaaucccaagaaaaauguaaauggaacaaaucuaaaccacguacgaguuuuuacucauguggcucucccaggcuucaggcacuguaaauagauuuguugugcuuuuagugggaagauauucagaauuuaacuagguucaacaaaacuauacacuccaccaccacucacacaaaaagacuccuaaaaaugucugcagaaaagacaaacuaccuuaauauuacuccaaauuccaaucaaagauucuuccaacauacaaucaaccauggcauuaucuuagaucaaggucacaaaaacaagcccuuggccuacaaucauguuguggcucuagaacguucuuaacaagcuuuccaggauacuucuuuccucuauuaagcagucuaggacccucucuauauuuuuucugaaaucaugaggaucuugucugaauagaccuguguacauaaaagaugcuaacuauucucacuugauguacaguacuuuuagaguuccauccagagacucugaguugggaaggcuggcauaccacacaggauuaggauuuaaucugaaaaugauaggcagaauacaaaucagaauucaagcagccugagccacuguucaugaugauggaaagguaaguggagacaaagggagcuaaaucacuuuccaggaaaaaugagacaaaaccgucccaagcacucuacauaacccaaucccauuugugucaccugccuuuuaaaauagaacguuacacauaguccucucuucaguuccaggcugcucaagggaguacuucuugagcaguacuuuuucuugaggaaauaguagaaagggcugggaauugggggcccgccucacuacuauugaaauagccuucccacagacccuucccauacaugacaugcagcaugcaaaauuacaauuauugaaaaaucaacaauaauugcaaaaagccaucugagaaacauaacauuuuaauagaugaaauaaauacuccaguacaugcaagguaaaaacuugacguugggggaaaaaaaaaucacucuauaguguaaauuaaaaaaacacacgcucacaguagcuuccccccauuugcaaaucacauggcaaauucauacucuuuccacaccaaguauacuccuaauucaacacgauugcuuaaaaaaaaaaaagacauacaaaaaaagguagcuacauccaugucuaaggagugaaaacugagguaaccuuucuuuuaauuaaaaacacaaaaaacaaaaaugaaaugaacccaugaccuccuuccugcccaauaaugaaauuuaguugagaaauuccggaagacgggcugggguagggggugggagugauaacacaaccagcagaugacauaucuuccagucccuacugcaugggggcugguggagagacaccugggcccuccaagugcgugugcagguugcgugcauggcccugccuuguggaagauuccucucgagcauuuaacguuggggaggguaggggguuucaccuaugauuucuuugguauaaauggagaggggcagagaguaaguaucuuccuuuagucuggggguggaagaagggguauggggguggggugcuaauucacagaauuggaauucacuggcgguaaaguccugggcgaagaccucucccuuaaagccugagauagcagggugcagccuucagacacggcgcaggccgaguuccucagccucucccugugguccgacaucuuggcgcccccgucggggugcugcgccagaucccugaggcacugggucaggagcacgcaggccgacaccacgcucauggcgccgcccaggauggcggucugcaccgccuugcccucggcgcucacagcugccgcgcgacccaggaacugcggcucgguggcgaagccuaccagggcgcucacugccugcaccaggggcccgcugaagagcgcacagcggcugcgcgccagcucacugggcgccaccuucaccucgcgcacgcaggccagcagcgccgacgcgcuggugcucaugcacuugacgcccagcuugaacugcucccgcgaaaagcggucccgugacuugucacuggccagggcgcacgcguccgucaggaacuugagguugcgcgacaggcccugcgacaccuccagcagcagcugcggcgucaugucggccagcggcguggcgcgcagcacggcgcaacccugcuccaccucguggcggcaucgcgucacgcgguagcgguccaccaggcccggcugcgcgggcugggcgcccggcguggccacagcggccagauaggccgcgugggccgagcacucggucagcgacaccaccaggucgcccagcuccaccaggcugucccccgccuccccgaagcggcccauguugagcuggcucugcacgucgugggugaggauggagagccccuuggugcgcgcgaugauggugucccggcacugcucgaaggacucggcgccggcaccagaggaggcggggcccucgaagagcacgggccgcgccucgcucgacagcagcagcaggucagccaccagcugcaucuugcccuugcaguggucgcagacggauaccagccucuuccgcggcugcgagcuggccccgccgauggcgcucgcaggagccggagaagccgccucgccagugggcuucccggcgcugccgcuagccaucgcgcccggggggcacuggcaugccgcuggggagcccgcuaccaccgccgcugccgcggccacugccgccgccccggcggccgucgcgacucagcuggccaaggccgcggugccuuccccgcaccaucaugccauccaccgccgcgggcagagggcacugggcugcggcggcgggagcccgggcggcgcggggugggcccgagggcgagagaacgcggaaggcucuucggggcaaggggaggggcugcagcuuucggccuccuagagggcuugcaggaaccaugaaccggggcagagcaaacucacuguccgcgcuccucgucgccgggcugccaggaaagucccuucugcugguucgccgccgccgccgccuucuugggcauggccuggcgcggcccucggagcggggagggcgggacggggaagcugggaguuguccuuccuuccuuccuuucuuugaaaucaaaauccuuuccucggggaggagcgcgggaggcagcucaggcgggcugugcugucagccgccgcgcucgaggccaccucgggcucggcggcgcacgugggcuucaggcgccgugaccccaccaggcggcacuuccccgcgacggcggccggggcuggcucucugggacgcgcggccgccccgggcgcaucuccugccuccagcucuugggaagcggcgccggcggcagcggggcagaggguguggccggcacugucgcggccgcgccgagucagagucgggcgggagccugcacugauugcgcacagcggccgcccggaucgcgcucaagcucucgcccgcccgccacacgcccgggcgugccgagcaccacggcggccccuucccgccucgccgguucacagagcgcggcccggcgccgcggcggcacgcccucccagaccgcgcgcccggcggcccggcgcuggcugucuacgcaaguccaucccugucgccucgucuggggcccgcagcagcugagcucucccgaggccccgggccccgcgcaucggacgccccugcacgagucucccugccaccgggccaacucagaagguccccgcggcgcugcggcaaccggcccgggccccggcuccugccauuuuugucaaccgccaacuuccgagcgagcgggcagaaacugaaaggaagggcgggggccgaaaggcagaggggaaaacacccgcuuccucuccgcgcgcggcuucaccucggagcgcggccguggcugcgccgccgcccgcaggggcugccggaggcuuuuccuguucccguccgcgccucgcccccgggcucgccgccgccgccgccucggccguaaccucccuggagccuauagaaaucuuuuguguggcgucaccgccuuucguuuaaaucccgcuuc

SEQ ID NO: 15260 - RNA, 4803 nt, Homo sapiens
gaagcgggauuuaaacgaaaggcggugacgccacacaaaagauuucuauaggcuccagggagguuacggccgaggcggcggcggcggcgagcccgggggcgaggcgcggacgggaacaggaaaagccuccggcagccccugcgggcggcggcgcagccacggccgcgcuccgaggugaagccgcgcgcggagaggaagcggguguuuuccccucugccuuucggcccccgcccuuccuuucaguuucugcccgcucgcucggaaguuggcgguugacaaaaauggcaggagccggggcccgggccgguugccgcagcgccgcggggaccuucugaguuggcccgguggcagggagacucgugcaggggcguccgaugcgcggggcccggggccucgggagagcucagcugcugcgggccccagacgaggcgacagggauggacuugcguagacagccagcgccgggccgccgggcgcgcggucugggagggcgugccgccgcggcgccgggccgcgcucugugaaccggcgaggcgggaaggggccgccguggugcucggcacgcccgggcguguggcgggcgggcgagagcuugagcgcgauccgggcggccgcugugcgcaaucagugcaggcucccgcccgacucugacucggcgcggccgcgacagugccggccacacccucugccccgcugccgccggcgccgcuucccaagagcuggaggcaggagaugcgcccggggcggccgcgcgucccagagagccagccccggccgccgucgcggggaagugccgccugguggggucacggcgccugaagcccacgugcgccgccgagcccgagguggccucgagcgcggcggcugacagcacagcccgccugagcugccucccgcgcuccuccccgaggaaaggauuuugauuucaaagaaaggaaggaaggaaggacaacucccagcuuccccgucccgcccuccccgcuccgagggccgcgccaggccaugcccaagaaggcggcggcggcggcgaaccagcagaagggacuuuccuggcagcccggcgacgaggagcgcggacagugaguuugcucugccccgguucaugguuccugcaagcccucuaggaggccgaaagcugcagccccuccccuugccccgaagagccuuccgcguucucucgcccucgggcccaccccgcgccgcccgggcucccgccgccgcagcccagugcccucugcccgcggcgguggauggcaugauggugcggggaaggcaccgcggccuuggccagcugagucgcgacggccgccggggcggcggcaguggccgcggcagcggcggugguagcgggcuccccagcggcaugccagugccccccgggcgcgauggcuagcggcagcgccgggaagcccacuggcgaggcggcuucuccggcuccugcgagcgccaucggcggggccagcucgcagccgcggaagaggcugguauccgucugcgaccacugcaagggcaagaugcagcugguggcugaccugcugcugcugucgagcgaggcgcggcccgugcucuucgagggccccgccuccucuggugccggcgccgaguccuucgagcagugccgggacaccaucaucgcgcgcaccaaggggcucuccauccucacccacgacgugcagagccagcucaacaugggccgcuucggggaggcgggggacagccugguggagcugggcgaccugguggugucgcugaccgagugcucggcccacgcggccuaucuggccgcuguggccacgccgggcgcccagcccgcgcagccgggccugguggaccgcuaccgcgugacgcgaugccgccacgagguggagcaggguugcgccgugcugcgcgccacgccgcuggccgacaugacgccgcagcugcugcuggaggugucgcagggccugucgcgcaaccucaaguuccugacggacgcgugcgcccuggccagugacaagucacgggaccgcuuuucgcgggagcaguucaagcugggcgucaagugcaugagcaccagcgcgucggcgcugcuggccugcgugcgcgaggugaagguggcgcccagugagcuggcgcgcagccgcugugcgcucuucagcgggccccuggugcaggcagugagcgcccugguaggcuucgccaccgagccgcaguuccugggucgcgcggcagcugugagcgccgagggcaaggcggugcagaccgccauccugggcggcgccaugagcguggugucggccugcgugcuccugacccagugccucagggaucuggcgcagcaccccgacgggggcgccaagaugucggaccacagggagaggcugaggaacucggccugcgccgugucugaaggcugcacccugcuaucucaggcuuuaagggagaggucuucgcccaggacuuuaccgccagugaauuccaauucugugaauuagcaccccacccccauaccccuucuuccacccccagacuaaaggaagauacuuacucucugccccucuccauuuauaccaaagaaaucauaggugaaacccccuacccuccccaacguuaaaugcucgagaggaaucuuccacaaggcagggccaugcacgcaaccugcacacgcacuuggagggcccaggugucucuccaccagcccccaugcaguagggacuggaagauaugucaucugcugguuguguuaucacucccacccccuaccccagcccgucuuccggaauuucucaacuaaauuucauuauugggcaggaaggaggucauggguucauuucauuuuuguuuuuuguguuuuuaauuaaaagaaagguuaccucaguuuucacuccuuagacauggauguagcuaccuuuuuuuguaugucuuuuuuuuuuuuaagcaaucguguugaauuaggaguauacuugguguggaaagaguaugaauuugccaugugauuugcaaauggggggaagcuacugugagcguguguuuuuuuaauuuacacuauagagugauuuuuuuuucccccaacgucaaguuuuuaccuugcauguacuggaguauuuauuucaucuauuaaaauguuauguuucucagauggcuuuuugcaauuauuguugauuuuucaauaauuguaauuuugcaugcugcaugucauguaugggaagggucugugggaaggcuauuucaauaguagugaggcgggcccccaauucccagcccuuucuacuauuuccucaagaaaaaguacugcucaagaaguacucccuugagcagccuggaacugaagagaggacuauguguaacguucuauuuuaaaaggcaggugacacaaaugggauuggguuauguagagugcuugggacgguuuugucucauuuuuccuggaaagugauuuagcucccuuugucuccacuuaccuuuccaucaucaugaacaguggcucaggcugcuugaauucugauuuguauucugccuaucauuuucagauuaaauccuaauccugugugguaugccagccuucccaacucagagucucuggauggaacucuaaaaguacuguacaucaagugagaauaguuagcaucuuuuauguacacaggucuauucagacaagauccucaugauuucagaaaaaauauagagaggguccuagacugcuuaauagaggaaagaaguauccuggaaagcuuguuaagaacguucuagagccacaacaugauuguaggccaagggcuuguuuuugugaccuugaucuaagauaaugccaugguugauuguauguuggaagaaucuuugauuggaauuuggaguaauauuaagguaguuugucuuuucugcagacauuuuuaggagucuuuuugugugaguggugguggaguguauaguuuuguugaaccuaguuaaauucugaauaucuucccacuaaaagcacaacaaaucuauuuacagugccugaagccugggagagccacaugaguaaaaacucguacgugguuuagauuuguuccauuuacauuuuucuugggauuuguugugcuuaaaccuuugcaguucccacagaucugaaaagaaagcauuuuucacuguaauacauuaagagagagagaaaaaagucauauugacuauuuuacuuguuugaaucgcuguuuuuauuacaaugacaugaaauacaacguguaaaagucuuuaaccuguguuggguaaggguaggacuguuucaccacccugaauuugaaauuugaaaaagucuuaaagugguaggguacuuaaauuuuuaaaaaaaugaccaugggagcaguuuuucucuguuaaauccugguaaacuucggguuuuugaagacuuuaaaagaugaaaaugaccuugagcaucuuuauuccuuuccucugccccuuaauguugggaugggguucaggaugaaagggaggugggauucuaauucaugugccagugacaauccugcaugcauauagaaauuuuuauuuauugaauguacacaaguaaugauggaguuugauuauaugguucauuuucauuuauccuaugcagaucacaaagaguaaacugaaaggaacaaacgcuaaguaaaauaagggccagaaaucuguaaauuugguauuagauuaagaaaaaaagaauugccaguuuuuuccuggacucuuuccuugcagaagcgauuuucaggacaacucaagccaauuaaaaaaaagaaaaucacuuucccuaucuguuuggaugaaguuaacuagcuagucacuaagugaauuuugaaaccucuuacc

SEQ ID NO: 15261 - RNA, 24207 nt, Homo sapiens
guuuuacaaucuauuaaacugguaaaugugaugcccaaggcuggcaaggauagaucuauuguuggcaaggguaagcugacuaaaccacuugggagggcaauuuggcaauacacaccaaaauguuaaauuccguuugcucuaauaauucuacugcuaggaauuuaccuuucagauauaaacaaaaguguaccgaaauauuuuguaugaaaauguccacugcagcacugaauauaccagcaaaaaaucugaacacucaaguguccaucagcagggacuaugcagugaaacagugguucaaaccucaccaucacccugcugauguaggacaccuucagcuauggccugcacuacugaagcaccucccagcucacggcucacaccugcugggguccucuucugaucacuucuccugugcaaccagugcaaccuggacugccuuucacacccaccccaucacaauuaagauccaccagggcgucccaaacuccuaccaaacuccaugugcuacgcuccuccaaccugggccugcacugggccccagccuccccgcuggccuuccugcugccucucccucugccacuucuagccacagggucuuagcucagacuguuuccucugccugccuuacucuauuucuccucuccuccucuugcccucagagaaggccucugguuuucuuaaccuggucagggaagauucuaccucccccuacccugccccuuucauacuucuaacagcugccauuuuacuuuguacauuacugacauuugucuucccccaccgaaucauugaguuuuacgauagcagaggcuguaucuacaccguccuggcaccuuguaguaccuaguacauaacagacacacagaaacuacugggugaagugggggcacacugcacaggaaacaaugagacagaucugcacauucugacaugggaaggcuccuaaguggaaacagaagguacagggcggagugaaagcuuugcuaccuuuugcuuaauuaaagcaauuaucucaucaaaacagcugcuuuauacugggccauuauggcuaugcaggacaguaaccccaucaaacugcccugaguacaacagaaaaagcccacagacagggcuugguucagccacggcaugauucagggacucguuuaugccaccaggguguggcgcucucuccccacugucagacaguucucuucuccaagggcggggccuacaacagcucccgcuccagguucaagaugcaggaggaacaagaaaagccucuuucagggccuaguacccuaguacgguagaucacacaggccucacccuggagagggcauggccuggaggguggggggacugcagggcaaaugucccauccaaagcagagaacugagaaugcagagggugugguucuuucgagggaaaugugagcagcuaccaaauuaaggggaaacagaugcugugaggccaaaacaaacauacaucaccauaaguacauuuacauaaguaaauguacuuuuuuuugguggaugggcagggagggggaugugggggcacaaauuguuaacagcagcuuccacugggacaagcuaccaccggcggcaagagagggauacacuuuucacuuuguaccauucuuuaacacugacauuuucuaaccauguaaugugcuacuuuuaauuuauuaaaaucacaauugaggguuuuucccaaagaauuuuaguucuuagaaaugacaucuguauauaaauguucuaacucuuauucacaguaggcucuaacaugaacggcaaaaucagacaucaacaguagcacaucauguuacucuauacgaaagcacagauuuaggcacuuuaucaaagaaaaauguuuagaaacaaaugagguuauugagucgucugucacacucugcaaaggacucugauucccuacuuaaauccuuuaaaacugucacauuaaauggaacauauaaccccucgacaccagcaguacucuuuccuaaauaaggaaacaaaacagaaccccuaacuuuacagaccacauaaaaccugacagacaccaagaguucucuuacugaugaguaagauucaagucaaagaaauucaaaacuacuuaggauuucaagugacauauuuucuauucuccgcauuuccugcauagauuuuggauuuacacacccuggcuuccuggcuacagacaucugaguucacaaagcauauuuuaccuuuaacauaaugaaaaugauguauauggcaugaagaguuuacucaauuaagucaagaguuuuaaagucuucucugaucagaauuugcuaucugaucagagcaggccacccaaucacagcaggugcuuggaggggaguggaaucucaguagaguugaugacucaccaaguguaaaugggaaaaagcaacacagucacauuuccauguaaggagauuuuauaguaaacaugaauuugucaguguccaguauuaauuagaaaacaucugucuucuuacuugaagccuauuaagcaguaauucuuugaccacaaacuggucauguggcagacccuuucuagaagacacuagaaugucauccggugugcaguugccugagaccacucccaccccaggagcugggcaaagagcucuccacguccaccuguccccccacagcgcgucacugcugccccaucacaggucuucucuuuuauucccagcucgauuuucuuccuuggaagaccgagauuucagaucuccuuccuucuuuuuuuugcccuugucuugcuuuguuuuauuuuucucuuugcuuccuccuccuuugccgggguacaccuggcccuccagaguuacaucagcacaccugucuugaccgaccaaaaaguccuugaucucccaggcguagcucccaucgcgaagcaugaagauagcacggucugaucccacaaugaaccuugggcagagagaugcaaucagucagccagcacguacuaguaaggugcuaaggggucagagcaauucucuggcacuuaucaguuuauuucaaauucuacaugaauauggaaugaaaaauuggauuuuccaaagccuagcagcuacugauaucucauguauuaaaauacuagcuugcugaacuauuaaacauccagcucagaucaaaauagaaacagacacuggauguuccuuuguuguauaaauggaugcccguguuaaaagugaacauuuggaaaaccucccuaggacacugcagagguggcucaggggcugcugcuggggagguaaagaggcagcuucgaucugaucuguaucuguuuuauauucuagaguguccaguuacacuuuuaugggacaaaagacuucugcugauaaagguggaaaaccaauggcuuagagugggucaugauaagaggcuaugaaggacucaagaggacacuugguuguuggacaaaaauccuagcccuugagcuuagcagcaagcugcccagcucguccacacucgaaaggucccaaggaacaaagcggaaagaaugaggccuggguggagcccuaguguggccagcgggcaagauucuucuguuccuuagggacuacaccacgcguucccccuucaguuucuaaugcucccaccacuccacagagaccagugggccuucuggagcagacaucaccaagacauuuauuuguucugucuaggugucuauuuaagcuaauugaaaauauuuugcuggccggacacucucuaaguacuccucccauuucuugucauugcuuuuauauuuccuaaaccagaauauuugcagaccccaaauuucagaacuguuuuugaggaaaaagaagcagauuucuuaaaauuguaccucaggaccauacucaagugugaaaacugagccucuucauacuaaauuaguuaucgguuaacagcaugguccaagcucuaugugugaacauagcuacacacaaagcacuuuccacugagcagaaacuucuagcugaagcugucaaacuauuaacuuugucccucaaagagucuaaacuaagcuauacacccuucuguucagaugaaauaaaagcuaaagauccaaagauaaauaaaacuuuaggaucaacugagauauuaaaaaaaaacacacacuaggcaugguugccagugacaguaauccuagcacuuugggagguugaggugcaaggaucacuugaggccagcaguucaagaucagccugggcaacauagugagaccucgccucuucaaaaaauaaaaacaaaaacuuaacugcuuuuaccaacaauaaaugcccuuuuuuuuuuuuuuucuuccccgagauggagucuugcucugccgccaggcuggagugcagugacgcaaucucggcucacugcaaccucugccucccagguucaagcgauucuccugccucagccucuggaguagcugggauuacaggcgugcaucaccaugccccgcuaauuuuucuguauuuuuaguagagacaggguuuccccacguuggccaggaugaucuugaucuccugacuucgugauccgcccaccucagccucccaaagugcugggauuacagaagugagucacugcacccggcaacgcucuucuuuacauuaaaaaaaucuagauaggcugagugcaguggcucacaccuguaauccuagcacuuugggaggcugaggcaggcagaucacgaggucaggagauugagaccauccuggcuaacacggugaaaccccgucucuauuaaaaauacaaaaaauuagcugggcgugguggcaggugccuguagucccagcuacucgggaggcugaggcaggagaauggcgugaaccgggaaggcggagcuugcagugagcugagacugcgccacugcacuccagccugggcaacacagugagacuccgucucaaaaaaaaaaaaaaaaaaaacaaacuagauagauaaauaauuuuaaaagaaaaccuagaaaggaaaggcagaggcccuugggaaauacggccagaaaggacacccuguuaagagccucaggaaaagccccagcacagggccaggugugguggcucacgccuguaaucccagcacuuagggaggcugaggcgggugcaucaccugaagucagaaauucaagaccagccuggccaacauggugaaacccugucucuacuaaaaauacaaaauuagccaggcaugguggcgggcgccuguaguuccagcuacucgggaggcugaggcaggagaaucgcuugaaccagggaggcggagguugcagugagccgagaucacgccgcugcacuccagccuaggcaacaagagcaaaacucugucucaaaaaaaucaucaucaucaucauaauuaauaauaauaauaaagaaaagaccgagcacagccuaugagucucucagcugguuguugcugcuuuaccucuggacgucauaguuggcauugaaaaggcugcccugccagaggcucguaauuuccucugucuccuucucaguagggcuuccugauacagugacaaacaucaugagagucuucccuuuuuucgucauuuucaauaugcuuucaggcuugcuugggucuaucuuugagaagucgacaggugcugaaggucucuugugcucuggaagaucuccuucuucaaugucaucaucuuucuaucagauuaggggaaaagcaucaaaccuaucaucagaaucuugcuuuucaacuggcacaggcaaaaacuucugcaugaugucaggugcauguauaugacuuaaauuacaacauaaaaaggaaaaccagggguuuucuuccucuucuuaacuuucaagauagucuaaguuucaggcagcacauacuacccacacccagguuaccaaucacagagcgcccccaugugauggguuucuagagcuuuuaaacucucauacaaucuacccaacaugguaggcuguaaaaauggccacauucugguauggucacacaaugaaauacuucacagcaacagagaacaaauacugauacaucuaacaaaucccaaaaauguuaagugacagaagccagauacaaaauaagauuuacuaugcaauuccguuuauuuaaaauucaagaaugagcaaaacuaaucuaggguaacagaaauuagaacaguguugccuguagaaggggggacaagggaggauuaacugagaauggacacaagagaacuuuucuggggugaugaaaauguucuacauuuugacagggguguagauuacacagauauauccauuuaucaaaauuuauugcaggccaggcacuguggcuuaccuuguaaucccagcacuuugggaggcugagguaaaacgaucacuugaggccaggaguucgacaucagccuaggcaacacaguaagacugucucuaaaaaaaaauuuaaaaguagccagguauggcaaugcacaccuguagucccagcuacagugaggcacaccuguagucccagcuacucaguaggcugaggugggagaauugcuugagcccaggaauuugagaucagccugggcaacauagugagaucccaucucuuaaaaaaaauuuaaaaauuagucagguguggcggcaggugccuguaguccuagcuacucaggaggcugagacacgaggaucacuugagcccaggagaucagggcugcaguaagcuauaauuaugccacugcauuccagccugggagacagaacgagacccugucuuaaaagaaaaaaaaaaaaagaaaagaaauacucccucuuugcacuguauacuuaaaaucugcacuccauguauacccauuucacuuaauaggcauuguacaaaaauauucaauuccaguuagcagguuuguuuucuguagugguaugggcuagcaauucugagacuaucuuaugugaccucuaggauugagaaaaggaguaaacauauugaggguaaugagagccagguucuuaacuucugggaaguaaguuacaaacaugaaagggggaagaaugagcccugugguauuaggcuggaauugaagguaucaggagaaacucaugguuuuucauagauuaacagaugaguaaacagauuaauggauaaaaauauuuaaaagagcguggguuccuuggagaacaggcuuauagcaagagagacagaagaugagccuagaauaaucccgcaucacaaaguaguaaagugcucaaagaaucgugaacaugucaaaaugccauggaagccaacuugaagcagcucucaugggccaaaguugaaauaaucucaacaucaaaauaaauaauaguaugacuuacaaccccucaaacaaaaugagauguugaacccauaaugaucaaaacaaaugaauaaauuacuaauagaaaacaguaacuuuuuuuuuuuuuuuuuuuuuuuuugagauggagucucacucugucaccaggcuggagugcaguggcacgaucucggcucacugcaaccucugccuccuggguucaggcgauucuccugccucagccucccgaguagcugggauuauaggcacgcaccaccacauccagcuaauuuuuguauuuuuaguagagacgggguuuugccauguugcccaggauggucucgaucuccugaccucgugaucugcccaccucggccucccaaagugcugggauuacaggcauuagccaccaugccuaauaaauagcauauagacugacaaauaaaaaaucuuuaauagaaccagguuccuuggagaaaaggcuaaugccagcaaccaaaaaaaaugaaguacuggcuggguaugguggcucacaacuauaaccucagcacuuuaggaggucgaagcuggagaucaccugagcacaggaguuaaagaccagccugagcaacauaucaugacccuaucucuaccaaaaagaaaaagaaaaaagaaaaaagaaaugaaguacugauugauacaugaaaauauuaugcuaagugaaagaagccagauaugaaagacuacacauucuaugauuccauuuauaggaaauguccagaauggauaaaucuguugagacagaagguagauaagcgauugcccggggcuggcuagggaguugggagaacacaggggaggagugguugaagguuucuuuuggggaugauaaaaauguucuaaaauugaguuuggugaugacuguacaauucucugaagauacuaaaacuaaaauguacacuuuacauggguaaauugccuauggcaugugaauugaaucucaauaaaccuguuaccaaaacaaaaaacaaaaaaaagccccuaagucacucuuacugaacaauaucugaagggccaaggcuuaagauaccauuaauaauguacuauauuaaaaauaauuuuaguaaaaaguaaaaacgaaagaauucuacgcagugcuugaaggugauccauaccgacgucagaccuggaaucugguuucaguuuugcauaacuagcugugugacccugccuaagaauccuuacgccucgaggccuguuuccucauuuacaaaaugaaaagcagaacgaagugaucuccaaggccccaguaacaugaccacacauaacacacuaaccuucuuuuccacucugccacccucucaacugacauguuucuuccucacuuugcuuucaaagagccacugauggugacuugcagacaggagcaugggcugugcugucagacggaugcgcuccaucacuauguggccuugggcaaguuacuuagcccaucugaaaauaacuuuccuuaccuauaauggaaagcugaggguaauaacagcuucucccuccuaagguuuguuuggggauguaaugacuuaaaggcaagcagaacucaguacuguaucuguuggcuaugacacugcugacucuuuaggccucugugaucuggccuccaaccacaaucacugcauggaaauuauacucucaagucacaaaggaccuccuaguugccaaauucacaaguuguuucugucuuuaucuuaauucuccauaacaucgguuauagucucuuuaaaacacuucaagacuuccaguugguucaauacccuagaauauuuguauuuuucagauugauuucacuaauaaucaugaaauuaacucaguaggucccaagcagcuuuuuuuuuuuuuuuuuuuuuuuuuagauggggucuuacucuauuacccaguuuggaaugcaauggugcuggugcaaucuuggcucauugcaacuucugccugccaggcucaagugaucuuccuaucccagccuccagaguagcugggaccacaagugcaugccaccacaccuggguaauuuauuuuuguauuucugguaaagacggguuucaccauguugcccaggcuggucucgaacuccugagcucgaaggauucacccgccucagucuuccaaagugcugggguuacaggcaugagccacuaagcccaguccagcacuucuuuguuaaugcaaauauaauuaaauagucguaagucuagugcauauaauacagguaaaaauuguuucaagagacuuaaaaaaaaaagcagcuuuaauuuccauuguauauguguguguguguuucaguuacagaaaagaaaauugcaaaauaguacccuaaugagccuggaggacauuauguuaagugcaauaagccagacacagaaagacaaauaccgcgcauucuccuucguaugcggaccuaaaauaguuguguucacauaaguggagauuagaauugugguuacuagaggcugggaaguggaggggagauagggagagaggauggugaauggauacaaaauuacauuagauaggaagaauaaauucuagugcucuauagcauuguaggaugacuauaguuaacaauaauuuauugcauauuuucaaacagcuaggagagaauuuuaaauguucccaacacaaagaaaugauuaauguuuaggagacagauaugcuaauuacccugaauugaccauuacauuuuauacauguguagaaauacaacucuguaccccauaaauauguauaauuauuauauguuaaaauugaaguguaaaaauaguacccuagauguacauaauuauccaguucuacccuuagucuggguaaccuaaccuguuaugaucaguguguuuaugcugaaaacaauccagucuuuacccugaggcagagcggggggccagggacaagucaggcaguccccugacuccaguccuagcccugccuccaggccagucuugcauuuucaacuggcuuuagagcuccuucauuacuguuugucuaagucaguagcuacaaagcugagcuccccuuucugcaaauccucuucuuccucccaugguucuugauauuaauaauaagugacaucuacuaaguagcuacuaagucccaggcacucuacauauauuaucuccaaccuucagaacaauccuacccgguuccauuuaauauacaaggaagaugauguucagagaggauaaaugauuuacuuaauuuacucacaugcuagaagugcaaaccacauuucuggcuccaaaucccuccaacugccucuucccauuauaccuggcuaucauaauguaaaauguaauaaccaccuuugguuuuucuacaccaauugggacucagaauuaguuguaacacaauggaaggaauucucaccucuccacaccucugaggcacagccucucacugaagcacuguuucucacacugcuggggaaggagugaggguauggauuuagagauggucacaagaggagaagaacugcuuccuacaaaaaaagcacccacagagauggauacgcucucccacauaaaaaacacugcuacuggggaagaguccucaugucuguagagcgucuacaaacauuaacucauuuaauccgcauggcacccugcaaaguagggcguuaucuggcuuuacagauacguaaaacuaggaugaaguagcuagugagggguaaagcugaguucaaaaucugucuuuuuuuuuuuuuuugagacagagucucacccugucgcccaggcuggagugcaguggcaugaucuuggcucacugcaaccuccaccucccugguucaagcgauucuugugccucagccucccaaguagcugggauuacaggugcccgccaccaugcccaacuaauuuuuuuauuuuuaguagagauggaguuucaccauguuggccaggcuggucuugaacuccugaccucaggugaugcacccgccuuugccucccaaaguguugggauuacaggcgugagccacugcgcccagccaaccugucuuuuuacuacauuauguggcccugcuauucacaaaaucaaucaauugcccaggcaugguggcucacgcccguaaucccaacacuuugggaagccaaggugggaggacugcaaaggccaagaguucaaaaccagcccagccaacauaaggagacccugucucuauaaaaaauaauuuaaaaaacaaaaucaaccaucaaguccuguuaaaaguauaaaaaucucacauuucucccuucuacucugcuccugcaguuucuagcuuaauccacgucuuccucacuauccuucauuugcacuucugucaccaacauguguggcaguacagguaaaacaguucaaagaacuggcucuaaaagucgcgaaagaauuugaaacucagcuagcuugcugugcgauguggagcaaguuauuuaaccucuuugugucucaaugucaucaucuagaaaauagggauaaguaccucccucauggaugggguaaaaggauuaaaugagauaauguguuuuucuuggccuucaaagucucuccccacucauccauccuguuaucuacuguucccagugcaaucuuuguucaucucuucagcacccucuucgucuagcucagggucugaguaggucaaggggaggauuucucaugaggugauguucucacucuggcagaucaaaaggcuuuauuugcuggaguccaaaaagagacaaggagauugcaagggagacggugaauggggacguucucucuacacucaaaucuaucccaaucuuuccaucagcuguugaugaccacaugaaaacacaagccugcauucuucuagucagaugcaucaggugguauuuuaaacucuugucugaaagucuuucccuucucccguaacacacacagagauaaucacaaaauaacaaaacaucaguguuggaaggaaucuuaggacccauccuaaccuccucauguugcagauaaagaaaccgaggccuagaaacuagacauaaccugcccaagguuccacagcuaugcaagucaaccaggacgauacaaucaccuuaggaaggggaaaaggcagcaaugugguuuuggccaguaaucuuuaccuuaaagcguauuacacacucccuguaacugcacacuccggugcguccaagugacaaaccagaaaacuuacucuccuuugaacaaaaagcgugaguuucacgauacagagccauuagccauugauacuucuccccucaguaaaauaaauccacccacaaaaagcacaaaauucccagcagggacauauaccaaaauaggaagucuaaaauuauacugauuuagaagacagcugagauaaccauuaaggaagaccaucuucacugcaacccacucucccacccacucaccgcaaaacagaaggaaaugcucuuuaguagauugggaaaggucacucucccuguuugcagggcucacugaccacaagaaucaacgcaaagacaaccagggcacugaagggugaagggagagcaaagcugaacagugaggggcagauccgugauugaagugguuugagaaauggcaggaggaacagggcacuggaaugacagagggcuggagcgagggucagcagggcgcgcgggucagaggaggaauggagggucaacaguggcuucagugggucaguaaggauucaaggcaugaguagaggagguuagggggucagaaaggucccaagacagaacagguaaggggucauagggaacagggucccgcacagagaagagccgggagggugugcgcgcgccgcggaccucccauugcuccagaagacgcgccaugucugcaucauuguaaucgcgaauauccuucuucuucuuccggggaggugggguagacucgucgggcgucccgggcgagccuucggccgcgcaggacccaggcggugguagcaguagcagcagcagcagcaggucagaggcacaaagcaggaccacggccuugcgcgcccaccuggaagccgccauuuucgcugcgccgcgcagcgcccuagacgcgcuuacccgaccugcgcgggccggaccccgccuugcacacgccuuccuguccgccuuuccgaggccccgccucccggcccucgcuagccuaccgggccccgccccguaccauuuccuaacccccgccucuggaagccccgccccuccgccauuuuggccccgccccacuggcuccuccucuugguccggcugaggcgcucugucccggcugggugggucccugagugcucauuuuucguuuuccgucagaggccgaccuuuuucucuggaacgcacaagccagguccaaaaguuccuucagggccuccaggaaccacuaaccaacgucccuguugaccucaguuucucgccugugaaauaaauuggaacuggaaguucuggaggcugccucggcucuaaaaaagcccauuucuggaugucggacguuuauccucagucucuugcaauuuccuuugagaacagccaguuaaaaagaagugaguggcagguagggcaacuuuuuucagaaagucauaaauaguucgaguccacugcuuuccucaucaauaaagaggauucaguucaaccagcuuucaauauuuguuuuuuuuuuccaaaaagaucauuacuauucauccaaaaaaaaaaaagcuugccuuucuuugauuucaaccuaauacuguaggcucuaacuaauccuuuucaaggcugaaucacgcuacuuuuuguuucuuaaaaagauuuuggccaaagaugcuuugagauucuucuuguuuuaaacggcucaucagcugaugucuuuaaaauguuuaauuacauaagaccuuaaaaaacaaaaaacaaaaaaaaccaaaggccgcacgguggcuuaagccuuuauaaucccagcacuuugggaggcugagguaggacgauaauuugaguuuaggaguuugagaccagacugggcaauaaagcaagacccgcaucucaaaaacaacaacaaaaaacgcuucauucuuuauacugcugcacaguuuuauuugguauuguuaaauuaauaguuuauuuuccuauugaugggcauuuauuaccaauuuuucugcuauuacaacaaaaaagagcuguaguaaaccuuauucaagccuuguuuggauaggauuaguaggcugcauauaaaagaaaacugacuuuuuaaggugguuuaaacaagauaaaagguuuuauugugauugacuuuucuuucacagaagcaguguaaacucgaaacuagggcugguauaguggcuucucagccaucugguacucagccucuuccucauccuucuaucauauuagccuguggcuuccacccucaaggucagaaauuccaggauggcuccuggagcuccagucaucaagaugacauucaaccagaggaagggagaaggcaggccaaaccaagcacaccuuucaaguggagucaacuucuuuuaagcagccuacuugaacauugcauacauuucuguuuacaucucauuggcuggaaccuagcucuccaagggaggcugagaaauugucuucuagcuguauacauugucaucucaaaugaaauuaggauuguuauaaagggaaaagaauaaaguggagguugaguaggcaacuacgccugcuuuccuucacucuuaggaccagugcaauuuaaauucucucacaccguaggaguggcugauauucuacauauucaugcaugcaucuguauguaaacacgcuaagcuaugaccuuuccuauugacguugagcagaaacaacucauaagaaaaagauuuuuucuuuugugaaaucauaggggaaaugucaugagcuuucuccccagagcacauugcuccacccaguggcuuggagcccuauccuagugcagucauacuaaaaaacaugcacagcuguggcugaucaugugcucuacugggaggggucacccugguaauucauauugccagcuucaaaguuaaggggcaaacguguugggauucuuggcccacauaucuaguuauagagaauaagaucauugaaaguuuuacagaaauuguugggaauguguagaaaguuucagggcuacugacuuuccucuaaggaggaaaucaauucggcauauaauccacugauaugaaaacaucuggaucaauugcauuuucaacauuuggauauuugaaacuuacuuuaguguuuggaacuugauuccauucaacuuggggggaauuuuauuuaccaaagaccuauuguuaaccaagaaucaggugaggcacugaugcaaaaaugaauauaacaauauccuuacucuggcagagcagauaaacaauaugcaguaaauuucaugcagauuacaggagauccgggcccaaagggaugaugugaugaugaugauaaucucuccaauuuaaauaagaggaaauccugguuuuacaauuacacaauuugucugaggcugcacagcuagugcagcggcaaggcaagaaucuaagccgagguguacuggauaacaagguccagucuucuuggaguccuucuuccgccacagcaccaucuagguuaaucagugaggcacucaggaugguuaaauugggagccaaauggaaaaugcauugaaaagucuggagcgaggagcacucagaugggacaagagucugugccagguaccagguggugcaguguagacuggagaggacagaugugaaagauugugugcucauggccuaagugaagccacaagucucuucagugcucugggguuaauacuaaccccaccucuaagugauucagugacuguggaugguaaaguugaaucucagaucuaauuagugucuuaaccugagcucauccuggcaugcaucauuccacaacagaggagggugaagcaagacuuucuaguacuauuuggaagcaggcggggguaauauucaaaauguugaaaaacuggaguagcacaauuaccaguuaaucagaacugaggcagaugagcugauggguacagucaccauugugccaaacauuaacccucuaaugacugacucaugggaaggcauaggaggagaggccuggggaugggcugagagagguaaugaguauuuaccauuuugcacuuuuguugcuuuuuaauccaauguaagaauagacguacugcauacuuccuggguuuuaccagccccuaaauuuacucacuuaaaaaauuuaauuacauagacacgaaucauucauuguaguugcuaaauauugguagcaacuaacucguugccuuuuguuggaauuucagauuuucaguagagaaugugacuggcccagucugaggcagguguccauuccuggucaccaccauuauuuuugggcagaagagcauacucacagaguuaaacauaauaauuaaaauuguguuuuccuggcugggcaugguggcucaugccuauaaucccagcacuuugggaggcugaggcgggcagaucgccugaggucaggaguuugagaccagccuggccaagauggugaaaccccgucucuacuaaaaauacaaaaauuagcugggugugguggcaugcaccuguaaucccagcuacucgggaggcugaggcaggagaauugcuugaacccgggaggcagagguggcagugagccgagguugugccacugcacucuagccugggugacagaguaacacucugucuccaaaaaaaaaaaacaacuuauaaaucaauaagaaaaagaugaacaaccaaaugaaaaacggucuaggacaugaauagguaauucccaaaagaauaaauauaaauggccaguucacauguggcaaaaacaaaacaaaacacagaaucucucuaauaucaaaaaaugcaaauucaaacauguuauaauuuuuaaauuaucaguugauccuggauaaaaauacagacaguauacacuguugacaaggcuaaggaaagaagucuucucacucacuucucgggggauggaguuuucugcuugaaaauuaggugaaauguaucaacucccccuccccacaaaaaagugcauaauaugauuagcaagucuacuuccaagaacuugacucugaggaaacagacaaugaaaauaauaguaauguuaauauugagcacuuacuauucgacaggcauucugcugagugcuuuccguguauuucuucacuuacccaauguaacaauccuauaacacucuccaugaguggggaaaaugagaacaacucuaaguguuucaaaaauuguagacuauaaaaucuacauuuacaguugcaagcuguauuccacacauaugauggauaauaugcaaucaaauauauauauuuguugcuacuaaagauauucauuuuauacuauaugauuuuaaaugcuauuaaaauuauacagauauauaucuauguauaggaaaagagcugcaaauauguauacgauggcugucucuaagcagugagauuccaaaauauuuuaaccuuuucucuguauuuucuauuuuucuucacaucuaacauacgucaguggugguguguuguuuuuguuuguuuguuuuuuugagacagggucuugcucugucacccagacuggagugcagcggccagauauuggcucucugcaaccuccaccucucaggcucaagggauccucccgccucagccucccauaccacaccuggcuaauuuuugcauuuuuuuuucuuuuuugagacagaguugcacuguguagcccaggcuggagugcaguggugcgaucucagcucacugcaaccucugccucccgggccccaguucaagcaauuguccugccucagccuccugaguagcugggauuacaggcacaugccaccauguccggcuaauuuuuguauuuuuaguagagacagggguuucaccauguuggccaggcuggucuugaacuccuaaccucgugauccacccgccuuggccucccaaagugcauuuuuuuuuuuuuaaaggauggguuuucaccauguugcccaagcuggucuagaacuuuugggcacaagugauccauccaccucgcccugccagagugcuggaauuauaggcgggaacugccgcgccuggcccacuugugcuuuaaaaggagagacacacauaaacacacugcugcuuacaaaaugugaauugauacccuucuuuccaccaauauguaagggugaaaagucuaauuucaauggaaauuaucagaauaauacauguaauucaaauuaucuacaauagugcaauggccuugaaaauuuggggaugagaucugaaucucugaagaaggcaggacuuuuaucugugucaucugaaaaaauuacauguacuuugcagcacagauauaugcaguuauguucagaaaauucagucuguuuccaaagaaucaccucccuggacuaucucaaacaagcuguaagaaaaaugaggugaacacacuugcuaagcaaacaggccucaggccuccccuucaaucuuaagaguugugagcuguuaggucaugaccagaccuagacuguaccccugcuguuguuucaugaauauccaugacuuucuguccguuacugaauaaaaguugugagcagccagaguuugguucaauaaaagggcaccuuucuugcacagagacuuaacagauaaaauaauucauuaacuuauuaaugccauaaacacugaauacauuaaaugugggggaaagaugcauagaucaagucccugcccuuacagagaugauaggguuguggagagaguuacaccaacaguuacaaguacuugacgccacucugaagcugagcaggcaucauaguagcuacaagggggggaagaaauaccugggucugucugaaagaucagggaaccuccuugugaggcaccaauacaucuaaucacucuguaguuacugacuacuaggcaccaugagagaugucaaaacuuggucaggcaugauuaguguuaagaccagggugccugaaacuuagcacuuguuuuuucucuucuucaggaugcuggaaaauagaaaauacauccaaagauggcuggccaguaaaugaaugggguacagaauuuauuaaucugugcaagcaaacuuugccuccauggagggugcucugguaaacuaaugcagaaaauuccagcucuccuagacuucaggaccugcaugcucaggugugccugccaagguauaacugguccagcacacagggcucccucacacacccagcugcaggugaacagagagaaagcauggagggaggaagggaggguggaaaguggggcuggggaggaaaugggagugaugugugagguacugcccagguguucuuacuggaugggaacaaaauaugccagagagcaagaggacaugccagguaaggagagcgagguguuagacagugaucuugcucccuggugaaccaggggcuguugucaugcaucaccuaugacaaugaaggaaucuggggaaaagaaggagagauauaaauuccucucuuuuacaacagauagugaaagggaaauaaugcauauguauaagaaagauagccugagauguaauuggcccaucugugugcacaaaagcaaaacagagggacauugcuccaaagggaaaaauaauuagggcagagaaugccucuuacugaccaacagguggcacuacagaccaaacacagcaugguuguuggucuguaaagugugggguagugugaaaguuggguaucaaaacccagaguggccagacaggcucacaccuguaaucucagcacuuugggaggcuaaggugagaggaccacuugaggccaagggugugagaccagucuggauaucaaagugagacugugucucugagacuuucucgcuacuaaauaaauaaauaaauaaauuuuugauagaaugaaaagauccggagugcuuacaauggaauaccguucacccauaaaaaagaagggaaauucccauguaugcuauaauaucaaugaaucuuaaagacauuauguuaaggcugggcacguggcucaugccuguaaucccagcacuuugggaggccaaggcaggcgcaucacgaggucaggagaucgagaccauccuggcuaacacagugaaaccccgucucuacuaaaaauacaaaaaaaaauuagcugcgugugguggugggugccugcagucccagcuacucgggaggcugaggcaggagaauggcaugaacccgagaggcggagcuugcagugagccgagaucgcgccacugugcucuagccugggagacagagccggaccucgucucaaaaaaaaaaaaaaaaaaaaaaaagauauuauguuaagugaaauaagccaggcacaaaauaacaaauauuguaugguuccacuaacaugagguaccuaggguagucaaauucauagagaaaguagaauggugguugccagggacuggaggaagggggaguggggagcaguuacuuaauggguauggaguuucaguugggcaagauuaaacauuucuggagauagaggauggugaugguugcacgauaauguacuuaacaauggguaagaugauauuaugcuauuuuaccacgauuuaaaacauaaaaacaaaacagaaugcccauaauguucucuuauaccaagugguggaugcaccuucuaaaacaggcaagagacgagguaaaagauguuuccccaauccugccugucucaaccugucaguuccucuuguccugcccaaauccucaguucucucuuugcaacuuguucacuuacuuuucaucagaugccuauuucaguguaggccuugagccaguauugagaaugcauucucuaggggccaggccauuuaccagcucccucucauccacuccauuuaccuucccucagccaauccucaguccacacauuuuccgcuuucuucucucacucaacauccauuaaaaaaaaaaauacuuaguccauuugagcugcuauaacaaaauaccuuagacuggguaauuuauaacuaauagaaauuuauugcucacagcucuagagcugggaaguagaagaucaaggccccagcaggggcccauuccucauagaugaugcguccucuauguugcugcauccucccaugaugaaagggcaaaagaggugaacaacucucucacaccucuuuuauaaggccacuaaccccauucaagagggcuccaccucaugacuuaaccaucucccaaaggcucaccuuguaauacugugacacuggugauuaaguuuuaacauaugaauuugggggucagaucacagcaaauacuuuugauuuauauuuauuuuaauuuugagaggguuagaagggguaauagguggaguuuucuaaagaaaaagccauugcuugagugacucuaagggcagacaccaacaagccauccucuaauuagacuaaaaauaugcaacagcaacagacaacccucaaaucucugugacuuaacacaccaauaauuuacuuuguguucacauugcauguccacuacagaucaagagggucugcuccacauggucaccuaagcuuacagaggcuccaccaacuagaaugcagucuccgugguaguuauaggagggcaagagaguggagaauuacagauuggcuuuucauugucucagccuagaaguaaccugcauagcuuccccuuacauuucauuggucagacagaaccacauggcccugccuaccuacaaauauuguaucugugaagccugauuaucucugcuauagguuuuuuacucugugcucucacugugccaauagugaaauuguggcuguuucuugugaaucuacuccuaucccuggacucuaaagagugggggccucauauuacaaauuauguaacuuuggugccuagcacaagacuggugcccagugauuguggagugauugaacaaucggacaaaguaaaggugaaccuaaagaaagguggaggcagugccugggaggaucaguuuaggagcuucccuaucugaaaaaugaagcagggaaggccgagaaaacaaugcuaucaguuuuaaaaaugaaaccaaaccucacugaauagaguggacagucuguguguaacacaacucauugucgggguggguuuccaucaacaacaaaacagacugcauauguagaagaaagggaaaaugggacccccaggggcacuacguggcuuuggaaaaaaaaucugaucuuagagcagccucaagaauaaacuaggcacagaacagucugacuucccucucauaaguuuuauuuauuuauuuauuuauuuuuuuuugagacggagucucccucugucgcccaggcugcagugcaguggcgcgaucuccgcucacugcaagcuccgccucccggguucaugccauucuccugccucagccucccgaguagcugggacuacaggcgcccgccaccaugcccggcuaauuuuuugcauuuuuaguagagacgggguuucacuguguuagccaggauggucuugaucuccugaccucgugaugcgccugccuuggccucccaaagugcugggauuacaggugugagccaucgcuuucggcccccucucauaaguuuuuggagcuuaagaaggacuaaggugcaaucccugggucaccauggaaaaaccuugacuuauccagcuguuuuuuuuuucucuuguagaagaaaaaaaggaauuaacccuacauaauuacuuccuauuucaagucaguuuuauugaccucgguuugcaaacuaagugggcucauccggauucuaaagauauuuaaggauacuuucaguuauaaguaggaugacuauccauccagguuugaaccugcuguucaugguuaauuuauuaauagcaugucucacaguucauucucagaaaugcuuggauauggccgauaaauugaaacgucauccuaguuaaaaguaacguuuuuaacuggcuggagaaaggugacuugggguucuaggaagggacagaggaacaaacauucuguuggcucagcacgcccagccuguguugggcugggcaccuuagaggaccuguuucaggacugcgugacuggcguuuugcugggaguagcccagguguuuuaaccacuuccugaagaacaagguucgguaaaaagaggcuggggcguaggcguggguuccugucccugccauaugcugucuuccugaucuucggaagucacuucaagcaccugaucaucaguuuccuuaucuguaaaacuggaguaguaauguuucccuccaaacgccgucguauuuaauucauuuaacagcagccacuauuauuccauuauacagacgaauaaauagacguuaugagagggcaaagugcgcugaucagggcucauaauaauucuaacagcuacuguuuaggaaccaaguacucaagcagccugugcacaaucucuaauuucuagaagagaagacggauacuuggaaagagaacuugaacaaugucauggaacucauaaauggcuugagaaaggcugauccuaggaaaucugcuucagaacccgcgcucucacugcauaaggcguauuucaagggaggaacgggcaggcaucuagcaccacucuucggacuccccauccagugcucuuuuccucuuuucguuacacugcacugcuggucggaaacccaucguggaaguggaucaaacacaacaaagggcagggggcguuggaaaaccgggcgaagucgcgcagaccgagacgacccaccggccccagcaaaucaccaggggccgaaauccaguguccuccucccuucagcccagaagccaggucaccuuuuagacuugcucucuuggcggggaggaagcguggagcccccugguccggcuaagagcuuacguaaggcccgcgggcggcugcgccccggucucccaugggugugcgcagagcccccgggccggagcaggccuuccccuguccgcucccccagucucucggcccaggaccacgggggaguucaggaccaccggcccca

SEQ ID NO: 15262 - RNA, 970 nt, Homo sapiens
cucugaaguucuggaaauuuaaugagacagggagacacugaucuuucaacucgauaagaacauguagacauuucagcaacuaauuggaaaaaaaugaaauagcuaugaugggaaugauaugccaggaugguaaagcuaggguccuacuauacauauccaccugucugagcauccuuagaggccacauuucuucuagugaccaucacucugaacucuugguucugcauauuucugcuaccccacuugucucugggacuguuggccccuuccagauuguauuucccuaagugacccaccaccgaggugucuucauugucccaaagaccacugcugcagagugguggaucauuuaucagacuuuagagagggcuuggggcaacaugaagggaguguagcugagcacaguacaagcaacaacuuaaaacuggccacuaggcaccauugccuggaaaacccaccacccauucucugcuuuggagaguuccucuccagccuguguucuccuuaaguccuggguuguggcuaccuucacaggccucccauucucuaaaugcuuuucauuucuugucugccaacuucuagccuucaauacuucugugcauuucuuuugcagaucaguuuaucuuucuauccacaaccccaaaguucaucuuagcuugccagaaacgaguugagacgcucugaucacaaaggaccaucuccucuaugcuucagcagcauaaugcaacaacugaagccugagauuccaguugcuuuuuucuccuuaauaugauccaguucuuagacaggucucccucccccaugugcuccaugugucucuuaaauggagagaguguacuguaaguauuuauucuccccugucuuaagcaagcuccccggcuucaucauaucuaucuugaucuuucuuuuuuugcuuggaacauguacaacagggaaaauggaagaaauccaaauauuuaauaauaggagu

SEQ ID NO: 15263 - RNA, 908 nt, Homo sapiens
aguuucuucagagcuuccuugaccucucgguuucuuaggcaauaaaugaaaggguugagagaaggagugacaauggcauagaagauggaaauaauuuuguucauguugaaggcauggauaacucgaggucgagcauacaugaaaauaauggcugaauagaaaauggugaccaccacaagaugggaggcacaaguggagaacgcuuucugcuuuccugugggcaugcauaauaugguggccagaaugcauccguaggacaggacaguaauaaagagugggaauaggaagaugaccagugccaggauaaagucuaccaacucaguuauggacaugucugugcaggagagauuaaguacuggagagaugucacagaagaagugguugaugacauugggaccacagaagcugaggcaggagaugaaguagaucuucgccagggagaugccaaagccaauggcccaggaaccaagagcgaggcggaagcagagcccauggcucauuaugguuggguaguggagugggcgacagauggccacauaccggucauaggccauggcggccagaagcacacauucugugcacaugagagcaaugaagaaguacaguuguaucauacagagugugaaagagaugcuguuguucacagaccaaaaacuaaacaguaacuugggcacagucacagagauguaccaggucuccaagaaggacagguuggccaggaagaaguacauaggcuugugcaguggccgauuuugcagcaccaauaggaugaugaucacguuuucagccacugucagaauauaggccacaaggaauaucagaaacauggcugcccgcauacucaagcucccagggaaucccaccagaaugaacuuggugacucgugucugguucuccaacuccauauu

SEQ ID NO: 15264 - RNA, 923 nt, Homo sapiens
gaugcccaauucaaccaccgugauggaauuucuccucaugagguuuucugauguguggacacuacagauuuuacauucugcauccuucuuuauguuguauuugguaacucuaaugggaaacauccucauugugaccgucaccaccugugacagcagccuucacaugcccauguacuucuuccucaggaaucugucuaucuuggaugccugcuacauuucuguuacagucccuaccucaugugucaauucccuacuggacagcaccaccauuucuaaggcgggauguguagcucaggucuuccucgugguuuuuuuuguauauguggagcuucuguuucucaccauuauggcucaugaccgcuauguggcugucugccagccacuucacuacccugugaucgugaacucucgaaucugcauccagaugacacuggccucccuacucaguggucuugucuaugcaggcaugcacacuggcagcacauuccagcugcccuucugucgguccaacguuauucaucaauucuucugugacauccccucucugcugaagcucucuugcucugacaccuucagcaaugaggucaugauuguugucucugcucuggggguagguggcggcuguuucaucuuuaucaucaggucuuacauucacaucuuuucgaccgugcucggguuuccaagaggagcagacagaacaaaggccuuuuccaccugcaucccucacauccugguggugucagucuuccucaguucaugcucuucuguguaccucaggccaccugcgauaccugcagccacccaggaucugauccuuucugguuuuuauuccauaaugccuccccucuuuaacccuauuauuuacagucuuagaaauaagcaaauaaagguggccaucaagaaaaucaugaagagaauuuuuu

SEQ ID NO: 15265 - RNA, 918 nt, Homo sapiens
ccaauucaaccaccgugauggaauuucuccucaugagguuuucugauguguggacacuacagauuuuacauucugcauccuucuuuauguuguauuugguaacucuaaugggaaacauccucauugugaccgucaccaccugugacagcagccuucacaugcccauguacuucuuccucaggaaucugucuaucuuggaugccugcuacauuucuguuacagucccuaccucaugugucaauucccuacuggacagcaccaccauuucuaaggcgggauguguagcucaggucuuccucgugguuuuuuuuguauauguggagcuucuguuucucaccauuauggcucaugaccgcuauguggcugucugccagccacuucacuacccugugaucgugaacucucgaaucugcauccagaugacacuggccucccuacucaguggucuugucuaugcaggcaugcacacuggcagcacauuccagcugcccuucugucgguccaacguuauucaucaauucuucugugacauccccucucugcugaagcucucuugcucugacaccuucagcaaugaggucaugauuguugucucugcucuggggguagguggcggcuguuucaucuuuaucaucaggucuuacauucacaucuuuucgaccgugcucggguuuccaagaggagcagacagaacaaaggccuuuuccaccugcaucccucacauccugguggugucagucuuccucaguucaugcucuucuguguaccucaggccaccugcgauaccugcagccacccaggaucugauccuuucugguuuuuauuccauaaugccuccccucuuuaacccuauuauuuacagucuuagaaauaagcaaauaaagguggccaucaagaaaaucaugaagagaauuuuuu

SEQ ID NO: 15266 - RNA, 551 nt, Homo sapiens
uuuuuuuguuuuuguuuuuguuuuauuuuaguuaaacaaucauuuuauugcuugaguacacagacaaauuuaugcgaccagggcagaggcuguagaugauucauauuuccaacugggagggaggacucgcuuggucuuauaauauugagccaaacggugaaucuggcucucuaucagaaucagauggaauuuagcauccuuauccuuucuguuccucucaagaugcuuugaacagcaacugcuuucuuaauuaaaugguagagaucuucaggaagaucaggagcaagucccuuagacuuaagaauucuuaaaauuuuauugccugucacaaaacguacuugugcaacaccaugugauucucucacgauuacaccgaucugugaaggaguaaggcccuucuuggccaguuuguaaaucugcuccuucacgucgucagaugucaacuucaaccaaguggggaagcugcgucgauaggguaaagccgacugggacaggcccuucucaggagcacgcauacgacccaugauggcggcgaucaggcaacgaaaggc

SEQ ID NO: 15267 - RNA, 19327 nt, Homo sapiens
uaagugacagugcuccaucugaauauccuuacaaauugcuacaaugcagguuuaccuggggugcaagcacagcaaacacgugcuuguaguccauuugauuuuuucuccgauacauuuagaaagaagugcuuaggccgagagccauaaaauaaaaacauacaauaaguccaagucuuuucuguauaugcugugauuugauaaucauauugauaaaacauguguaaaggccuuuauuggaaggcaugauucugauccauuuugcauucuuccaauuuucauuuuugcuauuauaccuaauuguuuaucuauaaccuagagcauuccagcaaaagcggcccuuuuaaagcuagagggaaaaaggccacacugguuuucuuaaaguaacuuccaaguauuuucacuauaaaugagagagaaaaguuuccaaauugaagaaguacauagcucccagaaagcacacugaaaacuaugcagaauaauuuuugaucaggcuggaggacugugccaggcuccaaacaagugguuauucuguugugacaucugccaggcaaugcuuccauuguucucuggaauuuaauucauuuuaaauuacuccauccaaaugauaaaacaugagaugugcuauaauccagggguaaaaugcuaugauuguuuuuaguguggccacaacuguuugcugggaggaaauacagccuguucuaauuaagcccugauuauugucuucugaaaaauagcuaguuccagaaaugugagugaaauccuguuaaauggaaggguugggauaaacacucuuggccacucugguaugacuuuaaaguugggagggccauaugcaaagacuuccuacaaaguagagcaacaaccuuuggaaaagaaacuauuuuuggaacuaaaagcagcuugggauacugguuuacuauaagguauaguuuaauauguguaucaguauagucaacacaucauuuuacuguucaaagacuaccaugcaaaugccuccaaauccaaaauauucugccuaacaaaugcugucaaaguuccuaaaugggaacacugccuuauggaagcauuaaagaucaggcacugaauuaaaaaaacaaaaaaacccaccaccaagaugaaucucagaagaaaacacacaugcacacauauaagaauucauaucucuuguaugccaaauauuuaauauaaaucuuugaaacaaguucagaugaaauaaaaaucaaaguuugcaaaaacgugaagauuaacuuaauugucaaauauuccucauugccccaaaucaguauuuuuuuuauuucuaugcaaaaguaugccuucaaacugcuuaaaugauauaugauaugauacacaaaccaguuuucaaauaguaaagccagucaucuugcaauuguaagaaauagguaaaagauuauaagacaccuuacacacacacacacacacacacacacgugugcacgccaaugacaaaaaacaauuuggccucuccuaaaauaagaacaugaagacccuuaauugcugccaggagggaacacugugucaccccucccuacaauccagguaguuuccuuuaauccaauagcaaaucugggcauauuugagaggagugauucugacagccacguugaaauccuguggggaaccauucauguccacccacuggugcccugaaaaaaugccaauaauuuuucgcucccacuucugcugcugucucuuccacauccucacauagaccccagacccgcuggccccuggcugggcaucgcauugcugguagagcaagucauaggucucgucuuugacgucacagaagcgauacaccaaauugccuggucggucauugucauaaccagagaagugaauucugcccccuggcagcugcuuagcaggagggcucaccccaaucuucauaaauuuucucuuguggggcuuuuugaguuccaggagggcauaaucauaauccaugccgaugucauuggcauugcccuugauccaacccuugggcacaugggugcguuucacccggauccacugaaauuucaucugcucgggcauggcugaaguggagucguuggccccucgaccaccaucuuuaaacuugggcuuuaggaagcccacucgaagcuucuggguuccuuucacauagguuuuuccaucguguaugcagugggcagcugugaggacaugcuucucugccaccagggugccggugcagcccguggauaacuucacugauguugagaaaggguaguugagcaggaaguccuucccaaaaaugcugaaccugcugucauagccauaaaucugccgcuuccuucgagacuuuccugaagacccugagucucgguguugggccccaucuccacuacugcugaggauguagaugcccaccugcgucucugugcggcugccauuggcauagagcguuucauaagacagauauugcuuggccucuucguaagugggcaguggaguucccuuaugacacugggguccacaugaagaagauacuucuaauuuggcuucggcuccaaagucuggcuuggcuaaauugaggguagacuggggcaagacgacagggaggcgguaugcaggccaaguggguuuccagggggcacuguaagggcucacuugcccaacagcacagagcagaaagaagagaaggaagaggagcccuggaaucccugccaugccgagcacuguucuguagaaacaaagacaagcaggucaggagggcaagggcugaacguucauuuacugcagacagcaaagcucagcagcaggccugucauuguuucugagucuuugaacacuccucaggaaucaggguguggagaggaauccuuagauaacggucucacuuucaacgcaaaggcucaaccuuaggaaaguuccuguggcugggugccugaagugaaauuggguguuccuuccuuucuauguuuaagaugucccuaaugaugguagacugcagaguagcaggcauaaagucauuaguccccuggcuaacugacugaccagccccaauuuccacguaauuuugagcccucuuugugcuugauucuaaaccuccuccucuucuaccuucaugauguccccgccuuucccuccuccuucucucauucucauuguaacauguacuuggaaaauuuucagagcaacuuggucacucagagggucaauuuaaauuacauggcuuacugagugacugagacaucaaagaaggacagcuccacagugucacaauuaccaccacuccugugguuuuuaaaugauggugcacucgagaaaggguaugagauuuuuuguuuuguuuuguuuuuugcuuugaauuuacaacaaccuuuacuauuauauauauugaguuccagaguggcuaggcuucuaauaaaauauuccuucuuccuuuggauuauguuguacacuaccaggaucuuugucaauaucuaaagcucuaauauugcaucagcuauaacacuaugaacuguuaccauugguuacuuuuucaguuguuuauaucuguauuaccaacuaaaucucuuaaauuugggccugugcuagcacucgacaaagauuuguuaaauggaugcuuguauuaauggaaaagugaaugaauguugcaugcugacgcuaaugacaaugauguacauggaugaugcgguagcucagagaaacagcuugaggccaauugugggaguaagaacaagagaggccuucuaggagaagugaugcuugagaaauaguaugccacagccucgcuccaaccucucaauauagaggaccaaauguauuauuuggcaaaugcacccguucuuuucaaauguacccaccauuuagaagcaauaggaguccuaguaaaggugacaccguggagcugucccuccuugaugcuucggucauucaguaagcuauguaauuuaaauuuacccucuaaaugaacaaauugccuagaaauuuuccaggcaucaccugauguuucagaugggugcugaaguagaaaagaagucugauaacauaagacagagagaaggggauacuuagggaagggaaacaagagucugugcaagggcacagcaacaugcaaccaugugaguaauuuggggaaucacacuuagcucagcaaggguggaguagaggaagugguggaggcagcaggcaagagcuagauugugaagugcuauguguacuaaacaaagaaguuuggauuuuauacugcaagguauguuuaaaugcccagaucaaucaucccacaagaaaaacaacaacgaggaauacugaaagugcuuucauaaauguuuaagcaucaguuggcucucaguggcucugacucuucugguucaauagaagcugacucagcagguaggguaacucauucacaaccaagcauccaaaaacaaggacccggaaggggugggucucaagaggcucugggaacacagcagaaguuaggaagaaacuguuuuguuauucucauucucuuccuguuugaaaguacagaucuacuggcaacuuugggugccuuuugcucccuuuuauauaaaaguagaaaaucccaaugaucugauguaguauagcugagcaugcccauucucauucccaauauccacacuguguuucuaacauaugugugugccccacccaccucugggaccuuuuugcuugacuuuuucucuuggcuuccacuucagucagggagaauagggauaggaaaagaaagaaauaagguccuggaaaagccaguuccuugggacucccuaauuccuugaaauucuacuugucuccaucuuuccaaauaggaagggucccugagcccuuuuguaggaaggaaauacauuuaauuauuucuuuaaauccuugaaaacauggggugcccgcauaugugcacacacguguuuguaugugcuuguugggaauauugccaagacuaaagguuuuaaguggacuaggaaggggaugccaaugcuagcugaguccuccucuccaauggagaacuuggcagugaaauggguguggugaugacaacccuuuaggagaucuguggggcaugguucugauuauucccaccuacuggcuaaggagucaucccuugggcuuaucgaggacuugagcagccuuuucucuauauaaguugcugucuaggugacuaaaugccccacucacaccagaaucccugccaaaugugacagggacuaggaggagucauauaucucccacauggcuguaucuugggcuucaacgcaccauucucuccucccuuugaguaauguggggaauguuaaugugacuuacauugagcacaugguaagccaaguuuuacuucagcuuaucuuaagaaagaaaacacagaaugcggagguccaaccugccaagcguucuuguuuuuaaaauacgauucuugggggagaaagaguaggagaugagguaguauuauaguauguauuaucaucagcuacagauaauauuuucaaugugcaugaagaacauggcaguuacaauauccucuuucaugagccacagccuuacuccaaccucucaauauagaggaucaaauguauucuuuggcaaaaugaugaaugauuaugucucaagaaacuuugggaucaguuaugaaucacagaauccuguuagagaaugcuaaagagucuacugcaugauagaauauuacuaauucagaguucuuacaacuugaauucuguucauuuagccaggagugaaggagaagccagccaucuauaagaaaaaaacaaacugcuaacccaacaggacagugugaagcuuuaacuuugaagaauaaauuuuucagagacuuaauaaguccuaauuucuauuaguuugcaacucugcuuccaaguucuccacauuacuaaacccuauuuacuaacuugugugauaagacuuuguucugacagcauuauauaucuugcuuaaagcuuccauguaacgcuaaaaguuauaaaauugcauuuaaaaaaguuuaauucagauuuagaaaugaaugcagacuuuuagaaacuaaugcccaucaaauuacuucaaacugauuaggcuuagauauuuuuaaaauaucuaaucagaaauuagaagauacagcuguggguucucaagcccuuaaauggguuuaaacugaugucuguauuaaagcuacaagcuucuuaaguugcuuaguccuuuaccaaauguuuauuuagggugcuuuagaaauucuucugaauagcauccucaaccagaugauugcuuuagcuggucuuuuuagcucuggucuuuagguccaggauucccuaauauuauaauuuuccagaaucacguaaguccaggucagggacgaugcugacuauagugucuguacuaucauuuacuucucaggaccauugauucauggaauuauggaggguggaggcaaaggagggggaaaggaaaaggaaaaggaaaaugaaucaugcuaauuucucaucuaucuggcagacaagauuucccugaucagucugcaacaggaccacuguuugagagaaugauuuaacuccuauagcaaacaagugcugggagggaaaaccuaauccuuaggucauauauucucuauuguacaaauugugacuccagcagaaggcagcuuucaagaacugaguggagggauggcuguguguguaugcucuuaagacaggccccaaagaaaagccugagggggaaacaacccuccuguccauuaagggucuuuccugaggcauucgcagccugcccugacucauccgcauuaauaaaacaacaaaugaugcaaaacugugaugcuuuaaaauuagguugguggauuuacauucauuucucaacucacaugauaauggaguaauuccuuagaagacaaauaauuauuguuaccaucuguauaaacccuggguaagccugugcuauaccuguuuaaguuuacuuaaacauaaacacucaucuaagguauaaacagauguaaugaaaacauucauaaucccacaccuggaaagguaacuaaugaguuacaugauuuuaaauucucucucacccuuauaaaugaaucaccuuauccuugcagagcugccuggaagacucacaccuuaaaaauggaaugaagauuuucaaaucucacccuuuuaccuaagucuggaugaagaaaauuuaggucuauaacguuucauuucuaggaauaaacuuuugcugaauaaagauuccugguauacauaaauuaucuuuuaagguuuccaaccaaguguuuccgugcaucauuucaccuaacuggcagggaagaauggaaaaugaagguaagaaaauauuuuuucaccaugcuuaguaauacagaaacuauuccuuuuccagcuuuggguaucugauucauaaauagguuacacaguccacccuccaucacucaauaugagccacugucugaaaauauuuauacuuuuugaggaugcugccacuucauaggcccuugguggugggacuuugcauaauuaacagauaugcaaacaacaaucucuuuggagacuggaugcagugacuacugucuccugcacggcaccuuagucuugaaaacugcaacaacacaggucuccucaagagggccacuguuugagagaaugauuuaacuccuauagcaaacaagugcugggagggaaaaccuaauccuuaggucauguauucucuauuguacaaauugugaauuccugcagccgcuauaaacaguaaugacagaaagaaacggcaggaaaguuugcaaagauacagguuuuggacaccauuuggagagaugacaaagggucuuccauggaaucaguggucagugauauggaacggugaaaucaugcuaaauccuaaagcaaaugcuuaagaaugaaccaagcucugugaauacucugcagucgggcuuguucucguuuuccugaaucacagacccuauuaaggcaaaacagaccuaaucacauaaucguuuaagaauuacagucuuguacaggaaacuacaaggcacuuacaaguccaagcaacccuaaacacaaucuuguggucaaaugaaguuuagccucuucucuaucggauuucagguaaacuaaauugagccugggacaaaccuggcagaacaagaacagagugcaaaaaaaccugcuaauauugagaacaugagaaacaaauucccuggagucugugggaguuaggcaugaauaaugccugguggaugaaauccuaagggaucuaugagaagaguuacugggagaaccugagacuauuaaccauugcagacuggggacaaaaauguucucagaugcauuaauggacacuuaugcuacaaccagaaaaugcauccauguuaaccauccagcugaauaagucgucaguguuacaaaaaugagauccauauuaggcaccuuggaaaaaggcuuccuucccaguucaggcacaggaaaggacaaguuaccgcuugacuuuauuuaacuaggaaaacugcaagugaaacaaccuuuucguacgcagauggggugcaaacacuuucacaaauaaacauaguggcuucugggggcauuuucuaaguuccuucuccccacuucaccuccaauccacuccugacagacuucaugguaggcacgguuauaaaccugucacaaauacucgcaugcacaaguaggaucuugaaacaacaugcaauaaauauccugauacuacuuugacauagggcuuuugaccacagcugaccucaucuauaaauucaauucuuucucacaugaccaugugaugaggauucuggcacuggccuaccuguuccuaaggagugcacagggagcccucaaauuuaguuucaggagcugagagaagcaagcccuauuccaauaccuacacugagcugcuuaauucuuacuggugucacccagugggcaguaaaacaaacaggauuuuuaucagcugcuuucuccugaggugcuggaaagcaaaccuaauuuguauucuggagaggaguggugguguuccuucaucugaacaagucuucucccgcuccuuuuaaaacuuuaaaacuuuuauuuaaaaguuaacucgugaugaaugccuacaggcagaagaacuauuugcuuacaacaacuguuguuaguucagacuguagugucuaggguuagcacccccggaacgcacacggacaaccacuccggagaaaagauucuauuucccagccuguauuugcugcacuuuugcacuucucuugcuugcuuagguguguucacaaucacaugcccaggguuaaaacuuaauauucagaacuugauggaauccgguauaugcaaaacucaaggaaaagaaguagugguggugguguguugggggggugcauggggguguagccaucgcccccgccgaaggacagcuugccgagagccggcucucucugcuucccaaccaacauccugcacccaagacagcaggaucuucuuuccccauccguuucaugggugacacugcaugaauccaaaugaccugcagcccccgccgucuccccagagcuccuucaggcccccagcccguguccuggaaccccgaggacugcccuggcgaaguccugcggugccuccggcagcccgcaguuacccuaccccgcgcauacccggcccuuugucccgcuccucccggcgccucgccucucccgcgcccgggcggaugccccagucggugcccgcacucacccgcgccgagcagcccgcccgggccgcggcucgcugcgccgcucagacaggugugggcgccgggagagagcgcgcggcucccaugccugccccgccgcacagccgagugcgagcaagcuggcgagcagcgcaggcagcuggcggguccgccccccgcgccacccgaggcccgcccgccccgccuccggccucggggaagccgcgcggacgccgcccgccccacugcacauaaaccgugccccccuccccucgccgcucgccugcggccggagcaggguggagcagcccagagggccugaggccgagcgucccugcgcaggugggccccgguggcgcggcagcagucgccaguccgggccucucggcgccaggcagcaccggcucuggcgggcucuccugcccgggacccgcgcgccgucacccuuugaacaccgcgcauccccgggucuggcgcgcggccuccugagcgagacuacggccuucgcugcugggagcacgcugccagcucgcaaaaagaccagguccccuacaaaaggcgaccccucccccaacagccuagaacuagggacgcgggccacaccugguguauggggagcccugggcaaauuugaagaauugguucagaaccugugugcgccccacccccacguacacuuuuagcgccuuaaggugcugaccgaacuccuaguuucuccggugccuccaaagaacagaaaccuguauucccauggcagggccaccaaugcuuugcauuuccuuacagcacucagugcugugcguggggcccaaagcaccgggggugcuuggcagcuucugagcggcgguggcuggggagcccacuggccucaguucuucaucggggcaccagcugguggagccaccuccuuguccagugggccuacuucccugaaucacuccaagcggucguuaucuuggugguggugguugggggccaggguaggggggugugcggggaguccucuccuaaccaggcuggagaccuugccauuuaagguccuaguguuagagccuuccuauuuaguauagauuacuguguauugagcguuuucggucaagagcuuuacauauaggccauuguggugaagaaggugcagagauuacacuaauuuuuauaaggaacaggagguuuggagagguuuuaugacuugcccaaaaucacacagcuacugaaugguaggacaagauuuugcacugagccaugcuuucuaucaagcuacuuagcuuuccuuucuccuaucaaagucuacucucagaaagggaaggucuaaagugcuauuucacaccaagguguuacugauaugccuaauacguugguguuugcaauuacuuuuacaugagaaagcccugaacacauuauuguguggucuuuucuuuuauuuuauuuucaagacaaguacucccucuguagcucauucuggagugcaguagcaggaucauagcucacugcagcguagaccuccugggcucaaguauccucccuucucagcaaguauuacacgcgugagucacugcucccggccugguauuucuuaaauagaaaggaaacugauauuuuccaccauuuuaagggcaaauuuuucuuagcuuagcuucaauuguuuucuuuuaaaaugucacauuaauauauagagacauaggccaggcucaguggcucacgccuguaaucguagcacuuuggaagaccaaagugggcagauugcuugaacuuaggaguuugagaccagccugggcaacauggcaaaaccccaucucuauaaaaaauacaaaaaaccuagccaguugugguggcacacgccuguggucucagcuauuugggaggcugaggugggaggauggcuugagcccaggagguggagguugcaaugagcuaugaucaccacugcacuccaaccugggugacagaccaagacccugucucaaaacacacacagacacaaaaccagauauaaacuuauguuacagcuuuugaacaacucgcaaauaaaaccaaaacagauuuauaaaaauuuucuuccagaauaauaaaauugaaauuaguaacguuuccuggacuacuaucagcauugcaugguacugacagcugaggcgucaguaccuuugacuucccuguggcucugccacucucaugaugugugaggugcccaaugcagacucaauucucucaccucuuuccuucguuccaucuaccauaucuccuuugcccacaccauaugucauugcaauggguuucucuugacucuaauacauuauuuagguauuugugcuguuucucucuuauuagcauagcaagugaagugguaacucuugcugccaaagacuaguacacacaggugcugcaaucaagaggcaguacuuggcaugagauggucaucccaaugauccagaauguguuuaucuuuuauuauaaaaauuuuaaagauuaaauugaggaucucuaagugucuguagcucccaauugaagaaacaccauuaaaagguaaguaucuuaauagaggaacuggaggugcagcuggaaggaagggaagaagggagagauuuaucaaccaugcucaaguuguauuagagucacuucaauccaacaaauauauauugagcacauauuacauggaaaacauugcgcuaggcacaaaauuaaagagaugcauauaggaggaccauacagcaacauaauuaagaguggccuguggcaucugacuaugggguaccaauccaaggucugacgcuuacuaguuguguggcuuuucacuuaacuuuucuguaccucaguuuccuccucuguaaaaccaggacuuucucauagaguucuuuuaagaauugaaugaauauacauagugugcuuaggagaguuucuuacauggaacaagcccuuaauaaauauuagguauuguuauauuuaucacacuuggcucugcuucggaguguaguccuccaguaccaccucagucagcuuugacauucauugcucauuuuuuuccuaguaguugcaauguuucaaguuagagucauggagaacaagaugauuauucccaucacucagagagaaaaacugaggcacagaagggcccaagagcacaacaguccuucaucuggucucagggacuaccgcccacuauccaaagagcuaauaggaaggacucuuuaacuacagaugucccacgggggcucaggguuugaacaugcaccacaagcuuuuguuguuccucagagcuaccaagaguaaaaugagaggcuacuuccuggcuguuagguugucaucacgauugccauaaggacgaugauagaacuguauuuugaccucugagacaaaugaccaauguaaacagcagaugucuucaugcuaagauuagagguuugcuuuucuuuuuguacucgucccauuucccuccccaguggggagggggucgggggaaccaaaaccgaaauccucacugcuucuuaagaacucaguucaacucuauaauuguaauucccgaauacuuuuuauaugcguagcaauggaguuguucaaaaugcauucagggcaaagcccacacauuuucugaucauccacucuguguaagguuauuugggcugucagggagagaaagcaaauaccccucagcucgaggaauguaugcaauggacauaaacaaaaucaaauauaggagaaagcaagauaucagcuggaucaggauacagacaugagcuagagaacauggaagagggaaucauuaauucccacucuggcaggugcugaaagcuuugagguagaauuugagcugaagcucaaagcauaaaaaucuggacauuaccucacuguguucacaaaacuacuuuguaacacagacaagaagaaaaauauccacuguauagaugagaaaaucaaugcauaaauuaagggagcagaacuaggacuaaauuguaucuaugcuuagugaaugcauacuauaugccagguacuguggaguauauuuuauuauguguaaucuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuauguguaaucuuuaagacaaauagagaagcuaugauuuucuucauucugcagaugaggauucugagguucaaaguuuuaaaauagucuacucggugccauacuacaguacaaaggaucacagcugugaccucugcccagucugccccauucuuuugcuggauuccauuguguuauauugcuucccagacuugccuuuucccguccugacaauaaggagguugcaucaguuucugaugucacuccagcucuaaguauccuuuugauucuaucuugcuuuuguuccaguuauguaauaacucacgaaugaccuguuaaauaaccccaaagcaggaaacaagaugggacugaaugauacuuggaagcuuaggguggcaugaccagcacuaacucuaaacucaaccucaacucaacuaaauuuuagugcuuauuuuuuaugagaccaagauccauauguagccucaacaauuuaagucaguuugaaaguuaucaaaaaggauuaugucuaaggagauaaaugggcauauuucaaaaucauuuccauaugguuucauauuucuuugauaauaauaaaguguuacguggaucuuguaguuuacucaguaaguggggguuuucagcucuguguagugagugaaaagagaauuggaaugaaagucaacacaggguggggcauucuaaaugugucuuagccauagaggugcugugugaccuuggguaaaucaccacacucauuggccuugauuucuugucuguuaguagagaaccuagauaaccugcuguuacagucuuugagcuuaugacauaguaauccuuacgggaagaugauccacaucauuuuuuaauuuuggggcacccacggugccuaccaugggaucccggaguagcaaaggaugugaaauucuguggucagacugacuuggauucaacuuagaauucauuuauucguugggugaaugugggcaaguuacgugaccuucugugccucacuuuucucaucugcacaaugagacugauuuagggguguuguaaagauucagugagauaaucaguacaaaacccauagcaucgagcucagcacaaaguaaauucuaaauuggcaauacguauuauuauuauaauuauuauuaucauuacuaucacugcugcuauuguuacuacugugaaugcucaauaaauguuuuugaaaauuguugaaugaauaaaugaauaaaucaaacuguuauauuauccaugcuaaaaaguuuaauccagacuuuauaagaaaaaauguaucccaggacucccguugacacccccaaaucuugucuucagucuggucuacaggcaagagaguuuuaauauugaauucaggaagaauuauagauucaaaugagagccaugguuguauuuuuugucuccuccuccaaucuccucuaugguaccaucaguucauucauugaacaauuaccuauugaaccaugaauauuacaagguuuauauauuugucaguguuuuuuuagggcaaaaucacauuuuucuuauaauguuuaauuuaaaauuuuccuuguaaaaaguaaaacccccauaguaaaauuccuguaauaaaaacaaaucuaacaagauaaaccacucaaaucucuacagcacuuaauacagaaaacaaauauauuuguauuacauucaaaacuuucuaaaaauuucuauuuuuguuaaguauagauuacucauuuuaagucuuuggaaacauagguagucaggcacucuaaauguaaauaugugaagguguaauauauaaaagcuuaacauacaaaauuauuguaggguuaaauugucauauugguacauaugguaggaaaaaaagagcugcacagcaaguaaaagcuuuacucuaauccuacuuagaauaugccaaucuaaaauuaucagaaagaaaaauagacuugaguacuugcaauuuccuguaugcucugggcacuauuguaaacugaaauauugggaacauuuuggaauaacuauguguuucucauuuucucuggucaaauuugaagucuccaaauuugaaguggccagcauggggcuucucugaucuacucuaacuugcauacuggaucuuaugaucaagaacaaaagagaaaaugaagauuuuauauuggaaauuuuuuuucugaaaucuuuacaacuuuaaaaaucuuuuauggaaaauuauuuuguuuucaauuuuuguuuauauuuauccauaaauguuggauucucuuuuuacuccuuuauaaggaguaagcuuucaugugguucaguguggggucuggauauuugaauuugggucuuuuaugagguuucuccuuuacuuuguggaaaauucuauucauccuucaagcucaaauaucagcuguucucugaaggcuuccaaacccuucggugcuagauuuguaaguuuaacuuauguuuuuuagaggguuguauuaaaauuauaucuuauguuguaauuauauauauuuacauguugaaacucaagcaguccagagcuccuuaugaguaggaaaucugucuuguuuuccuuuuuagucuuuauaguuuucugcuauagucuagcagagaaccuagcucuuuguaaaggcuuauuuaauguuaauuuaauaaaugauuaaauuaaugaauaaaauucuaauugguuaaaaauauuagaucagaaauaauuuagcuugccagccacuaggaacaggacacagugaguguacaugaaauuuuaccacuggggcucucacacucuccagaauguuaaucugaacuuccauuuagggucuguuuaccauuguuuccuuacaguucaugucagauaacaaauucaguuuccacuuggccugcuaauuacauuucacuacucacgcuauggcuacaugguggcauucuaggugccauuuguccaugauuuaugacauuugacuggcuuucugcagaacucuuugcaguaugcucugaauuuggccacuacaggguguucugaguugcucuaccauggagucccccaggauuaaagaaugcuauuggacaauauguguuucccaaauucuauucccucccacacuucuggaagaggucaauaaauugccuguaaaaaaagguaguuaaauauggauauuaccauuucaaauacucugagaagucuugcauaaagaaaucuaguuaagcucguuuaucucaaaggugcccaaucuuauuugaccacggaauccuuuuuucaauacagaaguaacaguucacaauauagaagccuucuaaagaacagaauuugagcucaggagcucaagacuagccugggcaacauggugaaaucccaucucuacaaaaaaauacaaaaauuagcugagccuagugacgugugcuuguagucccagcuaccuggggggcuugagccugggaggucaagguugcagugagcugugacuguaccacugcauuucagccugggugacaaagugagacccugucucaaaaaaagaauggaguuugaaaaacgucauccguaaguuuaccccacuucuacaauugaaccacuucuguucccaagaugugcucugugcuuuuuuuuugccuugcugucuuuguucauaucugaaacucuuucauauccaucugucuacauucuguccauuuuucaaaggccuaacacaauguuacaucuucuacaaaguauuuuuguuggccuuugauuucccauaacacuuucuguaacuuucucauagcucuuguaauuuuauucguuuuauuuucagcuuauguuucuccuccccuacuguugaauaccaugaguuugcaucucuggccugcaccuuuuuuggcuggguguguuauucagggucuuggcaauagcacauugguucaaaugaugauacuuuaaugaaguggcuacuuauggaggugaagacaggguagagggaacaaacaagccagagaggcauccagggucuagcagcagugggaagccaucacucaucugggcaggaggcagaaaggagaaaaugcugucccagagcccagugagcaugagcaccuuggagggaagccugcuuccaauugccgaguaguccauggagaguugcagcugcugcaagaaauggcuccccaaggacggaggaaguuggaaagaagcacccugaccucuucucuuccuacucugaucucccgaggccuaccaaagucagcucacaagggagucagguugugcugucuguaaggaccagccuucugagcacagugcaggguagugaaggguggagaacucaugggagagaggcagacagaaaauaaucagcacauugggaaagccugcuucaaaauagggguagugaccaguacccuccucacagggcuguaaggagauuauagggauuucauuagaaaauguauccaaauauuaacauaucgcacagagccugauucucaaauuauuuuagcuagucauaagaacccugugaauagcuacugguauaaaagcucauugaagaagaugucaugcauugcuuauuuuucagcucuuacacauggcagcauaggcccucugagcaguaggaccaugaauggaugccaucaggugugccacggggagccaccuugaacagaggucacagggaagcuaguuuggcuguuuugacuaaaaucaucagucagucugaccuuggaaaacagacagcagugagcugacuuuaagacuuauuuuuaacuuucagcagauuguucuggcacuucuuccccacagucuaggccucuagguuuuccuuugucucuuuguggaggugagagcugcugaaaaacaagugagcuugugaaaagugccucacagccaucacuggaaauggcaccaauuugucacauuugaaagccagcuagagguggcuggcccagggguucagcaggaggauuuguacuuacagaagcaaauugcuuccuccuuuuucagaagaguaaccuguuuuauuucaaacacaggaucaccuggcuccuucugcccuccgcacacagauuagggaaaccacaagaauaaucauccauguguucuuuucacuucaaagcccugcagaaugccacaagggcugguucucccaccugaaacaagagaggcccuuccagggcugugcugguuuaagaaagcccuuuccugggaacugggggagugaggugggacuuaccagaugaaggcaaaucugugucagacaaggaagccacacagguacccuccacugcagcucugcgccugugcuccuggaggaagggugaguuugcagggugacagcucuguggaaccugucacacugacagaggcaaugaaggucacacugggaugagauuccaguacugacaccagcagcugcagguaggg

SEQ ID NO: 15268 - RNA, 19327 nt, Homo sapiens
cccuaccugcagcugcuggugucaguacuggaaucucaucccagugugaccuucauugccucugucagugugacagguuccacagagcugucacccugcaaacucacccuuccuccaggagcacaggcgcagagcugcaguggaggguaccuguguggcuuccuugucugacacagauuugccuucaucugguaagucccaccucacucccccaguucccaggaaagggcuuucuuaaaccagcacagcccuggaagggccucucuuguuucaggugggagaaccagcccuuguggcauucugcagggcuuugaagugaaaagaacacauggaugauuauucuugugguuucccuaaucugugugcggagggcagaaggagccaggugauccuguguuugaaauaaaacagguuacucuucugaaaaaggaggaagcaauuugcuucuguaaguacaaauccuccugcugaaccccugggccagccaccucuagcuggcuuucaaaugugacaaauuggugccauuuccagugauggcugugaggcacuuuucacaagcucacuuguuuuucagcagcucucaccuccacaaagagacaaaggaaaaccuagaggccuagacuguggggaagaagugccagaacaaucugcugaaaguuaaaaauaagucuuaaagucagcucacugcugucuguuuuccaaggucagacugacugaugauuuuagucaaaacagccaaacuagcuucccugugaccucuguucaagguggcuccccguggcacaccugauggcauccauucaugguccuacugcucagagggccuaugcugccauguguaagagcugaaaaauaagcaaugcaugacaucuucuucaaugagcuuuuauaccaguagcuauucacaggguucuuaugacuagcuaaaauaauuugagaaucaggcucugugcgauauguuaauauuuggauacauuuucuaaugaaaucccuauaaucuccuuacagcccugugaggaggguacuggucacuaccccuauuuugaagcaggcuuucccaaugugcugauuauuuucugucugccucucucccaugaguucuccacccuucacuacccugcacugugcucagaaggcugguccuuacagacagcacaaccugacucccuugugagcugacuuugguaggccucgggagaucagaguaggaagagaagaggucagggugcuucuuuccaacuuccuccguccuuggggagccauuucuugcagcagcugcaacucuccauggacuacucggcaauuggaagcaggcuucccuccaaggugcucaugcucacugggcucugggacagcauuuucuccuuucugccuccugcccagaugagugauggcuucccacugcugcuagacccuggaugccucucuggcuuguuuguucccucuacccugucuucaccuccauaaguagccacuucauuaaaguaucaucauuugaaccaaugugcuauugccaagacccugaauaacacacccagccaaaaaaggugcaggccagagaugcaaacucaugguauucaacaguaggggaggagaaacauaagcugaaaauaaaacgaauaaaauuacaagagcuaugagaaaguuacagaaaguguuaugggaaaucaaaggccaacaaaaauacuuuguagaagauguaacauuguguuaggccuuugaaaaauggacagaauguagacagauggauaugaaagaguuucagauaugaacaaagacagcaaggcaaaaaaaaagcacagagcacaucuugggaacagaagugguucaauuguagaagugggguaaacuuacggaugacguuuuucaaacuccauucuuuuuuugagacagggucucacuuugucacccaggcugaaaugcagugguacagucacagcucacugcaaccuugaccucccaggcucaagccccccagguagcugggacuacaagcacacgucacuaggcucagcuaauuuuuguauuuuuuuguagagaugggauuucaccauguugcccaggcuagucuugagcuccugagcucaaauucuguucuuuagaaggcuucuauauugugaacuguuacuucuguauugaaaaaaggauuccguggucaaauaagauugggcaccuuugagauaaacgagcuuaacuagauuucuuuaugcaagacuucucagaguauuugaaaugguaauauccauauuuaacuaccuuuuuuuacaggcaauuuauugaccucuuccagaagugugggagggaauagaauuugggaaacacauauuguccaauagcauucuuuaauccugggggacuccaugguagagcaacucagaacacccuguaguggccaaauucagagcauacugcaaagaguucugcagaaagccagucaaaugucauaaaucauggacaaauggcaccuagaaugccaccauguagccauagcgugaguagugaaauguaauuagcaggccaaguggaaacugaauuuguuaucugacaugaacuguaaggaaacaaugguaaacagacccuaaauggaaguucagauuaacauucuggagagugugagagccccagugguaaaauuucauguacacucacuguguccuguuccuaguggcuggcaagcuaaauuauuucugaucuaauauuuuuaaccaauuagaauuuuauucauuaauuuaaucauuuauuaaauuaacauuaaauaagccuuuacaaagagcuagguucucugcuagacuauagcagaaaacuauaaagacuaaaaaggaaaacaagacagauuuccuacucauaaggagcucuggacugcuugaguuucaacauguaaauauauauaauuacaacauaagauauaauuuuaauacaacccucuaaaaaacauaaguuaaacuuacaaaucuagcaccgaaggguuuggaagccuucagagaacagcugauauuugagcuugaaggaugaauagaauuuuccacaaaguaaaggagaaaccucauaaaagacccaaauucaaauauccagaccccacacugaaccacaugaaagcuuacuccuuauaaaggaguaaaaagagaauccaacauuuauggauaaauauaaacaaaaauugaaaacaaaauaauuuuccauaaaagauuuuuaaaguuguaaagauuucagaaaaaaaauuuccaauauaaaaucuucauuuucucuuuuguucuugaucauaagauccaguaugcaaguuagaguagaucagagaagccccaugcuggccacuucaaauuuggagacuucaaauuugaccagagaaaaugagaaacacauaguuauuccaaaauguucccaauauuucaguuuacaauagugcccagagcauacaggaaauugcaaguacucaagucuauuuuucuuucugauaauuuuagauuggcauauucuaaguaggauuagaguaaagcuuuuacuugcugugcagcucuuuuuuuccuaccauauguaccaauaugacaauuuaacccuacaauaauuuuguauguuaagcuuuuauauauuacaccuucacauauuuacauuuagagugccugacuaccuauguuuccaaagacuuaaaaugaguaaucuauacuuaacaaaaauagaaauuuuuagaaaguuuugaauguaauacaaauauauuuguuuucuguauuaagugcuguagagauuugagugguuuaucuuguuagauuuguuuuuauuacaggaauuuuacuauggggguuuuacuuuuuacaaggaaaauuuuaaauuaaacauuauaagaaaaaugugauuuugcccuaaaaaaacacugacaaauauauaaaccuuguaauauucaugguucaauagguaauuguucaaugaaugaacugaugguaccauagaggagauuggaggaggagacaaaaaauacaaccauggcucucauuugaaucuauaauucuuccugaauucaauauuaaaacucucuugccuguagaccagacugaagacaagauuugggggugucaacgggaguccugggauacauuuuuucuuauaaagucuggauuaaacuuuuuagcauggauaauauaacaguuugauuuauucauuuauucauucaacaauuuucaaaaacauuuauugagcauucacaguaguaacaauagcagcagugauaguaaugauaauaauaauuauaauaauaauacguauugccaauuuagaauuuacuuugugcugagcucgaugcuauggguuuuguacugauuaucucacugaaucuuuacaacaccccuaaaucagucucauugugcagaugagaaaagugaggcacagaaggucacguaacuugcccacauucacccaacgaauaaaugaauucuaaguugaauccaagucagucugaccacagaauuucacauccuuugcuacuccgggaucccaugguaggcaccgugggugccccaaaauuaaaaaaugauguggaucaucuucccguaaggauuacuaugucauaagcucaaagacuguaacagcagguuaucuagguucucuacuaacagacaagaaaucaaggccaaugaguguggugauuuacccaaggucacacagcaccucuauggcuaagacacauuuagaaugccccacccuguguugacuuucauuccaauucucuuuucacucacuacacagagcugaaaacccccacuuacugaguaaacuacaagauccacguaacacuuuauuauuaucaaagaaauaugaaaccauauggaaaugauuuugaaauaugcccauuuaucuccuuagacauaauccuuuuugauaacuuucaaacugacuuaaauuguugaggcuacauauggaucuuggucucauaaaaaauaagcacuaaaauuuaguugaguugagguugaguuuagaguuagugcuggucaugccacccuaagcuuccaaguaucauucagucccaucuuguuuccugcuuugggguuauuuaacaggucauucgugaguuauuacauaacuggaacaaaagcaagauagaaucaaaaggauacuuagagcuggagugacaucagaaacugaugcaaccuccuuauugucaggacgggaaaaggcaagucugggaagcaauauaacacaauggaauccagcaaaagaauggggcagacugggcagaggucacagcugugauccuuuguacuguaguauggcaccgaguagacuauuuuaaaacuuugaaccucagaauccucaucugcagaaugaagaaaaucauagcuucucuauuugucuuaaagauuacacauaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaagauuacacauaauaaaauauacuccacaguaccuggcauauaguaugcauucacuaagcauagauacaauuuaguccuaguucugcucccuuaauuuaugcauugauuuucucaucuauacaguggauauuuuucuucuugucuguguuacaaaguaguuuugugaacacagugagguaauguccagauuuuuaugcuuugagcuucagcucaaauucuaccucaaagcuuucagcaccugccagagugggaauuaaugauucccucuuccauguucucuagcucaugucuguauccugauccagcugauaucuugcuuucuccuauauuugauuuuguuuauguccauugcauacauuccucgagcugagggguauuugcuuucucucccugacagcccaaauaaccuuacacagaguggaugaucagaaaaugugugggcuuugcccugaaugcauuuugaacaacuccauugcuacgcauauaaaaaguauucgggaauuacaauuauagaguugaacugaguucuuaagaagcagugaggauuucgguuuugguucccccgacccccuccccacuggggagggaaaugggacgaguacaaaaagaaaagcaaaccucuaaucuuagcaugaagacaucugcuguuuacauuggucauuugucucagaggucaaaauacaguucuaucaucguccuuauggcaaucgugaugacaaccuaacagccaggaaguagccucucauuuuacucuugguagcucugaggaacaacaaaagcuuguggugcauguucaaacccugagcccccgugggacaucuguaguuaaagaguccuuccuauuagcucuuuggauagugggcgguagucccugagaccagaugaaggacuguugugcucuugggcccuucugugccucaguuuuucucucugagugaugggaauaaucaucuuguucuccaugacucuaacuugaaacauugcaacuacuaggaaaaaaaugagcaaugaaugucaaagcugacugaggugguacuggaggacuacacuccgaagcagagccaagugugauaaauauaacaauaccuaauauuuauuaagggcuuguuccauguaagaaacucuccuaagcacacuauguauauucauucaauucuuaaaagaacucuaugagaaaguccugguuuuacagaggaggaaacugagguacagaaaaguuaagugaaaagccacacaacuaguaagcgucagaccuuggauugguaccccauagucagaugccacaggccacucuuaauuauguugcuguaugguccuccuauaugcaucucuuuaauuuugugccuagcgcaauguuuuccauguaauaugugcucaauauauauuuguuggauugaagugacucuaauacaacuugagcaugguugauaaaucucucccuucuucccuuccuuccagcugcaccuccaguuccucuauuaagauacuuaccuuuuaaugguguuucuucaauugggagcuacagacacuuagagauccucaauuuaaucuuuaaaauuuuuauaauaaaagauaaacacauucuggaucauugggaugaccaucucaugccaaguacugccucuugauugcagcaccuguguguacuagucuuuggcagcaagaguuaccacuucacuugcuaugcuaauaagagagaaacagcacaaauaccuaaauaauguauuagagucaagagaaacccauugcaaugacauauggugugggcaaaggagauaugguagauggaacgaaggaaagaggugagagaauugagucugcauugggcaccucacacaucaugagaguggcagagccacagggaagucaaagguacugacgccucagcugucaguaccaugcaaugcugauaguaguccaggaaacguuacuaauuucaauuuuauuauucuggaagaaaauuuuuauaaaucuguuuugguuuuauuugcgaguuguucaaaagcuguaacauaaguuuauaucugguuuugugucuguguguguuuugagacagggucuuggucugucacccagguuggagugcaguggugaucauagcucauugcaaccuccaccuccugggcucaagccauccucccaccucagccucccaaauagcugagaccacaggcgugugccaccacaacuggcuagguuuuuuguauuuuuuauagagaugggguuuugccauguugcccaggcuggucucaaacuccuaaguucaagcaaucugcccacuuuggucuuccaaagugcuacgauuacaggcgugagccacugagccuggccuaugucucuauauauuaaugugacauuuuaaaagaaaacaauugaagcuaagcuaagaaaaauuugcccuuaaaaugguggaaaauaucaguuuccuuucuauuuaagaaauaccaggccgggagcagugacucacgcguguaauacuugcugagaagggaggauacuugagcccaggaggucuacgcugcagugagcuaugauccugcuacugcacuccagaaugagcuacagagggaguacuugucuugaaaauaaaauaaaagaaaagaccacacaauaauguguucagggcuuucucauguaaaaguaauugcaaacaccaacguauuaggcauaucaguaacaccuuggugugaaauagcacuuuagaccuucccuuucugagaguagacuuugauaggagaaaggaaagcuaaguagcuugauagaaagcauggcucagugcaaaaucuuguccuaccauucaguagcugugugauuuugggcaagucauaaaaccucuccaaaccuccuguuccuuauaaaaauuaguguaaucucugcaccuucuucaccacaauggccuauauguaaagcucuugaccgaaaacgcucaauacacaguaaucuauacuaaauaggaaggcucuaacacuaggaccuuaaauggcaaggucuccagccugguuaggagaggacuccccgcacaccccccuacccuggcccccaaccaccaccaccaagauaacgaccgcuuggagugauucagggaaguaggcccacuggacaaggagguggcuccaccagcuggugccccgaugaagaacugaggccagugggcuccccagccaccgccgcucagaagcugccaagcacccccggugcuuugggccccacgcacagcacugagugcuguaaggaaaugcaaagcauugguggcccugccaugggaauacagguuucuguucuuuggaggcaccggagaaacuaggaguucggucagcaccuuaaggcgcuaaaaguguacguggggguggggcgcacacagguucugaaccaauucuucaaauuugcccagggcuccccauacaccagguguggcccgcgucccuaguucuaggcuguugggggaggggucgccuuuuguaggggaccuggucuuuuugcgagcuggcagcgugcucccagcagcgaaggccguagucucgcucaggaggccgcgcgccagacccggggaugcgcgguguucaaagggugacggcgcgcgggucccgggcaggagagcccgccagagccggugcugccuggcgccgagaggcccggacuggcgacugcugccgcgccaccggggcccaccugcgcagggacgcucggccucaggcccucugggcugcuccacccugcuccggccgcaggcgagcggcgaggggaggggggcacgguuuaugugcaguggggcgggcggcguccgcgcggcuuccccgaggccggaggcggggcgggcgggccucggguggcgcggggggcggacccgccagcugccugcgcugcucgccagcuugcucgcacucggcugugcggcggggcaggcaugggagccgcgcgcucucucccggcgcccacaccugucugagcggcgcagcgagccgcggcccgggcgggcugcucggcgcgggugagugcgggcaccgacuggggcauccgcccgggcgcgggagaggcgaggcgccgggaggagcgggacaaagggccggguaugcgcgggguaggguaacugcgggcugccggaggcaccgcaggacuucgccagggcaguccucgggguuccaggacacgggcugggggccugaaggagcucuggggagacggcgggggcugcaggucauuuggauucaugcagugucacccaugaaacggauggggaaagaagauccugcugucuugggugcaggauguugguugggaagcagagagagccggcucucggcaagcuguccuucggcgggggcgauggcuacacccccaugcacccccccaacacaccaccaccacuacuucuuuuccuugaguuuugcauauaccggauuccaucaaguucugaauauuaaguuuuaacccugggcaugugauugugaacacaccuaagcaagcaagagaagugcaaaagugcagcaaauacaggcugggaaauagaaucuuuucuccggagugguuguccgugugcguuccgggggugcuaacccuagacacuacagucugaacuaacaacaguuguuguaagcaaauaguucuucugccuguaggcauucaucacgaguuaacuuuuaaauaaaaguuuuaaaguuuuaaaaggagcgggagaagacuuguucagaugaaggaacaccaccacuccucuccagaauacaaauuagguuugcuuuccagcaccucaggagaaagcagcugauaaaaauccuguuuguuuuacugcccacugggugacaccaguaagaauuaagcagcucaguguagguauuggaauagggcuugcuucucucagcuccugaaacuaaauuugagggcucccugugcacuccuuaggaacagguaggccagugccagaauccucaucacauggucaugugagaaagaauugaauuuauagaugaggucagcuguggucaaaagcccuaugucaaaguaguaucaggauauuuauugcauguuguuucaagauccuacuugugcaugcgaguauuugugacagguuuauaaccgugccuaccaugaagucugucaggaguggauuggaggugaaguggggagaaggaacuuagaaaaugcccccagaagccacuauguuuauuugugaaaguguuugcaccccaucugcguacgaaaagguuguuucacuugcaguuuuccuaguuaaauaaagucaagcgguaacuuguccuuuccugugccugaacugggaaggaagccuuuuuccaaggugccuaauauggaucucauuuuuguaacacugacgacuuauucagcuggaugguuaacauggaugcauuuucugguuguagcauaaguguccauuaaugcaucugagaacauuuuuguccccagucugcaaugguuaauagucucagguucucccaguaacucuucucauagaucccuuaggauuucauccaccaggcauuauucaugccuaacucccacagacuccagggaauuuguuucucauguucucaauauuagcagguuuuuuugcacucuguucuuguucugccagguuugucccaggcucaauuuaguuuaccugaaauccgauagagaagaggcuaaacuucauuugaccacaagauuguguuuaggguugcuuggacuuguaagugccuuguaguuuccuguacaagacuguaauucuuaaacgauuaugugauuaggucuguuuugccuuaauagggucugugauucaggaaaacgagaacaagcccgacugcagaguauucacagagcuugguucauucuuaagcauuugcuuuaggauuuagcaugauuucaccguuccauaucacugaccacugauuccauggaagacccuuugucaucucuccaaaugguguccaaaaccuguaucuuugcaaacuuuccugccguuucuuucugucauuacuguuuauagcggcugcaggaauucacaauuuguacaauagagaauacaugaccuaaggauuagguuuucccucccagcacuuguuugcuauaggaguuaaaucauucucucaaacaguggcccucuugaggagaccuguguuguugcaguuuucaagacuaaggugccgugcaggagacaguagucacugcauccagucuccaaagagauuguuguuugcauaucuguuaauuaugcaaagucccaccaccaagggccuaugaaguggcagcauccucaaaaaguauaaauauuuucagacaguggcucauauugagugauggaggguggacuguguaaccuauuuaugaaucagauacccaaagcuggaaaaggaauaguuucuguauuacuaagcauggugaaaaaauauuuucuuaccuucauuuuccauucuucccugccaguuaggugaaaugaugcacggaaacacuugguuggaaaccuuaaaagauaauuuauguauaccaggaaucuuuauucagcaaaaguuuauuccuagaaaugaaacguuauagaccuaaauuuucuucauccagacuuagguaaaagggugagauuugaaaaucuucauuccauuuuuaaggugugagucuuccaggcagcucugcaaggauaaggugauucauuuauaagggugagagagaauuuaaaaucauguaacucauuaguuaccuuuccaggugugggauuaugaauguuuucauuacaucuguuuauaccuuagaugaguguuuauguuuaaguaaacuuaaacagguauagcacaggcuuacccaggguuuauacagaugguaacaauaauuauuugucuucuaaggaauuacuccauuaucaugugaguugagaaaugaauguaaauccaccaaccuaauuuuaaagcaucacaguuuugcaucauuuguuguuuuauuaaugcggaugagucagggcaggcugcgaaugccucaggaaagacccuuaauggacaggaggguuguuucccccucaggcuuuucuuuggggccugucuuaagagcauacacacacagccaucccuccacucaguucuugaaagcugccuucugcuggagucacaauuuguacaauagagaauauaugaccuaaggauuagguuuucccucccagcacuuguuugcuauaggaguuaaaucauucucucaaacagugguccuguugcagacugaucagggaaaucuugucugccagauagaugagaaauuagcaugauucauuuuccuuuuccuuuuccuuucccccuccuuugccuccacccuccauaauuccaugaaucaaugguccugagaaguaaaugauaguacagacacuauagucagcaucgucccugaccuggacuuacgugauucuggaaaauuauaauauuagggaauccuggaccuaaagaccagagcuaaaaagaccagcuaaagcaaucaucugguugaggaugcuauucagaagaauuucuaaagcacccuaaauaaacauuugguaaaggacuaagcaacuuaagaagcuuguagcuuuaauacagacaucaguuuaaacccauuuaagggcuugagaacccacagcuguaucuucuaauuucugauuagauauuuuaaaaauaucuaagccuaaucaguuugaaguaauuugaugggcauuaguuucuaaaagucugcauucauuucuaaaucugaauuaaacuuuuuuaaaugcaauuuuauaacuuuuagcguuacauggaagcuuuaagcaagauauauaaugcugucagaacaaagucuuaucacacaaguuaguaaauaggguuuaguaauguggagaacuuggaagcagaguugcaaacuaauagaaauuaggacuuauuaagucucugaaaaauuuauucuucaaaguuaaagcuucacacuguccuguuggguuagcaguuuguuuuuuucuuauagauggcuggcuucuccuucacuccuggcuaaaugaacagaauucaaguuguaagaacucugaauuaguaauauucuaucaugcaguagacucuuuagcauucucuaacaggauucugugauucauaacugaucccaaaguuucuugagacauaaucauucaucauuuugccaaagaauacauuugauccucuauauugagagguuggaguaaggcuguggcucaugaaagaggauauuguaacugccauguucuucaugcacauugaaaauauuaucuguagcugaugauaauacauacuauaauacuaccucaucuccuacucuuucucccccaagaaucguauuuuaaaaacaagaacgcuuggcagguuggaccuccgcauucuguguuuucuuucuuaagauaagcugaaguaaaacuuggcuuaccaugugcucaauguaagucacauuaacauuccccacauuacucaaagggaggagagaauggugcguugaagcccaagauacagccaugugggagauauaugacuccuccuagucccugucacauuuggcagggauucuggugugaguggggcauuuagucaccuagacagcaacuuauauagagaaaaggcugcucaaguccucgauaagcccaagggaugacuccuuagccaguaggugggaauaaucagaaccaugccccacagaucuccuaaaggguugucaucaccacacccauuucacugccaaguucuccauuggagaggaggacucagcuagcauuggcauccccuuccuaguccacuuaaaaccuuuagucuuggcaauauucccaacaagcacauacaaacacgugugugcacauaugcgggcaccccauguuuucaaggauuuaaagaaauaauuaaauguauuuccuuccuacaaaagggcucagggacccuuccuauuuggaaagauggagacaaguagaauuucaaggaauuagggagucccaaggaacuggcuuuuccaggaccuuauuucuuucuuuuccuaucccuauucucccugacugaaguggaagccaagagaaaaagucaagcaaaaaggucccagagguggguggggcacacacauauguuagaaacacaguguggauauugggaaugagaaugggcaugcucagcuauacuacaucagaucauugggauuuucuacuuuuauauaaaagggagcaaaaggcacccaaaguugccaguagaucuguacuuucaaacaggaagagaaugagaauaacaaaacaguuucuuccuaacuucugcuguguucccagagccucuugagacccaccccuuccggguccuuguuuuuggaugcuugguugugaaugaguuacccuaccugcugagucagcuucuauugaaccagaagagucagagccacugagagccaacugaugcuuaaacauuuaugaaagcacuuucaguauuccucguuguuguuuuucuugugggaugauugaucugggcauuuaaacauaccuugcaguauaaaauccaaacuucuuuguuuaguacacauagcacuucacaaucuagcucuugccugcugccuccaccacuuccucuacuccacccuugcugagcuaagugugauuccccaaauuacucacaugguugcauguugcugugcccuugcacagacucuuguuucccuucccuaaguauccccuucucucugucuuauguuaucagacuucuuuucuacuucagcacccaucugaaacaucaggugaugccuggaaaauuucuaggcaauuuguucauuuagaggguaaauuuaaauuacauagcuuacugaaugaccgaagcaucaaggagggacagcuccacggugucaccuuuacuaggacuccuauugcuucuaaaugguggguacauuugaaaagaacgggugcauuugccaaauaauacauuugguccucuauauugagagguuggagcgaggcuguggcauacuauuucucaagcaucacuucuccuagaaggccucucuuguucuuacucccacaauuggccucaagcuguuucucugagcuaccgcaucauccauguacaucauugucauuagcgucagcaugcaacauucauucacuuuuccauuaauacaagcauccauuuaacaaaucuuugucgagugcuagcacaggcccaaauuuaagagauuuaguugguaauacagauauaaacaacugaaaaaguaaccaaugguaacaguucauaguguuauagcugaugcaauauuagagcuuuagauauugacaaagauccugguaguguacaacauaauccaaaggaagaaggaauauuuuauuagaagccuagccacucuggaacucaauauauauaauaguaaagguuguuguaaauucaaagcaaaaaacaaaacaaaacaaaaaaucucauacccuuucucgagugcaccaucauuuaaaaaccacaggaguggugguaauugugacacuguggagcuguccuucuuugaugucucagucacucaguaagccauguaauuuaaauugacccucugagugaccaaguugcucugaaaauuuuccaaguacauguuacaaugagaaugagagaaggaggagggaaaggcggggacaucaugaagguagaagaggaggagguuuagaaucaagcacaaagagggcucaaaauuacguggaaauuggggcuggucagucaguuagccaggggacuaaugacuuuaugccugcuacucugcagucuaccaucauuagggacaucuuaaacauagaaaggaaggaacacccaauuucacuucaggcacccagccacaggaacuuuccuaagguugagccuuugcguugaaagugagaccguuaucuaaggauuccucuccacacccugauuccugaggaguguucaaagacucagaaacaaugacaggccugcugcugagcuuugcugucugcaguaaaugaacguucagcccuugcccuccugaccugcuugucuuuguuucuacagaacagugcucggcauggcagggauuccagggcuccucuuccuucucuucuuucugcucugugcuguugggcaagugagcccuuacagugcccccuggaaacccacuuggccugcauaccgccucccugucgucuugccccagucuacccucaauuuagccaagccagacuuuggagccgaagccaaauuagaaguaucuucuucauguggaccccagugucauaagggaacuccacugcccacuuacgaagaggccaagcaauaucugucuuaugaaacgcucuaugccaauggcagccgcacagagacgcaggugggcaucuacauccucagcaguaguggagauggggcccaacaccgagacucagggucuucaggaaagucucgaaggaagcggcagauuuauggcuaugacagcagguucagcauuuuugggaaggacuuccugcucaacuacccuuucucaacaucagugaaguuauccacgggcugcaccggcacccugguggcagagaagcauguccucacagcugcccacugcauacacgauggaaaaaccuaugugaaaggaacccagaagcuucgagugggcuuccuaaagcccaaguuuaaagaugguggucgaggggccaacgacuccacuucagccaugcccgagcagaugaaauuucaguggauccgggugaaacgcacccaugugcccaaggguuggaucaagggcaaugccaaugacaucggcauggauuaugauuaugcccuccuggaacucaaaaagccccacaagagaaaauuuaugaagauuggggugagcccuccugcuaagcagcugccagggggcagaauucacuucucugguuaugacaaugaccgaccaggcaauuugguguaucgcuucugugacgucaaagacgagaccuaugacuugcucuaccagcaaugcgaugcccagccaggggccagcgggucuggggucuaugugaggauguggaagagacagcagcagaagugggagcgaaaaauuauuggcauuuuuucagggcaccaguggguggacaugaaugguuccccacaggauuucaacguggcugucagaaucacuccucucaaauaugcccagauuugcuauuggauuaaaggaaacuaccuggauuguagggaggggugacacaguguucccuccuggcagcaauuaagggucuucauguucuuauuuuaggagaggccaaauuguuuuuugucauuggcgugcacacguguguguguguguguguguguguguaaggugucuuauaaucuuuuaccuauuucuuacaauugcaagaugacuggcuuuacuauuugaaaacugguuuguguaucauaucauauaucauuuaagcaguuugaaggcauacuuuugcauagaaauaaaaaaaauacugauuuggggcaaugaggaauauuugacaauuaaguuaaucuucacguuuuugcaaacuuugauuuuuauuucaucugaacuuguuucaaagauuuauauuaaauauuuggcauacaagagauaugaauucuuauaugugugcauguguguuuucuucugagauucaucuuggugguggguuuuuuuguuuuuuuaauucagugccugaucuuuaaugcuuccauaaggcaguguucccauuuaggaacuuugacagcauuuguuaggcagaauauuuuggauuuggaggcauuugcaugguagucuuugaacaguaaaaugauguguugacuauacugauacacauauuaaacuauaccuuauaguaaaccaguaucccaagcugcuuuuaguuccaaaaauaguuucuuuuccaaagguuguugcucuacuuuguaggaagucuuugcauauggcccucccaacuuuaaagucauaccagaguggccaagaguguuuaucccaacccuuccauuuaacaggauuucacucacauuucuggaacuagcuauuuuucagaagacaauaaucagggcuuaauuagaacaggcuguauuuccucccagcaaacaguuguggccacacuaaaaacaaucauagcauuuuaccccuggauuauagcacaucucauguuuuaucauuuggauggaguaauuuaaaaugaauuaaauuccagagaacaauggaagcauugccuggcagaugucacaacagaauaaccacuuguuuggagccuggcacaguccuccagccugaucaaaaauuauucugcauaguuuucagugugcuuucugggagcuauguacuucuucaauuuggaaacuuuucucucucauuuauagugaaaauacuuggaaguuacuuuaagaaaaccaguguggccuuuuucccucuagcuuuaaaagggccgcuuuugcuggaaugcucuagguuauagauaaacaauuagguauaauagcaaaaaugaaaauuggaagaaugcaaaauggaucagaaucaugccuuccaauaaaggccuuuacacauguuuuaucaauaugauuaucaaaucacagcauauacagaaaagacuuggacuuauuguauguuuuuauuuuauggcucucggccuaagcacuucuuucuaaauguaucggagaaaaaaucaaauggacuacaagcacguguuugcugugcuugcaccccagguaaaccugcauuguagcaauuuguaaggauauucagauggagcacugucacuua

SEQ ID NO: 15269 - RNA, 1788 nt, Homo sapiens
cggucauugucauaaccagagaagugaauucugcccccuggcagcugcuuagcaggagggcucaccccaaucuucauaaauuuucucuuguggggcuuuuugaguuccaggagggcauaaucauaauccaugccgaugucauuggcauugcccuugauccaacccuugggcacaugggugcguuucacccggauccacugaaauuucaucugcucgggcauggcugaaguggagucguuggccccucgaccaccaucuuuaaacuugggcuuuaggaagcccacucgaagcuucuggguuccuuucacauagguuuuuccaucguguaugcagugggcagcugugaggacaugcuucucugccaccagggugccggugcagcccguggauaacuucacugauguugagaaaggguaguugagcaggaaguccuucccaaaaaugcugaaccugcugucauagccauaaaucugccgcuuccuucgagacuuuccugaagacccugagucucgguguugggccccaucuccacuacugcugaggauguagaugcccaccugcgucucugugcggcugccauuggcauagagcguuucauaagacagauauugcuuggccucuucguaagugggcaguggaguucccuuaugacacugggguccacaugaagaagauacuucuaauuuggcuucggcuccaaagucuggcuuggcuaaauugaggguagacuggggcaagacgacagggaggcgguaugcaggccaaguggguuuccagggggcacuguaagggcucacuugcccaacagcacagagcagaaagaagagaaggaagaggagcccuggaaucccugccaugccgagcacuguucuguagaaacaaagacaagcaggucaggagggcaagggcugaacguucauuuacugcagacagcaaagcucagcagcaggccugucauuguuucugagucuuugaacacuccucaggaaucaggguguggagaggaauccuuagauaacggucucacuuucaacgcaaaggcucaaccuuaggaaaguuccuguggcugggugccugaagugaaauuggguguuccuuccuuucuauguuuaagaugucccuaaugaugguagacugcagaguagcaggcauaaagucauuaguccccuggcuaacugacugaccagccccaauuuccacguaauuuugagcccucuuugugcuugauucuaaaccuccuccucuucuaccuucaugauguccccgccuuucccuccuccuucucucauucucauuguaacauguacuuggaaaauuuucagagcaacuuggucacucagagggucaauuuaaauuacauggcuuacugagugacugagacaucaaagaaggacagcuccacagugucacaauuaccaccacuccugugguuuuuaaaugauggugcacucgagaaaggguaugagauuuuuuguuuuguuuuguuuuuugcuuugaauuuacaacaaccuuuacuauuauauauauugaguuccagaguggcuaggcuucuaauaaaauauuccuucuuccuuuggauuauguuguacacuaccaggaucuuugucaauaucuaaagcucuaauauugcaucagcuauaacacuaugaacuguuaccauugguuacuuuuucaguuguuuauaucuguauuaccaacuaaaucucuuaaauuugggccugugcuagcacucgacaaagauuuguuaaauggaugcuuguauuaauggaaaagugaaugaauguugca

SEQ ID NO: 15270 - RNA, 1788 nt, Homo sapiens
ugcaacauucauucacuuuuccauuaauacaagcauccauuuaacaaaucuuugucgagugcuagcacaggcccaaauuuaagagauuuaguugguaauacagauauaaacaacugaaaaaguaaccaaugguaacaguucauaguguuauagcugaugcaauauuagagcuuuagauauugacaaagauccugguaguguacaacauaauccaaaggaagaaggaauauuuuauuagaagccuagccacucuggaacucaauauauauaauaguaaagguuguuguaaauucaaagcaaaaaacaaaacaaaacaaaaaaucucauacccuuucucgagugcaccaucauuuaaaaaccacaggaguggugguaauugugacacuguggagcuguccuucuuugaugucucagucacucaguaagccauguaauuuaaauugacccucugagugaccaaguugcucugaaaauuuuccaaguacauguuacaaugagaaugagagaaggaggagggaaaggcggggacaucaugaagguagaagaggaggagguuuagaaucaagcacaaagagggcucaaaauuacguggaaauuggggcuggucagucaguuagccaggggacuaaugacuuuaugccugcuacucugcagucuaccaucauuagggacaucuuaaacauagaaaggaaggaacacccaauuucacuucaggcacccagccacaggaacuuuccuaagguugagccuuugcguugaaagugagaccguuaucuaaggauuccucuccacacccugauuccugaggaguguucaaagacucagaaacaaugacaggccugcugcugagcuuugcugucugcaguaaaugaacguucagcccuugcccuccugaccugcuugucuuuguuucuacagaacagugcucggcauggcagggauuccagggcuccucuuccuucucuucuuucugcucugugcuguugggcaagugagcccuuacagugcccccuggaaacccacuuggccugcauaccgccucccugucgucuugccccagucuacccucaauuuagccaagccagacuuuggagccgaagccaaauuagaaguaucuucuucauguggaccccagugucauaagggaacuccacugcccacuuacgaagaggccaagcaauaucugucuuaugaaacgcucuaugccaauggcagccgcacagagacgcaggugggcaucuacauccucagcaguaguggagauggggcccaacaccgagacucagggucuucaggaaagucucgaaggaagcggcagauuuauggcuaugacagcagguucagcauuuuugggaaggacuuccugcucaacuacccuuucucaacaucagugaaguuauccacgggcugcaccggcacccugguggcagagaagcauguccucacagcugcccacugcauacacgauggaaaaaccuaugugaaaggaacccagaagcuucgagugggcuuccuaaagcccaaguuuaaagaugguggucgaggggccaacgacuccacuucagccaugcccgagcagaugaaauuucaguggauccgggugaaacgcacccaugugcccaaggguuggaucaagggcaaugccaaugacaucggcauggauuaugauuaugcccuccuggaacucaaaaagccccacaagagaaaauuuaugaagauuggggugagcccuccugcuaagcagcugccagggggcagaauucacuucucugguuaugacaaugaccg

SEQ ID NO: 15271 - RNA, 9649 nt, Homo sapiens
cagcuucugcuucuuggccgcaggcaugucuguucccgccggcgcagucgacacuucccucucggacauauuccuccgccucccuccagguuccugccgccuggggcggggccuccgccacaccgccgucaagcaagcccggcccgagcuugccgcaaaguugccgcugccgccgccaccuccaccgccccccccacugucgcaaaucgcgcccagccgccgaggcgggcgugcgugcgaccccgccacacugcugaaaaaggggcgcgcgcgcgcgcccucccgcgcggcuuccuggcuccuucccuuccccaacucccgucuugcccuuuucccgccgcccucccggcagucuacacgauguaagguccguuggauuaagagggcaguauuaaguaugucucccuucccaccaccgccucgagaagaggcgaaacucaaagggaugcucccucacccccuuccuccuuccaaagacguuucagccgcaauuggcccguuccuucgaucuccgacccgcugcuagggagcgaaagucuguggaaugggcuacaccaccaaugucccaggaaacgggggaagauacaagacgucaccucuugcuuuagcugugcaugccacguuuccuuaaucuugaacuuggaggacagcgcuuccugacuauucacggaacuauucauaaccuaauucuuccuugaagauagaaaugcaaaaacaguaaccugcuucccccuggcuucccccaucuggcgaauggaaaguacccgucaggggaugcgcaggcgccguggcguacucuugcgcuggguucgucgaaacccgccuccuccaagccccuccucuguuugaauucucguuugcugaaccagguaguuuucuacccgguuuccgaaucccaggguggauuucaaagcgcuaccgaauuauacucuagacgcuucguaaauucuugucggauauuuauucuguugacuauuuauuguaaugaaugauuauccuuccaguugcuaccaauagugguuaagacuuaaauagaaauauccuaacauuaugagacuagacuccaaugaguuacagccaaagugcucuuuuuagcugcuaaaggauaggcccugaacuacgccaaggccuaagaaucagugcucaucuccauuaugagauugugauacuuaaccgacaauguuuugcuuguuuuugcacaucagauacaaugaaauucuagaaggcaacacaacuguuaaacuucaccaaaauauuugccucuguuacuauaucuauucucuagcaggugccagauaacauuggugagccuuguggaauuauuauaugggucaugaaaccauaacugaaugagcagcaggaaaaggagagugaugacgaaaaauaaaauacggcauccgccaccuuuuuuuuguuuuucuuagaacaugauugugacuacuuaucuauucgggcuucuguaaaaauguccucaucuguaaaaaugaggaggcaggaagggagaaagggaccuaccauuucuugggcaccugcuugauguuguauaucuuuucucuucuagaccucauuacccaccuagagugcaccauccauaaaauucuaguauacuugaauuauuucugcaugauaacuuuauaaccaggacaucaguuuccuuaucugcagauugcaagucacucuuucuuuuguagauaaagagagaacucuugguugagaaugagaaaaggaaguaaagcaaaggcaggucagaaugagagguuucugcagugaagacuuugaaauaaagaagccgaaaaaaaauuaaaguugaggucucaaugacggcagucauuuguucaguacuuccaauguuccaggcacuacuaagcacuccucaguuggugagaagagaugagacuggaguagaguaagcuccugacaaaguaagacgugcuuuggcaugacauuuucaucagcagacagaaacauccuucccuuuguuaagaacaucuuucccaacaaagggaaggacguuucugaaauauaguucuacaaguaaaggauaauugacuaaagcauuucaaauuaaaauuacuccgugugugagagauuagugggagcugggaagugggagucaacgucuagucauaaaauuagaaaagugcugaacauuuggauaaaggacacauaugguagaaaaaugccuuacagcauucauauuaucuguaacaaagcaaaaauaguuuaaagaggcuuauuaaaacuugaagggguuauuuuuaaaauguuucugaugaaucaggggugauaaauggaaauuaguuuauauuacuacguuauugucacuacauuaaaggaaaaauauucugacacuuguuaaaauaguaaggaacacuuaauucaggacuauuuugauagcugucaagacuaucacaauaggagagagaucaggcucaacuccaaauuacagcaaggaguggggauguauagucaaggagcaaaguuggagggguuggugguuggaaaauuacuaagaagagacaucaagaauggggaaacuuuugcuacaccaacuuaacagaauuugugcuaaaaaaggccggggugaucagauauccaggguauggguuuuucucuaaacugaugcagaauucuugcuacagcugagccaggcaagcuagacaggaagauggagaagagggcucagaggagagucuuuguuacuaauuuaagauauguaaaaugucauagguguuccaugcagaguacuacuuuugugguauuaauuuaauaaccauaaaagucuaauuaccuauuaaaaauaaguuuugcugagugcauugauguguaccuguaguuccagcuacucaagagacuaaggcaggaagauugcuugagcccgggauaucaaagccaggcugcgcugcauaaggagaccuacuucucuaaaaaagaaaaauuuguacguuucucaacacugcauucuccuacugugaaagaucucaggaaccaucacaguuggagaggucuuacuacccacauuuuacaaaugaggaaacuaagacuuaggauaaguaaacaguaugcccaaagacacacagcuguucaaguggcaguacuagagauuguguucaauugauuggaaagccaaagcacuuuuaccucaagaugagggacccaggcagcucuaaauuuauguaauucuaugcacagagcuuggucuuuagaccacagaauuguuuauaaaguaucaaagaacuuuaaaaagcuaucucacuugggacagaaagaagauacaacugggaaaacaaacaaagaaucuauagcauaguuuauaguaauguacggauuucagucuuuacuuaauuuugaccaauguaacaugguaauguaagauguuaauaaugagggaaacuggaugaggggaauacaggaacucucuaugcuaucuuuguucuuaguaaauuuucuguaaaaguauuccaaaauaaaaacuuacuuuaaaauaucuaucucauacuuggcuguugagaauucaguaagaaauaccccuuagccuucaaguaagugguugauccaucuuggaacuuuccaagaucauuuacuuauauagaaaaagaaaauucacagcguuccuuggcauugucuccugguaucuuguaagcuucauaucaggaaaugaguuucaaaagcuaaauuaaauccuucccauuucaacuggagucuauuucucauucauucaacauuuuugucucuucugcuucauaaauagcagcuguucaucaucauucaugcaauguguaaucauaugcuugcagaucugguuuucuaugaacagaacaucauauggcuuauuugaacguuuucaaaucaaucaggaagaauuuacugaaugccauuuacaugcaaagcaguaggauaauuccaggggcaauggggaggaggggacaauaaaaaagaaaauaagacacagucucuaccuucaaacagccuaauauucauccagcguuaagaaauaacgaauggggccgggcguggugguucaugccuguaaucccagcacuuugagaggccgaggcagguggaucaccugaggucaagaguucgagacuagucuggcuaacauggcgaaaccccgucucuacuaaaaauacaaaaauuagccugacgugguggcuggagccuguaaucccugcuacucgggaggcugaggugagagaauagcuugaaaccgggagguugagguuugcagugagcugagaucacaccauugcacuccagccugggugacaagagugaaacucugucuuaaaaaaaaaaaaaagaaaaauaacgaauagauuuaauauauauuuacugaguaccuacugugugcccaacacuguuccaggugcugaggaaacuugacaauaagcaaaaccagacaauuuccugcugucaucaugcuuauugacaaguaggagaaacaagcauuaaccaaauaaaugugaaauuaccgugguaagugguaugaaggggaaguacaaggucagggcugcugcuagcccauaugguaucuuugugcuauuuuuuaaaaggccauagcagaaagagcccagaguagguaaagcuuggcaagcaaacaaugacuuugguaaauuagaaaaggcacccccuuuuccagauugauacaacccugcuccgugugcaaggcuuugugaguggagcacaaauuugauuuuaguuuuaguugucaccucagcugggaacccuuguuuagaugaacaagcugcacaggcauacacagcagcuggacaaaguuuccauggacguguguaauaaagugagacaugggaggguuucccugagaaacagacagaagaguagaacuaaaagaagaaugggaguuaaccagucucccauuaagaagagaaggagaaacauucuagggagugauaacagcaugugcaaaaguccuggcgcaggaauaugagaagaguacaaacgccauugguacacugaaaggucagugcuggugaaggacugaaaagagaaggugacaaaagugugguaacagagaaggcuagaaaagaagguaaggggccagaucguggaggaucuuauagaccuucuuaagacaagucuauuaacauguaucuccuguugauaagacuuauacagaaggaauuagaauggcauuauuuuaacucuguuuguauuuauuucacuuauauacagugaaaugcacagaucucaaguauauaguuccauguguuuugacacaggcauacacccauauaauccacacaccaucaagauacagauggagcuuuccaacaccucagaaaguuuucucaugccucuucccagucaaaccucuccucucuuucuccccaggcagccacuauucuguuuugccuauauuugcauauuaguuuugccuauuguagaacuucauauaaauagaauaauucaguauguucucuuuuguaucuggcuucuuuugcucagcauaauguuuuuuagauguauaaaaugacauuagcuuuuaaagaaaaauacugccuuuagcuuucaaauacuaucuuuagcuuuuaaauauugucauuagcuuuuauggccgggcgugguggcucaugccuauaaugccagcacuuugggaggcugaggugggcggaucauuugagcuuagguguucgagaccagccuggccaacauggugaaaucuaucuguauuaaaaauguaaaaauuagcugagcauggucgugggugccugaaaucccagcuacucaggaggcugacauaggagaaucacuugaacccaggauguggagguugcagugagcagagauugcgccacugcacuccagcuugggcaacaaagugagacuccaucucaaaaaaaacaaaaacaaaaacuguuauuagcuuuuaaagaaaaauacuguauuuuaaaggaaaauacugucuaggucaaugguucucaaauuguaacaauucagaaacaucuggauagcuuguuaaaucacaguugccugggcccuaucuccagagacucugauacacuggguugggauccagccucucaaugugcaugucuaacaaacucacaggugauaccaguacugcugauuuaaagaucacgcuuugacaaccacuggucuagaugacaaaucagaaaugucuuauaaucaguuucaaggaauuuuucuguucauuuaauaaacacuuucuuaaaguaccugcuaugugcuaggcacuuucuagguggugggauucaaaaauaaaacaucacgccucuccucuaguaacuuauagucuaguaagggaagacagagguaaaccaaaugaguaucacuaguugucuuagaaaaucuguucacuaucuaauggaauaaaaccuuaaaagagagaaagugcuuuuguuuuccgaaguagauaaacugccaggcgcaguggcucaugccuguaaugccaacggaggcgggaggaucgcuugagcccaggauuucgagaccagccugggcaacauaaggagaccuugagucuauaaauaaaaauacgaaaaaauuagccaggcaugguggcaugcaccuguagucccaacuacuugggaggcugagaugagaagaucaccugaaccugggaggucaaggcugcagcgaucaugccacugcacuccagccugggugacagugagauuugugucaaaaaaaaaaaaaaacccaaccaaauaaaaaaacaaacaacaacaaaaacaaaaacuaauguagauaaaccacuaggaauaaaagcaaggcuguauaauggaugucccagacacgggauuccuuacugucaagcuaacugcaaaggugaucaguaagaccuacuuuacuaaguguuuuccaugugucugguacugugcaaaaugcuuucuacacagcaugccauuuaauccucucaauaucacuauaaaucugguacuauauuauccaugucuuacagaugacuuguagcucacagauuaagggauuagacaaaggacauucaacaaguaagugggagaaucagaauucgaacccagaucucauugacccaagugcugguccuuuuaaacacuaauacuuacaggucucuguuagaaaaacaaccuucauaaauaauuuuagugcuaccuagugcuauaauacaaaugcucaacagagaauacauacaguacuaugacagaacagguagggcaguaacuugguggaaauaugagaaggcaucacgaagaggugagaauuagcuuggaaaguaaauuuuugucaguguuacccugacaaaagucugagagacagacaauccauuggaugcaaacacuacauucugagcauuagcaaagaacacugucuuguggcuaaagaaaaguugauuaggaucacuuauagcuugagugaaaucucccuuauaauuaugcagugccuuuguuuaccacauacagucaugugcugccuaaugacaugucacacaaugacggacuacaugcacaguggucccauaagauuuuaauggaguugaagauuuccuauugccuauugaugucauggcaguaacaacaugguagcgcaauguagcacaaggcauaaagccuuucuuguuguuaaagggaugcaugacucagcuacucgggaggcugagauaggaggauugcuugaggccuggaguuugagacgagccugggccacagggacaccccaucucuuaaaaaauaaaauaaaaugagaaaauaagccaggcaugguggcgugugcccgcagucccagcuacucaggaggcugauucaggaggaucacuugagccuaggcauucaagguugcagcuuuggagacagagcaagacccugucucuaagaaaaagaaaaaagagagagagagagaugcuaucuugugagugcuauuucagcuuucugguuuccucgauaauagaaagugcccuaaagaauggacauuccgggccgggugcugugacucacaccuauaaucucagcacuuugggaggccgaggcaggcagaucaccugaggucaggaguucaaaaccagccuggccaacguggcaaaaccccaucucuaguaaaaguaugaaaauuagcuaggcgugguggugggcaccuguaaucccagauacucaggaggcugaggagggagaaucacuugaacccaggaggcagaguuugcagugagccgagaucaugccacugcacuccagccugggcaacagagcgagacuccaucucaaaaaaaaaaaaagaaagaaagaaagaaaaaagaauggauauucguauuccagucacuggagagguauacuccacagcaucucuucuucuucuucuucuuuuuuuuuuuuuuuugauggagucucacucugucgcccaggcuggagugcaguggcaugaucucggcucacugcaagcucugcuucccggguucacgccauucuccugccucagccuccccagcagcugggacuacaggcacacacugccgugcccggcuaauuuuuuguauuuuuaguagagacgggguuucaccguguuagccucgaucuccugaccuugugauccgcccgccucgaccucccaaagugcugggauuagaggcgugagccacugugcccagccaacagcaucucuucuauuuguuuauuugagacaaaguguuguucuguagccaggcuagagucccgggcucaaacaauccuccaaccucagccuccuaaguauccacagcauaacuuuaauacuuuggcaaaugguucaugaauaagugucuaguuuaggaggggucacaucaugaaaggccuuaugccauuggucuguaaaguaauagguagccaaagaaggguuuucucuuuggcaaaggucagaggguaaggcugagagaugggcucaggggcuauuucagcuauuucaguacugcagacgugaacuaaagcagugccaaugaagaugaaaagcaagggguugguuccagagauauuuaaaaaugcaaucaacaggacucaauaauucauggaccgugaggggcuuaggaugacucagguuuauaguuuagcugacuuccuggaucacgguaucucuaacuaagauagagaaaauaggaggagaaguagguggaauuuuuaacuuuuaguguugagaagauaagcauaauauaauuuaacuucucccuaaacccaaauauagucuuaaggguaaaggccaacaacaaugccuaucacuaauuaaaaggaauaauuggccgaaaaaauggauguaauuccaaugucuuguacauuuuaucuuuccuuuucuuucccuuucucucucugucuuuuccuuucucucuuccauucuuccuuccuucucucucuuucuuuccuucuuuuuuuuuuucuuucgaaacagggucuauguugcucagacuggucucaaacuccuaggcucaagcaauccucccaccuuggccucucaaaguguuaugauuacaggcaugagccaccaugcccagccaaauauuuuguucuuuaaaaauauguuugugugaaaaagugugugggacaauauguguguggaaaagcuuaaaccauuuauuauuggaggaaaaauuguugaacaaugaauauauuucaauuuuugaaacaaagguuugcuccugcuuuuaaauuaccagccuugauuuuaugaacga

SEQ ID NO: 15272 - RNA, 118074 nt, Homo sapiens
ucauaauacagcagccagagcgagccuuuuagcaacaaaaguuuuuaaagaauccucuggucaacauuuucgguggcuuccccacugagaaagaaauccaagccucagcauggccuagccuaggcccacugccaccccugaccucagcuccaaccugcucgcuuuguucaaaccuugcuggcgacagugcuguuucugacuagggaaacagggccuuuguucugcccucugcccccauauguggggaggagagccacucuccaaaucuuaccauccugcuuccuuacuuaguaucucuguucaaagaugacuucaaggucuuccuugacccuaucccaaacagcaccacacucugcucacaucacucucucuacuauuuuuuucucacaacacucaucaucauuugucauaaaauauuugcuaauugccuacucucacaagaaaauaagcucaaugaaagaagaaucuauguuuuguuuauugauucuugcaccuagaacuacuggcacauugaaggcacucaguguauugaauggaugaacgaagaacucaaucugcuuucuaaaaaucuuccuuggucagucuuuugcuuaguaucucuuuuaguucauagcuuuuugauaucucugcauuuucucaaugccaugugaucugccuucugucccugacaauucccagguauaucuagggguaagguucaaguuccuaauugcuagaaccaaugggcagguuuuggucuuuauuuuacuuguguuggccauucccuacuucuucaguuauauccuugacauaauuaucuuuccugguucuccgccuccagcuuugauuguucuuuccuggccuucaccccuuaauaaggguguguucccugggacucauccuuggcccuuacucuggcacacagugguuccuuugguaaucucaaccgcugucauagguacuuuuuuuuucuuuauuuuauuauuauuauacuugaaguuuuaggguacaugugcacaaugugcagguuuguuacauauguauacaugugccauguuggugugcugcacccauuaacucgucauuuagcauuagguagaucuccuaaugcuaucccuccccgcuccccccaccucaugacaguccccagagugugauguuccccuuccuguguccaugugcucucauuguucaauucccaccuaugagugagaacaugugguguuuguuuuuuuguccuugcgauaguuugcugagaaugaugguuuccaguuucauccacgucccuacaaaggacaugaacucuucauuuuuuauggcugcauaguauuccaugguguauuacgugccacauuuucuuaauccagucuauuguuguugggcauuuggguugguuccaagucuuugcuauugugaauauugccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaauuaguuuacggucccaccaacaguguaaaaguguuccuauuucuccacauccucuccagcaccuguuguuuccugacuuuuuaaugauagccauucuaacuggugugagaugguaucucauugugguuuugauuugcauuucucugauggccagugaugaugagcauuuuuucauguguuuuuuggcugcauaaaugucuucuuuugagaagugucuguucauauccuucgcccacuuuuugaugggguuguuuuuuucuuguaaauuuguuugaguucauuguagauucuggauauuagcccuuugucagaugaguagguugcgaaaauuuucucccauuuuguagguugccuguucacucucaugguaauuucuuuugcugugcagaagcucuuuaguuuaauuagaucccauuugucaauuuuggcuuuuguugccauuucuuuugguguuuuagauaugaaguccuugcccaugcccauguccugaaugguauugccuagguuuucuucuaggguuuuuaugguuuuaggucuaacauguaagucuuuaauccaucuugaauuaauuuuuguauaagguguaaggaagggauccaguuucagcucuuuuaauacuucuggacuucuuuaaaugucuagaaguggaauuacugagcaaaggagacaaacauuuuuaugacuuucuggaagggcuggccaauuuacagugcuccuaaaaaugaucagaguugcucacuuuccaucccaauaauuacagacuuugaacaggcaaauagguaaaaacaaaggcacagagaauuccagaguuucaauuaagaggcagggaagagacaguuagccugagcagaagcuucaagaguggagguaugagaaaggcugcaaugguuguaggccuugaauauuugauaagcagugagccacccaaacacacugaaggauuccagcuguuaaagcacaggauucaagggaaggggcuggagccaaccagaaacaugaacacccaccacgugauggaucacuccugcccuucucaggaagcuacauuugggcagaaaauuaucaagaaugagaacuuugugaaucauguaugcuaaguguugcaaucaauaaacugccugguaaaugaaacuaaaaaugccugauggguccugugguuucccauaacacaagacaagaggccugggaaguccugcuuacuucccaaguuuccuauaagacaguaaaauaaacauugaugaauggaaagcacgcuucucuauugggugacugauaaauauuguucuccuaagcccauuggaccaguauuccuccugucugcaccaaagaccagccuucccccaaaaagaaaauccaucuuuuucccuuggguuggccugaguaucagcagagccagcuaucagguaguguagacugggcucuaaccugggaugauagcaauaaaaaucugcacugaaugucuauuugugaccugugagaccaaggcucuuuugugcugcagguuuggucucaaggggugauacaucccauuaaucugaccucuuauucuuaaguaugaauuccuguuuguaaacaggccugcucucuacuuugucuuuggcuaugaguaaaagcuuccugaagccucaccagaagccagugccaugcagccugccaugagccaauuaaaccucuuuucuuuguaaauuaccuaaccucagguauuuauagcaaccccaagaacagacuaacacuacuacccuucuuaggacaaaaaugaucagagaugcagauuuaauauuuugugccuuacacaggcacuaagcuagcuggcagugccaguguggugugcuuaaugcuuccauguaguguucuuaaaaguuuaaagaaaucugacuuccuagauagccuaaguggugggcaguggggggcuacuugauauuuccuucccuagggucccagucagaggcacgguaacucaauacuuguuuauccagaggacaggacagcugccaagggaccaaggcucaaggaagacagacaggguaccuaauuggggaaggcuccgacagagcaagguuuagcucacaaggucaaucacacacaauuuuuauuucaaaaccaacuuuaggcugggugugguggcucacgccuguaaucucagcacuuugggagauggaggcgggaucacucaaggucaggaguuugagccagccuggccaacauagugaaaucccaucucuauuaaaauacaaaaauuagccaggcaugguggcaggcacaugaggcaggagaaucgcuugaaccugggagguggagguugcagugagccaaaaucacgccacugcacuacagccugagcaacagagugagacuccaccucaaaacaaaaacaaaacaaaacuuuaauuuuuuuuuuuuuugaagcagggucucaccucacucuguugcccaggcuggagugcaauggugugaccucggcucacagcagccucaaccauaccggguucaagugauccucccaucucagccuuuggaguggcugggacuuaauuuuuuuuuuuuuuuucacuguuguagagacgggguuucaccauguuggccaggcuggucucaagcuccugggcucaagugauccgcccacuuuguccucccaaaguguugggauuacagacaugagccacugcacuggccuaaaauuagcuuuuuuauuagauaaaaagcuauuuugaaccagggcuuaucagaaaacaaaacuuuuucuaaccucaccuuucucuccuaguugucugccuaaaaucaguuuaauauucgcuucaaguuacaucugccccagaacaaauaccauagaaggaacuuucauuaacaguguugucaguuucauacagcuuucaugcaacuacgucugcauacuacaucaacaacaaaugggacacaaugagugcuuaugcuaacauuaggaauacuagcuagaaacacagaaaaccuuuuggauuggugauacuucaaauaggacauuacuucuuaguaacagcaagaaaucagcuuaauguuuucagcaagagacagcauggaugauaaugcagccuuucuuuuccgaaacuucagacagcagaauuccagaagggcuagucacacccauggaaggcagcaaguguggcagaacaaagaucuaagcugacugcagaggccacugaugaaagcugugaaauaucuuuccuggaaggcaagaauaaauucaucuggcuuacuacuguggugucuccauacauugugaccuagucacugcuagcacacaggagccacacucacucuuaagagagauuuuuuuucucuguggaauuuuguagaauaagcaaacagaguuuggaagcguguuugugaguuacgauaaaugagaagaaccuugaaauuauuuuuaguucaagaaaaacaucccauuaaggccuauuucucauaagucacauuuuguuggcuucuggaaaagcagaagauuccuaggcuaacauaaggaaguccucuuccuaaauauguauucucauagucacuuguuaagaaagggauaccuuuuaaaaaaugcugaaugcugauagauguuaaaucaaaggcaaauaauuuugaaaacgauuugggacagguacaguuguccucugcuuacaaucuucucucuuaucucagccaauagcuacuugcuaacuggauaguaaaaugacaugagcauguaugaguuuacagccugauguaauuauguaaucaauagcugauuuacuucacucauuauauuuugguuaaaguugcucuugucgcauguuugcauucuuccuugucaacgaugucugggcaucagaggaggaggcaggaaauguacuucacuaaagaccacugggaauaaagaguggccaucagucuagauugcagagggaaacaaucuccaugucaguauauauauaugaauuacgugacagcaggucacagagagaacaauggaccaugaaagcaaagauuugauuuccaucuguuaacuuacucaucugggcaaguuccuuuuuuuuuuaaacagggucucacucugucacccaggguggaguaugcaguggcaugaucccagcucacugcagccucaacauccuggacucgggugauccuaccacuucagucucccaaguagcugggacuauaggcauauaccuggcuaauuuuuguauuuuugguacagauagcguuucaccauguugcccaggcuggucuugaacuccugggcucaagugaucauguaccucagccucccaaauuacuggaauaacaggugugagccacugcacccagcuccuuuucugauuucugauuccuacauauaaaauggguaaaauauggauaacacuuaucaaacauagcccaaaaguuguuuaaacaaugaaauaaaaauggcuaugaagcacgucacauacugaaacauacuuaaaaaaaaaaaggcaauaugaaagaaaacaagccacagaccuuaaauauaaacaccuccucaaacaccacaagagacaaaaauuuguaaaguuaaggaggguaacuuauaaaaguacaacuucccaguuuauaugaaaaugguuuaauaauacugaaacuuaaaagcugauaaaauuuauuggcuacgacuacauuuuuucuccaaucacagcaaauauuaugagacacuuaucaaugcaaagcuuuugauccuuuaucauguacucugaacccuaugcacuacuaaauaggcaauaugauacaaucaaagguuucuuuggcagacauaauuauauguaccaaaacauuaaacugcguauuuucccuuaaacuuaccugacuaaaggcaucugaucaaaagacaaaaagugaacaauuuuaauaaguaguugcauuuaucaauaagagucuacaagguaacaaaaaguguaaagagacaucuuuuugaaaauucauauaaaacaaaccuuccauguuauuagaucaacaaauauaaucaccuggguauauuuuauuagggaaaaaugacaauauugauaauaaaaagagaaaggaaaaaugaaaaugcaucucagaccagaauaccauaacaaaacuuuuguggaagcugcauuuuauuugaaaauccacccauuuugcuaacauacauuuuaauauuguaaacaaaaauagaaucugcagagacaaugcaacaagaaugcuuaaacucauguacagaauugcuuuccuacaaugaacuguccuucuuaaggccccucuccacccaaauguuaaagauguauuuacacaaagcaccgaucaacagugcaguuuaauucuucguuuacuaaacucuuggcuagacauuaacuuuaaagauacuauuuccccuuauuuaaaagguauaugaucauaacauggcacgagccaaagaaaauguucaaggacuuugccccccuucccucccccuuguaacaccuucuagaguuuuagugaaaagaaggaaagucuugaagugaaagcaauuccucacauucauuuuggaaaggcccuaaugucaaauggaaaauaaugacaugccaagcacaaagcaguaaagauccuucccaaugcacuaaugcugaauuuaaaauguagugcuuuuccuagucagugaacuguucccuggcaaaauccuaggcacagaauugacuauaaggauuaaugcauuuauaaugcuucccuaaaucccacagaggccgagaauucuuaagagauucagaccuauggacuugccuuaaaauauuuagugcucuguaugucagcugagaaaagcauucugaaucagauucauucuuguggauaaaaaucaaacauacugugcacauccauacucauuuucauaaggaggucugauacaauauuaauguuauguaaaauugauaaucauaaauaaauacaaauacuuaaggaaugucuacugcaaacugaauauaauuuuuuuuaaaaaaagaaaaguuaauuucaguuauuguuucuguauuugugaggacuggagaaaagaaagauaaugcauaauuaggaauuuuaauuuugaucccccaaaagaguccuguugaaauacaguaaaggacacaguucuucucuccaggcagcuuuuccaaauacaaauuucacacuuuccaaauaagggcuuuucuugauagguuacugauuauggguauuaacaggaguugaaagaauugaaggguuagucaccaaaaagacagaucuuagucuuaaaucauagcaauucuuggcuuuauaaacuguauugauacguucuccuauaaacuagucccaauuuccuucaugggccuucacugaguuacuuguagcauucuaauggaagaagagaguuuaagagauuuaagagacagcaguuuggauuuugcuggaaguaaggauuuugcugcuugagcacuugucuuuuuggaguaauuccauuuucuuccaucaaguuacauaaacuguaucuggaaaaaaaaaguggguauguuaauucauuguauuguaggaugucuucucauaaauaaaaaugcuuuguggucuuuaccauuuaacuggcccagaaguguucacaacaugcuuaucacaaacccuguuuauaaaacaaagucaguauuaucaacuuaugugccagaaagcucaauauuugacacauauagggacuuccaaauaauguuuuuuguuguuguuuuugagacagagucuugcucugcugucuaggcuggauugcaguggcaugaucaaagcucaauggcugggcaccauagcucacaccuguaaucccagcacucugggaggcugaggugggcagaucaccugaggugaguucgagaguucgagacuggccuggccaauauggugaaaccccgucucuacuaaaaauacaaaaauuagccaggcgugguggcgggcgccuguaauccuagcuacucgggaggcugaggcaggagaauggcuugaacccaggagguggagguugcagugagcugagaucgugccacugcacuccagccugggagacaagagcgaaacuccaucucaaaaaaaaaaaaaaaaaaaaaaagcucauuggaacuccugggcucaagcaacccuccugccucagccuccugaauagcuaggacugcagacagucgccaccacaccuggguaauuuuuggguggggguagagacuagggucucaccguauugcccaggcugaucuugaacuacuagccccaagugauccucccgcaucagccucccagggugcugggauuacaggcauaagcaaccacauccaggccaaauacuuaacugcuaaaaauagaggaauagcauguggaggaggaaaagaaagaagaucaaugaccuauuuuuucaugacaaguucagaaaaaucucuccauaagcacaaauaccacaagcaaaaucucauuugggaagcaaaauuugaaauauuauuuccaaaugauauacaauuagagacaauaaagggaacaguaauauuauacuaagucuuuuuauuaacauaaauaagaaccugaaagagccauaaaaauauuuuucaauaggguacuacuguucauucaaagauauuucacucacaauuucccuuaaacugcccauccaaagauuacugaaguagaugugcuaauaaacuugccaaaucagaagacuauaaacucccaaagaucuagaagguauaucuaaacugggggcuagagcaucaagaagaacaaauuacacugucuuccagcaaacagaggcaguguggaucauaugcagaauccuucuaaucgaaagggcuuaaguauucacuugcccuuaauuaaaaagcaaacuuuauccgaucucauccauuuacugugagcaguggaugagauuacuuuaaauaauuauguuacagauauuuuccaaaaguuguuuuuccuuauguccuaucuuuucauucugcaccuaaagaauagaggaagaggaggaggaggagagggagccuagaguccuuuaaagaaaugaaagagaagcgugaauuguguuuaauguuugguaauuguuuuuaaguauuuaaguccccaucucccaaaacaaguagcaauaccuaaagugauuuauaagaaauccuccaaagagagcucugcaaagggguccuuuccugaagcucugugaggacugugacuggaggggcuggaugcugccgacagcugggggaaaagaagacagagagagggaaagaaaaaaagaucucagaaugacagaacaugaaagcagaaaauguaugaaagaagaagugguuuugguuuugucaucuuuaauaaauauaagggcagucuuuguagaaaauggauuguuaagacaaaaguuucagucauaugucaaguuaaaagguaugcaauggcauguguuuuucagaaaacaaacucgugcuucugaaguuucaaaggaauaaugucuuuuacccaaaaggucgauauaagcugacccaugguuaagaauuuuaauguguguauggggggugguggggggauaggggagggaauacauaauugcauuuuuguuuaaaauugagagaacaugguuuccuguguccaggcuaucuguccaaagcugugcaacucugaccucaguccggacccaacacaucuagcugcaauauucuuuccuuucuuucuucauaagggucgaaaaguccuguccuagguucacacacuuuuuacacgaaguugucuccugcucauuuaucuugacgaacugcagcugacacacguacugugggaggugaaagggaccuuagaggucaccuacuguaacuguccacauacugcccugaauauggggaauacuuaagaucuuugauucugcuuccuguuuggacaaauuuacuugauucuuagaaucuguccuauuguuuaauucgaauauacuguaaggcaaguaaacaacugaauucaguauguaucuuuauucucccaaacacagacuauuccugaagaaccaagauauuaauuuucauacauguauccuucauuaagcugacaugagcguuucaaacccgacaugaaccuuuuuacuuuggaacaagcuuuuaauucuuuuucucccucuguauaagauugcaaagcauauaagcacaggacuauuacaaaaugagcuuuucuuuuagggauguccuagugaguaauaaaaguugacuaacuggaaauaguuucaauucauacuucaacauucaaauccuauagaggauuucuuugcuggugccaagugauuucauuucuuucuaccuauuuauuuauuuauuuauuuauuuauuuauuuucggaaaagcacuacagagaaugaacagccaaugagcuucggcaaauauuacaucacuaguauaugcaacuuguucuggaugccaagaucaauuuauaggcaucaguuauacucaugguugaguaauuuccuaaugcauaucuuguucccaaaaacaaauguucaaagacaaugggaagagacaaauggaacaaugauggaaucacgcaggcagcuacagaugggaggacagagcagcaugccugggcuugagguuucaaauaucauccaugcagagacaaauuaagguauaacuacuggaaagacucccccuccucccucuucagcgcaaccacggacggccaaucaaaagcacaacgauuucaaguaaagugauccucaguuacugagcuggagggaguccaacauccacacuuaucuccaagaugaacuugguuucucucugaagcagauuuucuuuuucaccuacaguuaaaacaacagcaacaacaaauccuacuuauugcagauagacugcaucuaaaaucagaaguuuccuaugauagccccacaccgaaauaccuucuuaaaucacguuuucaccaggguagcagucugaagaccugacagacccacaguaaaaugccccugaagaauacggaagagacaaaucuauuuucaauaugugagcauacugcuagacaaguccuagaggcuuauaaacaauguugaaaaggauuacuuuuccuugagaaaaagagcugguuuuuuauuagaacuccuaguagucucuuaaauugguaaaacacauacacgucucauaucuauaaaaauguagccaaacuaaaacaugacagagaccaccaauaagaaaacaagacaacaucccuggaauaaguuucuuaucaucaauaucuguaucaagcggaugaaaccauagccagggcuagcuaggcugacugcacagcuccaaggagugggacauacagcagccccugaccauccuaccccuuccuggcaucuauuccaaagcacagacacaccaugcacuggugagaaaguagucaccccagagaguaaauaagagaaggaaaggaaaugugcuucaguagcccaauuacugcucaggaaaaucaagaacaaaauagcaugaagaggcaauggguucuugguaggugagaaguaggagaauuuuaaaacuauaagagcugacuugacucuacuuauuucugugaguaaauuaaagaacaugauguaggguugcuaaagaacauaaaaaggcaagguuaaaguacuagaggauaaaaaauuaaaaacacaaaccagcaaccaaaagcuguugcuuucacauaaagcuauucacauaaagcacaaaaucaucaaauuuuacaagagagcauauguaauuuguuguucuggacaccaagacaaaucauaauugaucuuuccagucaagcccuacuauuacaucaccagguaucuaucacaaauaaaauuaaaacaaaacaaaaacaaaaagagccuuuaccuauuuacuucaaauaacauucucuaucccaaaauucccacagagccaaaaaaaauugguauagcuaucaguucguucaaaucaaaaugaccuaugucacaacugaagaugucuucaacaaaguggucaauuguaaugguccaauacagacauagucuuuucucauguauagaaaaaugaaauacugagaagagcagcguauaaauauacuaaaaucugcaagugguugaugauaguaucucuuaaauuccuucuccccuccuccacuacucuaaucaaucaauaagaaaaaauacgguaaaauguuaccaaaaucuuugcauuauauccagagcaaugauuuuuuugguuauagagcguguuucauauagucuaucuaucaacagugucuuguucugucacccaggcuguaguguaguggcgcagucacgggucacugcagccucaaucuccugggcucaagugauccucccaucucagccucccaaguagcugggauuacaggcaugcaccaccacaccuggcuuuuuuuuuuuuuuuuuuuuuuuauuaaaguuaaggucuugcaauguuguacaggcugggucaaacugacuuuaauaaaggacaaacacaccuagcuuaaagaagguuaaaaaaagucuauugauagacuaucauaaaauaaaaaugguuacuccuucauuauacuccuguuaacaucaaacaaagaaaauuucagguuagaacaagaaaacaucaacaaucucagaaagugaggcuaguggaauuaaaagcuuaugaaagacuaaaugguuggauauuuaggaaaaaacuugugacauaucauuuggcuguacuuaaaauccuuagagaaccaauuuugccacaucuuuacauuugaauuuuucagucacccaaaagacuggguagaaacuuaacaaugcuguagagauucauucugucucauuggcaaaaucaaccucuuaagagaaaaauggauuguacucccuuugccuggaaugacagugccagguuuuguagaaagauggaacugaaucuaauccuaacucucuuauaaaaugggauuuagaauaauaggcccaauaccuguacugccgcuuauggcugucuugagaauuaaaugaacacaagcacucagcaugcugccuggcauauauuaaguagcucaaauauucuuaguuccaucuucccuacuaccuaccaucaaauguucaucuacagauauaagaggccuagcucaaaugucauugccucuguguuguucuugcuccucugccgugcucuguuaugucuuucuuauaaggggucucauuccauuaucaaccagucacuugugcaucuguauuacacucaccuuuaggcugcucaggugcaggaaacacuuuaucuguccuuuguucagcaacuagcagucaauuacacauuguaagaauucuaaagugugcaaaauuaaaaugccuuuuggugauaaaacaagcuccauauaaaaacagucuccaaaguggaauguacaaagaaauuauuacaacuguccuauuuuuaaaaauuccuauuuuuacaugcuuaaauguaccucauauauauugcuguagaaauauaugaauguauuuuauaaauacacauacagucaugguacauacuugcuaugguuuugauugaguguuuguucccuacaaaacucuuguuuaaauuugguugccauuguaaacagcauugagaguuaggacuuuuaagagguauuuagguucucaucaagggaguggguucgcccccuuuuguucucucucugccuuucugccugccgugugauaccuuccaccauacuaucaugcaccaagaaggcccuugccaaaucccaguacgcugauacuagacuuuccagccuccacaacuguaagccaauaauuucucucuuuauaaacuacccagucuaugguauucuguuacaucagcacaaacagacuuagacaaugcuucaaacauguuuuccuaauacugauguguaaucaaaacauuuagagaccauggugcuacuaaauaggauuccacagagacacugagucacagaacaguuaggcuguuuugggguaauguuuaaaacaugaccaggccauuagugguacguugaauccaguugcuuaaggauauaaauuauacagugcugcauuucauuuauuuauauuaaagauaaugugauuccucagcuuccccugugagauagugcuaaaagacaggauuucucuacuauauacauguaggggucuguccuuuggguuaagucuagugccacaaauaauugcuucuuguguuuaugcucaacaaaaccccaccuuggguuucugcccaucaacaacauaacaaaguaaugccaacauuaacccugucaccuugaaugcauuacccauuuuguuuuuuuguuuuuuuuuuuuuuuuuuuuuuugagacagacucucugucgcccaggcuggaguacaguggugcgaucucagcucacugcaaccuucgccucccagguuucagcaauucuccugccucagccuccugaguugcugggacuacaggugccugccaccacgccuggcuaauuuuuguauuuuuuguagagacaggguuucaccauguuggucagccugguuucgaacucuugaccucgugaucugcaccccucccccagccucccaaagugcugggauuacaggugugagccaccgcacccggcccgcauuacgcauuuuguuuuaggggaugccacacagugaccugggagcauuccacuuugaauguauguuguaucugaaccucucuaaaacuguuuuuccccccccaaagacagggucuagcucuguugcccaggcuggaguacaguggugugaucauugcuaacuguagccuccaauuccugggcucaagugauccuuccacuuuagccuccaaaaguguugauaucacaggugugagccacugugcccaauucuccucuuagaauuagagaauaaggacaauucagggaauaggaacaauuuccaaaaacagggcaaccuuuaaauauuuucuuagucaguuucaaauauuuucauuugauccuuacagcaaaaugauaaaguacacaaaguaauaccacaauuuuacagguaaggaaacuaaggcucaaaguuacauagagaauuugcucucaacacaugguuagcugaggagucaagucaagacugcugaauugugaccccccaaaagauguguugaaguccuaaccccuggugcccauaaauuugacccuacuuggaaacagggucuuuguagauguaaucaaguuaagaugaggucuuuggagugacccuaauuugaugaccaguguccuuauaaggagaggcacguggagguagagacccauagagagaaugccauguugacagguagagacuaaauggcuacagaugcaaacuauggaacgaauggggcuaccaaaagcuggaaaagccaaggaaggacccuccucuagaaaauucagagggagcauggcucugccgauacccugauuucuccagaagugauagaaaacaaauuucuguuuuaauuucuguuuuuaagagcuuaaaaacuuuuaacaugcuuaaucaaguuugugguacacuuuguuacagcaguccuaggaaacuauaauauaaacucuaaugcagaucugcugguuccaaggcugguguuuuuuuccucuucaaacucugcuaucccaauuaauuucaauucagcuagaauuuacggcuauauugaauuuacaagaaaaaguuaaaguuggaguagagaaauaauuuuuuaaaggaacuuuucuaguaaaugugagacaauacauucccauucuuucuguauacacaguauuauacauggucacugauguucgucaugaagauucugcagaacuucacaggcaccccggacuuuaagaauacuuucugguuuuauuuauuaagacaagaaauuagauuucuaccuuuucgagaauguccucagcaaaaaccuaguaauaagcaaggucuuauucuauaaguugucuuguuagcaauagugaucagcagaugagacuucuaacauuucuauuucgaaugauucagguguguguacuaggagcuaguuuucaccuaugguacuacaucccaauccccaaggaaacgucccucaugguauucugcaguaggcaaggaugaaugagcacaacacauugcuuacaaggcaaaaagccuucuucacagaaauccagcuggagagaucggcugacagaggagguacugccaauacucacaauuaacacaccaagagaauaaaacaacaacaacaaaaccaaaaaacaaaaccaaaacgaaaccuaaaagcagccacuaguucuuaaauacaagaaaguacuuuaaaaggcuuuuucuaagacuuaaauuauucgaauaucuaaaggcaacaguguucccauuuagaaggauaaaaagcacucacaacaagccaucauuuccuuucagacacuuaacugaugucagacugauuuaaaauuagccacugcaaacaacaaaaaacagcagccauuuugcaucuuuaaccauauccuccauaaacaaaacuggcaguccuccuuuaaaaaaaggccuaauaccagucaagaaaccaacaaaacuuggccaggagcaguggcucaugccuauaaucccagcacuuuuggaagccaaggugggaggacugcuugagaucaggaguucaagaccagucugauguaugcuugcucuacaaaaaauuaaaaauuagucaggcauuguggugugugccugcagucuuagcuacccuggaggcugaggcuacagugagccaugauugugccauugcacuccagccugggggacagagugagacccugucucaaaaaaacaaaacaaacaaacaaaaacaacaaaaaagaaaccaacaguuaauuuuaaaauuaaaugcccaaagguaauacucuguauuuuucauauugcuucugggaaaauaggcagauugauaugugaucagugggaauuuuucauauaaggaaauaagaugacaacaacaacccuugucacccccaaagagcuucaaaaauaccuaaacugccauauaaacauucauuuaaaaaguguuauuucauaucacaaugacuuucagaagaaaauugaaacuauaacugucuucaugcuuaauaacauaauagcuguauauugcaacuaaagaauuaguuuaugaacuacuggcuuagcaauggacauuucaauuuauguaaagcaccaguaagagaaagcaggaguccccuuuccagacacacuagcaaucuguaccaaguaaccaaauaguaagacugugaggaagcacagaagagaaacaaaaggaaaaccacaaggaccuagaauuuaucaugaaguuaaacaucuaggaagaugcacuaauguagaacaacauaauaaagacagcuacaauguuaggcaugaaacagaaaaacaauaguaucuguuguuaaacaauuccaugaaaauaucuaaaaaauacagaaaaaugacucaacacacacacacacacacacacacacacacacacacacacacacacacacggagaaaaggguauguguauaggaauucauaaguucaaagcuacagcgcagucuacugaauuaaagccauaaugacaauuuccugaagaauugaaucaagucugagcuaacagccaucuggaagguguuagcugcuuccucauaaacaagcacuaaugcagugcuuagaguaaccuagauaaaauguaagacacacaacacacuggaaugucucacuaaauggcaacaagauaaagguaucugagagggcuagagcucucucaaaaauguuaacuugauauaauaguaaucaggcaagagaccaagagcuacaaguuaugccuuagguaaguaacagcucucaaaacaaacacuucaaagagcaaggaagaauuuugggaacagcuguagaaauuagauuugauuaaaagauuccauuuugauggaauuucauuuuucauuuaaacuaccauuuacuuuaccccauacaaagagauggaugaucucugcccuuaauaauuuuuuaauccaauugaaaaaaagggaacaaaacaaugaaagaacaauuaaaagguaauucauuaagaaaaaucuuuugguuucggcuagcauucuacggacaaaauuaauccaagagacuggcugagaaucauuaaacaugcuuuaaagcaugagaaaaaccuuaucuaguucaaagauaaacaguuuacuuuuuucuuuuuaaaaaacagacagucucacuauguugcccagguuggucuggaacuccugcacuuaagugauccuccuaccucagccucccaaagugcuaguauuacagacaugagccacuguguucggccaacaguuuaauuuuuaauuauuaaaaauguucaaucauaaacauaaaauaaagcugucuucauuccucaggugagccgucuaauguuuuagcucaccauaacuauuagccaacaaaucaaaccaauuuugaacaccacugcaaguuauuauaaugguuacaaguaagugaaaugagagauuaaggaggggcagaguaaguuauaugaugaaaaagguaaguuuacaaggugauucauuuacuuaacaaauaauguccaaaaacuauuacaugucaggcacuguucuaggaacuagggacagagaaguaaacaugccagagaagcuugccuucaugaagcuuauaaucuaguaaagaaagcccuugcuagacuggauggaugccagguagucacaaggucuguaagaaaaaauaaugcagaauaaggaaaagaauuccagaucucauaaggaugugaaagggacaccagaugacugaagacuggacaaagaauaaacccacuuuauggcaggugaaggacuuauggaaaagacaaauaacagcagaacacuggauacuuauugagaauuguaaaagcauggaaucgaagaacuugaauauuccguuaacucauuauuacucuuauaaauagggaggcuucaugagguuguuuuaagauggaaggaaagcugagaaaaggcuuuaaauguucaguuauauuuagauucaccuccuuaggcuggacacaguggcucacaccuguaaucccaacacuuugggaggcccaggagggaggaucacuugaggccaggaguuugagaccagccuggccaacauggugaaacccugucucuacuaaaaauuaguugggugugguggcgugugccuguaaucccagcugccggggaggcugaggcaggagguuuaacacaggaggcagaggcugcagugagcugaaaucguaccacugcccuccagccugggggacagagugagacuccauuacccacacacaaaaaagauucaccucccuaaauguuugaguauggagauggguauuacaaauacugccuacaaaagauuguuccaauauuuacaaaacggauuaaaucggggaggcagagaacaugagugacuauugcaaaacaagugugaauaaagagguuccaagacugggugaaagcuguagaaugcaaggagaagggugggucuaauuauagcagaggaauaauuagugagacuuugugauuagauacaugcagaacaaaggaauuacaaaauaauuaaaaguaacauuaacaaauuuaagauucugacuuucaaaugauucaaaugacuauguagagagaccaaagcuucuucaagccauuucauugcugccugauuuuauuuuccuaguuaucaauuugcuuccuucauuugcuuuuucaguaauacuuaaguacucauuucaaauuuuaucuuucaacuagaaacuuauuacccuaauguucucauucacuucucuucugauauaaaguaauuaagaaaagguauuucugucccuguuuuuuuucaugcacaaggaaauucuggcacuuuucugguguuucugugaaacgguuauguggguuuuagaaggcaacaggacguaaaaccuggguuaagagcagaugcuggguggguacgguggcucauaccuguaaucccagcacuuugggaggccgaggcagaugaacugcuagagcucaggaguucaagaacagccugggcaacauggcaaaacuccaucucuaaaaaaaauacaaaaauuagccaggcaugguggcauacaccaguaaucucagcuacucaggaggccaaggcgggaggauggcuugaacaugggagauggagguugcagugagccgagaucgcaccacuguacucgagucugggugacagagcaagacccugucucaaaaaaaaaaaacaaaacaaaaacagagcagaugcuggaugacaagcaauuuuuuguuuguuuugagauggaguuuagcucuugucgcccagccuggagugcaauggcccaauccaggcucacugcaaccucugccucccugguucaagcaauucccccaccucagccucccaaguagcugggauuccagacaugcaccaccaagcccagcaauuuuuuguauuuuuaguagagacaggguuucaccauguuggccaggcuggucuugaacucccgaccucaggugaucuacucaccuuggcuucccaaagugcugggacuacaggcgugagccaccgugccuggccaacaagaaauuuuuuaaagguagauuuuugccaacauuaaaaaaaaauguuuagguuuuuaaaaagcaaaacucauacacaauguuucaagguugaagguuauuacccaaaacuguagagaauauucuuuacaacuauaguaguuacauccugaauguguaaaugugguuuacaauuuagcagaaaaaccuaaggagugugcagacuguucacugcugacgaaagaagauggugcuaccguauuggccaguaagggcucaguaccacuagcagagagacugugguauaaaugagcacuggacuaggaaucagacacaccuggggauaaguugauuucaccauuuaauuaguugaagaacccuuccaagucugucuucuuuaccuaugaaaugugacggugagagcagacccaucuaccuuaaagaaucggcuaacacaauguaugugaaaguaauuggaaauugucugguaguauccaagcuuaagguagcaauauauucugacaacagccugcaaaucaagaugcagagugggugaaggguuuaacuacauaucaggaaaaacacuucuguagucgaaggucccuaauaaguuuuuagcauggacuauagcuuuaaaaaaaauuacuuaaauacauuuagguuucuaucacuuagucucuuguaccaaaauaauaauaauaauuuuuaaaguaaaugauacauaucugaaguuaaauguacaaauaacaaaauaaaaaacaaaaggacaugaaaaagacauuaacuguguaucaagaaaacaucuacaacagauagggaaaucauccauauacuucuuaaaagauuaucaaguuaaaccaguaaugagauuacugcugguaaaaguucaauaacaauuacuauaaauacuguaaacacucauagucuauuuuauaaaaacaaaugcacaaaaagugacugacuuauaaaaguaaugacugugucaauuacccucacuccaaguuauuuucaauuuucacuguaaauacuuaacugauuaaagaacaaggaggaagucauuuuaacauggacaaagggugggguaaaaaaagaggcauguugguaaauguauuaauugcaaccaacaugaauuuuaccccuuaaucagaacuaaauucacuacccacucucagccaaacagagauaucaauuuauuaagagacgcauuauucaaaacggcugagaaaugaaaggauugccuaggcuucacuagucuaugaaauacaguccacuauuucacuuucugugguuucaguuacccaaagugaaccguggucugaaaauagguaaguagaggauauuaagauaguucaagagaaagacagagagggagagagcaagcauguccgugagcaagagcacacauuaacaaaacuuuuauuacaguacacuguuacuguucuauuauucauuauuauuaaucucuuacuguacuuaauuuauaaauuaaccuuuaucagagguauguauguauagcauauauaugguucaguacuaccccauuuucaggcauccacugugggucuuggaacauaucccccaaagagaagaggggacuaccgugcacagagacuagauucaaauuggaucaaauaaacuaauauuggcaauguaagacuauaugcuuuggcaaauguaauauauaugcauucaagugaaaggggaauaacaaguccacuaagcaaaugcucauucaaauguuuucaagcauuaaacacauaaccaaucaguuagcauuagcaaccauuuaagaaaaggagggguguucuaacaauugcauauaauuaacuacuucuagaugucaaaacaguacgagcagagccacagacacagaaggauaaaccauccuaucacuucacaagagccucaucccagaguaugccaccagagaagugaauaacaaaggaauuuccuauaucuucuaaccguaacggguaaaacauuaaaaaaaaaaaauucuucuaaugcaacaauaaugggacaaaaaacaauguauauuuaugguguauuuucaggaacuaggagagaaaagccuuagaaacacgucaagaggaaagucucuggauuaaaccaucuaaguuuagcaugacauuucaagcuuuuugacuccuuuuuuugguuuuugaaaacaauccucaguggcagaaaguuaucuaacgaaaaaauaacauucaaaacuuuuuggagaguugccaagaguuucacaagcaucucaaggccaacacgcccugcuguagcaucauucuagccauuagccaaggaacuaaagcucugaguuaaugguuuugagguucacaaaggauacuacaccagaaucacgaagagcaaguaggcuccuuaaucucagaaaaaucauccuuuggaucuaccaacuauaaguuaccaagaauuuucugucuuuaguauuugcuaucuacuuauccuuucccuccaaauaaucaauauuccuaaagcucuuauauaagaaagauaugaagcaagcaauauccauaaugaagguagaaagugcuaguaacuuguuucucaaguuguacaaaaggguuuuauaguaucauauuccuuccaaaucaaacacauuaccacaguuacauguaguguguaauaccugugcuccugauacagggccaaagggguuuggaggucucaugacaggcuggcuguauauuaagguugguugcgucauuacaggaacacuucccauuuguggaggcuaaaaaagagaaaaauaucaaaagauacugacuccuaucuuccuuauugugacuaaguaaauaacaaugacaacagggaugacagguccuaguaccuuugcuugacucaaaggguaacuuccucugaauauaaguaagacuaacagcuacaaacuuucgagaguauuuuuuuuucuuuugguaaguaaagucuuuaacaugcucauuuuuaaaauguaguaacaaagccuaacuuuuucuauucaaugaguugcaaaauguaaacuuuauuguauuacaacagauaaaaugauuaagacuaagaguuuccaaauuuaucagguuuagacaucaagaaaacuuaagacucugucuucgcugcuaagaaauuucaaaguaaauuuguauaacaaaucaaguacuuuugccauuaugcaagugaucacaagugaagacaguugauucucugaauaagccugcucuaguucuuccauuuuauuucauauaagaaucaagaaagagcuuaaacuacaaaccagagguuaacucuuucuugaguaacugaaaauacaaucucaaccaaauauguuucuuuaaaaauuaccacuacaggguauaaaauuaaccuaguaagugacaauaccuaguguaaaaauaaugcacaaacagaauacuguuuugguuaaaaugcaaugcucuaaaaucuuuccuuucaagaaguucuauuuauuguuucaagcagacuacuauuugcauuuagagcuucauuuuaaguuuauggccugaguuucucagcagacuuuuuuuuuuuuuuuuuuuuuugagauggagucuugcuccguugcccagacuggagugcaguggcaugaucucaacucacugugaccucugccuccuggguucaagccauucuccugccucagccucccaaguagcuggaauuacaggugugcgccaccauacccagcuaauuuuuguauuuuuaguagagacggaguuucaccauauuggucaggcuggucuugaacucccaaccucaggugauccacccaccuuggccucccaaagugcugggauuacaggcguaagccaccacacccagccucagcagacauuuuaaugcaaugacuaugaaaaaaagcugugaaacuucuccacauguauaaaaggaguuacuuccauaucauauacauaaagaaguaacauagcaggcacaguagcaauaccaagggacacgguacugccuucuaccaggaacaguuccucaaauacauaccaguggguugaagcuacuagcaccauuucuuuucuaauugagucucuauauacugagaguugggaaacuaagggcaaucuaaaaugcacauuguggcauuuugaaagguuaaaagacuguuuuuguacuguaauaaucauugucacaggaaaauuucucuagccuuuaucagacuaaauuuaucucuauacaauucaaguguuaaucccucccaugcccuacaauaucagguuauaagaccucacugguauuuaauauauggucacagcaacaaaggcuuagaauuaacauuaauguuugaaauauaaaaggcccagcaaaguuacgaggagaaaaauaaaccaaguaauacuaugaacauuaaugcauaagaucucuuguauaaugauuauucuagacauacuuaugaaaccaaugcuaugguucuacugcauuaggcacuagggcuaggaguaugaggagcacuaaauucuuuuuuagguuaaauuguaauaaaaacauguuauauaugaaucaauauuuuuuccaaaagcuguaccuaggaaaauacuuacaauuccauauccuaucaugccuguugguguaguagcaggauaggccauuacagggggugccuaacauagugaaaggaaaaaugaacaagaaaguauaacucaugugugucaacugaguucaaggaauuaguagcuguaguuccacuaaaaagaauugcuaagacagcugugaguaagugacacuugugaucauuaagaacugucgauuaauggucagugaaaaaaaguguuuugaaauuagcagaaaagcagacuuauuagaaggauaacuauaccacuuaaacuuagauacagcagugaucuaagauuucaucaugcuuuuuacagcuuuaaaaaucuuuagauuuaaaaaaguaucuuaaauaguucuaaauaguucuaaaauuuaaagccuaucacuaucauuaaaaaaugucuacccagaaaaaguauuauugaauguuuucuuacuuagguaccugauugcuuuagcauucaaagaaaaaaauguaaagaucucaaaucaaucaauaaccugaucuuccaaaaaguuaguuucuaaggaucuuacucacucuuuucaaaaaacuccaaagguuucaaacuacuauugaguaugacuauuucuaugagccauaguucuuauauagaguauguacguuagcuuucuaauuuauuccaaaaauuauuuaagaggaacaaucaauuaggucaguuuaugcuuucauguuuaaaagaaccaucuaucacuaugauguuuaaguuccccucuuccuacuacuuugauuaucuguaaacauacaauuugagaacagaaucauuuuagauauaguugcugucuuaacaacauuuccuguguguguuucucauaaugaaaacugaaauugaauaaaggugaaagaccaauaacacugcuaaaacauaaaauaacugaaauuauauggcaauuugaacauaugcauggagaaauuaaaugaaauauaacuuuaaaaaaauaacacuaaagugaauaguuauaaguuuaguauucgggugagcguguaggacuuauuggucucucccuacuuaaaaccaagaucugcaagagcaguagacaaacugccaagaagagcagaagccuguaagauuucaugcaguuguuauuuuaaacauuaccacaaucaacauuucccuucauucagaagucaucaagugcauaguggcagcacagauacacacacagacacccagccaucuggcagcaaauggcggaauauuaagcaagaaaaaaaaucgguauuucccaugccaccaucagaaucaauucugcaacacacccaugaaaucaguagaugcuaggaagaauuucuggcacauugaaaaucugaaugugaaaacaaguaauagcugaaagguuaugagauucugcuacagcagugguuaauagcaugccaauuuauugcaaaaaggcucguuuuuggucacuuacguauuguggaaaaugcaugccauucuguuuuucccagggagaacaauuacauaaugcaauaacacuggauuagaacaaguacuuacacaacagaaaauacacagagagcauuuuaguucacauguacauucacuaacuaccuaaaaucccuuguauuuccaguaucuaaugaaagaacaucuauacuaaaacacuaucaagguugacaagggaauuguagucuuuggccucaucucuuuauauaaaaaauaguuuauugauuacaaguaccauuaaaacaucaauucuaucaacagugucaacagugcaaaauuuugggcauugcauaaacaggguugcaucagaugucuaccacagaaaaaaagcaagcacuaauuaaaagaauuuguaguauaauauauauuuuaauaaaauuccaaugaauuuguguuaaauuuaaaaaacacugaaaaaccuugacaguguuuaaggauuaauaaaaagguuagaaauguaaagaaaugucaaaagcagcaguuuaucuuaaguagugaaucacauuaucagccccaaacauuagccauuaaaaagaaaacuccauaaaauacauauaaauauuuaagcaaaauccuuaggagaugauacacauuaccauauauaacacagcaagauaaagacuguuaccuuaucaacuuaaauacaaauucuacaugacuaaauaccuacuacauuuuaguagucagucuuaagugcuaucuaugaacuccuaauacuucauauagauuaauacuaacuuaauauaagaaaauauucauuauauuuuaauagcagcacugguauuuauaucauuccucauacaucaucaaugucauaauucacacgaguccauaaaauccacuacucuaaacuccuaccauacccuagucagugagguguguuauagugggaagaagacuggauucagagucaaagagauggauuucaacuuaaaucugcuuuucaacugcuuugcacuuagggaaaaaaaaaaucuuuagaaguggggugauacaugcuccaauucccucaagacagcaacauuuacauguuuaagauuguguauuuguguguauaaaaaucuaaacuacuuaaaugcaaaguuuuaaaaucagugaugauaggcugggcgugguagcucaggccuguaaucccagcacucugggaggcugaggcggguggaucacuugaggucagcaguucaagaccagccuggccaacauaauaaaacccagucucuacuaaaaauuuaaaaauuagcuggaccugguggugggcaccuguaaucccagcuacucgggaggcuaaggcaggagaaucacuugaaccugggaggcagagguugcagugagcugaggucgcgccacugcaauguagccugggcaaaagagcaagacuccgucacaaaaaaaaaaaaaauacaaaauaauaaaauuagugauggcaaugaacacugucugaaagaaaacaaaaacaacaacaaaaaaacacugccuuaaaaagguagcuaaaucucaauauuacuuuccauuuaugaagucuuaagcuauauaauaaaaugcacaaauuuuaacaaacauacuauuuuuagcucaguccuacuaauuuuaacauaucauuaacccacggaaaacagggcagugcucuggaaguggcuauaaggacaaccgcagccucuaacaguaacaggacagcugucaguaacguguagcccguguaaucaaaacacagcuacuagccuacugucuggagaaagaaugcuucaaacuuuuccacaaggaguuuucuuugacugacgaaaauuuguugguugguaagauagaaacuggccaaggacaggagaauagccacagagcuauucugggucuaccauaccuuacaguaauuaaaacauacuaaaaccucuucauuacuagaugcuaauuauuuaauuagaaaauacaguuaauccucauuauucauggauuccauauuugcaaauucaccuacaugauaaacuuugugacaccaaaaaucaacacuccuggugcuuucaaggccauucaugcucauuugcagaggggcaaaaauuugacucauccaauacaguucaccuccagcugagauggaacaaaggacacucugccuugguucagcucucauaccagaccagaggauagagaaggaggauggggaguccaucauacugcaagaaacucugacucuggggccagcuggacagggcuaaaauuccaacucuggcaccaguuagugcgacagccuuaagcaagucacuuaacacuucugaacuuuauuuccucuuucauaaaauaaauagaauauacuagaaugagguuuucuaaaaggaccgucuaugugacauauacauauaugcauauauuucccccagcaaggguucaguguucacuaauucaguguuuggggugacuuaaguacuuaacugccacaaauaaugaguaucaacuguguaaguuauaugacauauauauaauugccaaacacauugucauauauauaaauuauaugacaaaaccgaagcaaguauaguuucuuuaccaauaaugaaaucacaagauuuuguauuuuagaaaaauaaauaaaaaauuugaggucaguaauauagaguagugauuaaggacauauguucuauaguuaggcugccuagguuauaaaaauucaacucaucauuuaagaucucuguaauccugagcacauugcuuaauaacucugagccuccacuuccucaucuguaaaauagggauaauaauagugacuaacacauuaauaggaggauuauaaaaaauaaaacauuauuauuuacuggaauaugucuggcacaaaguaacccuuaaauacuuguuagccacuaaaauguaucugguaaauauaggcaaccagcuuccuuugaaagaaauacaauuacuuauacuucuaaacucaguaacaauccuucuauuuaugucuaucacuuuaaaaacauuuucauguuacauauuuaacuaaauuauucaacuguuagucuaucaggagcuuuuucaacucaccauuguugcagcauuccaagcgguuguuggugcaaccuuugguugccaguuagaucccccaguuaacuucuuuucaccugguugacuccaauuuacaucacuuuaaauaaacauaagugagaauauuaaaugucucuaauuauaaaguuuccuuagcuauauacuuauauagaacagaguaagauagagacuugaggcugggcgugguggcucaugccuguaaucccagcacuuugggaggccaagguggacaaaucacuugaggucaggagauugagaccaaccuggcuaacacggcgaaaccccgucucuacuaaaaauacaaaaaaauuagccaggcaugguggugggugccuguaguccagcuacuugagaggcugaggcagaagaacggcgugaauccgggaggcggagcuugcagugggccgagauugcgccacuguacuccagccugagcaacagagcgagacuccgugucaaaaaaaaaaaaaaaagaugcagacuugauaucucuacacauauuuuugagaggaaagccaaaucaacccuccaaauaacacauggagaaaacacuaaauaacacacggagaaaacaauguguauauuaaacacucacuucuuagugguuccauuuccgaugccaagaucuaggaaaggagaaaaacaaaaaagcauuuuauaacacgagacgcaguuuaauaaaacaacauaaaagaagauuaacguauccaaagacuacuuacugcccacaagguuggcuaaagaugaauccaagucaucagauacuaacuugcuaggugggaguuuggcaacaggaagguucugguucugagaggccacuguugguuugagaaguccaccuaguucaucaaagccuuaaaguuacaaacagacgaaauagaauuuguaaggaacuuuaugacgcuaugguuuucuaaaggaggucuuugccuuuucuccuuguuuauucacuggaaaaguuauccaaaaaauagacauuaguaaaugucuuuaaauggaaaaugaagaaagucaccacuucauacugaauugacugagaaggcuguauuugcuuugacagaaaucaucucuuaucucaugacaaaauuacauuaggguuaaaggggauaagagagaaguauuauaaaagagaaaaaaaacaaauguaauucuccugcuagcccagcaaaauuuucugaagacucacuuauaucuaaagcaauauagguuaaaaaauagcucucuggaacuuugaaaaaaguuccuuuuacguuaagaaauaagauuuuauagacuuuuuuuuuuuuuuugagacggagucuugcucugucgcccaggucggacugcggacugcaguggcgcaaucucggcucacugcaagcuccacuuccuggguucacgccauucuccugccucagccucccgaguagcugggacuacaggcgcccgccaccgcgcccagcuaauuuuuuguauuuuuaguagagacgggguuucaccuuguuagccaggauggucucgaucuccugaccucaugauccacccgccucggccucccaaagugcugggauuacaggcgugagccaccgcgcccggccgagaccuuuuuuuuaaaagcagagaauguaagagugaacuauaucuaagaaacugcuaaauacuguaauuguauaagcccaucuaguaaaugagaacaauucuuaaaaaugaaaauaaaauucuuuaaguuuuccucaccaaauuauagaaaauaaaagaaaauccaaucaaacaaacccucuaugggacucaauaguaugaucuaggaauauuacaguuugaaaaagaaagucaccaaagaugauaguucacaacaaugauuggucucucuuuccacuuucccaggcaagacaaacuaaaaccuaccgcagcaaaaaaauauuaucauaaaccuacuagugcauagaaaaaaauaaauucuuaguccauacauauucuuuauaggcuugcuucuuaguuuuugaaggauaacuaauuauauguuauaaaauuaagaacaucucaauauauucucucuaaauggcuaaaaguuaauuacuaaccaaaaucaaaggccauccgaugguaagaacagaauuaugagugucaaaguuuuacaggcacuucaaauuaacaagguauuaaugaaaacacaaaguggaaaccugguucuacagaucuauaaaguuccuuuaagacaaaugaaccauaauaagaaucauucauaaaacaauaaaaagcuccuguacccacaggccugauuauuuaauacauucuaauuguuuauacacagacuauuuaaacaagucaagguaccacaaguuauauuauucuaguuuacaaacauagccaauuucauacauuaagagacaauacaguuauuauucauuucaguaaaaguaaaaauuguaugccuaaaaaggcacaacaucuacacauagucacaagcaacuuagcauucuacagagcuaaaucucuuuuucucucuuauuuugcucuaggacuaacucacucuucccaaagucuaaauuggcaccaauaaaagaauaaugacuaaacagcuccuugaaguucucaucuagugcuuggggggaugggacaauuucuuuggcuaccccaguuuaauauaucuaaacauuuuaaaagcagcauuauuuuuccuuacacagaaucuaaauuaggacauuauaauauuuuuaauaaaauuuuuuuuccuuacccccagaaucuacaauaacauuuguagauuuauuuccaaacacagauucaaagucaacauuaaggccagcugaaggguguggcugugcaacuggagaaggagugaauccugaguaaaccaaaauggaaaaaagcucaauuauuuaauaacucuacauuuacgacuauuuaauaaugaugacaauagaauggaaaaugcacuaaauuccccacacaaaaacaaagccaauccuucaagcaaaauguuuucuauaucacauuuuucgcagugauugcguuuucccuaacaaaaucauccuacugacaaaauuaacaaaugagcaacucacacugaacugaaaauaugcuucauuacagaaaucuuugcuuaucuuuuaccuuaauuuuauaugcagauaaucuuuaaaaaacuaaacacaucuaaaauuacaagauuuugcaugaagcaaaacauuuaagggaucagcugagaaugcaguaagaauucuguggugcuuuaaaaaacaaguaugaaacuucuaguagccccaagauaaaaguuuuucucccucccaccuacccauuuuccguauuucucuccauccuuccuucaacaguuaaucaaaagcgaaauagcuuaaguucagugaugggauucugaauguuccaacucacuaauccuuauguccaccuguauccauaugcuuuuaaaacaucaaagaaaaaagauaugccacuuucaacucucaaccacucucuaacuucaacuuaguacuugcaacaguggggaugacaagcacaaacucaagcauacuaauuaaggugacucuaguuuugcaacacaaaaccauuaacagaccuuauucuuucuugccugcguuacacuaaugcuagugguauuacacagacaauaagcucacaucuuuaagaucagccuauacagaguuaacaaauauaagauuuccaauuaugugagguuauauuuaaguaagguucugaaugucuaggggcugaaaagaauuaaaauccccuaaaaauauuaggucugucaugugauuuggagaacuuucaaucauugaguauauccaaauaaauaucaaccucacaaggaucacaaagaagaaauuauuucaccucguggaaugucauaaggcuccuaaggucucuuccuuuucuaaauucuacuaagucagaauauaaaaaacccaagaagcaaacaaaaaccaccuauauuagaagguuaaaaacuacaccauuagggagaaguuaaacuuuugguguccuaaauuuaggaucccuuucuuccccuccucuauucaggucagaaucucacuuugaauucuuaauguguaacaccaggacauaaaguauaaugaugucaugcuguacuagagagacugaucucaaagaaaacuguaaaaaguaggacaagauuuggugagauguccaagaagguccucaaagacagaaacaacaauuuauuauuagcaaagaaccauacaagcugauccacacuaaugauacuacuuuaaaguagcauuuuacacauccuauaaugacuauucuguagcgcacacauuuuuagagaauguaccaguuugaucuuguuccauaaucacguaacccuuaaacuacuauuaagucaaagacauuggucauacaaugagaacacaaaacacuaucaaaauacgaaauaauuuaguauauaaaucuucugacuauucaucaaaaggaucugagaauccuagacuuaccaauuuaauaauauuuuuaagugugcaagguguuuaagaauuaugccaucagcuuauugguuguucucuuaacucuuuacauaaaaagcgaauguaucuacucaagaaaaaaauccaucaugcuuaauuauguguccaugcuaucaucagaguguaaguaguacaaacaauguucuuuaaaucauucugguaauaaucuuggcuauugaugucacuaacuuuuagauuauauauggaacaacaauuuaaaauuaggccaauauaucaaauucccauuuucuccugcuacuuugccucagccuucuagaauaugauugauauaagagauaagccuauccuuuauagucacacagaaauuacuucauuacuuucuguaaaaagaggagccaucuccugaggugccuagagguaccaaucugugaaauuaugacauaauuaccuaaaaguauacaagguuagaaagacuauaaaguaacccagaacuuguaucucaaguuuuaaaaacaucuauaaacagagggaaaaaguaaaaaaaaguuaaaaaaagaaauuaauaaauugcaauagcuaaucggcuauuaauauuugcuuaaagucacacaguuaucagggaggcaagcaguuuauuuccaaauuuccaaaguaaaaaucuuuuaaguaauuacugcaugccugaaacacauacaccaacaagguuagaguuuuacaucauaauuucaaugcacauuaucgacuuuuugugaaacuaucaggacugccaacuuuuaauuuuuuuuuuuuuuuuuuuuuuuuuuuuuuuuuuuugagacggagucucgcucugucacccaggccggacugcggacugcaguggcgcaaucucggcucacugcaagcuccacuuccuggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccagagugcugggauuacaggcgugagccaccgcgcccggcccucgccaacuuuuaauuuuuaaaaguuauuuaaaacaaaaagacccagcuaguaucacuauucuaaaagagaaaguuuacagaaauacacacacacacauacacgcgugcgcacaugcuaaaaagagcaggcgcugagcucugaguuaagguuaacuuuaugauaucauuacauuguccugcuuacucuuccauuucaccaaggcccagugaaaacuuucucacuaaccagcaccaauccacaguuuaucauuuagaaaccacuggccugcagguuaaaucucaagaggacaauaauaaauuaauugaaaaguacaagaucaacaagcuuuggggacagaaagacauuccaaacaccuuuuacaaaauuuggguggauuguuaauugauuuuggugguaguuucacaauaaauuaggacucauacuuuuuugucaaaguaacuacuaccauuuauuaaacacuacuaagcacuaagcaagggcuuuauaaacaggguauuauuuaaaccucacauaaacccuaugacauaguuauuauuaucccuguuuuacagaugaggaaacaaagagagauuacauaauguacccaaggucaaagauuuaguaagcaucagaaccaagacuugaacccccauuuguuugauucuagaaucuauuaggguuuucaguuuaaucccaaguauuucaccuuacauaauauaguaaguagaaaaagaaauuuuuuacuauugcuauaacuauuauuaaaaacaacccaaauuuuaugaacuucuugagcuuuucauugcuaauauuagaccaaaaaaagugaauaaucuuuggcaauuuuaaaaucuaaaagcaauaaagaaaaaaucaauguuuaggauuuuaguugaugacuacauaauaauuuaggugagaaguacauucuaauuaugaugugguccacauauacaagaauuuuaaauucuuuaaauuuucugagagauagggucuugcauguugccgaggcuggccucaaacuccuggccucaagcuauccuccugccucagcuuccuaauuagcuggaauuauggguaccagcuacuguacccagcucccgagaugguuuuuaguaguagucauuuugauacuuuuauauaccuagcaaagugcuagauguuacauagucauguauguaaacuucaggacaauccugcaagacacuauuaucccaacuugcauagccuuaaaaagguuaaauacuugcuuaaagucaaguucaugaagcagaacuaaaauucaaaccuaaguucacuaggcuccaagcauauaccaucaaaugcccuaauaaauuccauuuuaaaauacauuuaguccuguccaauucuuguaaucaagagccucaauucuuuaguugugucaaacauucuuuuuaaugccaacuuaacuacaguaauaacuacuaugcacacagaaaauaucagcuggacuuuugagguuuuauugcuaccacacuggccuugaacauauguggaaagacauagauaauacaaaacuucagauuccauaaccuuguaauauuaaaacguuuucaugcuucugaaaauuuaagguuuugagaauggaguaaaguaagaagaugauaagcaacuauucauaaaaccaccaaguguuuaauuaaggcaaaugaaguuaggcaaaaacuaguguguucucugaaagcaaauaaguauauuuuuucuuaccaaguuuauaaaaacucauuuuaagaaaaaaaaaauccuuccugcauaaauaaguuguaaagauacuguuaucuagcuccaaaugagcuggcuacaguagaagaaacaaggcacauaaaggaaguauuaggacaaacuuaagugacacaaaaaauucugacaaggcauacaaggcaggaaggcaggaaaggaguaaggaaagggagaaaaagaggggaaggggaaggaaagaaucagggaagcagcuagggaggcacgugaggaagaagaggaagaagagaaaaaaaagaaagagaagaggaggaacaguuaugagugggauggguaaucaagaaaaacaaaaaauggggggagcccaagcacuuggcauucuucaaauuacaacuugcuaaaaaaagaacuuaaggcuccaugaaguauuaaaaaaacauauuccguuugcauaaauuagaaagaaaaacccaacacuguaucucauuagaaaagaaauauuaggcaguuggcuuuuuagccaacacuaucguguccucuaaugugugguuuuacagcuaagaaagcaagccuacacacuuucacagacacucacauaugcagcauaguuaagaccacgacucuccuuuauguacaauucaguguucuuaaagcuucaaugaggacaagcuaccuauuacacugaucauuguaucagauaaaugucuucccucugucaaggucagaggcuaucuagauacauagcucuucugauuuuucuggauuguucuuaauccuauagaguaagggcuggcaacuuguaucaaaaugacaugaaggaauuacugcaaugaauuaucacacuuuggauauauauguguuuuaagcuauuagacuagucauauuuuuacaacaccugacuuggaacuuugucugaucuacuaacuugcuuucuaguuaauucuuccuucucuuccuuccucucacuuauauauaucuaagagaauauuuagaauguggucacaugauuuguugaggguauacugaugacuuucugcaugcuguuuuaaucaaauauuuaaauucacaucaccguuaagcuguuucucugaacugaacaaaagaaauuucaucaucuuuggggcugagggggagcagaguuagcaucuuuuucagcagaauucaaaaacauuuauuucagcuucagcauauacuuuaaaacuuacuauucccuauauaaccucagugugaaauucugccuuuuuauacuguaauuacaggauauccaagucguguuucugcuuuacuauuuaaaaugaaacacauacuuccuacuuuuaucuccauacuaucaauaaagugaaauccuucagaaugggauaaaagauaugcauagauuuuggacaauauaaaacugugacgugcaacaguuaaaagagaaauaaaauauuaaagauagcugcuaagagugauuaaccacccucucucccaagcacaaagagaaaaauauaaucacauauaaacauguaaguuuaagugauguuacuuuucaaccaguucuccaaacuaaaacaggaagcugcaugugauacuagacagcuagaguauugcacuauaacacgacagagaaccaaacaccaaaaaaaaaaaaaaaaaaaaaguucaacaucaagagaaauuuuccuaaaagucuguauaaauaaaauugggauaccagugucaauuuaaaaaccucacuacauuauggcugguuaguuuuagaauuugauauuaaaaucuaaaguaacuauugcagugcuuuuaaaauaauuaauggacacguaaaauauaguuaggcaguauaaacauugauuggaaaaaaagguuaaaugguacuuuaccaacaaacauuucaugaguagguguccuaguaguaaaaguagauacaucugaagaaauggaaaggugaacaucaccacuacuuuuugugaggaaaggauuuaagcuuggaauggcaucaucaacagcaucuacaguagcagagaaaggaucugugcaguccaaauguauuauagcaaaaugaagaaaggaaguaaauaaauuaguauuguaauuagucaaaagaugcaaagugaaaaguaguaacuauauuauuguuuauuaaucuuaaauaucuaaauuaucaaaaacaaaaaauaccuaaucaucaagauagaagaauugcauuuaauauauuuuuaagugaauccuuagaaaaaauccuuuuauuuguuaacaccacaaagccaacagucagguaguuaaaaaauggaauaauaaccaagauguuucuauaaagagccacccaucuugcaccaaucuucccuguccuaggugagugugcuggucguggugguauagcuguguuuacuugaauaauugauauugacaauugguauguguguugugaguaaacuuucaaagaaaaaaagaggguaaugacaaauuagggcuaagaagcuguuuuuggcaugugcagauaauuccugcauagauucaaaauaaaaaauaaagaugaagaaaaaaaucuaaggaugggggaaagaauuuuagauaauuaagaacagagaugaaagaauguccacuuaauagacugcgaacaccuuugaaugucuaucuaagagcuuuagucuuuaaaugaauugcuaaaggaacaacaaaaguguuguuugccuacuagaaugauauaaauauguauuauaucaaauccuuuaucuaaaguuauucuagagucagauaauuauuauacugauaccuuauucaagauaauuaucauucuaaugacugaaaucuauuuuuccuuacuucucaagauuuaaagagcuaacuaaauggggaaagaaaaaauaaaaagcagcaaaaauaguauaauuuuuucuuuguaacauaauuaaaauaagaggauacuccuguaauucucaacaguggaaucuucuugucuguucuaguuuaguucuugaccuucacugaaauauacugugguaucuucauaguacuagguacuguauuuuacucuuaagauuguaugauugaacauuaagaaggcaacaguggccuaaggaccagcucauuuacuaugauauaggcacacuuccuuuaaagucaaaaaauucaaggcaagcauucuacaagcucaaauacaacugucugaaaaaggaaaaaaaaaaaucaagaaaauacucagguuaugauuuuaaaaacaacacaucuuuuaaauacaacuuuuucuguaguaagaacuuuucuauauaguauucuuauggaacaucaauucacacuaaaaaaaaaaaaguccuacaaaucuaucaaaauaugcugauuaugcuauucaaacucgaaaucuuucccaucauuccacccccaauaaauggaacacugggaaaaaagaaucagaaaacaguaauucagaaauagaaacuagaaaauaguuaaauaguuacaagaaguugcaggggggcacgguggguuuuuuuguuuucuucuuuuugagagugggucuugcucuguugcccaggcagacugcagugguacaaucagagcucacuguagccucaaacuccugggcucaagugaugcucccaccucagccuuccgaguagcugagacuacaggcaugugccaccaugccuggcuaauuuaauuuuuguagagaugcuaugauaccaacgcuagucuugaacaccugccuggacucaagcaauccuccugccuuggccucccaaagugcugggauuacaggcaugagccaacaaggacauugguuuuuaguacuaaaaauauauauauauuuuagcuaauauauauacugauggccacucuagcuucuucuugcauaagaaaggaguugcauuaagcuuacaguuggccaguuaggcugaaaguucuggguguguuuuguuuuuuuuuuuuuugagacagagucgaacucgcuguguugucuaggcugaagggcaauggugugaucucagcucauugcaacuuccgcuuccuggguucaagcaauucuccugccucaaccuccugaguagcugggauuacaggcgcgugccaccacgcucagcucauuuuucuauuuuuaguagagacggggguuucaccauguuggcuaggcuggccucgaacuccuaaccucaggugauccacccgccuuggccuccccaaagugcuggcauuacaggcaugagccaccacacacggccgaauguucuguuuuuaaauacaugauauuaacagcugcauagaguuuuaaaaguacauuauauuuugucagacaaguaaaauaucuguuuuucacgcaaaaaaagccaugaaauacguaauuuuuuaaagacacauuauuucuguaacagauccauugguuuaugagaaaacacauguucaggaaagguuaccagucauccgcuguucuacugacagauagguuuuaucuagcaccuaauuucaaucacuuccuauuacgugaaacaccuuagagaagaauauucagaaauauuugcaaaugcauucauaauuagaucaaucagauaaggaaaaccaguuccuaaucuacuugacaaaacacuacagguaaucuacaagauguuaaucuauuaauggacauuacacuauaauaauaaaaaccaauucauuaagguauaauaauaacgcuccagcuauuucaaguuaaccuauuaaacuggcaauucgaaaucccuuaaaguuuuuuuuuuuuuuuuuaaauaagagucuugcucuguugccuagguuggaaugccauggcauaaucauagcuuacugcagccucgaccuuucugugcucaagcaauccccccacuuuagccuucugaguagcugggaccacagguguauggcaccaugccuggcuauuuuccgauuuuuuuguagaggcaaggucuugccauguuguccaggcuggucucgaacuccugggcucaaauaaucugccugucucagcucccaaacugcugggauuacaagugugagccacugcacccagucuaaaauuuuuaaauauaguuuugucccuuuuuuuuucauuauucauucaaguuuaauuuuuucauuuuuuugagacagagguucgcucugucgcccaggcuagaaugcaggggcaugaucuuggcucacugcaaccucugcuucucagguucaagcgacucucgugccucagcuucccgaguagcugggauuacaggugcacaccaccacacccagcuaauuuuuacauuuuuuguagagaugggguaucaccauguuggccaggcuggucucaaauuccugacgucaaaugauccacccaccucaaccucccaaagugcugggauuacaggcgugagccaccacacaccuggcgcaaaaguuuaauuuuaugcuacacuagagucaucuaaaaaaauccaaaaaaaguuaaaacaaggauuaaaauggcaccacagucauauuaucgccuuuaaguccuaaacaacugauaccuacauucacacacacuaaacugauuuuuuuuuuuaaacaugguagagacaagguauugcuauauugcccaggcuggucucaaauucuugggcuaacgcaauccuccugccuuggucuccuaaaguauugcaauuacagguaugagccacugcaccugcccagauaaucaaauuuuuucaucaaguguuuuguguuucaugccagcuaaaaguaaagcaaauuaaacuucagaauggauaauucuauuacaccuaaacuaaaaucugaaaucuugcuucaaauauucaacaguguaccaaacugauaauauuguauauuuuuagauauaaaaauucaaaguuugcuaucauccaaaauuuucagggugaugaaaaccuaggucuucucagauauuaguauucaauaccgacugcuuguuuagacuccacaacauuuguugaaaaagucaaggcucauuaauaauacaaugaggccaacaagagagcuuguguucucccauuuucauucuaccaaaagguagaaucuuaaaugucuuucauauauacauauaaacuuuucuucccuuuaucucuaucuuaucacuaaucuaugacuaggaaugcgcaucauuucugugguguuuaaaagaacuaaauuaaauacuacgucuguuauuggcauucauuuuuagcuaauaaaagccaauaaaagaacaguacaagauuuggggauuaugaaaaaaaucauaccuuugcuuugucauauacuauaacagcagcauuauauguaaaauguuacauauuuaaguguucaaguaaauaguuaacuucaaaauaccuuaagcauuuaauguuaugaucuaagcuucucauacaugagauuucuuuucuuuucuuuucugucucccagguuagagugugguggcacaaaucucggcucauugcaauuuccgccuccgggguucaagugauucucaugccucggccucccaagaagcugagaugacagauguguaccaccacaccuggcuaauuuuuguauuuuuaguagagacaggguuuugccauguuggcgaggcuguucuggaacuccuguccucaugugaucugcccaccuuggcuucccaaaguacugggauuacaggugugagccaucgcaccuggccuuauaugagauuucuuuauuucagucuaaguuuaaguuaguuuagucuaacuuuaauuuuaaaaauuaaaaaaaauauaucgaucugauuguccuggauaugaguacugacuugaauuagaacuuucuuggcuuaaaguacucuucaguaucaugcagaagucaaaaccuuguuuaucaccaacucagaagccaaauauccuuauaugaaaguuaagacaggauuuaauucugauuaauuuauaggacuuaauaugggggaaauuuuuacagaaacagcauacaaagcaaaauaaccgaaaauagaaaaguaaaacaugauuaaauguauuccaauauauugcagucugucacauagagacuuugauggaauaaugucuuauaacaggacauagaacaauucuuacagacugaaauuacuuagaauuguucuuccacaguaauagucuaucugcuuucauaugugacuuuaacaaguucaaguagaaacuucaacuugucauuuuuaguuguacaugguguccagacaaaacaggaauugcaguucagcuucuuugaaauguuuaauauauuuuuauuuggccuucuauaaaauuuuuagucuauuuagaaaaacaacucagccuuaguuuuaaaaagacuacuacauuucuuuaaaaaaggaaauaagcugaaacugcuuaaauggucauguuaauucuacuaaccuuuucuaaagcaauucacaauaaggcagaaaauaauuaagaauccaaaaaucagaacauaacauuaggauauuaagaaacugcuuucuuaaucuuaauuuacuaucuauaguucauucugaaauaauucuaaaauacuuaacuuuaaacuauuaauaucuugucauuuuuaggaauuacucucagaucuuaaaacuuagcuaaauuaaacuagccuucaaagucaauuaguuuuuuaaaucaaguucaggcucacaaaauuaccaugaaaucuaguguuuuaggguuuuacuaucugcucugugccccaccuuauucaacaaacauuuacaaacuacuugucggaacaaaauauuuuaaaaccugccuucacagagcuuacuuucuaggauauaguuccuucaaaaaaauaauuuaaaauguucuuaaauucaaaucauuaaaauaaaaugaaaaaaagcuuuguuuauauacuauaaaaacucauuagaauaauuaacuuaucuugcuaugagagauaagccuaucacuucagaacugcuuaagggcagcaaacauucuuauugguacaaggggaaaauucuuugacuagcaaaaucuuucaggucuuaauuaaaaaaacauuuaaaacauuuaugucuugaccauaaagcuggucgagacaauuauggucacaacauguucccugugugauaauaccaucugaguuuuauuagaacuauaucauauacuuaacacaaagauaaguuauuccccaaaaguuaaaaaaaaaaaauucuacaccaaaaucgaaauaaccaccaugcauuuucugguuauggaauaaaaauucaacauuaaaagaauaaucucauaguuaaaaacacacuugguccuuccucuuacauuuaguuuuaucuuuauuaaaugucauuucauaauuuaauugaacauaaauuccuaaauuauuuauaauaaaugaacauaccuucaagggauaaaauugcuucauugccauuuuaauacuuaucaaguucucauguaucaaguguaauaaaaaacuacaaauaaguaaacaccacagaaugaggaggagagaugcauguaacaucuaaaauagaauucaucaaugcuuaccuccccauguacuugcuaccugagaagcaguugacauaggauguacagaugggugaaaaguuggcugcugcaaaucaagcagaucauugggcagcuuugaugugcuagaaagauauuuuggaaacguguuuuauuuaccagaaaaacuuugcuacuuuagugucaccuucuccacccaccacagauaaaaacauuaaaaacaagggagaaaagucucauuaauauaaaucucaaaagaggaacaguuucuucauaugacagcauauuucuaaggaggcuuggaaaaauaaucuaauaucauaucuuaaguuuauauaagauucaaagaacaguagcucuucugaaaaggaugaaugucuuccccuagaaaaaacuaauuucccuauuaaaaugaaccuaaacaacaagauucuaaaauacaaaauaucacagcaauuuuaauauuuuuaauaaaacucuuuucuuacuuuuaauauucacagaacuugaaucacauuugcaauacacuacacaguaaaauacucauuaaccucacuucuagugccucaguguccaaacuauguaucaaugauacagggaaaaaauuuuacaugcauuuaugaauagagccaccccaucacacaacacacuauuuacaugauauauuucuuucuucuuuuuuuugagacagagucucgcucugucgcccaggauggagugcagcggcgugaucuuggcucacuguaaccucugccucccagguucaaaugauucuccugccuuagccucccaagcagcugggacuacaggugcgcagcaccgcauccggcuaauuuuuguauuuuuaauagagacaggguuucaccauguuggccagccuggucucaaacucuugaccucaggugauacgccugccucggccucccagagugcugggauuacaggcgugagccacugugcucagccucuuuuuuuguuguuguuuugcuuuuuuugagacaagagucucacucuguuguccaggcuggagugcagugaugugaucuuggcucaaugcaaccuccaccuccuggguuccagugacuggcaugccuuagccucccaagaagcugggauuaaaggugcaugccaccaugcuuggcuaauuuuuguccuuuaguagagacaggguuucaccacacugcccaggcuggccucgaacuccugaccucagaugauccacccaccugagccucccaaagugcugggauuacaggcgggaggcaccaugccuggcuuacaugauauauuucuaccucaagacuucuauguaauuuuuuuuauuugagacagagucucgcuccgucgcccaggcuggagugcaguggagcgauccuggcucacugcaagcuccgccucccggguucaugccauucuucuaccucagccugccaaguagcugggacuacaggcgccugccaccacgcccggcuaauuuuuuauauuuuuaguagagaugggcuuucaccguguuagccaggauggucucgaucuccugaccucaugaugcgcccaccucagccucccaaaaugcugggauuacaggcaugagccaccaugcccggccgacuucuaugugauuuuaaugaacaacucaaaacaugaccccagagugucuaagaauucaaacacaguacagauaauuuuuuuaagagaaggggucuggaggcuggguguaguggcucaugccuguaaucccagcacuuugggaggcugaggcgugcggacugcuugaguucaaaaguucaagaucagcuugggcaaaauggcgaaaaaauacgaaaaauaguugggcauugcggagugcgccuguagucccagcuacucgggaagcuaaggcagagggaaugcuugagcccaggagguugaggcugcagugagccauggcugugccacugcacuccagccugggugacagaguaagucacugucucaaaagagagagagagauugagagagaaacagacaaacagaccaagagauguugcccaggcuagcuuguacggcugggcucaggccuuccuccugccucaaccuccugaguagcugggacaacaggcacacgccaccacacccagcuccuaauuuuuaacuuauauauucuccaaaauagaauguuuuucuuuuuaaauggauauacaauaauuguacauauuuaugggauacauaugauauugugauacaugcauaccauguaauuaucaggacaucuaucacaccucaaacauucaucauuucucuguguugagaacauucuaaaucuucuagcuacuuugauauagguaauacaauuguuuuuaauuaguaauucuacugugcuaucaaacacuagaacuuauuccuucuaacuguauuuuuauaaaaaaguuuugaagacaugucuuuuagauguacaauaguuguguagauaguagauauaaacgcauuuagugcuuuggggaacauauagaauauacaauaauaauucuguaaaugggcuguaagauuugcccuuaauuacuauuaaaaaggugaaaauuuuuaguaugugacauaaaacauagugaaauuaguucuuuauccaauaauuuguuucagccucgaacaaugaacauucuuuucacuucuuucuccuaggacagacuucuuuucaagaucuccauguugagaacuugccccuuaauggggucaauguuacuuaacuggggauuaaagaagguagcauacaugagcaaacaaaucauaaagcugaaagaaaaaaaagaacuaaauucaacaaacaccuacuaagauuucagggagcagguagcaacugagcaugcauacagcaagcaguucacguaguaaaacuuacacugagcuauuaggcucagcuauuaggagucaguaggcaggcagaugagcuuuuaagggugaguuaauaaacagcaacaacaaagugaaaggaaaaaacucaccacucucuauggaacauuuaacaugugcuaauaaugcacugugcuaaaaccuagucaccugggagcaucuuaaaaacaaaaauucuugggccccaggccccaccuacugaaucaaaacucuaggauugggacucagauaucuguaguuuaauaaacucuccaaaugcuucugauguuaaaguugagaaccacagucucaucugaaaacaagguuucucaaaaaaaguuaagaacuaacagagccaggauucaaaccagaaucugacuuuuaaaacuacuuuaagccacucugagguucagaaaaugccaauuguuuuacuuuaccuggcaauauuauauuuccauguuaaguagcuuaaauuagacaacaagauuauuaaaguuagucugguaggcuucaauaccaagaaaccuggcaacuaaacucugucacuguguuccagauuacagaguuuaaaaccaggaaacagauaugacagacguuuaauaucuaaugaaaugguauuuugaaauauauaucauauccauaugucaaagagcuauaaagggucuugaaccauuagaugccucauaaauguguuuaaucauaauuuuuacacaaugaaaaguuggcccagagauaacagcuauauuccuauuaguauaaaucagugauuuaacuaucuuccauuucguaaauacguaaaauauaaacucaucacuuuaucuuuagguauuauaccaauaucaccauuuaucgccaccucuuugugugaauagauuauaaaagcauaaauaaaaguaaaccugaaaaguucugcaaaauuucuauuagaagucuuugaaccuacauauucaaagguaaccuuaacuucuacuccuaccuguuagaagaacuagggguagaaaauaugucaauggcuggugcagucauuaucccuccugcugagguggauacaggagaggcugcaguuguuaaagagguaugagguuucuuugcaaguucuuuuaggcgcuguuccuguuaagaaagggaacuaccauaaggauuccagaaaccagauuucuuuguacagccucugaaaaaagcauuuucuaauuuguucugauagcagauauucuguuuuaccuaauucuaugucaggacgaaaaguuagacugaguuucagcccauuagguagcuauacauuuaagacucuaagucugugcagaggccccauuuaccuaaugaacaccuguacucauuuuucgaaauaaggagaaugcacaaacuuaccuuuaaagcuuucaaacgugccuguucuuccucuaaugcugccugcuuuucccuuucauccacuuuggucagagauagaccagugcuugccagggaagacacugcauuggaaaguguaguugcccuaggauaauugaacagagauaauuuggcuuuuugcuaaacacuucacauuacacccaggucaugaaauggucuggcaaccuugccauggauaggcacuauaauuauaaacuuaacuucuggauucaaauccaguacuucagaugaaauauucuaccuagugaucuacaggauuaaagcaauuagaaaaaucuugacuuaauauacacucacugcuuucagaguaaguguuugacuuuggaaaggguucacaacagaguggggcacauugccucuuccaagccccaagagaggaaaccagugcaauugggaaagagcccacauaaucccacaaaaucccugaugggaaaaaguguugaguuuaucacagggaaaacccucugcuaauuuacagccuacguuucggcagugccacaggaacaccaaaacaugcauaccaguaacacguaacguaagucuagguauguuucaccuauaacaacauccccagaggacuucagguuccuucaaaagaagacugguuucaaucuagucaucaggccauuuggcaucuuucuaugugcugcccuuuugccaaaccagaauuuccuuuuuaauauacauguacaauguaucauuuuucacuggcaaggcaccuccuuucccuuuuaucaaaaacguauccacacuauaaaccucaacauuaacuuuccaaauguuaacucuaggcuaaguaaaacaagugguaaagaauucuaaccugaagaacuaccuugagcuuuauuaauuuuccuuuuaccacacaccaaacaucauuaguuucuacucuuaagcacguaaagugguaaaaacuaccuuuuaaauuuuauguaauauuaguauuauaaauaagccaauaaaaagguacaauucagaagacaaaggaagaauaacauaguugugacagaaaugcaagaaaaccaauaaauuuuaugauaaacauuucagguaaauuggugcaccugaacuacguggcucuuuuuuucguuauucucucaaauaaaugagacuuauuguuuugacugcuacuucgaaaaucuuacuagaaaauucaaaguacaaaucuaggauuaaaaaugaguacuaaaauccaauaacggcauuucccuuuggaaauuauuuaaauuuuauuacuaaaagaaagaucaaaaguucugaaacaaccagaaagucuaaaaagaaccaaaggaagguucucacuauacaaauucuuucuucaugcuguuuuaaaaaaagguucauaagaaaacaugagaauaacucaaguaauuucuuaacccaauacaaaaaucauguuaccagacugauaugaaaugauuucuguuacuuucaauuugcuagguuaaauggucuuagucugaggaauuagcuuaaaacauaauaaagugauuaaaauauaaaauaucaauaaucaaccccaugaacuggcauuaggcagagaugaugcaauuugaugucagauauucuagguuugagucccagcauugcuacuacauacuucacagggcuauugugaggauugagcaaauuaauacgaaaguaucuugcaauuauaggccuggcacggugguucaugccuguaaucccagcacuuugggaggcugaggugugcagaucacuugaguucagggguucgagaccagccugcucaacauggugaaacccugucucuacuaaaaauacaaaaauuagccggccgugguggcaugcaucuguagucccacccuugggaggcugaggugggagaaucgcuugaacccaggagguggaaguugcaagugaguugagauugugccacugcacuccagccugggcaauagagugagacucugccucgggggaagaaaaaaaaaauguaucuuauaacuacaaagcaccacauaaaacaaugcauuagcaucuuuaggagaaauuuugacaucauaaacacaauucuaaacuaugcagucacugucauuaucuuaacagaugcugacauuuauugaaggucagaaacaauuucaagaauuugcauguauuaauccauuuaauccuaauacuaauucuaugaggcugauauuaugauuaaauccauuuuauagaaaaugaaaucaagauauagagaaauuaaacagcuuggaacuugagcugguuucaucuacugccucagaaaaaucacucuggcuuuuuggccuacaaagaaugauauaccugcuugcagcuguagaaucuuugauuuucuuuccuuccaaggaagcuaaauguuguuccaaagcaucaagaagacugcuaggggccugcaauuguacaaauauuaagaauuucaugauaauuaggccacuggucaaauuaaaucaaguaucaucuaauuagagagcaacaaaaauaaacagguauguucuucauguacuaauuaacaguggaguuuuagcuacuuaauaagaaugacaaucuuacuuuuguuauacaaacgugaccuaguuggagauauuaagaaacauuaucaaaaacguuaagaacugaaaacuauguaaacaugaaacauuuuuuaaaaaucuugcaaguacuuaaauuuuaaaguaaaaccauacuccuaaaagcucgacauacuacugagcaugcagaagguacuuaauaagcaccugaugagcaacugaauguguucaaacaugacucuggaauaauuacugauaaaugacacugaacacugucaucagggaaaugaaaaugaaaaucacaaugagauacaccuuuucacuuacuacaaugacuaaaguuaaauacaucugcaguaucaaauguuggugagcauauggaacaacuggaacucucauauaucacuaguaggaguuuaucaccuugaaaauggauuagguuguucuuuacaaaguuaaauacacaccuaccuuaaugacccaauuccauuccuauuuaccccaaagagauaaaaacuuaucucuguaagaaaagacuuaauguuuaauguggcuuuauuuacaauagucaaaaacugcaaauaauccaaaacuccaucauuuggaaaauggauagacaaaauugugguaaauauuauucagcaauaaagaagaauuaauuaaugguauauucaacaacauagaucucaaacaauacgaugagcaaaaaaagccagaaugcaaaaguaaauacuuguaugauuacgcuuauauuaagaaccaacaaaauuaugcuauuagaaaucaaaacagugacuguggagguggguaagaagugacuggaagggggcauaaggauuggggaaauagaauuuuccuaucuugaaugauguguugguuacauaaauguuuauuuaucaaacugcauugaaaugaauacuuacguuuuuuuuuuuaauggaagacuaauuuuaaacucaggcuauaggucaaaucucaacuuaauaugaagaaagcucucaaaaggaaaccuuuucagugugcagacuaagaacuguccgcucuaagugaagcaaaugcaccaguagcauuuacuuacccuaaauauucuauaggauuugagacacaguuucuggauacaggaucuaaaaauaguuaaaggggcaauaccugcuaauuucucuaucauugauggcuuuaacaacuucuuucauccacuauucccucuauauaccaggacccuagcccaagggagacacaguagaaaaccauuuaaaaccaaauacuacauuggaagaugaacuucuuuguugaacugagaguauacauacacuuucaaacagccccagcaaaaauguuugcuaaucagcaagcaaagcacugucuuaagagcuuucagagaugauaaggaggauguugaugauagugguuaacauuuaaaaagcucuucucacacaacagguacugugcuagcuaccuuguaguagucacugaaucuaugaaguagacacuacugguauauccauauuacagauaaacaaccugagacagugaagauuaaguaaucuguccaagaucacauaucugauacacaacagaagccaagauagggaagguaucucugacuuuaaagacuacauaauuaacuacuaugguaccaaauccuggacugaaacuguggucauagaaacuguaguuuaucuuuuuucugaaggguuuaagcuguggcuuacaaauaaaaauauuaaacuaccaaguuaugauuaguaagacaaaccauuucuaaaaucccuucuaaauauaucuggcuauuuuucaaaagucaaauccacacgacaaagagugaggaggcugggcacagugacucacaccuguaaucccaaaacuuucggaaguagauagaggugagaugacugcuugagcccaguuguuugagaccagccugcggaauauagggagacccugucuccacaaaaaaauaaaaaaauuaguugggugugguggcauaugccuguggucccagcuacaaaggaggcugaggugggaggauuacuugagccugggagggugaggaugcagugacccaugauuuugucaaugcgccccagccugggugacaaagcaaaagccuaucuuuucucucccucccccaacaaaacccaaagagugaagaaaaugugaugcuuuacaccuuaaaagaaauuaccaaaaaaaaaaaaaagaguaaauaaucucaaauuuucacucuucugcauuaccaccaucgucccuaaaguguaaauagcuuuguuuuguucacuuuugaaaauuuucugaaucagccaaagaaugccuggcaaguuaccuuugcucagagaucaucaauacagaggaaaagaggaacggagguuaaagaacccuacucuaauuacaauagggugaauauuaacauacacagauacaugaugacggccuguaacuucuacaucuagccugaggacaaugauuuuuaaauaaaacauaagggaagcauaacaaaugggguggguaacaggugaaucuaaaguugccaaaucauuuuauaauauacguuauucaagcaaugacuugucucauguucaacccagaaucaugugcuugcucuuaauaaagccaauuuauuucaaguggacauauacaggauucuuuacuuacauauaacccaugacuagauuuauugcauacucuuagccuugacauuagagggaagaaucagaacaagugaguacagagaaacucaauaauaacuguuaacaaggcguuuaaaagauguacuggaagcuggguguggugguucacgccuguaaucccaacacuuucggaagccuaggcgggcagaucaccugaggucaggaguuugagaccagccuggcuaauauggaaaaccccgucucuacuaaaaauacgaaaauuagcugggcgugguggcuuacaccuguaaucccagcuacuugggaggcugaggugggagaaucgcuugaacccaggaagcggagguugcagugagcugagaucaugccacugcacucuagccuaggcgacaauagcaaaacucuaugucaaaaagaaacaacaacaaaaaaauguccuggaauaauucaaaacaagguaaaacagaugucaacaaaugagagaguugauggaaauguuacaaggauagcuuaugccagguacuuucauucuuaauacuccguaaagaaaacagagaaucagccagaacaaccagcagguaugaaguuuuuuccuagaaaauuuuuugaugaugaugaugauaaagacaauauuaaaauagcaaacauuaguugaguguguuuaaugcucuaauuuuuuuuuuuggcauuaacuuauuuaauccugugaacuacuuacugucugagguagguacuguuguaucuucauuuuacagaugaugaaacugaagaauagaaaguaacuuccccaaagucacagggccagcuaauggcacagccgggacugaaauuucgacguaucccaaacccuacucucuuaaucuuauguuuugugguuuaucccuaaauuaauacucccaccugagucaaacagucaaaguggaaguuuaaaacaggaaaaauaaauacuggauaauucucuaccagcauuauagugaaaauuguuuuucuaaauaucauuuucuaaauucagguuccaaaaaguuuuuuuuuccuuuuuuaaacaaugaugaugggaaagaaagagugauugaagagauuaaauaaaugguaugacaguggguaggcaacaaauauaagugguaagcagaucauuuuacguggucauaguguuagaacaaucuucaggaauacaucaaaauguuaaaacuggucaaaaacugcauugaucccuuugacaaugggggcuauauguuacuuaucuuaauacucuucacaacuuguacacaacagauaguggauugguauuuuaacaauaaacuuaccugugaaaggucugguauaucaccucugucaauuccaacuugcuguaagaaaagcauuguauuuaauaaauuauaauaaaaauauuuuauaaauaaaauuuggaaaaaugacaucacggcuaguaccaguaauauuuuaaacagacuucuuaagaaucaggaaaauauuuaaucuccaaaaauacucaacauuuccaauggcuuagauauuauuugguggcccuaaaaguucuuaacaguagggaaacuagaguuggaaagucaacaaaucuaaguuaccaucccugucuucugaacaccuguauguaagcuaccuugucacaaucugaaaacuccccucucuucuauguguaauaugauaaaaacacuaugguaagaaugagaaagccugaccaugaacaagcucuuugaugcaaaaaaaaaaaaaaauuuaagaaacaaaccugaagacaucgacuuugucuuucuccauaaaacaugcuuucccuggaaaucaccacagauaacacuuuaaaaacucaugcucugucagguaggccagguuuacauaaaugucaagugauaucuaaucaggauauaacugucuucucaaaccaauuccaauauaccuucaugaugcucaggcccuaggcaauuuccagcaaaaaaagauagaaacgguuccuguguauucuagcaccccaauuagaaaacuauuuucugucccguggcuguguuucauuuucuaaucagucucccuuccuuuugugaccucucaggggcuggucucagaaugaugucagcagaaaaucugauaaaggccagauaugguggcucaugucuguaaucccagcacuuugggaggcugaggugggcggaucacgaggucaggagaucuagaccauccuggcuaacacagugaaaccccagcucuacuaaaaauacaaaaauuagccgggcaugguggcaggcaccuguaaucccagcuacucagcaggcugaagcaggagaaucguuugaacccgggagguagagggugcagugagcagagauugcuccaccgcacuccagccugggaaacagagugagacuccaucucaggagaaaaaaaaaaaaucugauaaauucauuauuacucagauguuacuaaucacugccugauauauuuguccuccucaaacauguuucaagagguuacucuugccuucuuccaggaacuaaggcguucuaauuaaacugcaagcccaaacacagucucaaaacagaauauuuuaagguaagggacucuggccgggcgcgguggcucacgccuguaaucccagcucucagggaggcuaagaggcgggaggauagcuugagcccaggaguuugagaccugccugggcaauauagugagaccccguucuccagaaaaaggaaaaaaaaaaaagccaaaaaaaaaaaaaaagaaaaaaagcguaagguaagggacucuucauauuuuucuuaaaucauauggagcaggcugggugugguggcuuaugccuauaaucagagcacuuugggaggccaggguggguugauuacuugaggucaggaguuccagauuagcccggccaacauggugaaaccucaucucuaaaauuagcugggcgugguggcgggcaccuguaaucccagcuacccaggaagcugaggcaggagaaucgcuugaaccugggaggcagagguugcagcgagacgagaccaugccauggcacuccagccugggugacacagcaagucucugucucaaaaaaaaaaaaaaaaaaaaaaaaaaaaaaagucauauauagcagacagucuauugcaccuaagaauaaguuaacagcagaucuggaguacagaagggggcuuacaacuuaaguuugggcgggaugccauggcucacgccuguaaucccagcacuuugggaggcccaggcgggcagaucaccugaggucaggaguucaagaccagccuggccaacacggugaaaccccgucucuacuaaaaauacaaaaauuagccgggugugguggcaggcaccugcaaucccagcuacucgggaggcugagacagcagaaucgcuugaacccaggagguggagguugcagugagccaagauugcgccauugcacuccagccuaggggacaagagcaagacuucaucucaaaaacaaacaaacaaaaaaaacuuaacuuuguaacuacaacuaccaaaugcaaagaacauaaaaggccaagagggaaggucaacaaauuaaaacuuacuugaagaauuuacuagaaucacagcauaaacaccaccuucuucuguuuuaguacgugacugacccuuaaaaaacggaaaggaucuuucuccuugaaacauuuuuaaauucaaaauuaauuucaguaggcuucauaaaacagcagacuaauaacaaagcuauuguugaucauccuguucuguccuauugcaucuaauauagaauaauauaucaccacaguaacaaagccuagaaucacuauguugcuaauuccaaaguaacugcuuugacauaauugagcaaauuauccuaggaagaaaucuuugguggagauggguagaggcuggagaaugggagaacaaacaaaaaaaccccuuaagaacgccucugugguagcaagauaaugccugcaaguauuaccacaccugccuuccgugacaauuucagaaaauuauuuuuaagcagagcugcaaaauuagauauccuauuaccuacauucauaguuuucacaaucaaugauaauaaauacacaaaauccauuucugucggggaacaaaagcuuuuuuuuuuuuuuugagauagagucuugcucugucgcccagccuggagugcaguggugcgaucucagcucacugcaaccuccgccuccugggcucaagugauucuccugccucagccuccuaaguagcugggauuacaagugcccgccuccaugacuggcuaauuuuuguaucuuuaguauagacgggauuuugccauguuggccagucuugaacuccugaccucaggugauccacccaccucagcuucccaaaaugcugggauuacaggucugagccacggugcccagccaacgaaaacauuuugaacuauggcuccagcugucucacuggaaagaaaccugcacugauacuggauauucucuaccacauuuaacaauaaacauucucaaauauaugguucauuccaaccauaaaaaucucuggcacuacuguaugucaccuacuuaauuuuauagagaaguaaacaauguaaaaacagguaacuuuucaauacucgcuauugaauuaaauuuacagcauguauuuuauucacuacuuuaucauauucauaucuugccacagaauucaauacagcauaauaaugauugaauacuaaauugaagacauuuauuuuauuuggauagugagugaugacuucaaaauccauacuuacagacaaaaaggcaaguuaggagacagucacuuaaagacaguuuaccucugcaacuuugaggaacucugagauucuugucauccuaguuaggaacuucuuauagaugucaagaccuucuuugcauugguucuuuuucauaucaaaauauuuuucugacaaaauaaauguaaaaauucuuuuguucacaucaaaauauaacacccaaaaaaggaaaaaaaaaguagguaauagcuccaaauaggucucuaaaggagcauacauacccuacuagaaaaauaucaguguuaaguuagcuuagguauuuaaagcaaauuagaauagaggugcuauuauacuaaaaaaagaaacauuacuugacccuacucauauuccuaguuugugccauaguacuuuuccucacaauuaccuaaguacauauuuguguguaaacacguaccacacuugaccccauuuaaaacagcacuaacaucuauuuccaaucuuacuaauaguauauuaucuaagauaacaacuuuaccaugcccaaaugucacucagaaaguucauuuaaguuuaauguauacauagaaaagguuaauuuauacuaauuauaguauugaagacuaugccuuccaaagcuuuauagaaaaaccuuuauuuuucacuugugaaaaaauaagccaaauuucccuaucccuauagauuaaagcaucccugaguaaguccacguuacuucagacuauaaaaaacagauuuaaauuuuuuaaaaguucauuauggaguugauuaugagaaaacaauauucuucugggacaaaauauuuguuuuuuucccaucuuuuuuuauugugguaaaauaccuguaacauaaaacuuacuauccuuuuuguuuuuuuuuuuuuuuugaaacugaguuucgcucuuguugcccaggcuggaguacaauggcacgaucuaggcucacugcaaccuccgccuccuggguucaagcaauucuccugccucagccuaaaacuuacuaucuuaacccagcuaaauuuuaaaggcacuuuuauauuucuaaaaauuaauaaaauggguggaaaaaacauagauacaucuaaaaaauaaaguucaucuugcugaacauccuggguauaaaaauauguaaucacuugcagaaguaauuagguauaaaacucuuuucuccaaauuaacuguuacaaugaaugaauauaucauaauaaauuuuuagccagcuuuaaguaacaacucagucaauauuguuuauccauaugacacaagauaagaaauguuauuaggcuacagcaguauuuacccaacaaauuaauaauuccuucauuguaugcugcaaacagucuaauggcaucuuugaacaggagcaugaaggcagcauuuauuaccccauuuguaaguucauugcuauuaaccuagggaaaaauuggaaaauaaaauuagcuaaucuuagguuuuaaaugacauugacaaaaagauuuccuucaaauuaagauacaguaaauucaugcauuaggcauguuagugaaaaauacauuuauuuucucuaauacauacauaaagaucacggugcaguagcuaccauauaaaugaacauuauuuauuauuauuaaauuugcuguaaccagauaauuguauuuauuugacuaaaagaauacuggaaauauuuuuaguuuuaucucaaggaauaaaucaaaaagauaaaccaaauuaauucuaaguucuuuuuuagcacaugaaaauuaacucguuauauauagaaaaacuaagcacaaaauugaauggcaaacaaaaaacugguaaaaaaguuauuugcagacuaucuaguagagcugauguccauuauauagggagaauccuaauaauaaauaaaguaaaugaaaacaauuuacaaaauaaaaaauacauauggauaauaacgugaaaagaaauacaacuucacuuaucagguaaauuaaaauacaauaaucaaaucaaauuacuaaaauauccuuuccugaacaucagacuauauuacucagugcccauaagaaugaaaaaagaaaagaacacgguagcucaugccuguggucccagcacuuugugaggccgaggcaggaggauugcuugagccuggcaguuucaaaugagaccagccugggcaacacagcaagaccuugucucuacaaaaaacuaaaaccaagaaaaggcagcugagcauggugguguaccccuguagucccagcuacucaggaggcugaggugggaggauugcuugagcccaggaguuggaggcugcaaugagcuaugaucaugccacagaacuccagccagggugacagagaaaaaugcugucucaaaaaaacaaaaaaaagaugaaaaagcaaaaacagacaccuguugagaaguuaguggcucacccuuuuggaauauaagcaauauuuauuaaaaauuuaaauguuuauauuauuugaaccaccacauucuuuuucuggguguuaaaccuauugaaauagguuuacaaauagaaacacacacacacacagagggagagacagacaagagacagagagaggagagagaauugaguguagcacuguuuaggauaaaaaaacagaauaaacaucuaucaacaggaggauuagauaaauuguuauuauauaacaaaguacaauacagacauugaaaagaauaagaaauuuuaaacaaauacaauauauuaagaaaaauaugcaugguuggacccugagauucuauacaaaccaaaauaauguugaauaacugcaucaguaccccaugccuucuagagcaggggucagcaaacuuuuuuuuguaaagggucagaugguaaauauuuuagacugugggccacacagucucugucauaacuuuugaacucugcuguuguaacauaaaacagccauagauaauauguaucagugagcuuggcuguguuccaauaauacuauugaggacacugaaguuggaauuucauguaacuuccaccuguuacaaaauaccauuuaauuauuuucaaccacuuaaaaaacauacaaaaacaggcaguaagcuguaguuggauaaucucuguuuuagucuaugaaauaccuguaagauuuauugaauguuuacugaacacuuacuaugugccacauuaauaggcaauggggguacaacagagaacaaaagugaccuaguuccugcccugaagaagcuuaaaaacuagcaauuaaacaauuuaaaggaaaaaucuauuucagcaugaaacugucacaguuccauucacuaacuugcacucacaaucucuaaaacaaaaugacaaauaaauaauaaacaaaacauuguuaagauagaugacaaaaaaacagaacagaguugaaaacguuaacuucuaacacauuauaaaugaaugacaaagcuggcagcuugguucaagucauggucauuaaaacaaaaauuccagcgaacacaaugcccuugggcaauagcuacauaauaagcuauuauaacugcuauuuaaacuucuucuucugaauaauugccaugcuuugagucccauuaaauagacaaaaguaaaauauuaaguuggcuauuuauuuaaaaaauaucccuguacauuuucaagaucuaaaagccauuaucaaaagaaaauauauuuucagaucaauccuuucaccacuuuagcuuguauaucuuaaaauucuagagcuagagaagcacuaaagaaauaaauccaaaacagucauaaaaaucagaaaguaauuugacuugagacuauuuuauaaaaaauccuuagccauauaggauaucaggaugugaaaaacuagagucugugaaaacuugagguuaaaaauucucaugaauuauaaugaccuaauuuuuuaaaaucuuaaauuacaaaagcauaacucacauuaaaaucaagaagugcauccaucugauucugaauaauugguacaguuuuuaggaguuuuucuguguucauuguucucauaacuccaucagcccuguuaugaaaaaaccagagaaauaaacaaaugaaucugcaauuaaaucuacauuucaaacucccccccugguuuucuacuaaaacagagaaccaaguugcuaugaaaugucacauauuuuuaagucauuauggaacaugaaaacugaagcagagaucauacagaaaaaacaaaaacaggcaacacaauaugucaaauaucaagguacucauuuagaacuaaaaaagaacauaaagcaugagccauaaaagcaaaaguauacauuauacagcaaggucuauagcuuguauuuucacaagaugaaaugaucugauccucacaaucauugguguguaaagagcaguuuuaccauuuuuuaaaauuacaaauaaaauaaucauuugccucaagucaaaaaacaguuaaacacucuguaggccaagaguuaacaaagucuuagagcucuguuuuauuuaaaguauuuuauucaugacccaacagcaauggcuuuuaauucagaaauuauaacuaaaacuacuuuauuacaaaauaaagaacaauuuuaccaaaucauucuaaucuggcuauuacacaagagauacuuucaauggacagccuuuaauaaaauagucuguuaaauauuuccaaacagauauuucuaaagauagagaaauuauuggcagcaccaaaacagauuuaaaaaccaguacaugaaagguacuggggcuaacguacacaacuaauauuaagagcuuauuauauaucacacuaaguauuauucagagauugcccuaucauuuucaaauccucauucuacugauuuacuguuugguugaguaacaaggcauuuccaaaaaauaugucagguuccccuaauuuacaaaugaccuauacuuauaaauggcuguucuacccuacgauaaaccaugaacuaugaccucagacgccaaaaaacaauuaagcuauaaaaagcaacaacugugcuuuguaggacacaacaaaguuuaauaaccaaauacuagacugccuuaaguagucaccuauugaucagcuucggccuaauucucccuaauguguuaacuuauggaugccuguuuccgcucaagugcuaaacagcauuggcuggaagcagcugcuggagcuugggcugaggacaccauuccuucuuuugcaacucuucuuacugaugucauuuuuuuaccucugguuacuucuccaucacagaagauuugaacauuggcucagucuuucuugucauuagcuucaacaucuacauggacaaccaauccaacaccuugaugucaaaaucccugauucuaaccuuacugcccccagaaaccacaucauccuagccccaccccugaagaacaacaacaaaaaaagguaaaauucagacaccuuauucugugacaauuaccuuuuaaccuuucagcugcuuuggucacauaucccugugguaaaaacuauuugaccucaucagaaacuucaauguuucaacuccaccacuacccacauugauccuuucucauuuuuacuuucuucaucuagcuuagaauuccacagaucauuaauauaaucacuccuuuacaaauaccuuuaacuuucuugcaccucuuuucuucccugcauuucagucaucuggcaaauucacuauccuggcugagcaaacaccuaacuaauccaugccuguacacacauagcugagugcugguaaagaaaacagcacaacugggcaaacuggcaaaacuauaaacucaugaucaucaaccucaaaugaauacucaacauugccagcaauccucuuagccgucucuaauaaaauccucuccuaaguaucuucgaauccucuucucuuuccuugucuccuuacaugaaacacauaagcucucagcucuuaacucccaaaauauuucauucuggaacagaaaauaacaaaaagcaauugucuggucuucuugccacccaaacuauauuucuauuuaaaaaguguuggcuaaggcugggcgcguuggcucacgcuuguaaucccagcacuuugggaggcugaggggcgaguggaucacgaggucaggauuucgagaccagccuggccaauauggugaaaccccaucucuacuaaaaaauacaaaaaguagccgggcacaguggcaugcgccuauagucccagauacucgggaggcugaggugggagaaucgcuugaaucuggaaggcggagguugcagggagcagagaucacgccacugcacuccagccugggugacagagugagacucugucucaaaaaaaaaaaaaaaaguuagcuucuaccucauguuuuuccuaccaugguagauuccaaaugaauccaagauuaaaauauaaaacaccuaauccauaaauauaacugaugaaaacauaaucauuuuagcucacugagcuugcuugaaagauaaaaaacauaaaaaugaagauaaugauuuugaucaccuaagauuguaaagcuuuuaacaauguuaaaaaacaaggaaaaauacucauaaccuauaacaauuuauuuuccuaauauacaaaaaguucauuuguugaguguuuguuauguguuaagcacuacauacaauaucccauuuaauucucacaacaauccugacaggaaaguacuaauuaacaucguaauuuuacagaugaaauaacucagagcuuaaguaaggccuucccaguuuugccacagcauacuaguaugguagaaaggguuauaagugugccaagauguugauccuuuuuaacccuuuagccucaaguagucucuuguauaaauaguuaacaguuugugugccaccaugugaaagaaguuuagcaagcugauagauacguaauaaaauauccuuguuuuuagaaaauauucaccaaaguauuaaaagauauaaacuauaaaaggcaucagguauguaacccacucucaaaugguucagaaaaaaaugugugugugcgccugugugaauauacacagaaagagaaaugcagauguggcaaaaugcuaaaaacuggugguucugaguaaaguauacagaaguucucuaauauucuugcuacauuucuggaagugaaauuauuuuaaaguaauauuauuuuuuaaaagucaguaaaccagcuaaaguaucucacugaagucucucaucuaauuggugugaagcuagaauucaaaccuagauucaucugacuaaaaaagcuugugaguucuuaccacuauuaaacacaauggaaaagagugaaaaacccaauagagaagcugucaauggacaucaaaagacaauuaauaaaacaaguauggcauucaaaaggaagggggagugugcucaauaucaccauuuauucaaucaacuaauauaaaaugaacacauaugaacgcauuuuucaugaugauggaagaauacaaauaacuauuuaagccaauaauuuaguauaacuuuuauaaaggauaauuugguguuuuguauuaaaauguuaaauguauauauaucucaaugacucaucaauuuuaauaauuuauucuauagaaaaacucaaugcaaccauacauaaaaggauggucaauccacugcuuuuauaagauuaaaaaaagggaauaaaucagauguacaccugcaacauaauucuacagccauucauaagaaugagauggauugaggccagaugagguggcucaugccuguaaucucagcacuuugggaggccgagacagguagcucacuugaggucaggagcucaagaucagccuggccaacauggcaaaaccccaucucuacuaaaaauacaaaaauuagcugggcauuguggcgggcaccuguagucccaacuacuugggaggcugagacagaagaaucgcuugaacccgggagguggagguugcagugagccaagagcacgccacugcaccccagccugggugauagagccagacucugacuuaaaaaaaaaaaagaaaaaaaugagauggaucuauguguacagacauugaaaauguccaaaauacacaggaggggaagaaaagcagccuucaaagaaucugauccaauuuuuauguaauuuucuaugugccuuuauauacauauuucuauuuacucgcacagaaaagguuagacacacuaaaauguuaacauuuucuaugaauuaggaugguauuuuucuuaaauuuuauuacuuuuguaaacauaaaaaaaaaucuuaauaaaucaaacuuuacuacuuacaaugagaguccucuccaaaagguguagccuacugagguuuuugccaugauauaauaauuucaauugcugucauguccucaauuuauaccugauauucuugauuuuuuucuuuuguauuuauacagucugacguguauauguguguguauaaugccacuuuugcacuucuucuugguccccacucaauuauggcuccuccuugauucaacuaagucaauacuaauuuuauuguacuuaaucaggagcuauuuuccuccaauuaaaaaagacugcucuauuaaauaaaaaaauucaccaacuauucucaagacuggcccuucaaauuagaacaaaaguuaccauuuuaaaaaucuauuauucugaaaucuguaaauacacugaagaucaacuucacugaagacacuuuacagugaaauauuauuggacaggauacagagguuaaaaaucagacuucuaaaaaaguucuccaccauaaucuucuacaaagugcuuaaauauaugaaacaaaaucuguagaauuuacuuuagguauauuccaaaauaaucaccuccugauggauuuggaauggcagcauagaacauuuaaauucagcuuuaaauuuucuugcauaacuaagagguuaccucuauauuuuaauuaaauuuuucacuucaguccauuaauuuaaaauuucaauagaacaaucuaaaggaacacaucaauugcuuagaccuuugggaucacugagcagcagaguggcucaggaaggcauucaccagacuauuucuguacaugccagauucccuucaagacaggucuucauagcuacaagggucaucgcugcugcuaagaaugucuucaguggcuuucuccugaggccucauccuauauccuaggaaaaaaaucugcauaucagguguuaucacuuauagaagcacugacuauaucauucaugugacuggaucauguacuaagaugauuguuauuuagggugcagcaaaaauuaaaugcaucuucugcauuuaagauuaaaagaaagcuuaaauacaaaacagcacugaaagaaaugaaaaaagauccaaauaaacagaaacacaucucuuguucauagacuagaaauuuaaucauuaagaagguaauacuccccaaacugaucuauagauucaaugcaaucccccacaaaaucccagcuaucuuuucugcagaaaucaaaaagcugauccugaaauucacaugggaaugcaaggggcccagaacagcuaaaacaaucuugggaaaaaaaaaaaaaaaaaaagaauagaauuggaagacucacacguucuaauuuuaaaacacacugcaaagcaacaguaaucaagacaaugugguacuggcaugaagauauacauacagaucaacagaacagaacugcaaguccagaaauaaaccuuuacauuuauggucaacucaucuucaacaagguacuaagacuauccaauggggaaagaagaguaauuucacaaaauguugcugggauaacucaauauccacauacaaaagaauaaauuuggacucaccucucacaccauauacaaaaguuaauuccaaauagauaagaaccuaacuauaugggcaaaaaauacaagauucuuagaauaaaaaguaggaguaaaucuuugugacccuggauuaaacaaugauuucuuagacaugauuacaaaaguacaagcaaccaaaggaaaaaaaagauacacuuaauuaauuaaaaauguuuguucuucaaaaaacaccaacaagaaacugaaaagacaagccaugggagaaaaauauuugcaaauuauuuaugcgauaagaaacuggugcccagaacauauuuuuuaaaauucuugcaacuuaacaauaaaaagggcaaguaacccaauuuaaaaaugagcaaaaggccaggucaguagcucaagccuauaaucucaacacugugggaggccaaaaugggaagacugcuugagcccaggaguucaagaccagccuuggcaacauagugagaacucauuuguaugaaaauuuuuuuaaaaauuaacugagcauaguguugcaugccuguguucccagcuacucagcaggcugagggggaaaaauugcuugagcacaggaggucgacacugcagugagcugggauggugccacugucucaaaaagugaaaauaaaaaauaaaaacagggcaaaggguuugaagaggcauuuuuucaaaagacgauaugcaaauggucaacagcucaaaaaaaaugcucaauaucauuagccaucagggaaaugcaaacuaaaaaucacaagacaccaguucacacccacuaggauggcuaccauuuaagaaaaaaaaaaaaaggcaaaaaaaaacccagaaaauaacaaguauggcaagaauagggagaaacugaaagugccauacauugcuggugggaacguaaagugauucaacugcuuugaaaaaugauuuggcaguuccucaaaaugacaaacauaagaguuaccauaugacacagcaauuccacuucuagguauacaccgaagagaauuaaaaagauaauccacauaaaaucuaauguucacagcaccauuauuccuaauaggcaaaaguagaaacuauucaaguggccaucaccuuaugaacagauaaacaaaaugcaguauauguccauaaaguaaaauaugauuuggcuagaaaaaggaauaaaauacugauauaugaaauaacauggaugcuauaacuuggacauaucaugcuacacaaaggucacauauuguauaauuucauuuauaugaaauguucagaauagacaagcccagagacacagaaaguagauucaugguugccaggaucuaggggaagagggaauaggaaaugaaugcuaauagguauagaguuucuuuguggaggugauaaaaauguucugaaauuaguggugauguuggacaacuuuguaaauacacuaaaaaccaaugaauuacacacuuuaaaaugauaaauuuuguuaugugaaugauaucucaauaaaggugcuauaaaaagaacuuaaaaacaaauccuaccacaaaaaguacuugauauaccucaucaaagaaaaaugaggcucaucuuuuaaaacuggcuaaaauuucauaauucauaaucuaguaacuccuauguuuuacauuuuuaaaaauucaaaucaauuagaugucaaaaaaagcuuaacucacccucucuucacuuuugugaaaucaaaugcaacuugucuguaugaaacugcuuucucauuuaaauaucuacuauaccgccuaauaaauguagacaugucauauccuguaaaaaaacaaaaacaaaaacaaaacaaagagagagacaaguuuuuauaaaugacuaaaaaucccaauaugccuagaaaaacaacucauugcauccaauggcuauaaaaugucuugauaucccaauucaauuuaguauguaaauuaaguaacuaauuaauaacauuaccauuaaauucucuuaaggcuucauauuuaaaucagauaaguccuauguaguuuuaaaaaaaaaaccucuucccuuagaacuucacuauucucucaauauuccuauucuuuauucaucaggaauuagaaaaacguucuuuuacacaacuugauaaucucacaacucaaauuuaacauccuauggaaccacaaucccauuccucaaaucaagcaacuuuauauaauuuuuauacuccuaaaaucuuuagcuguauuuagaaccauaacuuguaugugccaaccuuauaaaaaguauaaaaaauuacuguguaauauaagaaauggcaacaugcaaguucaggguguaacaaaaacaauuauaugaauguuuucaaugaaacuuucuaaaugaauacauaaaucauucuaagauuuuguuucaucaugaccuugacuugaaaacuuuagcaacauaaaaucuaaucaauauuauuuucuaaaaacaccaaaaacuuuguguuuuaguuauuaccuggcucaaggaagucuauaaauuuuugcuccucauugaaaagugaacccauuuuaucucauauucaucuaacaaauuuaauuacuuggucuuugcuaccuuuaaaagacaauaccaaaaccaaccaaaauguaaacuaacuggauuucaacaucaccaguucauuuauuuagcaaaauauuuauugagugccuauuaaguaccaguggagaaaaaucagugaacaaaauagaaaaaaaaauacugcucccauaugacuucauaccuacuacuguacacgucagguguuacaugcucacauuccucagcucuucgguucauaugguucuaucuacuauaccccauccuaagacgguaaacaccucucauccuucaaggcucaaccucucgucuacauaaaaagagugaaauuauuaacaccuuaccacuagaauugcuuaauuuccaucuuaagaaaaugauaaaucagucgcuaauaagacacaaaaaaccuacuuggauauaugcauaaacucugccuagagcacugcucugcaucuuguuuuccauagacuuuuaaaguuaaaaugaacugaaugagggaggaagugaaaauuaaaggaugaguaggcaguuucuuccaugccccugaaaauagagacacuccauuuuuaucuauaauauauaucuggcuucuguuuaagauuucaaaaagaggccaggugugguggcucaugccuguaaucccagcacuuugggaggcuuaggaggaucgcuuuagaccaagaguucaagaccaaccuggucaacagagcaagagcccaucucuacaaaauauuuaagaauaaaaauauuagccaggcgugguggugcacaucuguaaucccagcugcucaggaggcugaagggaggaccgcuugagccaggaguuagaggcugcagugagcuacgaucauaccacugcacccagccuaggugacagagcaagccccggucucucuuacuccagccucagcaacagaaccagauccugucucaaagaaaaaaaaaauuuuuuuuucaagagagggggucuacuguuuuaauuuuuuuuccuuaaguuagagcgccguaacucuuguuaaaauauaaugcauuuuguaacauggguccuacauauagauuacuggucuucuagaaugucuggaagauaggguauuaaauucuuuuuaagcaauaccugcacuuaccaaagggaaacaaguauuggacugaacaccuccaaacucaaauacagccagucacauuaaaaaaaaaaaaaaauuccccugaucuuuuuuuuuuuuuacaccuccagaagaaccacaguucaggcccugauuaacucuacacuagauaaccagaacaacugaaacagucucagcaucuucaagauuugguuuacucugaucuaacuugacuaagcuaugaugcuuuccugguaacacauaauucccucuccccuccucucucuacugcauuauaaaauuccaacucuauaaaaaauuuuugugcuugauuuuggcucugaacagcuucuugagggcuaucugccacuacauguucucaaauacaccauucauauauauucuauucacauucauuugcucuguaaaucuuaaauacucauauccaugugaaugacuuucacauccauauacaucuguguaucuguccuuacuuucacauucauguauuguaccugugcuuaagccaacucaucuucucauccuucucuugaagcccagcacaaaucucaccuucucuaaagacauuucccugauugagccucacuguugaauauucccaauucauuuggcauauccuuuaugagguucucccuaaagcuaacauucuauaaugcuaacagccuaguuacagaacuaaguaaaacagaucccauuaagacaaugugcauggacagcuauaaccacauuauguccauuucaaguuacuaaauaaaaaauagcaggccgggugugguggcucacgccuguaaucccagcacuuugggaggccgaggcaagcagaucaugaggucaagagaugcagaccauccuggccaacauggugaaaccccaucucuacuaaagauacacaaaguagcugggcguggugacaugcgcggguagucccagcuacucgggaggcugaggcaggagaaucgcuugaacccgggaggcggagguugcagugagccaagaucaugccacugcacuccagccuggugacagaacgagacuucgucucaaaaaaacauaaauaagaaaauagcuacgaauaugaaggaacaauucaucucaacaaauuauauccacuuuagcuacuaaaacauguaauauuucaacuacauuucuuggaaugaaacauaauauaauaacaaugaaagcaaauauuacauagcauuucuuuuuuuguuuguuuuuuugagacagagucuagcuuugucacccaggcuggagugcaguggcaugaucuuggcucacugcaaccuucgccuccuggguucaagcgauucuccugccucagccuccugaguagcugggauuacaggugugcaccaccaaucccggcuaauuuuuguauuuuuaguagagacgggguuucaccauguuggccaggcuggucuugaacacuugaccucaagugacccacccgccucagccucccaaagugcugcaauaacaggcaugagccaccguacccagccuuacauagcaugucuugugugccaggcacuguucuaagcacuuuguaguaauuaacuagguuaagucucaugacaaucuuacuggguagguacuaucacuauuacucgauucuacugaugcagaggugaaguaaccugcccaaguucauauagcugguaggcagcaaagaugagauucaaaccuagacaguccagcuccagaauucaugcucucaaauaacuacucuguacuccgucucagagagcucugaguaucugguaggaagauuauuauuaaucuucaaauuaaaagacaguuuuuucuuuccuacaaccuucacuaaaauauaagguuuaaaguagcacauguucuaaaagacagaguucuacucuggaguaaucaucaugugggugucauucuuuugauuuucuauaauguaaaaguuaucuuuaccuugcaauccacuuuuauccaaaaaauugcuuaaguuaaacaacguguuucuugaagccaaauacugaauaaaacgcuggaaaaaaaaaauuacaucauauuaagguacugccaucucaccaacucuaauucgaaaauuaggaggaaaaguuaugguuaacacauucuauuaagcuuaucuaguuuaaauuucucauccucacucuuuccauuaacuaguuaccaaaccuaaaaacauaauacauauuuuucacuagcaugcgagaauuuauuaaagccuaaugcccacagauauaguauuaagucaaaacaauaaaagcaaauaggcaguggaagcaguaguuuugguuuuauuacagcauacuaaaacuauagcuaaucauuuuuagguggcaucuguauuuuaaacagccgucugguaaaccaaaguuuuggcuuuaaaaaaaaaauacuucuaaacauacaagaaagcaauagagauccucuuacccacuguccagauuaaacaaauucacauguucacuucacaucuuauauagaaucaaaacauuauagccuccauugaagaaccacaccuucaaucucccuucccucccucuucagaggugaguacuuuucugaaacagguauacguuacuuucacacagguuuucaccauuuuacuagacauacaaguaucuauaaacuauccaaguguuuucuauuugaaauuuacacaaguaucauaguguacuuacucuuugcaauguguuuuaacucaacuuuucccuaagaauugucccacuuaacauuucaucuuaaaugauguucuaauauucuaaugaauacaucaucauaaauccauuuauuuauuauggauauacuuuguaauuuucgcuauuauuaacaaaguuguauugacauauuucuucauggucuccaugcauaaguauaugaguauaugaguuuuucaggauauauaccuagggaugaauuauuaggccagcacauauguaaaagcucaucuucucaauauugccaaaauggucucugaagugcuuaccauaguacauaaccuuagucuccuucacauacagccucuaaauagcuaaagaaaugccuuucaacuucgcuucuuaggauuacuuuacuuucuucuucauuuuuuuuuuaaugcauguagaggcuaauaaucaacuaggauguacaccaucaccucugaaaucaguauuuuuuuuuuuuuuugagacagggucucgcucugucauccaggcuggaguacaguggugugaucacagcuuuccacccuccugcucucaagcaauccucccaucucaguaugaagcaccacccaccauccaccccucacccucgcccccaaguagcugggacuacaggcauguccagcucacauuuuuaaaaaaauuuuuuguagagacaacgucuuacuacauugccuaggcuggucuggaacucuugggcucaagcaauccucccgccuuggccccccaaacucucaggauuauagguaugagaaacugcgcccggccuccaaauuagacuuguacaacugagaucaccccaaacuaacaaaccaggauuuugaaaaucaauguguaaacugaagacucauauuucacaauuauccuaaaauaguguuucaaaaaguuauaaaaauaucguaagacaauauuagacuaugauuuuaauagauuuugauaagacucuucuuuaccucugcauucuaaauuaauguaaauaauuucgucuaccaggccauuucauucaugauuuuagagauaauaaaucuaaauuuuccuuuucauuuuauuaguccuuucuacguucauuauauuuagcugcaaagacauauauggcuuuaaucaaguuuugauuuuguuuucaacagcauccuaaugauauucaaaaugguauuaaauugagcaccaugccaacacucuggcaaguaauaaggcuucacagguucccauuuugggucauaagcgguaaccugaaauggauuauccuaaaccuucauuuaaagaauggcaauguggaaggugggugauuagguacauaagcauuuguuaugccauucacucuacuauuguguauauuagaaacuuuucauaacaaaauauuuaaagaacauauuucagauuauuuuacccaaaaugguauuaaauacuuuauaauaaauccaugcuugguacuucucuuuucuaauuucaucuacaaauuuuuaacucuacauuuucauguauuaaucaucuauaacuugucauacuauaguaagagccuuggucaauucuauuuaccaugaagguacuaucauauuauugaggaagcuccagaagugacuuacccaagucacccaguugguaagugaacaacaguauaaaaguaccuaccugccucauguuaagggucuauaacacaaugcucacucagccuuaccuuuugagauuuuucucuguggccagguuucucaaccugaguacucugacacugaaucagguaauucuuuguuguuggagacugcucugugcauuacuguuuuuaauuuucuuuuuuuuuuuuuuuugagauggagucucuugcuuuguugcccaggcuggcaugcaaaggugucaucucgcucacugcaaccuccgcuucccagguuuaagcgauucuccugccucagccuccugaguagcugggauuacauaugugcaccaccacgcuuggcuaauuuuuguauuuuuuacuagagacgggguuucaccauguuggucacacuggucucgaacuugcgaccucaggugauccacccaccuuggccucccaaauugcugggauuacaggugugagcuaccucacccagccuguucugugcauuauuguaagauguuuugaagcagcccuggccuuuaccuacuauauaccagcagcauccccuucaguugugacaaauguccccuaagggaaaaaaaaaaucaucccccuuccccacucaguuuugagaaucaccgcuccaugguauuccaaucaccacaguauagugaaauccuauguacagccucuaacaaauuaauggcaccugccaaugggaacaucugaagguuguacaaacuagcauaaaaaccugaagguuguacaaaccagcauaaaaaaugaacagagcauggaauuugcuuuaacugccuacaggaagcuaaacaugaguuuaucaaaaaacacacuaucaaaaaaacacacuaaaaugcuaucuuucuccccuugucagucaaucuacaaaaugacugucaacuuucuguuuugucuuuauuaacauuuugccucuaguacuaucaauuaccuuauuuacagccucugaaagccauuauugauacuuuguuuaucuggcaguguagcugguuauauuuguggcuuuuucuuuuuaaaaaauaaacuacaucaaauaaauaaagaagaagaagaaaaguacauacacgcuuggaauucuucagaauaaucauaaucuuaacuaaacauauucuugcuaaaaguaaaaacuauuauccuaguuaagauguuucaaguuacauuuaagcuaauacagccaaacauuucuauuagcucuaucaacugguuauaaugaauuagaaagcaacuaacauaaguccuaaaaauggucaugucuguugacuuaguaaucacauuucagguaacacuuaggggaaaucauuuuuaaaaauuaaaaacuacaaauaaaaucacucaauguggugguauaacgaugaaucagaaaacucaauuucuagcaaggaaaauaguuuaaaaauugugaacuauacgaucaauuacauaguuacuaaagaugauaaaaaaauacaacauggcaaugcugauaguguaauauuauauaaaaagcuaaguauauuuuaucuacauuaugauuauagccauuuaaaaaauacaaauacuuuuggacaagaacuagagggaagaccaaaaugugccaaaaguaagaugugcuggaacaauaaaguuguggguaaauucuugcuuuaauuuugaacuuuaauaaugcuauauugguaguugucaaaaaauaguuucaauacugaaaagcccaaaauaacacacaacgugauggaugucaacaagucauuacgcucagaaaacuaauaccaaugacuaaaguucuuucucaucucuagaagguuaucuucccgggcugcauuuuucuaaggcacauaccgaagaagauuuaucuaguucuacucagauguucuugaaaagcuccuguuaauacaauuuuacaaauaaguuuauugagcugagaaaaugaaccaaaaaauuagcugcuaggcuaucacggaaaguaagaugauucucucaaaacagauuuucaaaagcguauauaucuuauuuguuacccuuuuaggcaacaaaggcuucagacacaccucucugcugaagaaggcacacuucaaucagucccucucagcaaaugccaucuuaguccuaaauaucacagcuuugaaguaggcaaagugcuuccauaaacaacuauaugagaucagacaagaaucuaaagcugggugugauggcuuacgccuguaaucccagcacuuugggaggcuaaggugggaagaucacuugagcccagaaguucaagaccagccuaagccaagauggaaagacccccaucucuacaaaaaaauuuaaaaauaagccaggcaugguagcacacacuuguaaucccagcuacaugggaggcugaggugggaaggucccuugagcccaggaauuugagguagcagugagcuaugaugguaccacugcaccucagccugggcaacaaagcaagacccugucucaaaacaaacaaacaaaaaaucuaacuggacuauaauaaaagaacaaauggauauagacaaaauauauagucuauaaacaggaccagcaaaaaccagggaugcuuauggaacccauuucuaggcauuaaucuuugcuucuugauccauuauugauguccucugugcucuaacccacuuuuugcuuucuggcuuacaagcuaucuuuccucaaauuacagggucuauaauuauauuucuggcuaggcaccuugaccuuuguaccugggagcuguuucugaaguuucagugagagaagcuagcuaacaauaagucaacacaucaguauacuuguucaauaaaaauucugcuuaccucauuuccauacaccaucaaaugaugaguuguaaugagagauuugaagaccaccacccaacuacuauuaguaguucuuucaaauaaacugucugccaacugugggauguucacauucaucucauuugugcacugaauuaagucugcaauaaaaaauuuuuaaaugauuaauuuccucugugguuuuaauuuauuguuaauaccagaucugcauacaaacaggcaaaagauuuaacacaaaguggagcaguaauaguuuggagauguuguuaaaaaucucucaauuagagcaauugagacuaccauaaucuaccuaagaagcaggguaccaauuagaaucacauaaaugaucaacaauaccaaaaaauaaaucaaacucccucaggguauaauucucucucaaguacuuuggucaucucaaaaugaauuguuucaagguuuugaggaaccuucuauuuccuuacuacuuaaaaaccuuccauuaaaauacugguauuauucaucucuuuaaaauuaacuuuaacauuuuucuuuaaauaaagcuuauuuaaagaaaucauccauacagaagaaugaacaaaaugaagaucaaacuaucuuuaugaacauccacccuagaaugcugucuuugcaacaggaagauaacagggcagagaucuggucuguaauugaguuggaucuguuuguucauacaaaagauuuauacuccuucucuccccucuguucuacugaauuagcucagaucaguugauaacuagguaauacugagaacaaaacuggaaaaaaagauucucaauaaaacuuaagaagaguaaccuacaaucuguuuaagagauauuauucguaaacucaaugaagaaaauguaaaauagguugggugcgguggcucaccccuguaaucccaguacuuuggaaaccugaggugggguggaucacccaagaucaggaguucgagaccagccuggccaauaugcugaaaccccaucuuuacuaauaauaccaaaaacauuagcugggcuugguggcgggcauggguaaucccagcuacucaggaggcugaggcaggacaauugcuugaaccugggaggcggagguugcagugagcggagauaguaccacugcacuccagccugggcaacagagugagacucugccucaauaaaaaauguaauauaauauaauccaauuuagagauauaacagaggagaaaaccaagaaaugaguuacuuuuaaaauauauauaaaauguaauguauaaaugucucagcuauacuacaauaaagggaaaaaaguuauucaugacauuaauuuguucacuuuuaaucuucaguguguaaugauuaaauaugaauucaaaugaucuaacuuggccuugauugcuagcaagaaaugacaauguaacuaccaacauuuacuuaaaauuuuuccuuuaauagguccaauuauuauauaaguuaauaucugauaaacacaugcauuuuagauaagcagcuacgguggccaauacugcuuaaagaacaaagaacaaaacagagugcccauggaacaacagaaugacacaaagcuuucacaauucagacuauuugcaacaaaaaugaaacaguaaauccaacuuggauaugcaugcuucaacuucugagaguaaaaaauggaauuuaaucucugccuucucuagaucuucauagcacuuuauaacuggccuauggcacugaacauauuacacuagacuucaguuucaacgacaguacuuuauacacacaaacacacacacaauuuaauacuauauagugcauggugcaugguguguguguauauauauauacuguacuauguauguuauaaaacauauguguauguauauguacauauauccauacuauauucccuuugugaucuguucuuccccccacugcaucacugccaucuucuuugcaaugccucccauaugccaagcacucuuaucucagguguuugguacuguuguuccuccugccuagaauucucuucugcuagauaccuaugcugcuugcucccuucgcuuccuucccauagcuauuugcuaaagugucaccauauuagauaaacuucccugaauauuuacgcaaaauaacaaagccuugggcauuccccuaccucuaaacccucauuaucccccuuacucugcuuauuucucuccaaagcauuuauugccacugaacucaucuuaauuuguuuaaugucuuucucucucaauuaaaauguuuuuaaguuccaugugggcagggcuuuuuuguucucaacucuauccccaaagaccuagaauaaugccucaaacauaaagaucagucauauuuuuuaagacacauucauuuugguaugcauauggguauucuuaacaugacauuuuuucaaaagcauccaagauuguguccuuacauuaaguuaaaucaacaucuuacaacuaucuguacaaccugcuauucccaagagguugaaaaacaaagccgagcccaauacaugugcaaauuuucaaauuucaaauuaaaaggggaucuaacaaauaaagguuuuuacuauaaugcuuauuaaaaacuauaguaugcuuuuaguacugaucacagaaaaacuggaguuauuuugaaggauaacuccagaagcuaaaaaaaauucuucacacauaauaaaacaggaaaaauuaaguaagaauucacacugagauuaugaauccagaauagaccaaauguaaaaccaaguuauacaaauaugacaggugggguggggaggauauugaauaaaauuagcagucuauaccucccauaguauuuaacucagccagucauuuucuccauacaguaauuuuuuaucuguacaauguuucucauuuaauaguacccugaaaaugcuuccaaguuugagcuccaagucaggaaggaaaauauucuucccaccugugacuaaccaaaaguaaacuguuccaaacaaaaguaacacuuaucggggacucucaauaguuaacugcuuuucccacucucaauccagaagauacuauuucuuaaaaagcaaaaacuguaacgauuucccuugccaaccaauaaguuaccaaaaugaggacagaucuuauauuuucuuuucauuauuuaucucaauaacauaaaaacugaaguaccuucuugaauauucauuauuaacaauuucugaaucccacacacacuaaaaaaaaaacaaguaccacauggcacguagguucucugcuuuagguaugagugagaauuuacaaagauuuccaauauuuaaggggaugaagacaauaggccuaaaaauaagccuaccauagaaaugacaaucacuuuuccauguagagaaagcagaaggaaccaauacccaccauacaaacacaaaugcucuuuuauuauuucauaugcucuuucaacaaacaaugacugagguagauaaagcugauguuaacuguauuuacacaggcaaggucacaggagcuaagugacagauuaaugacuagaauuaaauuuuugcaaaggauaaggauccacuaaaacauacagcaaguaaaugcucaacuagccaauuuaauacacguucucgacugaaaacuaauuaaaaacaaaaacaauagaaaaacagugaaaugcaaaacaguauuuuuguauucugaggaagucuuuuuuuuuuuuuaacaaaguacaaaaaauuuagaacuaagcaguuaccaaaugguuucauuaaucuuacagucauauuccuaguguaggccuuuacaaacucucccaccaggcagaguucaccaacuucagccuauauagauuuccccaggcagaguucaucaacuuuagaaacuuaaauuaggacacucaggguucacuucuacagcaagucaggcaacccagccaguggccugugccaucagaaugcagaguucucaaguucccaucuaaacagcaacucacuaggcuacaucaaaaccacacugauacccgaauaagauuuucuaaaaaagaagccuggccuaaaccaguauuuguuuguuuguuuuuaaaucaacauaccacaaucacuuagccaaacacaguaauacauauaaaauuuaguaaucccuuucaaaaaggucauuuugaacgagaacuucuuuuuuacaccugcccucauaaauuuacaaccuaaaauugauuuauucagucaucuagaaaacuggagauacggcugggcacgguggcucacaucuguaaucccagcacuuucggaggccgaggcgggcggacuaccugaggucaggaguucgagaccagccuggccaacauggugaaacucugucucuacuaaaaaaaaaacacaaaaauuagccgggcaugguggcacacgccuguaaucccagcuacuuaggaggcugaggcagcagaauugcuugagucugggaggcggagguugcagugagccgagaucaugccacugcacuccagccuggccuacagagcgagacucugccucaaaaaaaaaaaaaaaaaagaaaaaaaaagaaaauuggagauaaaauuaauauggaaggcaaggcaaauuaacugguuaaucaaauuuugcuucacuuaucaaaucuuuguaauuuuuccuuggugggaguagaaacaaaaagcauauucaucaaaaaauaguaaacagaggauaaggaacuuuuauaugaaguaucagcaaaauuuuuuucauauagcaaaauuguuuuaaguauuucaaaacuaugcaaguugaaauuagacauaggcuaaucaaaguuaaacacaggcaaauuugccuagucguaagugucaauguccaggaaaugaaaugaacagucuuauuucuuacuccaaugauuugugaaagggaucauaaaauaugguccaaauuaagauguaacuguuaaaauuuuaucuguaaaguucauggggucuucugugagaaacacaauguuuuauuuuuauauaacuuccaguagaauuaacucaaaacuaugcucuucacaggcugacuuacaccuuaagaaaucuaaccaacauaauuggacuuuaauaacuggggaaauacucuuaaagacagaauauggaacgcugaguacaaugacaaagauugacaaaaauaaucagauggcuuuuagaacaauacuaaugaagcuaagggaccuaauucauaauuuaaguggacauauccaagagugaagaguuaaucaaaugacacuacagucugacuaugaaauacuaugaggccaacgaaugcauggcacaaaaaauaaaagcugucaggagaaaauguucaccacauauuaagucaaaaguuauaguaaagaaaaauacacaguacaauuccauuuuuuaaaacuguaugugugaggcuaggcauugugguucaugccuguaaucccagugcuuuggaaggccgagguaggaugacugcuugaggucacgaguuugagaccagccuaagcaacacagggagauccugucucaacaacaaccaaaaaaaaaaaauuuuuuuugagauggagucuugcucuguagccaggcuggagugcauggcgugaucucggcucacugcaaccuccgccucccagguucaagcgauucuccugccucagccugccaagcagcugggacuacaggggcccgccaccacgcccagcuaauuuuuguauuuuuaguagagacaggguuucaccauguuggccaggauggucucaaucucuugaucucgugaucuacccgcuucggccucccaaagggcuggggauuacaggcaugagccaccacacccagccaaaaaaaaaagaaaauuuuuuuuuuuuuuuuuugagacggagucucacucuaucgcccaggcuggagugcaguggugugaucucggcucacugccaccuuugccacccagguucaugcaauucuccugccucagccucccaaguagcugggauuacaggcaccugcuaccacgcccggcuaauuuuuguauuuuuaguagagaugggguuucaccaucuuggccaggcuggucuugaacuccugaccuugugauccaccugccucggccucccaaagugcugggauuacaggcgugagccaccgcacccagcucccuaguuuuuuuuuuuuuaauuacugcuuguaguggagguugaggcgggaagauaguuuaagcccaagaguuuaagguuacagugaacugugaucacgacauugcacuccaacuuggauaacacagcaagacacugucuaaaaaaaaaaaguuauguauguguaauauuuuuuuguauauauuguauuugcccaaauacaaggugaugcauacacaaucgaacacuuccaaaaugacuuagcaacuaugucauauaugaaguuagagaaaaauaauuuauaaaggaacuauaacacuguuacuuccauaaacuaaucucaguaccucucaugucacauagcacacaccaguucuguacuguaauuuauuccacacccuuuagaacguuaucaugaucaagagcagaaaggagagccaugacacauucuuuaucuccucaaggaugugaggaagaggugguacaagaauaagaguggcugggccaggcauggaggcuuacgccuauaaucccaacacuauggaaaguugaggcagguagaucacuugaggucaggaguucgagaccagccuggccaauauggugaaacccugucucuacuaaaaacacaaaaauuagccaggcaugguggcacaugcuuguaaucccagcuacuugggaggcugacacaggagaaucgcuugaacccaggaggcggagguaaaaggaagcugagaucacagccauagcacuccaaccugggcaacagagcgagacuccauccgaaaaaaauuaaacaaaacaaaacaaaaaaagaauaagaguugcaugguaaaguaccugagaauuuggcagccacuaugccagaaguaggucaguauuuugaacacaaguucaaucucuuacaaugguaaaugagccuuaaggaaucuccagaccccacacccaaaguaagucaaaguccuggccgggcacgguggcucacgccuggaaucccagcacuuugggagaccgaggcggguggaucaugaggucaggaguucaagaccagccuggccaagaugcugaaaccccaucucuacuaaaaauacaaaaauuagccgagcuugguggcaggugccuguaaucccagcuacuugggaggcugaggcagagaacugcuugaacccaggaggcggagguugcgagcugagaucacaccacggcacuccagccugggcgacagagcgagacuccaucucagaaaaaaaaaaaagguaagucaaaguccuaucuuaacguuuaaaaauaaaagaccaggugcaguggcucaugccuguaaucccaguacguugggggucaaggagaacggaucacucaaggucaggaguuugagaccagccuggccaacauggugaaaccccagcucuauuaaaaauacaaaaauuagcuggacguggugacaacacgacuguaaucccaacuacuugggaggcugaggcaggagaauaacuugaaucugggaggcagagguuguggugagccaagaucaugccacugcacucuugucugggcaacagagugagacucuaucucaaaaaaaaaaaaagugcagcuguaggaaaaaaaucaguauauuagcacaacuagauaugcuauuucugucacuguguucuuagcaacaugaauggacuaagauucccacacuuaaaaauuagaaaauguaaaaauagaguggaacauggugacaugcaccuguagucagcuacuuggaaggcugacaggaggaucccuugaucccaggaguucaaggcuguaauguacuauaaucaugccugugaacaaccacugcccuccagccugggaaacacagugacacucugugucuaaaaaaaaauaaauuaaaauaaauuuuaaaaggcaauccuccccccaccagaaauguaaaaauaauucuaccauuuguaaaauugccagguaaaaugacagcacuuucccucucuaaaaacuauucaauagaaaaacugccauaagucuucacaaaucaucucauuaucuggucuguuuauuuuaacaaaguucuuccugaagaagguaaccugaaaagaccuccaacaaugcuaguuucaggugcuuaugaagaaauaaaaaauuuaacagagguaaguauuccugggaauauauaccacauaauugcaaaauuguguugggugucuucagaacuuuaaaaagcaacaaaaucauuuugggaggccgaggcgggcagaucacgaggucaggagagcgagaccauccuggcuaacacggugaaaucccaucucuacuaaaaauacaaaaaaauuagcugggcaugguggcgggagccuguagucccagcuacucaggaggcugaagcaggagaaugacaugaacccggguggcggagcuugcagugagccgagaucgcgccauugcacuccagccugggcgacagagcaugacgccgucucaaaaaaaaaaaaaaaaaaaaaaaaggcaacaaaauaaaguuauguugcagaugcagagaucagaaauauagaaauauacaugaggaacgaaagaaacaaacugucuuaguguuauaagaauggauggugauagucugugaaaaaauuucuaauguaaauuagaaagaucuuacacaaaaggaaagauguuauauaacuuuaaaaaaggggcuguggaugaccaaaaaaacacaaaauauccaauauauacaugaauguaaaaugagucaaaugucauguggugagguauguaugaguggcgaaaagaaacuacuauuuuaaaaucacagauuacuucucuuucuaauaacuuuuuaaaauuuuauugauuuauuuuuauagagacgaggucucccccucuguugcccaggcuagucuggaacuccugggcucaagggauccuucuccucggccucccaaagugcugggauuacuacagaugugagccaccgcacucagccagauuacuuuuuauaguaaucuuucauauguauucuaacuagugaguuucaauauuaugaggcugacugcuucaucuauaucccuaacauuuacauauuuaaauagguuaaauaaauaaaacuugaggggcugucaaugucucugggaaaaugcaggcuugcuuuauauuugggguuaccuuacauucagguacaaacaguauagguguauauauguuuaaguguguguauauauuccaaaaugcuuuaagugagacacaggaugaagccacacacuuucagagcuaucccuuuugcuggaaaugacccggaugcaauucaaauaaacaauggauucaccuaaguauaugccaaauacuuagauauacaaagcugagaagaugcaaaauuucuccccuacuaaacugaggucuuuggggguaaagauacagccucacaauacauuauggugauuguaaucuguauguauaggauucagagauggcaaaaagaccaggcaauuguuuuggaggggaaagcaaauuuucccugguuucaauuucauacucucuuaacucaucauacaauaguuacagcacuuuucacacuucauuacaauuacuagcucauauaucagucucuccuaugagagagcucacuaaaggcaguccaugacuucuucauccucaaauugccagcaccuagcaggauacaccuuaaauauuuauuaaauuaauacuaguaaaugaaauguaacuuagaagacaucuguagaaagcaacaauauucuauuuagucuaagcuucagugcagcaaauuuggaaaaaaauauauuagcaaucuagagagcagcauaauugcuuuuucaaguuuauaccaccccauauuccuccuccugccacuauacugauauuaugaacuaccucaauaaaaagccucuacuucaagaacggaacacagaagagauuuuuuaaaaggcauuuuccuggcagagaaaggacugacauccuuuuuauuuguggcagaggaaagaugaggaacugaaaagggaauauguagagaagaaagaauucagauagaacuggguacacaaagcaaacuccuaagauacuauauauuaauauaugucugaaauuuagccucuuaagucauggcugaacccaagccaaauuuaccgaacuguucaaacuuuaauuuuaaaagugcaaacuaaauuguuuuaaaugaagucauuauguaauugcucuaaaauuuuaaucaacacugaaaacacauuuuucagaucagucuaaucuacugucucuuaaaauuaucuuucauuugucucuuuacccacuaaugucauaaauacaaaaacucuuagaacaaaaguggaaaguuuaagucaugaaaaugcucuauagaaaaacauauacucuuggaauacucugacuucacugccacugacuuguauuuucaaaugaaagaguuguuccuccccccuccucugauuaucaaaauguuuuaaauuacuacguaagccuucuuaauauaagaaaguguaaaccuagagcuuuccguuggcauucugguaaacucugcauuccuaccacuagauggcagacuguacagaggaacaacaggacccuggcaagaacacagaugcauucaggcucaucuguaaaccacauucuuaaaucugagauuguuuaggauuccauucuaguacucuaaaguggugauuuucaaaccuagauaccuuaggcccauccuagauuccaaauaaggauuacuguaagggaugaggaaaaucauauuuugguaagcaccaucucaaagauuuauuacuucuaugucaauuuuaaauuuaucagaaauacaagacaauaaaaagcuacuuaauggaauaaaaacucaucacuuaauauaagaauuaaaaauuuuauuuaaacaauaagaaaacaaacugaaaguauuacagugcuccaacaugaaaaaauaacauauucaugguauaaauuacauucucuucuuugaagaucuuaaauuucacaaugacaaccccaccuauaggaaagaaaacauauuaaguaucaaguaauuuaagaacaaaugccaaaauuacaaacacuuuuuuguauuacaugcuaagaacuuacuaacuguucguuagcccaguuaaauaucaucaggacucucaaaaaaaaaaaaaaaucuaguacuggaucagaaaaauacagaaaccucauuuccuaagcaaaaugaaagucaacuaacaauacauugagaauacuacuuaccuccaccaaugcugugaacccaagcaggguccagagugggggcagaaaaauucuccuuucuuuccaacaagacagggaaaaagaaaccaacaacugagaggcucugcaagugcagaucagaguacuauaaaggaaaaaacauuuaugguauaauaucuauaauuauuuauagauaauucuggagagguuaaaggaauugggacuaagucuggagaaaaguacguuauuaguuaggaaugaccaaccguccugguuuugcuggaacaguccugguucacaccuguuguccagggucccauucagauagcacacccuuucacucuuaaaagugacccaaguuuggaugacauauuacacaucaccuuaguuauaagcacacuaauaaaaguuuacauguagcuaagaaauuaauacacuaccaguagcagcuauucacagugcauuugcauuuuccuuuuaugagugcuauauucuaguucuuagccuccuuaaaacacaaacaugcuucuauucugccuacuuugcccucuaaccccucuacccaugaccauuuuuaacaauaaucucugcuucuguuuuuuucaccccgggaaacucaucuaauuucuuaaccucaaagaaaaucucuaugcaaaucauucacaaauuucuucucagaaaaaucaaucuaaggucuucugggggaguuagagacauuagaauuuuucaccucuguguccaaaaacaucucacguuuaaaaaacaagaacauggucucaacuauaaccuaaaugucccauuuuuguuuuaauuaauaacacucauucuuaacuuuguuaaauucucaggaauccugucucuuuguaucuuccacaaugugacacagcgccuuauacauguguucauaugacagcauaaauauuuguggauuuguaagugaaacaaaggcucauuucuccacucauaagauccaggagacagaaguaaggguaacagcgaaaaagccuucccuguagguagguuaaaguuuuucguuaagagccaaacccaugucuaaauuaaguaggaauccagaagauuuuucaucucuucucuuaaaaauuuuuaaauucugcccagucacagggaauaauggauugcaguuagacucucugccagaggcucccucacucagaaaacacaaguuccguuccauguccccaaugcacacagaacaacgagaaucuuuauauuccacuuucaugaagcuuugcaaaccucaguaagaacaaacagaaaucccauuuauucuaguauuaacugcauacuauaauacgccaauagugucuuaggaguuagaaauauacaauaguggacaaaguuucuauuaucacggagcuuauauacuaaugggaggaauguaaucaguaaacaaaugaacaaauagaugguggcaagugcuaaaaauuucuuagcucuuggaagggauggagcuauguguuugagggagguugcuaggaaggagccccacauaaaaugacuuuuaagaauuauggcaacagugguagugugucaccaguggccuggaggccuauggaacugaccaucaugaucaacuaccaccuuccacauagugaguaagugugaaggccucccauucauucuauaucucacaugucugcuccaccugugccaaaccaaagacacaucaaacgggaucgucucuugguaauuuugcaaagccucuaguuuuacguauauaguaccagacgguggaaaucucauuuauuuauucacaugcuucacaauuaaaacaaucugaucacuuuaagugacucaaaauuacacgagccauuuauuacacgauuaagugacguaacuguagcuaguaagcaugugaagacccuguaagccagggguucccaacccccaggccguggaccauuacuggcucaugaccuguuaggaacugggccacacaguagcuggugagcuaggaagcauuacugccugagcucugccuccuaucagaucagcaggggcauuagauucucauaggagcgcgaccccuauugugaacugcacaugcaagggaucuaggcugugcacuccuuaugagaaucuaaugccuaugaucgagguggaacaguuucaucccgaaaccaucccuccacacacccccugccagucuguggaaaaacugucuuccaugaaaccacuccuuggugccaaaaagguuggggaccguugcuguaagccacugaguaacaagugaaagccauuucugaaaaaucauuuuucaaacugcuggaaaccaacugcaguaauggcggauguagcaccaaauaauaaccuaucuacauggcuuuaaauuuugaaauaauacucucuaaguggaaaauaugagcaauuuuaauacauuauuaauauaucacuauaaaauaaagccauuaauaaaucacuacaaaauaaagccagaguuauuuuuccuaauaaguuuaauauuacgccuuuaaguuucuacaagaaggaaaaaucaccaggauuauucuacaagaagaaauaaucaccaggacaaaaaauaucucuauccucauacaccucauaaccauacaccuguucuuauaagauuccuagaaggguacagugguaugcaccuguagucccagccacucaggagguugagguggguggaucacuucagcccaagaguuugaggcuguaguaugcaaugaugacaacugugaauagccacugaacuccagccuaggcaacauagugagacccugucuugaaauucaaaaaaaaaaaaaaaaaaaaaaaaaagacuccauauaacccacauucaccuauuuccuauuucucagcacuaaaaagucugacaauuuuacuuccugacaaaugucuuucuuaaaaggaauuauaaaauuuuauauagaucuauauuuauacaauaucccauuuauuuucaaaaccacauucuaucuaugaauggauauaugaagagucuccuaaauuucuuaaagaguguaucuuuauccuggcuugugugagaaaguaauauacauuuuaaguggucuagacaaguaggaagggaaauuuaaucaucuuucucccaucauucuacaguaccaaucuuucaccaacuuuuuuuugcuaugaugccaaacgaucuucaaauaaaccuucuacccaaccacagcuuuucaaguuaaucucuuccuaaacuugacaaacacuggagaauguuaacuaguuuuuacuuucauugcuacauuagauacucuccagagugacugggauuggcagguaucuuguuuuuaacucuuucuacaagauauuucauuaaaguuaauuucucccauuaaaaaucuucuggcucacauuuauuugauagucuguccuaagagcuauucauuuucaauaucugcuucaaauacugauaaugaagauuuuaauuugccaucacugaaguucugcucuagacucucuggcuuccaugcauggucccauccauuuccaugugcuacaacuguacuauaacaagacuaaccaacacaucagaaugagcaaaaaaaaucuagaaucaaauucgagauucaugauucaccauugugauuucaggcauguuaauuagucacucaguuuccauuucaacauuuaaaaaauaggacuaauacuuaauuuucacaacaucuuggcuuaguaaggugauauauuuaggguauuuuaaaaguacccuaaagcuuuaaagcaucauuacaaauauuuucauuucuuucuuaccaucauuuuguauugauguuuucccucauuuuaggagacaacuccucuaucaccuuuccaauacacugucaugaaaauagcucaaacucaauuacugcugcaaaaccuucauuaucuaaugcccaauuucuucaucaacugggaaguguuaccauagauccuugcacucaaucuuaagaguggcaaaaucuuuauaaugcacauaugauuucuuucuuucuuaauaaagacagggucuuacucugucacccagacuggaguagcugggacuacagguacaugccagcacaugcagccaauuuuuaaauuuucuguagauacaaggucucacuauguugcccaggcuggucucaaacuccuggccuuaagugauccucccacuuuggccucccaaaguguugggauuacaggcaugagccaccgugcuuggccaagauuucuuuauacauuacaaaauucuuucauauccuuagucuuccaauuuaacaacagccuugugccaaggcaaggaaugcucuauuauaauaucucuauugcaaagauuuaaauacuugucuaaaguagcacaaacuaguggcuguguuggaacuacauuuuucaaacaguaaccuuuccacuagcaggauagaugaagacacacauccacaacacacacacacucuacccccauuuccauguggucugagugagacuuaucauuuucucuaauuacucuaaacugcacacauuuucacaaauucaguguuguguuuaguucucacaaaucuaauuccuaguauacacaguaggccaccucuugucugguuuaguauaauccucauuggcauaaucaucuucuuuguggcuacaaugaacuaaaguugacagacuaugaggaaagcgacacauuauucaacucaaguucacaaguugcgaaaguucugggcauugcccauuuccaaaugacucaaacugcaagccuuaauuuauaagcaaguuuaaagaagccaagaaugucagagaacaaacuaaaucaacucacuagauuuuaggugaacaggucuuauaugauguuacaugagaagaacacaaagcaauuuuccagucaucuuuugcccuagagauguaauuacuaucaauucuaaguaauagcagaagggguaaacuacguuaaaaggggccucaacaguuauaacacauucuugguuagucauuaaguuaugaaaauauaacucugaugaagaaagucaaagaaaaaucaauucuagauuaagucuauaagcccaaggacaggaagcaacuuauuaguaaguuucucucuuaaaacguuuccggcugggugcaguggcucacacucguaauaccagcacuuugggaggcugaggcgggcagaucaccugaggucaggaguuugagaccagccuggccaacauggugaaaccucgucucuacuaaaaauauaaaaaauuagccgggcaugguggcgggcaccuguaaucccagcuacuugggaggcugacgcaggagaaucuccugaacucgggaggcagaggcugcagugagccgagaucccgccacugcacuccagccugggcaacaaggccaaaacuccgucucaaaaaaaaaagguuuccaaucuccugaugcgaagcaaugguucucuccuugcacugcaccuucaugcagucaaggaguaucuuaguaucccaagcugcucuauaaauagcuuucuaacuuagcugccaguugcaauucuauagcuaauuuuuaaguuaguaccuauggcuguuuuucauugccacucagcuaugucaggcaguguuucuagguuaggcuacuacagaaaccacuugaagauagugccuugauccacucuaggucaccaagucaaaacaguauuuugcaagaauacgaugaacaaaaauaaaugaggguuuauacucuauaaagucuaagacuuuauauuaaauugauagccaacacaaauuccaaaccugacaacaaauacacaaauacauaguucugugaagaaaaauuacuaaagcuaauguuaauaaaagaaaaauaggccgggugcaguggcucacaccuguaaucccagcacuuuggggggcugaggcgggcagaucacaacaucaggaggucgagaccauccuggccaacauggugaaaucccagcucuacuaaaaauacaaaaauuagccgggcgugguggcgcaugccuguaaucucagcuacucgggaggcugaggcaggagaaucgcuugaaccugggaggcagagguugcggugagccaagauauagcaccacugcacuucagccuccuggggaguaagagugaaacuccgucucaaaaaaaaaaaaaaaaaaaaaaauuacugccugcuaaacuguaacuuuucagucauuaaacagcugguuuuacuucaauaaggaaauguacaaaugggaauaaggauaauguggguauaucuuccaauucugaaaaugggaggcaaagugaccacguaaagaacaaaucagagggccgggugcgguggcucccaccuguaaucccagcacuuuggaagaccaaggcggguggaucacaugaggcuaggaguuccagaccagccugaccaacauggcaaaagcccgucucuacuaaaaauacaaaaauuagucaggcacggugggugcacaccuauaaucccaacuacuugggaggcugaggcaugagaaucacuggaacccagugcagugagcugagauugugccacugcacugcagccugggugacaaagcaagacugucucaaaaaaacaaacaaaaaaaaacauaaaucagaucuuuacuccgguuccauaccaaaagaucaaaugcaacuauccaguuaacuuauuuuaucuuugauauucaguuuuaacacacaaauucauugcagagcaacccacuccauuuuguauguaucaauaaaucuucacacugaucuuauaucucaaaaccagacaaauucccccaugacagcucgccugaaauaaagccaguaacuguuaauuggagaaauucauuuucuuuuauuuucccuuuuuuuuuccuuuucccugagaaagagucucacucugucacccaggcuggagugcaguggcgcaaucucgggguuucaucauauuggccaggcuggucucaaacuccugaccucaggugauccaccugccuuggccucccaaagugcagggguuacaggcgugagccaccaugccuggccucuuuucuauucaucuaagagaacugcuaccuuccaaaauucugcccauccccuuccaaagaugcaaucugaagguagaugaacuuagagaaguuaaaaaaaaaaaaagguaccaacaauuaaaacgaguuugcuagguaaaacuacauauuggacacaacuaaagauuauucuaaacuacaucaggccaggugagguggcucacgccugugaucccagcacuuuaggaggucaacguggguggaucaccugaagucaggaguucacaaccagccuggccaacauggcaaaaccccaucucuacuaaaaauaaaauacaaaaauuagccaggcguagugaugagagccuauaaucccagcuacucaggaggcuaaggcaggauaacuccuugaacccaggaggcggagguugcagugagcagagaucgcgccacugcacuccagccugggcaacagagcaagacucugucucaaaaaaaaaaaaaaaaaaaaacuauaucaguaaguugcuuaauuucaagucacaaaaggcccccccaaaaaaaaagccaaaaagaaaguucacccuuuuuugacaaauaacucaaaacuagauguacauguacugcaaguaaaagcaaacuuuucuggcucuuaaugguugucacugguacacaaaaguuuauaagccaaaaaugugcaagcaauuacagccacaaaaacugaugcagccuugaccuauuacagauuucuaauauuaaacagauacaugcaauuccccauucuacaauacauauacacagcauucauauaauuuaagaaacacaguccuuccaucaugcaaauuaaauuaaggauccuggcaacaauaauaauguuuacauuucuguguuucugaagaauuaaaaugaagagauaaaaauaaggugaagcaauuauccaucaauucaucacuuaauaauuuuaagauuaugucacugugguagaacauaaauggugauggauuagugaugcuccuuacacacccucagcugaucccccaauaugaacaacaggcaacacauauaagacaauuuuuaauaaagguagaaagaaacucccuuuuuuuuacauccaagauacacacuggaaaaaaauuauuuauuguuauuauuuuuuaugugauguggucucgcuauguuguacaagguggccucaaacuacuggccucaagaaauacugccaccucagucaccugaguagcugggacuacaaggaugcaccaacacacccagcugaaaauucacauuuuuguugcccauuuccuccuaaaacaagaaucacauaagacaaugccaccuauuccuaccaaugauaauaagauaugcaaauucaaacuguuuuucaaauaaugauauaguaguaaaugggacagaauacucugauggagaaugaagcaaaggcucagagagaaacuguuucugguauucguuuccaaaggaccaagccuacaacaaaaaaagcuaaaggagcacaauuauagcaucacagaauaacagaguaagaagguaauuuagaaaauaaacuauuuuaguaacagauuuuugugaggucauauggagcuagggucaguacccuacauuccaguuagagcuuacuccucuugaagcauauggaaaauuuaucuuaagauaaagugguggcucacuccuguaaucccagcacuuugggagauggaggugggcggaucacuugaagucaggaguuccugaccagucuggccaacauggugaaaccccaucucuacuaaaaauacaaaaauuagccaggcaugguagcgugcacucacagucccagcuacuugggaggcugaagcaggagaaucacuugaaccugggaggcagagguugcagugagcugacaucgcgacacugcacuccagccugcguaacagagugagacuccaucucaaaaagaaaagaaaaaaaguauagaaaguugacaucucaaaauguaaucuuacauauuuacauaaauuauauuccucaaagaaaagcucucuccuaucuauaucucauuccauauaaguuuucugugagcuaagaagcuccccuucagauugccugaccucuagucaagguucuucaucgccaucuaaaugucagauuuauucucuaugucuucuuacuaauaguguuuugguuuaaguauguggaaaauaaagccaauaagacuaucugaugaauagguuuguauaaacauuguguuaacaaugcaugucaauugcccaagacauagaaagguuuccuuaaagguuagcuauucuccccauuuuguauguccuaacuaaaccaacugaaacgguuuggcucugugucccuacccaaaucucaccuugaguuguaauaauacccaugugaaggacaggaccagguggagauaacugaaucauagcgacaguuucucccaugcuguucucaugauagugagugaguucucaugagaucugaugguuuuauaaggggcacuucucucuccugccaucaugugagaaaggacauguuugcuucccuuucugccauaauuguaaguuuccugaggucucccuggccaugcagaacugugagucaauuaaaccucuuuucuuuauaaauuacccagucuuggguguuucuucauagcagcacgagaauagacuaauacaccaauuuuuaucagacuuugugaaucccugaagacugaaaguuuccuuucuuuuauaaaauuucuuccuucagaucaaaguuagguuuacauuauuucuguugagaagacuucuucaaugauuccugugcaaucuagagacucggaaauccccaaaccucaguaauugccaccauucauucauucuauaauaaaguuaauacaaaaacuugaagcagcaaaaucucaucucagcuuccagaucagcaaaacuccuugccuuuccuguuuucacacuggcagcagaaacuacagauaaaguguaauuuugaaaaauuggcucuaacuaugguccaacuugaccuacaguagccaaaaagcuauaucuaaaggucauauaauuaaaagucauacucccuucacaaucuagccucagacaauugcuccgacuguauuucucauugcacccaaccugucccucucacaguccaaaagcaccccauuuacaaaucucuuuguuccucaaacacaauuucagcuuccugucuacaaauguuugcucaugcucuuuccuccaccugaaaugccuaguguuccuaauaacuuaucauuuaagguccaguuaucuucccuuaucaaaagcaguaucucucuuaucugauuuuuaacaucauuugaucuguacuuaucucacauugucuggcaauacagcuaucugcauacgucaucuacccuacuagacugaggacagauuaguguuucacaauaaucucaacacaaccugaauagugacacuguuaauuaaauuuggccuaaagcugcuuccauaagcagggaacugcaccucaguauguuaaaacugcaaccuaacucgaguauauucuuguaacgaggcuaagcguucugccaaucacaagcggcaagcugcucagacauguccaaauaaggcaaacguggacacaaacguggaccuguaaccaaucagacuaugucuggaugucacuucuuuuucugucuauaaauccugacuauccacauugcuggguggaacucucugaaccuuuacuccuucagggugcugcucaauucaugaauuguuucuuugcucaaauuaacugccaaauuuaauuugucuaaaguuuuauuuuaacaagacucaauauguaaugcuaaugagcauauuaauuuccuuaagacgaauaaagucuuuuuuuugagacagggucucacugucaccaaggcuggaguacaguggcaugaucucggcucacuauaaccucugccuccugggcucaagugauccucccgcuucagcauuacaaguagcugggacuacaggugugugccaccaugcccaaauaauuuuuauauuuucaguagagaugggauuucacuaugucacccaggcuggucucaaacuccuggacucaagcaaucugcccaccucggccucccaaaguucuggaauuacagggaugagccaaagcacccauccaagacuaacaaagccuuguuugguagaaauccagcuuuaaaaaugcacaagugacaauauaucauuuucagauauauaaaagucacuaauuaaaucaaacaggccacgaagauucuuacugacuucaaacugauuuaacaaaucuuauuuauucauacuaucacccaauaagauaguuuguguuaaguucauucauaaauuuggaacucaauaaaagcucaauucccagacaagcccacaaaagccaugaguucacaguaugccugauuuuacuuauuuggagagccaaacacuauguauaacaacauucggagguccaauuuuggguggcaagguauauuuagcccccugcacaugugccaacagaaucaugcauuccuucuuuccugucuuucucaacaaccucacuacaaacuaugugugaaaaggaaaaaauacauugcuaguuucacagcacugguaucuaaagcuagggaagcagcuaauaaaugggagaaaggagggcucuaaaaugaagacggaggauggcacugaagagcccagaguuuaucaagacaaguccugcuccuuuaagagcucccucuccagccucaucuccccuuacucccauuaacacuuugcauucuaccacacaaaacuauucaguuucccacaaacacaccauaaagcgcuuuuuugccccaugucacugcuuaucaucugcaaaucaccauucauccuuaaaguuccuguuaccuccccucugugaggucuuuacuaaccuccuucaaaguuaauuacucucuccuacuuugaucuuuauguaaaaauuuauuaugcauuuaccuuaauguauuauaaucaauuauuaguuugcacauuuuacacuauuagaucucaggcuccuuuuaagguaagaaucaagugucacucauuuuuucuuuuugagacggaguuucacucuuguugcucaggcugugggguuucuccauguuggucaggcuggucuugaacuccugaccacagguuauccauccaccuuggccucccaaagugcugggauuacaggcgugagccacugugccuggcccacucaucuuuauaauauuuucuggacugucaccauuuuuccuuagcacuccaaaaaaaauaugauuuuuuuuaaauguuggcaaaaaucuaccuuuaaaaaauugcuugcuggcugggggugguggcuaaugccuguaaucucaacacugugggaggcugagauggguggaucaccugaggucaguaguuugagaccagccuggacaacauggugaaacccccgucucuacuaaaauacaaaauuagccaggcgugguggcacacgucuguaaucccagcuacuugagaggcuaaggcaggagaaucgcuugaacucaggaggcggagguugcagugagccuagaucgugccacugcacuccagccuggacaagagcaaaacuccgucucaaaaaaaaaaaaaaagauaccauggaaacauacaaugacacuauuauuuguggaccaaaacaacuuauugauagucaugcaacuauuuguuaccuucuucauauaucuaagacuauucugaaaauguaaaaaauauaaacuggaucagauuaagugguuuauccagcugaaagaaugacccaaauaauuccaguuauccaucaccaaacuauacccaguagucauggagauugccaucaaguaacauuuuucuccugcacaauuccauuuccacauuacacagagguaguagaguuguauuccaugucaacuucaaaagauuaaaaacccaaauaucuuugguuuuccuuaauacaaauguguuucuucauaccauauacaaaaguuaacucaaaauugaucaaucuuaaaucuaagagcuaaaauuucuuccuaaaacucuuagaguuguaaaggugcauaaccuugaaucagccaaugauuucuuagauauaucgaaagcacaaucgaaaaaaucagaggcugggugagagugugauggcucacgucuauaaucccagcauuuugggaggccgaggcagguagaucgcuugaggucaggaguucaagaccagccuggccaacauggaaaaacccugucucuacuaaaaauacaaaaacuuagccagcaugguggcacaugccuguagucccagcuacucgggaggcuaaggugggaggaucacuugaaccugggaggcgaaguugcagugagccaagaucacaccacugcacucuagccugggugacagaacaagacucugucuuuaaaaaaaaaaaaaaagaaaaaacccuugaaaaauuagacuugaaaauuuaaaacuuuugugcauuaaaagacauuguaucaagaaagugacaagccaagccacagaauggggaaaaaaauuacaaaucauauaaagaucuaguaugugagguauguaaaguacucuucugguauccagaauacauaaagaucaaauuuuaaaacaggcaaaagaccuugaauagauauuuucccaaagauauacaaauagucaauaaccacauaaagaaaugcuaaacagcauuaaccacuagggaaauggaaaccaaaaucacaaugacauaacacuucacacccacuaggaugacuauuuuuuaaaaaucauaaaacuaaaauccugaaaauaacaaguuuggcaagaaaguagaggagaaacaggaaucuucauacauugcugaugggaauguaaaacagugucacugauguggaaaacaguuugguaguuccucaaaaaguuacacagaauuaccauauaacccaguaauuuuacuccuagauauauaccuaagagaacugaaaauauguucacacgaaaacuuguaugugaauguucauagcaguacuauucuucacagcccaaauggcuaaacaacccaaauguccaccaacuaaugaagguauaaaugaaauguggguaacuauacaagggaguauuacucaccuauaaaaaugaauaaaguacugauaugugcuacaaggacaaaccuuuaaaacauuauaacugaaagaagccaggcacaaaaggccacauauuguaugacuccauuaauacgaaauguacagaacagaaaaauucauagauagaaaguggauuaaugguugcaggggggccgaggagagcuuaggagugaccguuaacagauacaggaucucuuucuugggugauggaaaauguucuagaauuacauaauggggaugguugcacacaacacugugaacauacuaaauaacacugaauucucuacuuuaaaacugaauuuuauguuauguagauuaugucucaauuuuaaaauugcaaaaaaauguguacucuaaaagggaaaaaaaauaaauaauugcaaaaaagaaaauuauguguguggggccaggcgcgguggcucacgccugcaaucccagcacuuugggaggccgagaggcaggcggaucacgaggucaggaguuugagaccagccugaccaacauggugaaaccccgucucuacuaaaaauacaaaaauuagcugggccugguggcucgcgccuguaaucccagcuacccgggaggcugagacaggagaaucgcuugaacccaggaggcagagguuguaggagcugagaucgugccauugcacuccagccugggcaacagaguaagacuccaucucaaaaacaaacaaacauauaaauaaauaaauaaauaaugaauaaaaaauuauguguguguguguguauguacacacaauuagcccuccauaucaauggguuccauuaucauggauucaaucaugaaucgaaaauauaccaaaaaaaugcaucucuacugaacaugcgcagacauuuuuccuugucaucauucccuaaacaauacaguauaacaacuguuuauguagcacuuauauuguauuaggcauuuuaaguaaccuagagaugauuuaaaguauucaggagaugugcauagguuauaugcaaacaaugucauuuuacaucagggauuugagcacccuuggauuuucuuaucugugggagguccuggaaccaauccccuauagauacugaaggacaaccgcauauauuuaucaccucaccucaaaaucucuuuaucuuagcuuuggauuaguuaaaugcuaauguuucaaauuauucaauacagugcaugaggcggauuucugccaacaauuguuugaaguauauuaaaaagacuugccaauccucugcagugugaauaccacccgcuauuuauuuuuugcgauauacuuaaauuacauuaaaauuuuugcauauaagguguauuuaaaauauggcacacauuccuauuucuuaaauauccacaagauaacuauuaccagcacauaaaauuuuaagugcacacacacacccccacaaagaugacccuugaucucagaacuuauaaucacgugggaccuauaaucagaagaaacauguaaauuaaaauaugacaauugaguauauucugugaagucacuuacagaguauaucugcaaucuuuagugaggaaagaaguuuuggaaagcauacccaacuuccucaaccacuacuuggaagaacugccccuugauuaagacuugggucccuaggaugcuuucaaguaauaaguucauggcuauaaauaccagcaccauuccccuaaucacugcuaaaaauuccauguauucagaugaaacuuucagcaauucccacuggccccuggaaucaacuuacugauuaaguaaucuagauuaagugauccuauuuuuaccaccauugcuaccaccacccuaaccuuugccuauuaucucauacagcuuccuucuaaaacagacacuucuuuucuuuuacauuuugauaucaucuguuaagugugcuuuaucccuucuuauaucaaaaaugagucuacuguacaguuauacucuaggaggcaccuuucauacaaaaaggugugacaggcaccuucuagaguugugcaaggaagcagcucugauaaacuccucagaucuauuucugguccucuguuuaauucuuaaaaauuacauuccuaauuucaagaauauguccucaaaaaugugcauuuuaauauaguguucaacuggagcagcuacaaaaauuuugaaguaacaauguuuuggaagacacuaccuuguaucuaaacaaaacuaaauaagccucuuaaugccucaugaguuccaugaaacaguaauuuguuauguuuuuaucaauguuacugacucuauauauaaauuuguaaccaggcaauuuccauagucaccauaaaaaauauccuuaaaugucuacuggcauagauuuuuauguccauaaauuguucauggaauagucugagcuaugaagggagguuaaguauaaucauucaauauuuacugagcacccaugggggguugcugacuagguacuuggagaagagauagagaacaauaccgaaaacaauuccuauucuguggaggaaaugugcauaaacccaaaauacauaaaagcaagauagccacuacaguuuaacaauauuugaaacucuauaaauggugagaauaaugcuggacugacaggaccagggggaguuauucagugauguuuuuaugaaagcgguuaccuuaaaugugaauauuaaugggagcaagguaaagacaguuuaaaagaggccgagcaugguggcucacacuuauaaucccagcacuuugggaggccaaggccagaaguucgagaccagccuaggaaagagaccccuuucucuuuagcagggcaugguggcacacaccuguaguccuaccuacucaggaggcugaggcaagagaaucccuugagcccaagaguucagaguuacaguaagccaugaucaugacacuacacuccagcuugggugacagagccagacccugucuuuaguccaaggaaucauaugugcaaaggcuaacgguuugguagucaagaacuuuuggcacaauugauaccuaaccugccuaacuuucacaaaaaaggauaguuuugacauaaaaaaaaaaaagagagaggacaaauaaucaagaguuccaauuaauaacuaauuuuuaaggccuuugggaaaaaaauuuaaauauuauuguuaagacuuuuuugccccagcaguuuccuuuccaagucauacugaacacuccuuccaaucuauuuauggacauaaaguggacauagggauuaugauaccacaucucuugcuugaaaucuuccaaaaguugaggcacuguuaccuacaaaaucaaauccaaaauuacuuugagaauucaaaggaucccuuagaucuaguuccucuuugaguacucuuuugucccuucuaauacacacucaucccuaaaggugcauuuuuuuagucucagaaccuucacacuuuuaaaauugaggagccaagagcuuucauguggggguucucuaccaauauuuacuguuagaaacugaaacugauaaauuuaucaacauuaauucauuugaaaaauaacaguauuuucaaaaaaccccacaauuuagaagaguggcacuguuucacauuuuggcaaaacucuauuuugugguuuaauaggaaauaguugaauuaucauuaucugcuacuacauucaaccuauggcaauaucacacacacaucacacagccucuagaaaacuccacuguacagugguucuugaaagaauaaaaauagaaaaggcaaauaaugucuuaguauaugaaaacaguuuugaacucacaaacuugcugaaauggucuugaggacccccaaaaguccccagaccacaccuuaagaaccacugccagcaaaggagaaaggcaauacaaugcagcaaagauaaucuuuucaacaaauaguacugcacaacuagauauccacaggcaaaaaaaaaaaaaaugaaucaggagacagacauuacacucacaaaaauuaacucaaaauggaucacagaccuaaauguaaaaugcaaaauuauaaagcucccaaauggugacauagaagacaaucuagaugaccuugaguuuguugaugacuuuuuaaauacaaugaugaaggcaugacccaugaaagaaagaacugcuaaacuggacuucauuaagauuaaaauuuucugcucugugaaaggcauugucaagagaaugaaaaagacaaggcacagacugggagaaaauauuugcaaaagauacauuugauagccgggcucaguggcucaugccuguaaucccaacacuuugggaggcugaagcaggcggaucaccugagaugaggaguucaagaccagccuggcuaauauggucaaacgccaucucuacuaaaaauacaaaaauuagccaggcaugaugguagacaccuguaaucccagcuacuugcgaggcugaggcagaagaaucacuugaaccccugggagacagagcuuacagugagaugagauggccccauugcacuccagcccgggagacagagcaagacuccaucucaaaaaaaaaaaaaaaaaaaaaaaaagaaaagaaaagacacauuugauaaaggacuguuauucaaaauaaacaacucucaaaccucaacaauaagaaaacaaagaaccugacuuuaagaacaggacaaugaccuuaacggacaccucacuaaagaagauauaaagauggcgaguaugcauaugaaaaaaagucacauaaucaggaaaaugcaaauuaaaacaauaccacuacacaccuauuagaauggccaaaacccauuaacagugacaauaucaaaugcuggugagaaugugaacagaaacucccauucauuacuggugggaauauaaaaugguaccaucacuuugaaagacaguuuagagguuucuugcaaaacuaaagguauucuuaccauaugauccagcaacuguguuccuugcuauuuacccaaacgaacugaaaacuuauguccacacaaaagacacgcacacagauguuugauguuuauagcagcuuuauucacgauugccaaaacuagggagcaaccaagauguccuucaguaaguaaauggacaaauaaacccggguauauccagauaauagaauagucaagugcaaaagaaaaaaaaaagcugucaaaccgugaaaagccauugaggaaaucguaaacgcauauuaguacgugaaaaaagaaaaucugaaaaggcuauagacuguaugauuccaacuaugacaucuugaaaaggcaaaacuauggagacaguuaacaaaaaauagugguugccaguggcuggggaagagaagggauggcgagggggagcacagaguauuucagggcagauaaacauuguaccgcuacaacaguggauaugugccauacaauuggccaaacccauagaacauacaaacagcaagaguaaaccuuggccgggcgcaguggcucacgccuguaaucccaacacuuugggaggccgagguggguggaucaccugaggucaggagcucgagaccagccuggccaacauggugaagccccaucucuaucaaaaauacaaaaauuuagcugggcgugguggugggcaccuguaaucccagguauuugggaggcugaggcaggagaaucccuugaacccaggaggcaaagguugcaguuagcugagaucgcaccacugcacuccagccugggcaacaagagcgaaacuccgucucaaaaaaaaaaaaacccuaauguaaaccauggacuuugggugguaaagaugucugaauguagguccaucaauuuuaacaaauguaccacuuucgugggggauauaauauaucuugauaauaauauaacuugagaaauccuucauuuucugauaaucuaacaaaucacaacucugaacauaauuuuuaauacaaaggcuuagguucaucaagauucucuuuuaaagaacuaucuaacugcccaaaaugauucacauacacagugaacauacaaaauacuaaaaggucaaguccaaaauuuugauucucuagagaaacguauaaagcaguuuaacugggaacauacuaagacagaacacaaaguaacggaaaugccacuuuagcuaccaaaagaacaggaagagcaaauacuaagacuuuacuuugaaagucuaaggcuacuucuuccugguagggcucuaaccucuugccaagaagccuguaaguuuauuuuucuuacuucuuuauuuuaagugagaaaccaugaaauuaaccauuucagagcugaagaaaacaaaggagaaacaacuaugucuacggugaacuuucacauuaacuauucuaaaugauuaucauggccaaauaaacaaauauuuuuaaaugaaagcaauucugauuauuaaaauagauuauuuuuaaacaaucaguguuuuuuaaacaucaaaguaaauguuucauauaaaugucucacaaagcguaugaaagaaaaaugucaaucacaucuuaugaaguguuucacuucucaccugccauaguaacuuuaaauucaaagacaccuuuaaaaauuauccagauauauaaaauauucaguaaacacaaaagguauauagaugcccaaagucuuauacuauuucuuaacauagcaaauaaauccaucagggaacaauaauuacaaaaguauuucagaauucauuugcuaauuaugaauaagcggcuacaaaaaauaguugaauauuaaguucucuuuagaguuccucuuuuaaaacacauacuguucagaaacuuaacuagacauaucugggaggaaaaaggauacauuugugaauuuuauuauauaccucaggcauucuguucugccauggcgacagaaaaaauaaaaauaaauaaaaugccucaggcauuugacaugugugaucaaaucuuacucauuacuaccacuuugauaacucuauuucuauuuucuguauugcaaaacuacuaaaagacuaguaaggauaaugaaaaaugaaaauauaaaucauaugacuaauucuuacaggaaagaauaggaagcccagacauuaauuacaaaauaacugucuucuuaaaacaagauccuuuuggaaaaaaaaaaagucccaguuaccuuacuuuuaaauaaaagauauccugggacagaucuucuacuuuauuucuuccuuacaugcaucuucuuagaaaucacauccuaguuaccagauccuucuugacaauacgcaaacuaagcacccauaagauauuauuaacugagacauuaaaaaccauuugugcuuuaaaagggaauuaauucagguacagucugguauguuauacgcauuuuuaauguaguuacacaaaccacuagcccaaauacaaauucuacauaugcaaaauauucaaauccuacuuuuuaaaaacuuauuuccaauuucuagauccaguucacaacauacaaauaaccaugcuguaucgaccagagauauguugauaauggaugcuuaguaagaacuugaucuugauuuuguuuuagaaaagauaaggcagugguugaaaugaaaugucccuguaaauuaacuggggaaaauaugaauuaaaaaacagagacauacaggauauggugacucacaccuauaaucccagcacuuuaggaggcucagcugguagagaggauccuugagcccaggaguuugagaccugcccgagcaacacaaggagacccugucuguauaaaaauuaaaaauuagcugugcgugguagcagaugccuguggucccagguacucagaaagauugucugaacccgggaagucaaggcugcagugagaugugauuccaccacugcacuccagccugggcaacagaguaagacccaccucauuuuaaaaaaaaaaaaaaaaaaggagacauuacagccauuaguauaaauauuacauuucagugaaauaugucaaaauauaaauguccaacgauaguaaauaagaauaaagaaaauuaagaauucauaucaaaaaauaggauaagggccaggcaugcuggcucacaccuguaaucccagcacucugggaggcugaggcaagaggauuacuugagcccaggaguucaagaccagccugggccacauagggagacccccaucucuccaaaaauaaaaaguuucuuuaauuaaccaggcgugguggcacaugccuauagucccagcuacuugggagacugaugugggaggauuucuugagccugaggaggauaaggcugcagugagccaugauccugccacugcacaccagagacagagcaagacccuguauccaaaaaaaggggugggguuaagacuaaagauuguaagaucagauaaaaaugauuuuuauauuaagaaguuauaaauuaaaaauugugggccaggcacaguggcucacacgucuguaaucccagcccuuugggaggccgaggcgggcgaaucauguggucaagagauccagaccauccuggccaacauggugaaaccccaucucuacuaaaaauacaaaaauuagcugggugugguggcaugcgccuguagucacagcuacucaagaggcugaggcagaaucucuugaaccugggaggcagagguugcagugagccaagaucgcaccacugcacuccagccuggcgacagagcgagacuccgucucaaaaaaaaaaaaaauuuguuuuuucuauccugcaauaauuaugguucuuuuaagcauucuguacugcuaaauggaauuagaagcuacuuucuauguauaugaauugcccccaccuccagcugugagacaggauuaaaugagaugaugagaaagugccuggaaaacugaaguucuucaaauauaagggcugcuauuccucuaccuugauuauggcuacuaaaggccuaagauuaaacggaaaucguguuuauuuuuacaaacauauuucaaguuugacaacucuuucacacuagggaugcuagucaacacuauuauccacuaacaccuacaguauaagcaaagcaaaaaaaucuuucuucaguaaguauauaauguaguaugaauuaagccauaauucaugaauuauuaauaaucacuuccuaauguggaaagaucuuggcgagaaacugacagaaaccaccuccacacucuaagggcuuauacgaaaaacaacaguccuaagcauauuuuuuguuaaaugcugccauuuuaaaaugaaaucauuuucauuagauucauauaaauaagcaucaguugcuaggggcauuaaaaggugcacauaaacuaagcuuucacuauaaagaaaaauuccuaaaagacaaaaaauuacuugaaaugacagguuucuguauuaaagccuaaaguucaugaugucaacaccaugaacuguccguagaagacuuuuuaauuuucucaaagcauguuagugugugcaaggaagguauuuguuuaguaaaccacucacuggucagacuuuaccuaagauaaagguauuuuauuagugagaacugauuacaggacauuuuaaucaacaauguagggaaaauaguaucccuguauuuuaaaaccucauugaaaagaaacagaagcacauuaacgacacauauauuuuuaaaucaaauacuaccagguauauucaaguuccaaaaacgugggagcuuguaaacacagaagugguagagaaaaagaacgacaaaugcaagauuauccuccaaaccuaaucccaguuaccaucuaucugcaguaguggcuauaacaagagaaauagcuaauaacauuuaugaaacaacaugcaaauagcacucuucuaacccuaccuauuuucuccucuuuuugacaaugcuuuaaaagaaccacugcuacauuugaaauaagacacaaaccuuuacaaaaaaaacuuuuaaaagccuuaucgauucuuauuuugaaugaggaaagaggaaaauaguucacacagucacaacuaguuucuucauacucccauacaaaaaaaaaaaacaaaaaaaaaccaaaagcaacuaacaaaagaauuaacacagugucaggacaaacuguaagauuugguagggcaaaccaaguaguauuugaagagccguaaauagcagaaacgucuacuacacguaucagauaaucaaaaaaucacauauggcuuuacgaugcauuuuaaaaaguuuucuguucauaagagugucaccauuuaaacauauucuccauucucuaagacaagcaaggacugagaguuuaaaagcagccugcaugcauaucugaaagaaucaagcacuaaugcuuuuuuauuuaaaacuuuuuuccacaguggaggaacaaucacaaagaauaauaggcuucuguguagcaaaaacuuguucuaacagcauucaugagcacaguaacuuggaagaaucuacauuucguacauuuuuuuuaaagugcaaacuuuacggccaaaguccaaaugagaaaucaaaacaggcuuccagacagugaauuaucuuucagggcaugcucacucuugcuucaaacaguaaaacaaaguaacuuucauguaugaugaaagucagucagacuaauguguccagucauuuaaaaagggaacuuacuuaucgugacuauugcccuauuuuucccugaaaaguuucaggucuaagcuccauuggcuugagugauccaaugagcuuuguacccugggguaaaagagcgcaaagaaaaaggaggguauuacaggugacuuccagguuagaaaaaaguuacgaggaguuagcucuacuaauuguaucuacguuagcgaauggacgaauacuaugucguguaagagaagcuaaagcuaguuccucaaaagguaacuggcauaauuaaaacauccaaacucaagcaucaucaaacaucauuuugccaauuuuuuuaagggauguauguuauuuguaaguaaauuuauuaauccauuuggaauuccaacagucuacgcuuaacacucaagcuucugaauucaagccgccagaauuaacaguuccaggaacugauaagaguaucagcaaaaugccuuuuuccauauccccaugugaaaagcuggggggcagagcugacagucacaaacucaccccagucaaaaguauggacaacacaacgauuaaauuccaccagaggcaaauaaaaaucccaacuuuccagaaagcuuucccuacaccaaauugaauccuuuuacuuucacucccacaaagaagguaaucugaaauaaaagucggguaacuggguaugguauuuaaaaugagucgaagaaacuacacugaagcuacuauagaggcgaugaaaagguaacccaaaagcaggagggaagguggaacagaaagccaggaagggaugggcgaagcagcuaguggagcaaaggaagugggggaucccuuccagggaggcagcccggagggauaacaaggaucuggaugcaaggaaccaggcguuuacugaaacccgaaggaggcugaugaagaaacaauggggcuuggagacgcucagacgagggcgacgaggcggcaccggacgggugggaaggaagagcagaaggcugcaguggagacggguagggggugagaagccagguggggaagcaaguugguuggguaugauggggugugguagcgcaccgggcagggagacgaggguccccuaggaauagggaggggaguggcuugucagauuuugagacggggagcggaggccgugaaggcaggugugauggaagcaaaagaacacagcucaacgggcacaggaccggccgugccagagaagacgcagggagggaagaggcaguagaagggugaaagacaagagagagagagaaggacgcgcgcgggucgcgcgggcgccggggagcgggggccgcggucggcuucacucacaguccaggugcuuuuucuugggccccaugaucucgugggucguggccuugcauacugucuuggauacggcagagccggugacacugugcugggcggcagugauucgguccgucaggcucuggccggacaucucugcagcuccuccaccaccccacccgcucagcagccggcggggacugggacccccaagagccggaggguccccaccccccaccgcacccccuacccccaccggcuccuuccccgccugccggccuggggcgcgguucggggccgcgcgcugccaccaguccagagagaaccggcucgugucacccgcggagucggacaagaugucgggcacucccuugcccccgccucaguucagcccaccccuucccgggucagcuggagccgggcaggguaagaggaacaggcagcugcaggaaaauggcggcgccaggcuccuccucggagcuuuccgggcugccccgggucacgug

SEQ ID NO: 15273 - RNA, 8597 nt, Homo sapiens
gcgucacgagucagccaaagauggcugcgcccagguaauuugagcaaaggccacagugaacuccggcguggcugaggaaggaggaggcacccacaggcugcugggaggagagcauaagguacugguauuccgggggagggggugaaguaaaugucccggugucaggagaagcacgacgcggugacacgcuagcuaccagcagcgcugcgcguaaaugagagcaaguagaaguguaguuagcucuuccugcugucuuuucacuuugcacucuagaaggaaagaccuuauauuuaaauuaacucaguagaaaggagaaaugccugagauugaauuuaaucccagguuuacugucaauuuacaaggugaccacggccaaauuugauuuucagaggucccacuuuacuucucuuucagauaggccccacacugccuaucucucagagcucuuccaagaaugacaugagauagguaacacaaaaaucuuucgaaauauuuguaguuuuuacaggcggcguugucuuugauagauauuuguuauuaauaucggagacaaaaugcccacaggggcugcccagucagcacuuauacugaauugagugacuuaauugcccucaguacaauauauacauacuaaauuugauuauauauuucaccaccccauacacaaaaucauucagagcuccuguacagcagagauugugucuuaucaucuuaucguagccaaggcccucaaaaauuugacuaccagaaaccuagacauaaauuucuaaggcugcuuuguacuuauuagguuagcuuuaagucuagagauauggaaugucaagguaaucaacauuuccaaaugaccucuuaucgauauaaaacagguagcaauaaauauuuaaacgagugccuguaauguuguaggaaaugagaaaaucugguuucauaaaagcauguuuuccuuuguuguuaucccugaacuguuuuuuuuuuuuuuuuuguagaccgagucucgcucucacccaggcuggagugcaguggcgagaucucggcacacugcaaccuccaccucccagguucaagcgauucuccugccucagccucccgaguagcugggauuacaggcagcugccgccgugccuggcuaauuuuuguauuuuuaaaagacagggaguuucaccauguuggccaggcuggucucgaacuccugaccucaggugauccgucugccuuggccucccaaggugcugggauuacaggcgugagccacugcauccagccuuuguuuuucuuaacuguuacccugaaaccugagccaaaucuucaucauucaccauucccuucacauuuucacccuaacuagugcagacaucaacaaacuacuggcauguaggccauaugcagccuauagcuugccuugguacagccacccagcuaagaaugauuuuuauguuuuuauaguuuuuuuaaaaacaaauauucaacaaaggcuguauguuaccugcaaagccuaccacauuuacaucuggcccuuuaaaguuugcugagcccugaucucagguauaccuagaaaugaaauugcuagcuaugugugucuucuaucugcuaaauaauaccaaauucuuucccaaagugacuguacaguuuggguaaagcuaccccacagaauguacacagaauguaguuuuagcuaccccgcauucuugccaauaauuggaauugucagauuuugauuuuagcuaaccuauggguaccuauugguaucucacuguggguuguucccccaguuauaaugaaggugagcauauuuucauguuuauuggccauuuaacuuuccuuuuugugaagugccuguucaaauauuuugucaguuuuuccguagggcugcuuaccuuuuucauguugauauguaguuccauguauguucuggguacuaacuacucuuuugucaguucuauugcauuuucucccccacuagcuuaucuuuaugguauauguugauaaccauagguucuuaacuucaauacuguuaguuuuauaagucuuuuauguuuagugcuauuugugaauuguuuaggaaauacuuucaaggauuaugaagauauucuguauuuccuaaaagcuuuauguguugcuuuucauguucugguuucuguuucacuuagauuuuuuuuuaauaauauguaugcaaugauuuuuuucagauuagcucuacaguauuauuuuuagucuucagaagguuuuuaaaauucuuuguauaaauucuugagaaaugauaucuucauguuuuuuaaggcucaaaauggaaaaucauaaauccaauaauaaggaaaacauaacaauuguugauauauccagaaaaauuaaccagcuuccagaagcagaaagguaagaucccuucuuaauuuaaaaacaccuuuuaucagguggauuuucaccauugauucauuaucucaaguuuaucugguuugaguauaaacaacauggaaugugagaaggaaauugcccuuuucuugccuggaugagagcguuuaaccauuuugcucaacaucacauagcuaauuguggaaggugaggcuggaacucaugucuuuggacauaccuaauuguauaauguuuugaguuuuuccauuaggcuuggaguauaguaaaauguaaacauuuacagacccauuuaaauaacaaaacuuuaacuuuuaaaaugucuuuuuuuucccaguucauucugucaguaugcuuaccagucuaagaguaccauagaacacacauagcaagauagagaaugucagagaaauaggaucauggcuaaagaucuuuaagauauuauuaaagagggccaggcaugguggcucacgccaguaaucccagcacuuugggaggccagggugggcagaucaccugaggucaggaguucagaccagccuggccaacauggugaaaccucaucucuacuaaaaguacaaaaauuagcugggcgugguggcaggugccuguaaucccagcuacuugggaggcugaggcaggagaauugcuugaaccagggaggcggagguugcagugagccgagaucacaccacuacaccccagccugggcgacaagagugaggauccgucucaaaaaaaaaaaaaaaaaaaaaagauauuaaagagaaaaaccaauauagggaacauacuaaucuuugccaggcagcuaauguguacuuccacaaaaugucuuacacuuuguugacagucaagaaggucucucugacuauaaaaggaugaaaagcagccaccugggaaggagagagggacagugucuuaaguagagggaauggcauaugccuagccacaagauagccaaggcuugugguacuugaguaaccauuguuaccgaaguacuaaggaagugggaguaaggaccaggaauaguuuugagcagggggaugauguuagcauuucuaaagaacauuccagcugcuuuuuggaaagcagauuugagguaggaaagaaaggaaacacaaauaccaguagaaaaaauggcacaguaauccuggugaguggagaugguagggguggugacagcugagaugaaaagaggaugcauuuaaaauacauucuggaagcauaaucuugcuaucuucaggaauagaaacugaacaaauccccaucuugcugccacuuaccaucuuaaucagggagaacccauaaaucaagaccaguaguguucagaacaaggaucuccaaggggaagaaaaaaaaggccaguaguaagaacuuggugagaucuuaaaagcucuuucacccccccuccccacacuccaacuccacucccuucuaguuguuuuccugagguaacggaaaaccuuuuaaagcaaaaaaggaacuauguccauguuuccaggccagcaagauagggaaagugagaaagacuaauaaaagaguaguaggcugggcaugguggcucacaccuguaaucccagcacuuugggaggcggaggcgggcuggucaccugaggucaggaguuuaagacuagccuggccaacauggcgaaacccuaucucuacuaaaaauacaaaaauuagccagaugugggggcacgugccuguaguccuacccacuggagaagcugaggcacgagaauuguuugaaccugggaggcggauguugcauggagcugagaucaugccacugcacuccagccugggcgacagagcaagacugucucaaaaaagaguagaugguggcagcuuugaagagaagaaagcagucugucacuggguucuuuaccaaauuagaaagaauaccuggaacugcaaaguaaaauuuaguuuagaggcaauaaauguuucaaucauuggcaucuaaacuaggcagauuacaguguccuguuaucuuugccuuguuccuauuuuuucucuucauucccauuuuauuuucuaaguuuaaaucuucauuucuucuuggauuauuaaucagguauuuaaugguuacuuggcauguccuucaguguauggagcuuucuuaauaucaaaaacuucauuuucugaucuacagcaauacuuucacguacauguuugucauuuguuaaauuugggcuauuucaugucuauuucuuguguaugucuuaucaaaaagucaugaguuuuuaguugguauagguacuuuuuuggaaaacuggcaaggggcugcuagguaacaauuuugugcuaacuuuuaauuaacuaaacauuuugaccuuagcuaugggaaaaaucugguugggagagagcaaaguuugcuaugcagauuucacuuguacuacuuuuuauuuauuuguauauguaacauacuuguaaacaaauggacuuauauauaacauguauauauguauuuuauauauauuauauauacauacaggcaaauuguuuaccugagcauugggauuuaaaauggggauaauauacauuucacaugauuuuuaugaugaaauauuuuagaggaaguguucaaguuuuuuauuccaacccccacaaaaaaaaaauaggcuuuucacauuuacaugguuuuugugguugguagguucuccagacugucaucacuaauuauaaucuauguacuccaaguuccugaacugccacugucuuguaccaccauuaccauuuucauagacuucuguuauaucucguuuacaucucuuucuucuccaguaauauuuaacuauguuaaccuugaagauagaagguaauuuuuugugccuuuagcacuaagucugcugcauacagugggguucucaaugagugacaggcaucaugauugcaaagugucagauaagaaaagcaauaccuuauacaacguaggaagcugaguuccuagaaaagcuauuuuaagaugaguguaagccauagaaguuagaggagguacucuguggcuacuuuggcuaguuaagaguaaugaaaaucuuaagacuguauuguagauggcaauguaagugguaaaaaagcuaagucguagucugaaaaguuuggagucaguauuuucaauauucagcaaucauguuagguauuacuuuuucccaaaacuaaagaaugcauaggacauaaguuaaaaguucauacauaaccuggcuucaaauccaguucuaccacuaccugaaaacaucaguuuauuucucaucaauggguuguuauaaaguaccuagcauaggguauugcuuaaauguuaauacucccaauccugacacuaauguuucagggaagagugaaagaaaucacauuaacuccacauuauugaacaucuucugugucaggcugaauacaucuuuguauccauugucuucugguuguuuaaagacuaguguagaagccugacauguaaaucggugauuauauaagauaguacugucuuguaauguguugugcuagagagguuaaguauuaauuauuaugggagcucaggagaggcacccacuggcugcugggagaagagcaaaaaccuauauauaaagcaauuuuuaagauuuugguucuauaagggauagaugucguauccaguuaguguauucccaaaguccuauaacacaugucaagaucgggaaagcucacacacacaauaaugccaaagaaaaguucuuucuucucacccuuucaggaaucuacuugaaaauggaucgguuuauguuggauuaaaugcugcucuuuguggccucauagcaaacagucuuuuucgacgcaucuugaaugugacaaaggcucgcauagcugcuggcuuaccaauggcagggauaccuuuucuuacaacagacuuaacuuacagauguuuuguaaguuuuccuuugaauacagguaaauucuacuucacuaucaccaaagaguuugccuuaguauauguuauuugcagcuuuaguccauacuuauuaauaucaaguagcuguaugcuguaaugcaguuaagauuaaaucuugcuagccuauauaauguggcaaauaauucauauuaguauggucuaccaaccaagaugcacauacacagcaguucuaaauacuuuuucuuuaauugagauggaguuuugcucuuguugcccagguuggagugcccuggcgcaaucuuggcucacugcaaccuccaccuucuggguucaagcaauucuccugccucagccuccugaguagcugggauuacaggugcccaccaccaugcccggcuaauuuuuuguauuuuuaguagagacaggguuucaccauguuggccaggcuggucucaaacuccugaccucaggugauccacccgccuugucuucucaaagugcugggauuacaggcgugagccacugcacccggcaauacuucccuuuuucuaacauaucuuucucacagugcucauuuagaguaagaaauauuuggaaauccauauauacauauauaugaaaauuauauauauggaaauauuauauauauacaaauguauauaaauaauauguuggcuaccuuagauuuuuuauuuauauuuuauagagaaguuccuuaaagggggaaaauauuuuuaugggaauaacucuuuauacaguaaaucucuuaaagcacuaaaugcauauacauuuaucaaauacauggagauuugauuuccuuuugaaaaucuaccaugugugcugaauacuuugaguacaguuaaucauaaaaaaaacuuuugauuaauuauuucaaauaaaaauauuaccaugggugcuagggaaggcaguccaucuaaauuuuguuaagugcugcuccaaauuuguuuaaauuugacgaguauuuuguuuuaauucccaugaccaguggaaacaauuucuaugaucaaggaagaccuaucgcccauuuaauugaacagacugagugaaaauauuagccuaggucuguugauaaaaaacaaggcagaaagcuagcaguagcccaaaccaugagauuauuauaucuaaguugagaacaaauuagagaacuuuuuuuccuaaaauaguuuuaccaauuauuccuagcuauuuuaaguuacucauagauguaauuauaccuuuuaacaggcuuuguacaauuacauuugauauauuaccugaaaaauaccugugauacacaaaagaggaucuuacauucuuuaaaucauguuugcuugacuaucaugaccuucauuucuaugacuaauuuauuuccuaggugauuuggauugugaaaccuguaccauaacacggaguggacugacuggucuuguuauugguggucuauacccuguuuucuuggcuauaccuguaaaugguggucuagcagccagguaggaaauaaaaaacuuuuuauaauaugugauuaccuauaaaacucacaacuuaaagcagcaaauauauuuuguuuuuaaggcauuuagaccaaaggcaauguuacccucuugauuagaaguuagcaagaccuguuuuuucuuauaaugaaauucuacuuaucaagaauuucaaacaguuauacuugguguguaguuaggcuauuaaccuuaauuuguguacugaauacuaaacuaacuacaaagcugcaaacaguauuaugcaugaaacuucuaucauauaaacaauuaucuuggaugaguuugaacacuugcacuaaaggaaaauuccaucagaaaaugucuagcuguuauauuagccuucuauucuaaaauaauucuggcuauucucuguugaacucuugcaucagcaaucuaugcuauagccuugaagcaaacuggauaaagaaacaaaaguuuuuaggauuaauagacacugaagaccuuuacuuuaauauucaguuuuaucuuaagacuucuaggacuaauauguaucacagauggguuugccauuugaugcaacaaucuuuucuauugaacuaucucaauguuuucuuacagguaucaaucagcucuguuaccacacaaagggaacaucuuaaguuacuggauuagaacuucuaagccugucuuuagaaagauguuauuuccuauuuugcuccagacuauguuuucagcauaccuugggucugaacaauauaaacuacuuauaaaggcccuucaguuaucugaaccuggcaaagaaauucacugauuuuaaacaaauauguaaacaaaaauaaaaugguaaaaacaguuuaugucuaauguuaugucuaaug

SEQ ID NO: 15274 - RNA, 32217 nt, Homo sapiens
auuucgcacgacgcagcgguugggaacacagacauuuucggagcuggagccgccacugccgccgccauuuugugucuguggagaaagaagcuucuguggcggcuggaaguggacggagaucacccgcgagacggcggcguuucauacccgagguucccccugugucgucccccauccccccuccgcggucagcauguggugaagccggagccgcgagagagccggggagaggaagaggagucggaagggaggcgggguauccagagcggcuucagcuucagcugcagcggaccucggaggggggccgcggcgcaaugucagagcagacgccggccgaggccggugcugcgggggcccgggaggacgccugucgggauuaucagucaucgcucgaagaccugaccuucaauagcaagccgcacaucaauaugcugaccauucuagccgaggagaaccugcccuucgccaaggagaucgucucucucaucgaggcccaaaccgccaagguuuuuauacaccccgcagccuccuauuacuucuaauacucccugauuuuagugucagccucaucccaggucucgcuuccaucccaagggggacaguguuccuucucuccaacccccccaccccccuccaacucaggcucggucuuuggcccaggcuucgagcaugggccucugggggggagggaguggggaggauaaaggguggagucccacuuccgcuuuccaacucccuuuuuaggccaccgcauuguauaucccgacacacacacgcuuugaauagagcccuuuggggugggggagacuuaaaggcaguuugugguuuggggaaguaagaguuaacauaagccauuuuaauucccugggaagugggagagugggucucccauuuuccccaagcacccuuuuugguaauuguguucuguggguuggaaggaggugaagggggaccugggagcgagcuguuggugggugggaauagggauuuggccccgaguggagcagccgccuguuaggagcccaacauggcgccugaaaagcacaugaugcgaaagggaagagaggagaauccauucccugccagccaggcagcugcucacucccgucagccccauuuuggggugggggcggcuagauaaaacuuuuauucuccuauuggagggucuaauuugucccaaaauaggggcaagugggguugagggugggguuuggguggggggaggagaucuuauccaaccuguagguggagaacuggcccagaggguaacaaguacuugcaguuucucugaaaaguucagucccuccuccucuuccuuuucucuuuuucucccuucccugauagcgaaggaguguuuuucuuuaccccuugacagaagugguccucugccaccuuauauuucccuguaguccuccucuucuguggauucauaugggagcgauaugucauuuaaguaaaguuacuguucaacuuaguuacaaugaguuuuaauagcgucccagugcuacauuuuauuuuucaagcuuguacucacgguuuaguuuuuucuaguuguuagugauugcaauuaucaggaugagccuccuuuuagcagagugaaccccuuuuuaaaggccacuuuaacaacaaccaccaauauauuguuuagagacgguuucugucuaguguaaaacuugaguggucugacucuaauaaaugguuuugaaaugugugacugguauuauaaaauuugugaauaaaacauauaaaauauguauuugucuuuuuuauuuaccuuuguaagguguagaaucuguuuccaagacuuauuuuuaucuacgugguuguguguuuuaaacaaaagucuuuaagugacuuggguucauucuucuuuagguuccauccacucuuuuggguaaaccucuucacaagauacacgguuucaggugguccuuucauaauuuaaagaggacgaaaaggaaggguuuuuuuucuuuuuccuuuuaaggaccucaacaaguuuaucaugcucagucugacagcuaagauacaaguuuucguucacuuuuuccugugaaaguguauguaaaacagcuuuuuuuuuuaagugugagauuuaaaaaggaagcauucgucauacucaacaugcuuuuuauugauaccacaaacaucuuggacaugaaaacuuaguuuuugccuuguugaaggcuuaacuugacauuaaaugccuuaaagcacuuguguuuuuaaggcaaaaacauugauuuuuaaaaucuaauuaccucguaucuugggauuuaauauuccacagcgccuaauauuuagcagcucagguugucacucaaagaaccuugcugguuuuuaauggauccggaagaccuucgagaaccgaaaacuaaaugcugaauauagugaccacauaaaacuuguguuuguauaucgcuacacagugaugaaaauagaugagcucuuugcugguaaaagacagcugaaauuuugggggcacacguuuccugguuauuuuuguaaagccagguugaggaaaagauguaaaagucacuuugggggaucuaucuuaaucuggguugggaucgagggugaggggagggauuuccguuauuugguagcaaacuggccugguuuuguguuuuggaggugaauguuuguguccuuauucuuuagcuucucugcguuacuaaacuuaaaggauucacacuuaauuugacuccucccaagagagagcaguagcgaaaaauaauacauaaaaggacuucacuuguacaauaaaaaauuagccuacuuaacagacuuugguguuuaagagagccuguuuaucuucauaaguacaauaaugacuaaaaugguguaaaacaugacaugguaagguaaagacacagcaguaaaccauuugacauguucguacuuaauauaguugacccacaugcagugggugaacccuuuuauuagacaguaccuuaaaagaaauuuuucauacaaaguuauucaaagcuucccuuagccaacuuuugguuguaaagguguuaucagaagcaagagcauuuccacacacuuguaugggcaauugguuuuauuauauaugauggcauuguguacuccagaacugugagccuacccuagcuucaggcagcuauggguaaguguuacuuaggguuaagauuccuauacacgugggguggguaaauggggauaaccuaaguuuuuuuuuuuuuuuuuuuuuugucuuuuuuuuuuauuuuaaaucaugggugcuccuuuggagucagaguuaaaacuauuauggugugucuuaaugcuccucaacaagucugugaaccugcugaugcuuucuggaagcuugcugugccuucuaaaagccagugguggguaggcauugcaguugaacuggggcaacauuucuuuacuuuggaaagggccaccuguaucagcaucaccacacuggcucugcacaaauuuauaaccccugguuugugcaugucagaggaaaauaucucggcggagaguccaggcugugaagaaaaucuucaggacaaauccugguuuccagagucaaguucaaccugauuuacaugauucagcggcugcuccauccaguuuuucuugucugaguaacaaacuugcaacuuccugcauguucgugugcaaguuucaguguuuugccauugacuuccuaggugaaguguuuuuaauuuuuguucauuuggauuauagagaaguaauccuaaugauuuuacagguaacaaaagcuucauagacuugaacauauaaaauaugcccauggaaauuaguuucuacaagaggucuaaaaacugcuuugaguguaggcacaccguuguaaguuaauaugggucacaaaacugacacuuggauuauauaaaguaauuuucccucgccuccuccuuauuuuugucacuuaaaacacaggucuuuuuaccacaugaacuugaaauuucauugaguguuaaaugaguauauuagggauuacagcuguuguucauccugguaauucugagcuuuuuugugcucaacuaaggauugugagaguugagagcuugauugaacacuuaaguuucauaaagauuacuucaaaaauauuuaguaucaacaaaaauagaggucuguauuguagguuuaaaaacucauuuuuaaauaauuauuuggugguaauucauuauacuaaacuucucaguuucuuuuuauucaggcuccuuccucagagaagcuuccuguuauguaccuuauggauucuauugugaaaaacguuggaagagaguaucucacugccuuuacuaaaaaucuaguugcaacauuuauuuguguguuugaaaagguacauaugcauuuagaaacauuugcguuuuuuuuuaaaaaauguguuccugauuaaauaaauauuugcuuuguguuggguuuucuuggguggugaaauguuuuauacuuuuggacauuuaucguuaguaccauuucaaagaaagaggcugaaguuaauguuuuauguuagauuuuuagaacagauucuagggguuuacauuauccauuuaagaauagauggauuugcuuuuagaauugugcuuuuuaaaaaaauugaguguguucauuugaacaucuguuucaucacuuacaaaccaggcaaaaagaucugaaaucgucaagaguaauuaaaauuucauuguuuacauuucugguguuaggauguugacuguucucuuggggggguaaaaagcauaaucccucagugucucaaccugugauugguuccugaaacuuguguguuuuuuuguuuuguuuucuggaaauguuuacuuuuguuacauuguucaagguauguuuuaggugaauguuguugguaugugugaaugguggaccaguuaauugcuguugguuauucuggaaauacuuuugccccuaccuuaguguucagaaauuaggcuuauuuuucauaucuagagauuguaaauuucuuccauaacacuguaacauggugguuugguuaaagcaguauuauguugaggaggacaagggauuugcugagguaauucucugccugucaggcuauaucuuucacauugaacaaaaaggcacuuaugagauacuuagguuuaaagauuguuuccuaacgucaauauuuggugguaguuauuauauuuuaguagaugaacaccugugugucaguugucagauuuguagaauuggaauuuuuuuuggaagaacuauucaguauuagauuuuacauguuuauuagaaaauaaguaguugcuauuugagaaauguuuuuaaguucuuagagaaaaacaguauaugcagaagaaaucuggaaagcucuauaucauauagcauuaaaaugcuuguuaauagaauauuguagacauuugcugaauacugcuaaccagaggcuguagucuuaaggagaagcuuaaccaaccucuugguuucgguuucaguauguucaaauucacuuggguguuugguagcauaccuuuacugaaucuaacugggcauuaacaugacaguugauuaaaaugaccuuguaauaaauacauuauuaucugaagacuuaugaauauaguuaaggcuuuacugucuauccuaauguugaaaaucuaacucaguuuucccaaguccuagguuucuugauggcgaauuuucuuucuuuuucuuuuuuuuguuuugagauggaguuuugcucuuguugcccaagcuggagugcaauggcacaaucucggcucacugcaaccuccgccucccggauucaagugauucuccugccucagccucccgaguagcugggauuacaggcaugagccaucaugccuggcuaauuuuguauuuuuaguaaagacgggguuucaccauuguuggucaggcuggucuugaacucccucaggugauccaccugccucggccucucaaaguguuggaauuacaggcgugagccaccgugccuggcaauggcaaauuuucuaaacauuuuuacgccaucacaaaccugaacagaaaaguuauuuaaaacuaaggcuuaucagugguuaagauuuugugaauuucaguuguuaaagugcuuuccacaccacaauaucuuguuccuauguacccaaccauauaguauugcugagcauuaguuagugagauaguuuugcuuuaauuuuaacuuuguacuacuauguaaauaauuuaaaacauuuaagccaucagguaaucaauuuuucuaguuguuuuauauuuuuuaguuuuauauuuucuaguugucuuacauuuuuuuuucccagagaaagaguaacuuuaggaauauuauacuaagcucuaagauguggaaacguuuuguauauagaaaggcucaccugguugguugcuugcaugaaggcuaggugaaaaugguuuuaauuacucuguuuuugaaggagaaaugcaccuuuaauaaauuauuacuguuguauauacuuaccaauggguaguacaguucuguaugugaaguagagcagauuuauauaacuuauauuuaauauauaaaauauucuauaguaacuuaacaagccauagaauuguucuguuguucuagguggaugaaaauacuaggaaaaguuuauuuaaguuacguucuacaugggaugaaauauucccuuugaagaaacuuuaugcccuggaugucagagucaauucauuagauccugcuuggccuauuaaaccucuaccccccaaugugaauacgucuagcauccaugugaauccuaaauuuuuaaauaaaucgguaaguuuuaauaugaauaguaaguaacauacuuuuaaguaucacauuuugaauucuucugcagaacuuacugccagaaagucaaaauagaauacucgguagugaauugguucaauuugaaaaaaaaaaaaauaguguguauauguuuggaauuuuuauuuagaaauauauucaccuuguuuagguauuauguaacauuuauuuuggguuuuaaauuucugauaaguuuucugugugauaggaauuuggaucauauuaagaguuaagcugauaauuuuuacucccuagcuuccguuuuagcugauacguuuuucuuaaacaaauugucuuuucuuauagcccgaggagccuucaacaccugguacaguggucaguuccccuagcaucuccacuccuccaauuguuccugauauacaaaagaaucuuacacaagaacaacuaauaaggcagcaguuacuggcaaagcaaaaacaguuguuagaacuucagcagaaaaagcuggagcuugagcuagagcaagcuaaggcacaguugguaaguaagggagauugucauuuuaaauauuuuaaaccugucuaacaauagggaaguaauguuuauguuugaauuuuauuaacauguuacuuuuauuaauaguguacucuuuuuucacuuuuauuuuacaaaugaguauauuuauuagacuauacuuuuauaucuuuauuguaaaauucacuugauuaaaaacugcauaggccaggcgcaguggaucaugccuguaaucccaacacuugggaagucugaggugggaggaucgcuugaguuuaggaguuugaggccagccugggcaacauagugaggcccuaccaaaaaaaaaaaaauuagccaggugggguagugcauccuugugaucccagcuacucgagaggcugaguuggaaggaucacuugcggcugcagugugcuaugauugcuucacugcacucuagcuugagugacagaucaagacccugucucaagaaaacccuccaaaaacuacaaaacuacacuauuuccuccaaacaguuuucuguuagauugcuaucuuauaaaauagcaucuuaauuuuguuuaaucauuacauuauguggacuuaauauuucagucccaagaugguaggcauguuguggcaaauauuuuugcauagucuuuaauguuuuaugagcuuaugcuccaugaacagaaaugacaaaauuaaggaggccaggaagauuauaucuuucuacacauaaaugacuuuauacuaaguuauuuugcuuagcaucugagcuuauucgacagugaggugcaggaaggcagaauuuuauaaguucauuaauagcaccacuuugggagaaacuaaauuuuaggacuuagaauuuagcugaaaugacucugauucuugugcagccggaguguagugauuuagcaauuucuuaggagcaguauggcucagaauccugaacaauaaggaagagaaacaauuuuuuuucauucuauuuagagauuauauuauaaagucucaaaaaauacuaguaagaaauaaugggcaacuuaaaucauggacuuuuucuuuucauuguaaucucaauuuauacauuauaaguguacaauuuaaauguaguguugaguaaauauauuuauugaauaaagcauuaucuucuucaguuguuugcaauuucuugacaaucugcauguucugcaguguuaacaugaacauuuauuuuguguuuuaggcaguuucucuuaguguucagcaggaaacauccaauuuagguccuggaucugcaccauccaaauuacauguuucacagauucccccuauggcaguuaaagcuccucaucagguuccugugcaaucugagaaaagccguccaggaccauccuuacaaauucaggauuuaaaaggaacuaaccgggauccucgucugaacaggauaagccaacauucucauggaaaagaucagagucacaggaaagaauuucuaaugaacacauuaaaccagucugauacuaagacaaguaaaacuauacccucugaaaaacuaaauucauccaagcaagaaaaaaguaaaucaggugaaaaaauaaccaagaaagaacuugaccaauuagauucuaaaucgaaaucgaaaucgaaaucacccucaccuuugaaaaacaaauuaucucacacaaaagacuugaaaaaucaagaaucggaaaguaugagguugucugauaugaacaagagagauccaagauuaaaaaaacaucuucaggauaagaccgauggcaaagaugaugaugugaaagagaagagaaaaacugcagaaaaaaaggauaaagaugagcacaugaagucauccgaacacagacuggcuggaaguagaaauaaaaucauaaauggcauuguacaaaaacaggauacaauaacagaagagucagaaaaacaggggacaaaaccagggagaucgaguacuagaaagcgaucaagaucucgaucacccaagucuaggucaccaauuauacauuccccaaagagaagagauaggcggucacccaaacgaaggcaaagaaguaugucuccaacaucgacaccuaaagcuggaaagauucgccaaucuggagcuaagcagucacauauggaagaguuuacaccaccuucuagggaagacagaaaugcuaagagaaguacuaaacaggauauucgggauccaaggcgaaugaaaaagacugaagaggagcgaccacaagaaacuacaaaucagcauucuacaaagucaggcacugaaccaaaggagaauguagaaaacuggcaaaguuccaagucugccaaaagauggaaaucugguugggaagaaaauaaaagguaugauguuaacauuuuaagucaaguguaguaguguauauguuucaaaagauaguguuaauuuaaaaauuggaaaauguuuauuaggugcuauuaguacuuuuuuuccaucuaauucuuacaucucuguggguuaaauacuauuauuauuucuauuuuacagauaaggaaacugaaguuuagaaagguuaacuaaucuaccuaaggcugcaguccaggacaugcaagaaucagaauucauaucuguuuuugcugauuucauauuuugugcucuuaaucauuuauuuaauuacuuuuugugguuacauaugcccauuuuaaccauauccuuugaaaagaaucuuuaaauaugguccugaguauuuuuuaaaaaaacauuucaauguaacauacugcuuuuaugguuucagcuuacaacagguugaugaacauaguaaaccuccucaucugaggcauagggagagcuggucaagcacuaaaggaauuuuaucaccucgagccccaaagcagcaacagcaucgauuaaguguagaugccaaucuucagauuccuaaagaguuaacucuugcaagcaaaagagaauuacuucaaaagguaguuacuaugauuaaucccauguagucaucauuaucuaucgucuauuuuuuugguauuuuuuuauauuuaaaauauuuuauuuccuuuuaucaccccuauacagacgagugaacguuuagcaucuggugaaauuacacaggaugacuuccuuguuguugugcaucaaauucgacagcuauuucaguaucaagaagguaaacauagaugcaauguacgggauaguccuacagaagaaaauaaagguggauuaaaaaagaaaccucucuuaucugaugcugaauuaaccuacuaugaacauaaagcaaaacugaaaaggacacagguucagcauucauuuccaagacuugaucucuuagauccugauauuuuugacuacccuuugacugaugccuuguugucuggaauagaaugugagccauccaaaaguaaacaugcaaguaggaauaguggagcacaguuugacagaaaagaacaauuuagugaaagagcaagacgucuuucuccuauaucugggagucguacuuaugcugagaaucuuucaccccaugagggccggagaagacaugacgagcaagucucugcuaaagguagaaaaaguuaaaucagauuaugccuauugaaucacacagcagugaagggaaaaugaacaagcuaaguggggauggauuuuugugacuguucagauuaccauuuuuuuucccauuuauuuuguuauguuuuuucccuuuaaggaaagggaagggaagggagcuaauauuucuaaggccaguugugugucagguacuucauuagguauuuuuuauauguaauuugauuuaauccucacaacaauacaaugaaguguauauucucccuauuuuacagauaggaaauaaaagagagguuaaauaacuugcucucaaaaugaaauaauuaguauguugauaggaugguaauuuuuuuguuacucaggugugucugacucuagagggcauccucuuaucugcugcuuuacgcugucggucucuccugccccucuaauguagugagauaguuauauauuuggauaaacauucauacgaaaauagaagauuuuaagauaacuuuagugaaaauaauuuuuuuccuuuuuaaaaggugugcgagaagagcagagaucuccauucaaugaucguuuuccacuuaagcgaccucgauaugaagauucagauaaaccauuuguagauaguccagcaucaagauucgccggccuggauacaaaucagcgacuuacagcuuuagcugaagacagaccguuauuugauggaccuaguaggccaucaguagcaagagauggcccaacgaagaugauuuuugaaggacccaauaaauuaagcccucgaauugauggaccucccacaccagcuucucuucgguuugaugggucaccaggacaaauggggggaggaggcccuuugagauuugaggggccacaaggucagcuaggagguggguguccuuugagauuugaagguccuccaggaccaguggggacaccucugcgguuugagggcccaauuggucaagcaggaggaggugguuuucgguuugaagguuccccuggucugagguuugagggaucuccaggugguuugagauuugagggaccaggaggccagccuguggguggucugagguuugagggacaucguggucaaccuguggguggucuaagguuugagggaccucauggucagccuguggguggacuuagauuugauaauccccgaggucagccuguagguggacuuagauuugaggggggucaugguccaucaggggcugcgauuagguuugauggaccucauggucagccaggagguggaaucagauuugagggcccuuugcuacagcaagggguuggaaugagguuugagggcccccauggucagucaguagcuggucugagauuugagggacaacauaaucaacuuggugggaaccuuagguuugaggguccacauggucagccagggguugguaucagguuugaaggcccuuuaguccaacaaggagguggaaugagguuugaggguccuucuguaccaggagguggccugagaauugaagggccucugggucaaggugguccaagauuugaagguugucaugcuuuaagguuugaugggcagccaggucagccgucacucuugccaagauuugauggauuacauggucagccagguccuagauuugaaaggacuccuggucagccaggcccucagagguuugauggaccaccuggacagcagguucaacccagauuugacgguguaccucaaagauuugaugguccacaacaucagcaagcaucaagguuugauauuccucuuggucuucaaggcacaagauuugacaaucauccuucacaaaggcuugaaucaguaucuuucaaucagacugguccauauaaugauccaccuggcaaugcuuuuaaugccccaucccaaggacuacaguuccaaagacaugaacaaauauuugauucaccucaaggaccaaauuuuaauggaccacauggcccuggaaaccagaguuucucuaauccacuuaacagagcuucuggacacuauuuugaugaaaaaaaucuucagaguucucaauuuggaaacuuuggcaauauaccugcuccaaugacaguaggaaauauucaggcaucucaacagguaagucuguuauucuaaaauugcguuguaugcagauaaguuaaccauuuuuuaauguuucuaggaggguuuucaggacauaguuuauuguguagauuggaaagaaguuuuuaauguacucuaaagccacaugcuaaggaagugggaugagcaucuuuuggggaugaaauuugcaacuuaaauccaaaauugauuuuagcucuuucaggaucuagggaaauaucucaaucaaacccccaccuccagcucuguuuuuucuuuuuccuuuuuuuuugcuuuaaagcuuuugagauauuauacaauugugugucauagaccucuacauugcagaacuguugagcccugacgugcuuuaagguagccauagaauugauugaacuguucuuugaccaagaauuuccuuaaccugaguuaaauaagaagaucaaauugugucccugcuuucacagucuacaauucuuuuuuuuugguccuuuuuuccuacuuuuuaccaccuuuccagucacuucaguuaaacacaauuguuugauauuaaugacaacauagcgaauagccuuccaaauacacucugguuacgaaacaugcacuguuaccuguugguauucuuucacacuuguucuguauacauuuuaaaaugcauacugagacaacuuuaaggcaguauguuuacaauuugugauuaauucgguugguuuugaaugacuacuuuugcuugcgugcugaaauucuccuaggcugaguuuuacuucuuuuccaggugcagacauuuucuuacuaugacagauuuauuuuauaguaguaagauugcauggaagaaaauacaaaauaagaaagauuuuaaaaguacauuaggaacauuauugauagaaaguaguccuucuguucaucucuaaugguacgaaaaaacaguuggcuugccuagauuuacucuacuguauauccuugaaagaaaugauacucuuauugacagauacucuagaaugguacuuacuuagucuuguuucuacauuacacagaaucggugggguuuuuauuauguguacucacuaccaaaaguccacauguauacugaacaaggauuauaaauggauauuuauucacauaccagcaauauguagaaguccugccucccucuggacugcaaaugcuguauuuguaugccaguauaguucuugcuccaugacuauucuguuuuuuaacauucccuuugacaucuuuuacaagaccuuuuacaagauuacuuuguaauguggcuauaaccaugugcaaagaugauggccaagcaagaugcuuaccugcuugguaauucagaaugcuaauuagaacaggcuuuugauaucuguggaaaaguggcaaggguuaggaguucuggccucaguuuugcuccuaacuagcccuugugauuguguauagaucauauugcauuaugucaguucuucuauuuguaaaauaagggaaagcaccagcaagguaaagugacuuguguaaaguaacacagcuaguuaccuuauauuugcaugguaucuuacaguuuccuuuuuggggggcuacuuugccucucuaguagguaccuuaaacuuuucaaagaaguuuuaacccauucucaguaacuuauaccucuaugaaacagauaagggaagguuuuauuguuccuguuuguagaagaccuagaagugaagugaugcagccaaguuaucuuucuaaaucuuuauuuauaagccaggccuugugacaucuaugaauauuuuuauguaauuaggauguuaaaaguuuuacuugaaauauagaaagcauguucuuaaaauuaagguuuuucuuaaagguucugagugguguugcucagccaguagcuuuuggucaaggacaacaguuuuuaccaguucauccacaaaauccuggauuuguucagaauccuucagguauguacuuucugaacuuuguuuuucaaaagacaaaugauuauuguuuuguugaauagcuaacuuugugaauuuuaggaaaugacaguuuugcaaagguauauuuaauuuagagaaauuuaaucuggcugacauauuuuuguuccuuuucuaaguuuauuuacauuguggauguguauucauaaugacccuauuuacagcuagagaugguuagcggggacuuguaguccacuaaacaaagggaaggaaaccuauuggguggaaacugggagugggagggaagguaugacauuuguguugagauagaaugaaauaaaugacagaccuuagaaaucucagugaauacugaggauacugcauuaauaaaguugauuaauuuuuauguuuuugugggcacucaaauagcaaaaagcggcuuuccuagccagguucacugauaagcaucuuuguuacuauggggugaugcuuaguacuagauaaaaggacuuuuaaaauggauuuuaguuuuauuuauuuauuuauuuaugaggcagaaucuugcucucuuacccagucuggagugcaguagugucauauugccucacugcagccucugccuccgggguucaagcgauucuccugucucagccucccaaguagcugggacuacaggcgugugccaccagacugggcuaacuuuuguauuuuuacgggguuucaccaucuuggccaggcuggucucgagcuccugaccucaagugaucugcccaccucagccucccaaagugcugagauggcaggugugagccaccaugcccggcaaaaugaauuuuaguuuuaauaugugguaauagggaaguacauacauuagugauacuugcuuucauuucugaaucauugaaacagcuguuucagaaacaugcuuuacuguaguauugaguuaaucaguuuacaauaaauuuauggaguuuuccaaaacuucugaaguaauuaggaaauccuagccaagcucuuuuuuauacauuaguccuuaaauugugucaagaaauucaaugaauuuggaagcuuuuaaguuuuaauuucuacauggacaauuaugacuaauuaauauuuguuauuauuauuauuuuguuacuauaaugaaaagagaaggaaagaauuugggaucuaaagcccagaagaccaggguuggaaucucuacuauguuacuuuauaaaugcgcaggcuuuaagcaaguaucuccccugagguucaguuuuuucccucuguaaacagcauaugggccgggcaugguggcucacgccuauaaucccagcacucugggaggacgaggcagguggaucacaaggucaagagauggagaccauccuggccaacauggugaaaccucgucucuacuaaaaauacaaaaauuagcugggugugguggugcaugccuguagucccagcuacucaggagacugaggcaggagaaucgcuugaacccaggagguggagguugcagugagccaagaucaggccacugcacuuaggccuggugacagagugagacuccgucucagaaaaaaaaccaaaaaccaaaaaaaaaacaugauaugguaguaucaguauuugucuguuuuguuguuguuuuuuuuuuuuuagagaaucaaaugauauaguauaugcaaaaguacuuuguaacuuguaacuugucaagugcuauauuaauguauuuuccuuuagaacucaguuuuuauuguugagcagaggauuuguuauauugggguuaguggcaugagaugcucuacagaaacuacaaauuuucuuguuucuuucuuucuuucuuuuuuuuuuuuuuuuuuuuuuuuuuuugagacgagucuugcucuugucacccaggcuggagugcaguggcaugaucucagcucacugcaaccucugccuccugaauucaagcaguucucccgggcucagccuccccaguagcugggacuacaggcacaugccacuacaccuggcuaauuuuuguauuuuuaauagaggcagaguuucaccauauuggucaggguggcuugaauccugaccucaggugauccaccugccuugaccucccaaagugcugggacuacagguaugagccacugugcccagccuuguuuugcuuuuacaaccuuggguuauauguguauguguacaggacauagcagugucacagaggaaaucauaauuauuccccuuguuaggggguauugaaugggacauuaggugugucuucauucuucaaguucuucuuacucuuaaaagaugugucaacaguuuucagugugcuauauuuagcuucucucaagguuccuucucuaauuugaaaguguaaacaucccuuuucuaguaggaaauauacccauguucauuuuucagacauauauuagucaucugcuguaugcuaggcaguaugcuaggaugaauuuaauaagguucauccuucaaagaccuuuauuuuuauuuuuaaaguuuuuuuuuuuuuuuuaaagagggugcucacuauguagcccaggcuggucucaaacaccugaacucaagcaauccucccaccucggccucccaaaguguuggguuuauaggcaugagccaccacacucggccucaaagagcuuuauaauauagaaaggcuauugauuuuuuuuuuuugguuuaacaaaaaacacauaauaaugccaaacaccucaguuccuuagaaauauuaauucauuuaaccucauaucaaucuuagguaggaacuauuauuacccuuuuuacaggcacgggaaacugaggcauagauaaggaacuugauuaugucacacaacuagaaaguggaauuucugguuaaaaucccuggagucugguuccacaguuuaugcuguugguuacuagacuuggcugcccucagacaucugaauagcuaauugugcaucuuaggcauauaaauagcuaauuuaaaggaaaguaaagguuaaacuagugaguuaaauguuacuguaauugauuauugaaguugaucucuucauucauguauucagacauuuaguuugaacagacauuaauuagccuacgauauauaaggcaguaugauaaauguauacagugguuaaggguagggauuaucuguauguggaugcaaauugaauuucugccauuaagaggaauuuuuagugguucagaacuuuucuguauagguguagugagaugcaucauagugacauacaaauacauuaaaauauuguuuucuuuuuuuugagauagggucuucuugcucuuuuguccaggcuggaguacaguggggugaucuuggcucacugcaaccuccucccaguuucaaacgauucucaugccucagccuucugaguagcuggauuacaggcaugggcuaccacaaccggcuaauuuuuguauuuuuuaguagagacgggguuucaccauauuggccaggcuggucucaaacuccugaccucaggugauccaccugcaucacccucccaaagugcugggauuacaggugugagccgcugcaccuggccuaaaauauuguuuucauaguuaaagaaucacaauuauggccgggcacuguagcucacaccuguaaucccagcacuuuugggaggcuaaggcaggcagaucauggagucaggagaucaggaccauccuggcuaacacggugaaaccccgucucuacuaaaaauacaaaaagaaauuagcugggugugguggcacgcaccuguaguccagcugcucuggaggcugaggcaggagaacggugugaacccaggagguggagcuugcagugagcugagaucgugccccugcacuccagccugggcaacagagugagacucugucucaaaacaaaaacaaaaacaaaaaaagaaucacaauuauuagaauagugcuuggaaaaauaugagacuggaaugauuccucaccaaugaggauuccuuaucaagcagaacaagauuguuaggcuuaucuuauuuauucaaguuauugaagcuuuaguaaccaugacaccuuuucagcaauagcuugagcugcuuugcaagggcaguaugcuuuuuagcaaaggucauaggagcagguauacucugagccaucugauucaucucccuguuucaguuuuccuguuacgucagggagcauugaggucaggaguacuuccacuuaggcuuagugcuaagggguaauaaacuauuucaucuauauaaaacuacuuuuuccaguguacuuagaagaugaggaagagagauuagaaagguggaaaguuggagaugggguggugcugcauugcuugggagaagggagcauaaagggucauuauuuucaguguugucagcauuuguuuuagaauauauucucaacuccaguguggugauuccucaagcaucuagaacuagaaauacuauuugacccagcaaucccauuacuggguauauacccaaaggauuauaaaucaugcuuuuauaaagacacgugcacacauauguuuauuguggcacuauucacaauagcaaagacuuggaaccaacccaaauguccaucaaugauagacuggauuaagaaaguguggcacauauacaccauggaguacuuugcagccauaaaaaaggaugaguucauguccuuugcagggacauggaugaagcaggaaaccaucauucuaagcaaacuaucacaagggcagaaaaacaaacaccgcauguucucacuuguagguaggaauugaacaaugggaacacuuggacacagggcagggaacaucacacaccaggcacagucgggggguggggggucugggggagggauagcauuaggagaaauaccuaauguaaaugacgaguugauuggugcagcaaaucaacauggcacauguauaccuauguaacaaaccugcacguugugcacauguacccuagaacuuaaaaguauaauaaaaaaacaaaaaaaaaagaaggaaaaaagaauauauucucaagucaugcugacuuguagaccuaaaugaaaagauaaucuuaggggcuuuugaaauuaaacuuauuaauaaauuagauuuugucaaauuuacuguuggcaggacaucuugaagaaaacuuugaaaaaugcuuaguauaauuugcaucuuuaaguucuacauucacuucaaaagugguuuuuuuucuuucuuucuuuuuuuuguuaggagcccucccuaaggcauauccugauaaucaucucagucagguggauguaaaugaauuguuuucaaaauugcuaaaaacaggaauucucaaauugucccaaacugauucagcuacaacacguaagugugauuuuauacuuaaauuuacacaaagcuucauuaaguuuuugagauguaugauguaauauaaugauauaaguuaugauaaagguccuuacaauaauugaauuccuagguauagcuuuuauuuuugauuuucgguuuauaaugaaauucuuuuagauuuccuaagauugaacuaccuuauaguggacauguguuucaguuaacuaacauaccuaaugugcaggcuuuuuaccaguaauuguauguuagauuaacuuuugaaaagguuuugaauauuaaugaaauaaaugacuuuuauuauagaugacuuuuaagaaaucagaguuaacaucacauaucaaaauaaaaaauuguauuagguuccuuggccaguaaacuugagaucagaagcacugaauggacuagguggauuucucuauuugcuuauaauacuauaguguuccucuguagagaauacauggagaaugguauuaagaaauuuguaugucucuucuuaauugaagaaguaagugaaguaacugcucagccucccccugaagaggaggaagaucaaaaugaagaucaagauguuccagaucuuacuaauuuuacaguugaagaauugaaacaguauguaaucuaauuuucuuuaagauaaagaggcagugacuuuaauaacacuguuauaguggacauuguuacuauuagugcuuucccuuucccuuuaucccuuuuacuguuuuaacauuuaggaagucuuuuuuuuuuuuuaaugugguaaaauauacauaacauagucuuugggaagccuauuuuuaaaucgucuuuuaaaauaugucugcuguacaaguacuugggccaaaggccacccccaaaagucuuacucugcugcccaggcuggaguucaguggcgugauccugacucacugcaaccucugccucccagguucaagugauucuccugggauuacaggugugcaccaccauacccagcuaauuuuuguauuuuuaguagagaugggguuucaccacguuggccaggcuagucucgaacuccuaaccuccagugauccaccugccuuggccucccaaagugcugggauuacaggugugagccaccacaccuggucccucaaaauuuucauuuuuuaaucugugauacagaaaacuuagggaguuuaaauauuagguauugauaauucauguauuccuguuuaguuucauuuucuguguaucaucauuuuuucuguauugauauucuuaacauuuuugagguucagaaaugagauuuucauaguucagcauuuacaauuaaaaaaaaaucggcugggcgcgguggcucacuccuguaaucccagcacuuuguaaggccgaggcagguggaucacgaggucaggagaucgagaccauccuggcuaacaagaccauccuggcuaacauggugaaaccccgucucuacuaaaaauacaaaaaauuagccgggcgcaguggcgggugccuguagucccagcuacucgggaggcugaggcaggagaauggugugaacccgggaggcggagcuugcagugagccgagauaacgccacugcacuccagccugggcgaaagagcgagacugugucucaaaaaaaaaaaaaaaucuauuuuucauuuuauaaguaauguuaauuguggaaaauuagaacauacuauaaauaaaaucaagaaaacguacaacucucacuuuauggauaacaacuguuaacauuuggugcauaucuuuucauaauuuucuauuguauuauaaaaaacauuuaaagauuuuucuagugaauaaauucauuaauccugugaguacuuuauaaaaaauaaaauagugaaugaguuuuucacucuuaaaaucauuuuuuaaauuugaauuagauacuauaauguaaaauccuuuuuuuuuucaaaguaauacuuucacauaaaggcuuuuaauaaaagauggcaucccuuucuccuucacccaacacuguacccuagaggcaaucauuuuauuuuuuuaacuuuucaaacuauuuuuucugccauuuaccucuuuuuccuuuuuuuuuugagacagagucucacucugucacccaggcuagagugcaguggcccugucuuggcucauugcaaccuccgccucccagguucaagugauucuccugccgcagccuccugaguagcuaagauuauaggcacccaucaccacgcccagcuaauuuuuguauuuuuaguagagaugggguuucaucauguuguccaggcuguucucgaacuccugggcucaagucaucugcccgccucggccuuccaaaaugcugggauuacagguuugagccaccuauuucuuauaauacacauaauuuucuguuucuugauuuaccacaucuggacauaaucucuuaacuuucugaaagugauuuaggcugggcgcaguggcucaugccuguaaucccagcacuuugggaggcugaggugggcagaucaccugaggucaggaguucaagaccagcuuggccaacaugguaacaugucucuacuagaaccugucucuacuagaaauacuaaaauuagcugggcgugguagugggcacuuguaaucccagcuacucgggaggcugagguggggagaauugcuugaacccaggaggcggaggcuuuagugagcugagaucgggccacugcacugcauccugggugacagagcgcgagacuccgucuccaaaaaaaacgggcgggggguggauuuagcuagcucuuguaguguccuacuaacuccccuccauguaguuauaagacuguuuuuuauuauucaguauuaauauugugacuagauguuuauuuuguugcuguaacaaaguaccaguguucuguuauuugcuuuauucuauuuuuuuuuuuuuuuuuuugagauggagucucacucuguggcccaggcuggagugcaguggcgugaucuuggcucacugcauccuccgccucccgauucaagugauucuccugccucagccuccuaaguagcugggauuacaggcaugugccaccacacccagcuaauuuuuguauuuuuaguagggacaggguuucaccacguuggucagguuggucuugagcuccugaccucgugaucugcccaccuuggccucccaaagugcugggauuacaggcgugagccgcugugcccggcuauuuuuuuuuuuuuucuuggaguuaauaacugcucuguuuguucacuuacuuggucuucuauauauaccuguuucuucccaaauagggagcccagaauuuaaaaaacuaauuauuuguugaccacagcaaacuaauuauuguuucccaaugguauucuaaguuuucucuuuaguuauccauacuauuauuauuucuucuguccuuuuuucacuguuacaccagaguggagaaguugaauuauucagaaugccaaagaucuagagaggugaaauuuaacuguucugccauguccaucuugacuugacuccaaacuaaaauaagcuaacuauugccuuguuagcuagcacaggaucauuucauuuuuagcuaaaaggaaauaaauaacugggucagggcuaucaauaagaagacaggcuccaucuuccaaaagucaccaaaguuaagguaaagagggucaaucacauuguuagagaauaauacugaucuuuggguauuaacuguuucagccagcucuugguuucaccauuguuacaguauggaaaauugaaauauuuguaauuggcuuuuaaaggccauuaagccauauuaucaacacuaaagauuauuucuuuuucaaaauagacguuaugacaguguuauaaaucgacuguacacugguauucaguguuacucuuguggaaugagguuuacaacaucacagacagauguuuaugcagaucauuuggacuggcauuaucggcaaaauagaacugaaaaggauguuagccgaaaagucacucauagacguugguacuacaguuuaacaguaaguaacccaugugccuccauaguaucuuuuaggcuuaaauuauaucauucuaaaaguauauuaauuuuaauaauuauuaaaauuuaauuuuaauuaaguaauuuaauaauuuuaauaacugcuggaaucuaacauugaaauuuccugaauaaaauuugaccccuagaauauaaacagauuuuuuaaaaaaugaauuuugaagaguauuuuuuuuuuuaaauuaagauuagaguauagcauacaggcuuguucuagcucuaaaaguccaaggcuuugaccccuggaauauaaacacauuuuuuaaaaaaugaauuuugaagggaauuuuuuuuuuuuuaauuaagauuagaguguagccuacaggcuuguucuagcucuaaaauucccaggcucuaggacuguuuuuuguaaaaaaaaaaauauacuugaagcuugucuuuuuugaauuaguaguuguaacuauagaguuaauggaaaagaucuuaauuauuaguuucauguugucauuaguuauauguuucaaaguauaauuuuaaauaauauuagagcauaauguagaaaauaguauaccccuaccuuuaaauggcauuauauugaagauacacaguaaaaauuuagaaauaaauggaauaaucuuuuaaaaaucaacuccuuuuaaggacuggauagaauuugaggagauagcugaucuggaagaacgggcaaagagccaguuuuuugaaaaggugcaugaagaaguugugcucaaaacucaagaggcugcuaaagaaaaagaguuccaaaguguaccugcuggaccagcuggagcaguugaggugagagaagaacguuuaaguuuucucacagugggagugucccucacuuccuuuauguaaauacucauaaacacaucacuauauuuauaucccuguuuuaaugauuuuaagacuucuugaaagcucuacucuucaauuuuacucuuacaaucuagcuuugaguuucauaacuacaguggccaaaagcagugaaauguuuacucuuuuuacuggaaagauugacagaaucccauaaauguauuuugaaucauacuguauauuggacauuauucaaacuuuuggaacacucauaaauucuuuacuccacuuaacaguguuuguauauuuuuacuuaaugggguuaaauauggucuauuauguaaauuucauuuuauaugauucuauuuuagaguugugaaaucugucaagaacaauuugaacaauacugggaugaagaagaggaggaauggcauuugaaaaaugcuauuagaguagauggaaagguaauuuucauuucuuuauaaggaaguguuaagauuaguguuuuuuuguuggguuaacacauuacuuugaaaggaggcgguucauaauaguuuuuguuugauuuuuggucuuaauaaaaaggguauuggacuuuaguaauagaauguuugaauuagaagggaucuuagcagucacccgguucuguacacuuuacacaggagguugcacuauuagucagugacagacccaggacuaggucuucugaaucuaguuagucguuuuucugucgacccacacuauuuugauuguggauuuauauuucaucaucaaacuauacugugcugaaaacaaagcaaguuaggcuagauacuuaaaugggccaagagaagucaguuuuucagacucuuuaagcauaaggaugaaaauuugguuuuauccauuuugggaccaaauaauuuuugucuucuuuccaaagacuaucuucuggcuuaaaguuaaaaagaaauaucagaauagcccauuagaaaugaauacgcacauauuuacuuuuuuucuuuuugcuucagauuuaucauccaucauguuaugaagauuaucaaaauguaaguucuuuuugguuacuguauuuguucucauuugcauuaauaaauuuuacuuuucaguuuuuuuuuugcaucagagcaauauuguuauuuuaaacuuaauauauugaacuguuuuuguuuuuugauauagcauuuagguuguucaguaaaaacuggugccagauugacagaauugacauauaugaauaucauuuucugugauaacgcaaacaauuaaaauuuugaaauuuaucauuccuugcauuuuauucacuugaaucaugguaucuuuuacuaguccacuaggcccaaagaaaugugaggaaaagugaagauaaggauccugauggggauacguuucuagagcuauggguagcauuuacugcuauuuuuuuuucuuacaucucuauucagccaucuaaauagguauauucuuuuuguuguuuuguucugagacaaaguuucgcucuuguugcccaggcuggagugcaauggcgcaaucucggcucacugcaaccuccaccuccuggguucaagggauucuccugccccugcuucccaaguagcugggauuacaggcgugcaccaccacaccuggcuaauuuuguauuuuuaguagagacaggguuucaccacauuggucaggcuggucuugaacuccugaccucaagugauccacccaccuuggccucccaaagugcuaggauuauaggcgugagccaccgugcucggccaaaauagguauacuuuuuaaugaucacauacggaaucuaaaaaugauaccagucguugaccuuaaaaguucaaauggucggcugggcgugguggcucaugccuguaaucccagcacuuuugggaggccgaggcgaguggaucaccugaggucaggaguucgagaacagccuggccaacauggugaaacccugucucuacuaaaaauacaaaaauuagccaggcaugguggcgggugccuauaguuccaccugauugugaggcugaggcaggagaauuguuugaauccaggagguggagguugcagugagcugaguucaugccacugcacugcaaccugugcgacaagagugagcucugucucaaaaaaaaaaaaaaaaaaaaaaguucaaauggucauauuuguagucuguuuuuaaaaucaaguaauggaauaaauagguuuuuagagauaauggguuggaggcaauuuggaagguuuauuuagguugucagaagacuaguguugagggugaugguuuguggggauuuaaaaaauccucagacuauuugaaauuaggguaguaacaagucccaggauauauguaugaguuuaacaucuauguagagauuaaaauguagaagcaugucuaaucaacuuuuuuuggcuguauaauguccuauaacuuagcuguuaacugcuuaacucacugcugaguacauauugaacgugcaauauauauuuuauuucugguugucuuuauggcacauuuuguugggaggcagguguuucauuugcauuugguuguauguguguucucuuguucauacaagggucuuacaagacuaaauguuauuuaaugugagaauuuugaacuuucaucaguacucauagggccuuucauuuuguagacaucuucauuugauuguacaccaucucccagcaagacaccaguugaaaaccccuugaauauuauguugaacauugucaaaaacgaauugcaggaacccugugacagucccaaaguuaaggaagaacgaauugauacaccaccagcuuguacagaggaaagcauagcaacacccucugaaauuaaaacagaaaaugacacagucgagucaguuuaaauaaaaugagaaagguauguuuuucuuuuuuaaaaaagcugcuguuggaucuagaaggugaagaauuuuuuuauguauauauagacauaucuauauaaauugucuggcugaggcagggccuucagcuaucauuugguuaauaaauacauuuuaguauuugcauuuccuacugccugcagaguuucaggugcuuguugugugaaaguucuguagaugugugcaaauuuaacgaaaugaaauuguauguguaaaaauguacgauuuuucacugugcaacuguaaauuauaaauaaaaaauauuuuugcuauucauggaguguaauauuuaugcacaccaucaaauaguuucuguacuuuuuauuggguaaaaauggaauugaacagcaaccucaacauaagauuuuuuuucuaguagccucccacugauuaaagaagcaaguuugagguuucauccuucaaaaggggguuccgagagagcaccguagggcuuuucucaaauagaaaagccagauuuugaaaaaauuuuaaagauaaaauaggacauauuuugcagauauauauauauauauacacaaacacaucuccagguauagagaaccauccagauguucacuuuugaaaauaucuaaugaugcaaaguuuuauucuugaacuuggacacugaugccaucaaacaauuaacaaauauauuuaaguacuaaaggugauuuuuuuuuuaaagacuuuuucaaauugucaaaugauuuaaugcagaugaacauauuucuauuuuaaguaacgggaaucuguaagaauguuugcuugagauaugguuaacuuuuuucuuuuguugguuuugacuuagauggacaccaugagauguuaauauucauacauguaauaaauagaaugaugaagaaacuuuguuuguacuucuuuauuucuugaaaagcuuuagaaugugacuuucuuguugucuuucaucuguuuuuugaaacaugaacaugguacuugcuaugagccaggcacucugagacagguuagucuuuucugccauuuauuggagauaggcauauaaaacacugaguuuuauugagcacauaguauguggcaggcacuagcacuuucuacauguauuuucucugguauucacaucuaauaacuacaugguagaugguguccccacuuuacagaugaaauuaagccacucacuuuaaaauuuuuauaagaauuugaacguggcuuuguuuccucuaauuccauacaauuucugcaauuuuaaaagauacccccaaauugauuguuaggauagaaauaagcacaccaaacuacuggaagguggcuaaggaagauucuacaaaaguggugacauuugagucuuggaggauaaccaggaguggaguccauacugaugggaaggguaucuuuggaaaaugaacagcaaauguaaaggcuuaaaauacuuuuguguuuucaaaaauugacuucuuaugguuaaaacucaguaguuuugaauagauuaugaugagccauuaauuuuuuuaguagaaauggagucucacuacguaguccaggcugguuucgaauuccugggcucaagugauccuacugccuuggccucccagagugcugggauuacaggcaugagccacgugcccagccuuuauuuuuaaguagugaagagccuucuuggucaugcuaaggaauuuuuauuaaacugaugaccagagcagccacuagaaauuuuaaacagggugacauccuaucugcauuuaagcuuuuuuauuuuuuuaagaaucaagugaauacaauuuuagagauugcuaaauccagagagguccagugggaaaacugguagccauuggauuugaguuguaaacacguaacagcugaacuuacguauaugaacacugccauaggaacugaggucugugaauccaaaaauguaggcaaaacuuccuguugaacauuuuucuggggaaaccaccauagcuuuuaucaaaugcuuaaagguauggaacauucuaaaaggaaggugauauucaaaccuaaaaguguaucaacgguauccacauggagaagagggucaaggaugggggaacaaagacugguaggugggaaggucaaaaagaaaaugggaaaaccagcaaugggaaaauuuuuuuuuuucuuuuuuugagacagucuugcuauguugcucaggcuggaucagugcaguagcacaaucucggcucagugcaguggcacaaucucggcucacugcaaccucugccuccuggguucaagugauucuccugucucagccucccaaguagcugggauuacaggugcccgccaccacgccuggcuaauuuuuauauuuugaguagaggcgggguuucaccacguuggccaggcuggucucgaacuccugaccuuaagugaucugcccgucuuggccucccagagugcugggauuacaggugugcgcaggaagaaaauuucaauggacgagguagucaacaaaaugaagucaagaaaauauguaagacucagaaauacucuaacuguugaccuaagaacagcugaguaugggugccaacaccuggugcaauggguaguguggaugagagguaacaaaauauuaaaagcuauuuuuuuaaaugaaguuuaacuccagagauugaauuguaguuagacaaauaggagaggcauuagcauguuaagaggagcucaguggagaaauggguugaagauggagaugaccgguauaccagucucaagguuguaacaagauaguaucaacaauagcacaggaggggcggggcacaguggcucaugccuguaauuccagcacuuugggaggaugaaguggguagauugcuugaguguaggaguucaagaccagccugggcaacauggugaaacuccgucgcuaccaaauauaugaaaaaccagagggacacugucugccaaaaaaaauaaaagcacaggaaggauuuagcuuuggaauggaggugggccaguguucuccaagauggccacuaguauuuacaguuggguuugaguucaauucuuauuuucucuuugagguagaaggccagauguaaggcagugauccagaucugccccauauuuggcugugcauuagaauuauagugaauuuaaaacaaauuuuaauacuaaauuuagagauggggccuuaccagguuguccaggcuggccucgaacuccugggaucaagccagucucccaccucagccucccaaguaacuagauuacaggugcacaccacuacaccuggcuuagaauuagugaauauuaagagauuccuaaucucuggagagucucauuuaguugauucgcauucaggggcacuucuaguauucaagcuccauaguuuuuucuaaugaacagccagaucugguaaauaauucagaaaucaacaucaacagcauccccaaagauagaaaaagagucaauacauaacacuguuagcuagaaguaguaaucuaacacuguaaagugcaguaaggaaaauuaaaugaagccucagagaugauggaacauuuucuuuuaaauugaauugaaguuugagagaacaaguaaaaggaaaaguauguguuuccuaaaaucuaaagauuucauuaaguuuauauccuccugguuuuaguguaauuuucccacugaaaauguccaacuuugaugcuuuggaaaauagaaagcaaucucauugcaauucagcuaaaaauaaaaagcuuugggaagaaaaauaaggaauuacauauaaaaaauuaaaacauucucauauaacagcuuaguauauacauauuuuuuauaugacugaccuuacaauuuaguaccaaguaagcaaccuaauggagguuuacacaaaauauucaggaaaaucugaggaggcaucuaaccaugcugcagguggaaaaauguagcugccuaaauggagguagaaauggaaaauaaagacuauuaucaagaaagaccugcacucuuguagaauugggaaguuuuuuccuaauccuaaauggggucagcucccagagauaaugggcauuguguugagcagguggggaagaguagcuaaauaagagccaaaagguacccaaggaguaccccugugaagauuugggagugagcaccaaaagaagaacaagaaugacugggaaauaacagaaaauggcacauaggcagaaaggaguacagacugucaccaauauccacuucguuuuuuguuuuugccugggguuggcccugcucccuucucugaaacaagauauaaaaagcugauuuaugauauccugcuuuaucaccccacuuuagaaaaacugagguagaaguggaggacuagucauauuuacuaacuggaaucauaccuuccuuccuacucacaaaagguuccaguucucuagaauacugagaugaccacuccaggauguauucugaacccuguuucacuuaagaaacuucuucca

SEQ ID NO: 15275 - RNA, 3330 nt, Homo sapiens
aggggaaacacuaguuuaggugugaggaguucuaguaugccacaaauuagcugagacuuuagacgaagcacaauauuugagcaucaaucuucucaucuaugagauagaccugucaggauuauugugaaaauuagaugagauaaguugaaaguacagugcuugguaaacaguuagcacucaaauauuaguucuuuuucacuuuaauuaagagcagacuuugaauggucugaugccaaguguagauccuuaagagacaaaacaaagaaacuuuccuggcuucaaagaaaagaacuccauuucugaaagggugccuuaaaaggaauucauuugucugauccauccuuuugccuuugggcauuacuacugucacccuccauuucuuuacaaacuucaggcaagguggucucucucucucucccaauaggcaauuccaggguuguaaacucauuaucaggaagcuuaaucuuagaacugaaauaccucacagagcaauuuaaaccucuuucuucuuguuccuauucuucaugggaagaaaacuggguugaucccuaucuucuuuuuaaggagccacauuugccauuuauuauugcucuuuugccuauuuaaaaaaaauaacagucagaaaaaauaaugauuauuaaaaugauagucauuauuuacuuagugaaugucaggauagguauuuauuacucuuagcuucuuauugguaucagauguagaucacggucuuacuguugauuaacucuucaguuauauauacauacuuugauucuuuaguuacauaauugauaacaaagugugcuucugaagaauuauucuggcuguauggcucuuguuuccuccccuugguaaaaauggaggcaugaaucucgguuuugugaucugcuuuuaauuucauauaugacauuauuugauguacauaauuaccaacauccaaaagcguuucuuccccuuucuacgugugcacuaaauucuaaaacaaaaauuggaauacaaaaugccuaauaaagaaaaaauucauguacagaaaagcaaaagauaaucuacuuuguuaagauaauuugucacuagcugguugaauaaugcacaguuuuuguuuaagguuacacauuuaugccuggauuaaauaacaauaguaaaacuugacaagucuuuugaaaaacagcugcuaaacauauugcuuucuggaauguaaucauuagcaacaaauauucucuuauucuauacaauugcagaaugcuaguggaacuuucuuguagguuauuugacaaugaauguuaauugauuuauuuuuuaaaaauguaaaauccucuuaucccuuuaaggccgguuuaggcuuucaugucccugugauagaaaauuucaaaugcuggcuucuaauuucuacucacugaagugucuuccagacauaccagaugguuggagcuccuuugauaguauauaagggagcuacauaaauguauuugaacuaacucgugagcaaaauuucuguuuucagcaaaaaaaaaaaaaaaaagaaaaaacaacaaacucugcucaaaauuucagauaauacaggaguaaaaagagguuuuugauaaucugaagggaaaagugugccccauauaucuuguacacacuuuuaaugcaugacuuuuaguauagagaugaaauaaaaugcaaaauauauaauucuggagaucucagcagcuaguuaaaauauuuagagaagcugcuuuaugaagacuuagagaauccuugaucucccccacauuuccuaucacuccauugaaacauggaucuuuaauauuaauacauacauaguuuuaacuaauaaacagguuaaucacugaguuuuaugaacucgauucuugauauuuggcuauugguuuuaagcauaggauaucaguauuauuuguauacagcguuauauaaaaucuaaccaacuucaauauaagaauaguacuugauuuuaaauguuaauaugcaaauauuaacaguauacuacaucauauuuuauguguucauauauugaucuuuuuacuuaacaaaaagccuguuagaaauauaacccacugaugacccgaguccaauuagcugaaaaccuucuguagaaaggugauuguaugaaaaauucaaucaacauuaaaaaagggaaguggggagggaauacaaacuugaacaaaauauucuuaaaugaaguugcaucucuuuuuaaaauuaagauaucauucaugcaccauacgguuuauccuauuaagguguaaacuucaauguuuuuaaucauauucacuaaguugugcaacaucaccacucccuaacuucagaacacuuucaucaccuccaaaagaaaccccauaccauuugcaaucacuccuccuccuccuucccccagcauccggcaaccacuaaucuacuuucugucccuaugaauuugccuauccuggacauuucauauagucaaacaacauguggccuuuugugucuggcuucucuaaguaagcauaauguuuuuaaagcucauccauguuguagcauaaaucaguacauuguuuucauguuuaaauaauauuccauugcauguauaugccacauuuuauuuguccauuuaucauuugauggacauuuggguuuuuuccaccuuuugauuauaauaaugcugcugugaacauuuauguaaaaguuuuuuguauggguguauguuuucacaucucucuuaaaaacaauuagucugacaaaucaaaucaaaucauuuauguuuauuuacguagaaccucuugcaauccuguuuggagagugcaacuuacgaucuuaguuuaauugaucaauuaggagaccucugaauaaagacuaacuccccaauacauccauaagaauuuuucuaugagccugucauuuagaugugauaagcaaucaauuucaugaagacuguuucagucuuguagaaauugaguugccaucacauagaggauuucuuguccucugcauuguuuaaaggacaacuacaaaucaugcuggauaagaguacucauucaaucuuuuaggauucaaugaaguagcauuuuaaauauguaaguuauuuuauauauugucugucuuuuaaaauuggacuuugcuucuugaaaaaaguuugucaaaucaccaaaccauaugacuguccauucauuguagccuauguuuucuauuauuaagaaauaauucauacugagaguaaaagaaaaagaauguauuuugugugcaaaggaugaauguauuaaaaacuuuuuauuuguaacaauuuuuuaaaaaaacuaaauggaaauugcuuucccauguacuuguauauaaauaaacauuuccuguugcccacau

SEQ ID NO: 15276 - RNA, 32951 nt, Homo sapiens
aguuuugguuugcaaagucuuuauuucuggauguauaugugauuuuaacaaacauuaauacuuucaaaaacaaucuuaacaauauuauuaaaguacaauaaacaguauaagauaaagugcucaacuaccuaaucauaguauucuagauaaaacccuggggaaaacaauggcuuuauauuuuaaaaggcacaguagcucccagcagaguccuguuuucaauuugcuucucuccaaguguucaaaauguaaagaaugcuuuccguaccccugaaggcaaacauuuccaaacagauuuaaaaguucaggaauuggguucaggugacuuuuuaugaaaacaauucaggugaccaagcacuucgaguuucacacacugaaggugggccuuuuucugaaaauggaaggcaacauuugacuucugaacaagaaucagguccaagaauagggugcagcugaggugcugcuaagacuugaaugucuggacauuuggaaauccagccugaacuuuuacaguuauauuuaugaguuuucuuuuucguaacaacugcugcaagcauauucuuuaauuucuucuuaauuaaaccuuuauugguuccuugucuaauauguuucaguuucuuucuugguaacucuuguugaucagggaaaugauaggcagcaaggcauuucccuagaccuaugccuuggaauccaagcauaucugaaggaaauauuuuuugugugguaggagggacccauucaucacuaucaguuucauggcacucagcaaaaggguagugauugaaaacgucugguugugaaacaccagauacaauagggcuucugauuuucuggcuagguguuuuuauauuuuuuggacagcuugggcuggcuugcuguuugucauuuucagggaaaauccuuauuuuuucauaguuaccaucaagaucugaauaaaauacagguuuuuugaaagcucuguuuaucccaugaauucuuguuugguggaacccugaaauuggaguugacugugaacauggaacaaagucuugacuauuuucaaaauuauauucugaaucugauugaaaaugagguguuggagagcauguucuugaaugccuagagucagauaggcuuugcaaggauaauuuuugugaaggcuggaugaagucuucagaaagugaucucagugaaaaaucagacucugaagggugacuuucugccaaagauguuccccauuuuaacaaaauauccugugauuuuuugguaaucucaguugcaauguccauuucuuuagcaauaucaucaaagagaucagcagaggcaucauagcuaccuucauaaccaauagaauagcucuguguuacguuguuauugauauguccccaaggcauuucuuucaauguauuuguacuucuauuuggacuauugcaaagaguuucuaaaggauauguaaguuuccugcaaauuguaaaacugucaucuugguucuuggaccaccuacaauauuguuuauuuucuaauuugcaaagaucagagacaucauuauacuuccuauaacacagaguugucaacuuuucauucauuucugaaacugauauuucuccacauccauucaaauauuuguuauuuagacuagaauggucacucucccuguguggugagauucugauagucuucuuaagaguaacuauuguuucuaaaucuuuugaagaugaagacagagcugacagguaaggauucgguaaaaaauauucugacauaucucuuccauuaugauuuacagagacagccucuacuuuguuaucugguugugacuccuuuucaacacuaggacuuagauuuccuuuacaguugaaaaggaagucaucuuugcuacaguuugcuuugacuauuacuugugaugaucuuaaagcuauaggugguguaugcagggcuccaguaguucucuggggagucacagauaaccugcuguggucugcaugaaauuuaucaaugucauuaucuacaugauguuuccuacuacugacaucugccuggguuacagcaaucucacuuucaagaacugccagaaacuuguucaggcuuucagagaauggcagaucaucccaaauuugagggucaccauccugggaacugcuggcugucucuucaagucugaguaacgaagguggacaacaugcagaucucuucugaaggcuaguugggguaucuauaccaugaugcugaaaacaugguagcucaugcugggaccuauuuuuaauuuccacugcacuguggaaggauuuuguauuacuugacucaaggggcucucgcauuuccaaagagaauaaauuagagucauuaacuccaauuucaugaugacugcugugaacugcacucagcuccuuagcuuguaagccaaguucuuuacccaacuuuucugcuguacucuuuuuauccauauaugaaacaaggcuccaugaauccugaaugggaucauggcagcuacuggaaccaguggccucugcaauggagauggacuuucuguucugcugaagaguaccaaaggccuuacuuuguucugaagcugaaaaaucaucauuaucuguuaguugugaaacaaugcaagugaauucaagugauggcugccagaauuuugaaaaaguauccuugcugcaggacuugaaaaaaucagaagugcugucagaaguauauaugcugcugagaucacuauuugagugaucuaaagcaaguaagugauuguuaggugccugagagucacacugaaguuuccugaaauuaaaagucugcaaaaguugauggaaguagucaaugacaguaaagccugcaauaccugggucugguagaacaaucuggcaagccacuagugcuuuggcuuuucuuuuguggucagagcauugcuguaagaaguuacuggcaucugaaccuuguccagguugguuuucaaaauucugugaaagaagcaaagaaauuuaaguaagaauaaaauugucuuccauuuacuuaaacaugaaacagaaauuuagccaggcacaguggcucaugccuguaaucccagcacuuugagaggccgaggcaggcagaucacuugagccucaagaguuugagaccagacugggcaacaugguaaaaccucuccucuaaaaaaaauacccccacaaaaauuagcugggcaugguggcgugugccuguagucucagcuacucaggaggcuggggugggagaucaccagagccuagggaggucaaggcugcagugagccaugaucuugguacugcaguccagccugggugacagagugagauucugucucaaaaauaaaauaaaauaaacagauuuaaaagguuaaaacagauacaacuauuaccuccaucccccaauuccaauuucgauucuguuaguuuuauaggcaaaguagcauauguaagagaauauaaaccuuagaguaaagagcuuguuuaaacugauuugaagaaauccuaguucccgcauuuauuaauaguguugagacuuuggacaauuuauuuaaccugagucuucuccuuuauaaaauaaaaauaaaaauaaaaaugcaggauuacuguuuaguaauaaaauggaaaacugcacagugcuuagaaaauagcaguggcucaauaaauggcaacuaucauaguucucuuuagcuaaggaaagagaggaggggaggggaggggaaaaaggggaggaggaaaaagaagagaggagagaaaaggacugucuacgauuuuaacaaguaaagcucuguagccguugauucuaccuucccuuuggauuuuucucacucuucuguuguggaguccucuuuuaaaacccugauuccaguguggaaaaaaaugucucuuuguucccuuuagcauagaugagacagaaaacuauuacuccuucaaagucaaaggaguaacuucuuuuuuuuuuaacuucuucuacagucacuuuuauauuuaagaccaucuuucuuaaucuaguuuuaguauucuuaucaauacucaagauacuuugccuucaguguuccauuauucucuuuuauagaagacagaauuaaaaagcuagagaauugguggaaguuuuacuauagaauuugaacaaaauccggagggcaaaauaaauacuaaauaccaaaaacaaauaucuaacauuucuaaauauauaauaaauuuauauuuuuaagcucugaaagcauuugaaguaggcuccccugacuuucgaaagaggaaguugucacacaugguguuuuaacagaccaccuauaggcuauuuuuacauaguuuaaaguguuucuacaggccuucacauguacagaacuccuaacaacuauuuagaaaauucacauaauucauuacaauggaaauguuaacagauuauuaaaaagaaagcuagucucaauuaccgucacuccaaaaauaaagcuuuguccaacaaagcaaguuucaacugcuuuaguuaauagauucugaguuguaucauuguccaguguuucuggaauuuuauuaggauccugaauguaccuugauuggaaaaaaaguaaaaaaugugaagcaaugaacuuugaaauuuuacuugccauaaagucagagacacaauuaauuugaaaaugcagcaugaaccuuuuauagaggaaaaaaagugacuuuaagagccaggcaguuuguucucucuaguuucucauagcacagaaaaaucaacaaaaccaauugaucaagugggaguaaaguaguuaccugccuaaccaucaggcccggcaaugauuauaaggaaaaauaaaaguggcagugggaauagugguggcaucucuagcucuucacuugaaagcaggaaaaagucaucccuuuucucugauaagccugguuguggucccuuuauugucucaagcacaaaaauguggacauagauuucuugcaugugauuaggggaggagggcagaagacugagggggaagaaaagcuuuuuuuuuuuuuuuugagacagagucucgcucugucucccaggcuggagugcaguggugcaaucuuggcucacuacaagcucugccuccuggguucaugccauucuccugccucagccucccggcguagcugggacuacaggcgcccaccaccaugcccagcuaauuuuuuguauuuuuaguagagaugggguuucaccguguuagccaggauggucuccaucuccugaccuugugauccgcccgccucggccucccaaagcgcugggauuacaggcgugagcuaccgcgcccggccaagaaaagcuuuaauugcuuauucuuauauucucaggacaaugucguaaaaggucaaacuaugcaaauuaaauugcaauacagauaaaaaauaaaauuucaauuucugaaaugcaaauauucccucaaauagauucuucugccucaggggaaccuaacuguuucaaugcuaaccucaauuuggauaauucuucaauuugaaaugauguuacuuucuuagccucuauuucuguaacuuggauuagagauuuauaacuuaauauucuaauuacagauuaauuacccuaaauaaaaggagacuguuuuaauaucaucauaauauguauucaggaaauaaacaucuuucuuacuugcuugucuuuuaaaggaauugacaaucugggguugaaugauuaucuuucuacaaaaaugcauauugccuuauaaacuuguaucuucaaauucuaagggcagucaggaaaaaggauguuuuaaguauucuuaccugugcaaaccaguggcaguaagaccaaaaaauguaucuaagcaacuuccaaauacaguaauaacaaacaauuuguuugauucugcaacuuuuaaggaaaguuuguaucuguaauuggcauuuccagauucaccaguagagccacauuuuggacaauuagaccuagaaaagugguggaaaaaaguguggagauguucauuaaauguuuuucauaugaugaaaaauccagaacaguaaaaauuuaaaauaacauuuuguguauaaaugcuccuacacaacucaaauucuucuuaaacucuuucagaucaacuuauuuuaaauuucucuagucagaauaguuagcguuacugauuuaaauuaaacagccccaaguugauagaaauacauaccaaauugauggaaaacuaaaggagaacugugcaugaaagagaggacgaaaaggccgggcgcggugguucacaccuguaaucccagcacuuugggaggccgaggcgggugggucaccaggucaggagauugagaccauccuagcuaacacgguaaaacccugucucuacuaaaaauacauaaaaauuagauggguguggugaugggcaccuguaaucccagcuacuugggaggcugaggcagcagaaugaugugaacccgggagguggaucuugcagucagccaagaucgcaccacugcacuacagccuggggggcagagugacauuccgucucaaaaaaaaaaaaaaaaaaaaaaaaaaaaaaaaaaaaaaagaggacaaaaaauaaucucaaaauauuuaauaccuauuuauacacaaagcacuuaauugcauuuuucucaccauaaugaaaauuacuuucuuuaauucauuagacuauguugauaacuuaucagauuauaaaauuugauaugaaaaccaugcaauuuaacuuguuuuuuuaagacaguauguaaugguggcuaaaggcuuucuagucaaaaaguacacaucuacauggcaguguaacucuauugccauguacucauugucugacaguuacuaaauucuugaguuccucaucuaugaaguccagggcugaagaaggauuaaaauagacaaauaaagggucuagugcaaauacugugaaauuaguguuagucugcuucucccucauaauuauaucaaguauugugauaauuacugucacuuguacuguuaacuucucuucuaguuugcaauguauuauaacucugauuucuaucuuucagguucuuaauguccaccccucaguuagguuaacuuuauuuaacagacagaauaguuuaaaaaauuuuuuugaaauacaacaagcaccuaaaaacauuuuaugguaauggcuaauacuagaauuuuguuuuuucuucagauugcuaaagaucuuaaaaaagaguggcaaaaggcaaacagaaagcaaggugaaagaugguuguauaaauuugauuguugccagauggccacuagggggagucuaaaaucuguagcucugaaagugacucaccuuuauuagaucugugcuguuauucuucugccauacugaggauagaucuauaccaacccauucauauaauccuauacaaaucugcuagaguuugugcuguagguuagccauagaaugaauuaaagguaauugacucacuaggggauaaaacuccauuaguaccaaacucuagggaaaugaacuguuuaaaauauauauuggaauuucuuuaaaggcuaugcaauaaugcauacagguuuaauguaaaauuccuagcaaaacuuagacuaauaugcauuagcauucaguuuacaaauguuuucaacauacauuauuucauuuuuauagguaaaauuuacaaauggggaaauuaguuugaauuuuuaucugagaugacaaaguugguaaauauaugacccaaacccaagacugugaacucguaucaugaaguucugauauuaugauaugauaacagugggaccaaaugguuaaaauaaagaacugcuugcaaugacaguaucaauaauagccucaaaaaacuaugucuauuaguguucaugcauuuacauauuaaacuauauauauuuuuauaaaguacauauguauaaugaagauauuuauuuauauaguuuucuuuaauccuuuuaggaacgaugcuggauuaaaauaaauguuagugugguguaauacagauuagagcuucucaaacauuaauauguauacaaaucauccagagaucuuguuaaaaugaagauucugauucaggaagucugggaugaggcccaagauccugcauuuuuaauaagcucccagguaauacugaugcagauguaccuuaggccauacuuugagaaacaaggauauagacaacauauucacaucaccgucccgauuuaacuucuagaggcacccauauuucuaaaaugucauuuguuacagaauagcaguuuucaaacuuuuugguuucacacuccuuuaauacucuuaaaaaauuauugagaauaucaaagaguuuuguuuaugugaauaguaucuauuuuuuuuauucaaaaauauuuacuugggccaggcgugauggcucacaccuguaaucccagcacuuugggaggcuguggcgggcagaccacucaagcucaggaguucgaguccagccugggaaacauggcaaaacugugucucuacaaaaaauacaaaaauuaacgaacgugguggcaugcgccuguagucccagcuacuuaggaagcugagaugggaggauugcuugagcucaggcggcagagguuguggugagcugagauugugccauugaacuccagucuggaggugacagagccagacccugucucaaaaaaaaaaaaaaaaauuacuugccaaagauugaauauauucaagguauacaacauggugauuugaaauacgucuacacuguauaaugauuaccauagucaaaauuuuuuuuuuuuuuugagacagugucucgcuauuggccaggcuggagugcaguggugcaaucuuggcucacugcaaccuccaccucuuggguucaggcgauucuccugccucagccucccgauuagcugggacuacaggugcccgccaccacacccagcuaauuuuuuguauuuuuaguagaggcaggguuucaccguguuagccaggauggucucgaucuccugaccucaugauccgcccaccucggccucccaaagugcugggauuacaggugugagccaccgcaccuggcuaccauagucgaauuauuuaacacaucauccauuaccacucaagcuguacauuagauccauagaacuuguuuaucuuauaucugucuauauuucuuuuuugguuuguuuucagacagggucucauucugcugcccaggcuggaggacaguggugcuaucauagcuuacuguaacuucaaacuccugggcucaagagauccuccugccucagccuucugaguagcugggaccacaggcacaugccaccauauguggcuaauuuuaaauuuuuuuguagagaugggggucucacuguguugcccugacuaggcuugaacucuuaggcuuaagugauucucuuguuucggccucccagaguguugggauuacaggcgugagccaucacaccuggcuucuaucuacauuucucauaaaacgagaaauuaaaugaaagugagaaauuaaaacugagaaaucaaaaaaauauuaauucauuaaaaacagacccuuuacaugguuaacacaaaaaacauacuuuuaugaaaaauaguuauguuuuucaaauuuuaaaaauuaguaagaagagaccagcauuguuuuacauuuugcaaaucucuuuaaugucugguuucauaaaaagacagcuggauucucauaucugcuucucugcucaaucuguugugauaguacguguuauguagccucugggaaacuccauuaugcacucaugagagacugaaagugaaaaggcaaauaaugccuuagaauuaugaaaauagauuugaguucaaggagccucugaaaggaucuaucugaaauaauagcuguaauuugcuaucuuuuuuguuugaucccaguuaaaaaaauaccaaguuucauuuguuuuuuuuuuauuuuuauucauuuauuuuuuugagacaaggucuugcuuuguugcccaggcuggagugcaacgguaugaucuuggcucacugaagccuugaccgcucaggcucaagcgauccucccaccucagacuccugagcagcugggacuacaggcacaugccacgaugccugccuaauuuuguuuauuuuugguagaggauagguuucaccauguugcccaggcuggucucaaaauccuggacucaagcaauccucccaucuuggccucccaaaugcugggauugcaggcaugagcuacuaugcccagccucauuuguuuauuuuucuagcguacuuauauuuagcccagauguagaagaacuggugagauaaguaauccuuaauguuuucuuagucuugaaaaccuuaaaaaaucugaugaaagcaauggacucacucucuccccacaaaaaacagauaugaacacgauauucuacauaucuuagggacuggaggagucauacauaccuauaauguauccacagauuccagcuuaagaauauccugacuauaugauuauauaacaucccuuuccaaguuuauagacccagauuaaauacacacaaaguaaugagacauauuuuaaaaaacauaucucuuaaugcuuccacauaucacuucccccacaaaguaagaaaacuaugaucuauaugugugaaauuaaauuugacuugcuuaaguaaaugauauaaacuuuuuggguaguugggaaugggggagaggauagguagccucugagcgaugaguccuauuuuaagauaggaaaagaaaguuauuaguguuagaaauggauuucuaggcuaaaaggaauuaugggucccauuagucacccagaagggcaauuucuauguagauagcuugucuggauaaauaaaucccuucuccagcuuauaaucuggggagaguacagacauacacuauuguguguguauguguaguuacugcuucauaugaaggaccgaacuaacuuuguacacauuuuuuuuuauagauguaugucuauguuuguauauuuacauaaugaaacccccuuucaaaugaaauuuaacuuggaacacuaauauaaggaugagaauagagaucuuguugaaacuaacgugggggcccuagagucuuaccuacuacucagcacuagguacuauuacuacucuaaucccaucucccuccauaagcacuuccauggagccccaaggcucugcagaauaccuauagauugaaaacuacauucaaucuacugaucugaucuuggagguaagaaaguuaauuccauaaagcacaaaauacuuauuaugauuauagucacuaaaaauuucagguucaaagaaaauauuuagggacgucucucuguucuucagcaucucuaagaucuucugcaaaggcaagagcauggaacuccucugucauaagcuugcagugcuauagcaauggggaaaugaacaugaggaauuucuguuuccuguguuggcuuacaacugauuccaaguaagaaaaagggaaagcaaaaacaacaguagaaaagauaagcaccaggauuuagaucaucauggcggaugggaggcaggauuagauugcagcuccaacucggacaaagcagcauguuggggcucgcacuaugaauuuuagcuccagaacaacugcaagaacaaaccaggaaucccaagaggacccacagacccucugaaggaaguggacugcuccugcaggaccugggagacaccccaaauacugugugguauucagggccgagacacccauaaacgauucacaucacaggacucugugcagacaaacccugaauaccaccccggagccagacagacuggcuggauggcuagacccagaagagagauaacaaucacugcagcucggcucauaggaagcuacauccauaggaaaaggggggagaguaucacaucaagggaacauccugugggacaaaagaaucugaacaacagccuucagcccuagaccuugccucucugacagagccuacccaaauaagaaggaaccagaaaaccaacucugguaauaugacaaaacaaggcucuuuaacaccuccaaaaaaaaucacacuagcucaccagcaauggauucaaaccaauaagaaaucccugauuuaccugaaaaagaauucagcgaggcaccagagaaaagcgaagccugacgcaaggaaauccaaaaaacaauacgagaagugaagggagaaacauucaaggaaauagcauaaagaaaaacaaucaaaacuucaggaaacacuggacacacuuacaaaaaugcaaaaugcucuggaaagucccagcaauagaaaugaacaaauagaagaaagaaauucacagcuugaagacaaggucuucaaauuaacccaauccaacaaacacaaagaaaaaagaauaagaaauuaugaaccaagcauccaaaaagucugggauuauguuaaacagccaaaccuaagaauaaucgguguuccugaggaauaagagaaaucuaaaaguuuggaaaacauauuugggugaauaauugaggaaaccuuccccggccuugcuagagaccuaggcaucuaaauacaagaagcauaaagagcaucugggaaauucaucacaaaaagaucaucaccuaggcacacugucaucagguuaucuaaaguuaagacaaaggaaagaaucuuaagaguugugagacagaagcaccagguaaucuauaaaggaaaaccuauccgauuaacagcagauuucuuugcagaaacccuacaagcuagaagggauuagggcccuaucuuaagccuccucaugcaaagcaauuaucagccaagaauuuuguacccagugaaacuaaacaucauauaugaaggaaagauacagucuuucucagacaaacaaaugcugagagaaucugcuacuaccaaaccaccauuacaagaacugcuaggcugggcgcaguggcucaugccuguaauccuagcccuuugggaggcugaggcggguggaucaccugaggucaggaguuugagacuagccuggccaacauggugaaacccugucucuacuaaaaauacaaaaauuagcuggacgugguggugggugccuguaaucccagcuacucgggaggcugaggcaggagaauugcuugaaccugggggggcggagggugcagugagacgagauugcaccacuucacuccagccugggcgaaaaagcgaaacuccgucucaaaaaaaaaaaaaaaaaaaaaaaagaaagaaagaaaaaaacugugaaaaggagcucuaaaucuugaaacaaauccuggaaacacaucaaaaacagaaucucuuaaaagcauaaaucaugaaggaccuauaaaacaaaaacaauuuaaaaagcaaaaacaaaaaaaacaagguacacaggcaacaaauaccacaaugaaugcaaugguaccucaaaucucaauacuaacaucgaauguaaauggcauaaauguuccacuuaaaagauacagaauagcagaauggauaagaacucaccaaccaucugcugccuucaggagacucaccuaacacauaaggacucacauaaacaucaaguaaaggaguggaaaaaggcaguuugugcaaauggacaccaagcagggguagcuauuuuuauauuagacaaaaacaaacuuuaaagcaaaagcaguuaaaagagacaaaggacauuauauaaugauaaaaggccuuguccaacgagaaauaucacaauccuaaacauuuaugcaccuaacacuggagcucccaaauuuauaaaacaauuacuaauagaccuaagaaaugagauagacagcaacacaauaauaguggaggacuucaauacuacacugacagcacuagacaggucaucaagacagaaagucaacaaagaaaaaauggauuuaaacuaugccuuggaacaaaugaacuuaacagauaauauacagagcauuucauccaacaaccgcagauuacacauucuauucaacagcacauggaacuuucuccaagauagaccaugugauaagccagaaaacaagccuuaauaaauuuaagaaaauugaaaucauaucaagcacucucucaggccauaguggaauaaacuggaaaucaacuccaaaaggaaccuucaaaaccaugccaauacauggaaauuaaauaagcugcuccugaaugauccuuggaucaaaaaugaaaucaagauggaaauuuaaaaauucuucaaacugaauggcaauaaugacacaaccuaucaaaaccucugggcugcagcaaaggcagugcuaaaaggaaaggucauaguccuaaaugccuacaucaaaaagacugaaagaacacaaacugacauucuaaggucacaccucaaggaacuagagaaacaagaacaaaccaaaccgaaacccagcagaagaaaggaaauaaccaagaucaaagcagaacuaaauguaauugaaacaaaaacaaauacaaaagauacaugaaaccaaaagcuggcucuuugaaaagauaaauaaaauugauagaccguuagcaagauuaaccaagaagagagaaaauccaaauaaccucauuaagaaacaaaacgggacauauuacaacugacaccacugagacacaaaagaucauucaagacuacuacaaacaccuuuacacaagcuagaaaaccuagaagagauggauaaauuccuggaaaaauacaacccuccuagcuuaaaucaggaagaauuagauacccugaacagaccaauaauaagcagcaagauugaaaugggaauuaaaaaauuaccaacaaaaggccgggcguggugccucacgccuguaaucccagcgcuuugggaggcugaggugggcggaucaugagguuaggagaucgagaccauccuggcuaacaccgugaaacccugucuacuaaaaauacaaaagauuagcugggcaugguggugggcaccaguagucccagcuacucaggaggcugaggcagaauggcgugaagagagguagagcuugcagugcgcugagaucacgccacugcacuccagccugggcgacagagugagacuccgucucaaaaaaaaccaacgaaaaaaagucugggaccagauggauucacagcagaauucuaccagacauucaaagaagaauugguaccaauccuucugacgcuauucuaugagauaaagagggaacccucccuaauucauucuaugaaggcgacaucacccuaauacccaaaucaggaaaggacauaagcaaaaaagaaaacuacugcccgauauccuugaugaacauagaugcuaaaauccuuaacaaaauacuagcuaacugaauccaacaacauaucaaaaagauaauccaccaugauuaaguggguuucauaccagggauguagggacaguuuaacauacauaagucaauaagugugauauaccacauaaacagaauuuuaaaaccaaaaaucacaugaucaucucaauggaugcagaaaaaacauucaacaaaauccagcauccauuuaugauuaaaacucucagcgaaaguggcauacaagggacauaccucaauguaauaaaagccaucuaugacaaacccacagccaacauaacaaugaauggagaaaaguugaaagcauucccucugagaauuggaacaagacaaggaugcccacucucaccauucuucuucaacauacuacuggaaguccuagacaaugcaaucagacaagagaaagaaagaaagggcaucuaaaucaguaaagaggaagucaaacugucacuguuugcugacaauaugauuguuuaccucgaaaacccuaaagacuccuccagaaagcugcuagaacugauaaaagaauucagccaaguuucuggauacaagauuaauguacacaaaucaguagcucuucuauacacuaacagcaaccaaguggagagucaaaucaagaauuuaacuccuuuuacaacagcuacaaaaacacacacacaaaaaaaaaccacacaaaaaaaacaaauuuaggaagauaccuaaccaaggaggcaaaagaccucuacaagaaaaacuacaaaacauugcugaaagaaaucauagacaacacaaugaauggaaacacaucccaugcucguggauagguagaaucaauauugugaaaaugaccaugcugccaaaagcaaucuacaaauucagugcaaucccuaccaccaucauucuucacagaauuagaaaaaacaauuuuaaaaugcauauggaaccaaaacauggccugcacagccaaagcaagacuaagcaaaaagaacaaaccuggaggcaucgcauuaccugauuucaaacuguacuauaaggccaucgucaccaaaacaccaugguacugguauaaaaauaggcacauaggccaauggaacagaauagagaacccagaaauaaacucaaauacuuacagccaacugaucuuugacaaagugaacaauaguggggaaaggacacccuuuucaacaaauggugcugggaucauuggcuagccacauguaggagaaugaaucuuauauaaaagcaacucaagauggauuaaggacuuaaaucuaagaccugaaacuauaaaaauucuagaagauaacauuggaaaaacccuucuagacauuggcguacccaaaagcaaaugcaauaaaaacaaauagcugggacuuaauuaaacuaaagagcuuuugcauggccaaagaacagucagcagagugaacagacaacccacagaguggaagaaaaucuucacaaucuauacaucugacaaaggacuaacauccagaaucuacaacgaacucaaacaaaucaguaagaaaaaaacaagcaaucccaucaaacaguaggcuaaggacauaaauagacaauucucaaauggccaagaaaacacaugaaaaaaugcucaacaucacuaaugaccagggaaauacaaaucaaaaucacaaugcgauacuaccuucuuccugcaagaauggccauaaucaaaaaaucaaaaaccaguagauguugguguggaugcagcaaucagagaacacuucuacauugcugguagaaaugugaacuaguacagccacuauggaaaacaguguggagauuccuuaaagaacuaaaaguagaacuacuauuugauccagcaaucccacugcuggguaucuacucagaggaaaauaagucauuauaugcaaaagauacuugcacacucauguuuauagcagcccaguucacaauugcaaaaucguggaaccaacccaaauguccaucaaucaaugaguggauaaagaaacugugguauauauacacgaugaacuacuacucagccauaaaaaggaaugaauuaauggcauugcagucuccuggaugagacuggagacuguuauucuaagugaaguaacucaggaauggaaaaucaaacaccauauguucucagugauaugugggagcuaagcuaugaggaugcaaaagcauaagaaugauacaauggacuuuggggacuuggggggaagggugggagggggugagagauaaaagacuacaaauagggugcaguguauacugcucgggugaugggugcagcaaaaucucacaaagcaccacugaagaacuuacucauguagccaaauaccaccuguaccccaauaaccuaugggaaaaaaagguaagcaccagaaauuauggaaauaguuuuaaaaaauuuuugugucaauguaguauaugcagaaaacagguuauauuuccauggacuauguuuccauaggcaaggacuaugugccauggguuuuauauuccaaaaggguccagucacaaguccuuuccgaggucacuuuaaguucuaagaaagagaggggaagaugucauucugaauacaaacuucgcugcuaauuuggaaguaauauggugacuaugaagguagacagaauucagauuguuuaggcuugaauauguuucugccccuaacuagcuggcugugugaugauuugcgguaaguuacuuaacuuucccaagcuucaguugucuccuuuaaagguuggcauuaacaauagcauucacuucauagggcuauuguauuaaaagauauaaugcccacaaaguuccuagcacagugccuacuguacagcaaacacucacuaauguuaucuacugguauuacccgucuaaauaaguaacaauggcauuauuguucaaccuaaauuuuuguugcagauuaucuuuaaaauaaaugacuggaaagaaagaguuuuaaaaauauuuuauaucuauauauuacugauaauguaucagacaauguucuaggcauguuauguauauuaaccuauuugauccuuacaagaaccuuauuaggcagauauuacuuuccccauuuugaggcucagauaauuaaagugacuugcccaaggccacacagcuauaauggcaggguugcaauuugaauccaggcagucagcuccagagaauuaugcuuuuaaucaugauaacauacugcaauaagguaaaguauacuuauaauagauuauaauaauaauagcuaccacuuuggaaauccuaauauauguuauguauucuacuagaacauuucugugcauuaucucuaacuuuacaaugaucccauauuguggguaccaugaucccaccuuacaaaugaguaauuagacucacagaaguuaacuaucuugcccuaggucacauaguuaaugagagccagagccuacaugaaacucuguuguguucucugaagcuugaaauuguuccauuacaguaaguccucauuuaauguuagugauagguucuuggauacugugacuuuaagcaaaacuacuuauagcagauucucaaacaacaucauuauaacguugaugagaaaaaaauuuguuucauuauacaucauuuugcguaaaguugcggugucuaagaauccaacaacauuaaguaaggacuguauaccacacugcuucuaaguacagauuuugaugaaaggcaaauagcccauggguuuuaguuguuucagaugacaggcaagaaccugaaaaggggugaaccuaagacaaucuaaacacuaucaugcuaucacuuauucauucauuuaaccaacauuuguugaacacuuucuaugaacuaagcccuagccaaggauuuaaugaugaauaacacaaacagggucuuucucuuagagcuaacaaaugagugcuugagagaguggcuuaauaaaggaacagugugauaacuacuucaaggauuacuuagagucuagauaugaguuagaacugccaauccuuuucugccuccccauucaaugcuaacuagacaaaaagacuaguuaagaauauugcuggcacacuacucuuucuuacauaguucuaguuacuuacuagguauucuuguccucucuucgaugcagagagacaguguucuggagaaacuucaaaccuaaccucucguuucuacucuauaaagaucagaggaagaccuuaggcucucagguauaguuggcuugcaucugagcaccaugauaaagaauuauacgccaaacaccuuucuaguugcuaaaggauagaaauuacuauaacauagucccuggucucaaggaauuuauuuauuuauauuaacaacuauucuacugaucaugcaaaaauaaacaaagaauaaacacaagucuccuauauuauucccagggauaucccagaaaugggcuaaguuuuguacccaguauuggaacuuacucucugagaaguuauuuuucuucaaugaggcaaguauuuagcaaaggacuugacaguaacuuaaaacuuuucucuaguaauagaggauuagcagugaaaucuguucugggauuuacagaagaaccaaccccugagagaaucuaauguccuuguuugguaaaucugguccuugcccuugagccauaggaaaucuacagugugcauuuguauuuccucucucacacuuacagacuuuacuuuuaccuuuuggagaccaggauuauccuagagaagcacuucugacaugauggauauauaaaacuugaauucuggagagcaaguacugaggcuagaagaaauuuucgucuucuguucauguguucacaccguggucugcaaaacaaaauagccauugggaugacuggcaaaucuuucauugcagugcauauucuuuucuuaggaaaaccacuuaaccucuacugcaaagcuaauagaugucauuuguuucacuuucaaagugaaggugguaucaauguauuggaaaauuaauucuuuuucuccuuaaaauauuaauaggaagaaaaucacauuuaaaacagaguaguuuaagaaaauucuuguauccuguuucuuaauaaaugcucuaucccaguaauucaggaaagaugucauuuagcuucuucacaccuuuacaagaagauacacaacuugugucugccaucaauacaaaggaaacuaccgguugagcaucuugaaucugaaaguccaaaacccaaaaucugaaauguuuugagugccaccaugauggcacaaaucaaaauuccacacauaaguacuuaacacaaacuuuguuucaugcacuaaauuauuaaaaguauuguggccgggcgugguggcucaugccuguaaucccagcacuuugggaggccgaggcaggcggaucaccugagguagggaguuugagaccagccuggccaacauggugaaaccccaucuccacuaaauacaaaaaguagcugagcaugguggggggugccuguaaucccagcuacucaggaggcugcggcaggagaauugcuugaaccuaggaugcggagguugcagugagccgagauugcaccauggcacuucagccugggcaacaagagcaaaacuccaucuaaaaaagaaaaaaaaaaguauuguauaaaauuaccuucagacuauguguauaagauguauauaaaacauaaacaaauuuuauguuuagacuugggucccauuccugcaucucauuaauuaugugcaaauauucaaaaauccaaaauucacaagacuucuggacccaaacauuucagauaagguauauucaauguguacaugaacuuacaugaaucuuuuaaagaaccuaaauugguggaaauuguucuuuuuuagcugaaauaucacuuuauuagauuucagugugcucauuugauacaucuugaagagaaaaaaaagacuucagauuuuguaaacagaaaaagcaaaauguuacaugucaaaugauagcucaaaguguuuuaauauccuuguauaaaacacaucaggaaggccaagugugguggcuuaugucuguaaucucagcacuuucagagacugagguggggggauugcuugagcccaggaguucaagaccagccugggaaacacagggagacacugucucuacaaaaauauaagagaauuagcugagugugguggcacguaccuguaauaccagcugcuugggaggcuaaggcaggaggaucaaggccauagugagcuaugaugaugccauggcacuccagccugggugacagagcaagacccuaucuccaaauaaacaaaaucagagaagucaaauaauaaaauacagacacaccucauuuuauuaugcuucacuuuauuaugcuucacagauauuacauuuuuuuuacaaauugaagguuuauagcaacccugucucaagcaaguccacuuuuucaguggcaugugcucaccuuccaucucacauuuugguaauucucacaauauuucaaaaguuuucauuuuuauuauaucugauggugacuugugaucagugauguuugauguuacuauuguaauuguuuuggggugccacaaacuguaccuauauaagaugaauuuaaucuauaaaugugugucugacugccccaccaucucucucccucuuguugggucucccuauucugagacacaacaauauugaaauuaggccaguuauuaacccuacaaugaccucuagguguucaggugaaaggaagagucacauaucucucacuuuaaaauaaaagacagaaacaaaaauuaagguuagugaggaaagcauguugauagccgagacagaccaaaaguuagguuucuugugcuaaauagccaaguugugaauguaaaggaaauguuauugaaggaaauuaaaagugcuacuccagugaacacauaaguaagaauguaaaacagccuuuuuguugauauggagaaaauuuuaguggucuggauagaagaucaaacgagccacaacauucccuuaaaucgaagccuaauccagaguaauacccuaaugcucuucaauucuaugaaggcugagagaguugaggaagcugcagaaaaaaaugcuugaagcuagcagaggcugguucuugaaguuuaggaaaagaagccaccuccaaaacauaaaacauaacuugcugcaagguaaagcagcaagcgcugauguagaagcugcagaaaguuauccaaaagaucuaguuaagauaaguagaucuuaacuaguugaugaugguggcuacacuaaacaacagauuuuaaauguagacacaacagacuuauaugggaggaaaaugacaucuaggacuuucauagcuagagaagucagugccuggcuucaaggcuucaaagaacaggcuaacucucuuguuaggggugaaugcagcuggugucuugauacugacaccagugcucauuugccauuccaaaaauccuguggcccuuaaggauuaugcugaaucuacucugcuugugcucuagaaauggaagaagaaagccuggaugacagcacaucuguuuauggcaugauuuacugaauauuuuaagcccacuguugagaccuacugcucagaaaaaaagauuccuuucaacauauuaaugcucauugacaacgcaccuggucacccaagagcucugaugagaugcacaaggagauugauauuguuuucauaccuguuaacacauccauucucuacucauggaucaaugagucacuuugacuuucaagucuuauuauuucagaaacacauuuccuaaggccauagcugccauagauaaugcuuauucugauggaucugggcaaaguaaguugaaaaucuucugaaaagguuucaccaugcuagaagcuaauaagaacauucaugauuuaugggaggaagucaaaauauccacacuaauuggaguuuggaagaagcugauuccaguccucauggaugacuuugagggguucaagccuucaguggaggaagugacugcagaugugguggaauagcaagagaucuagaauuaaaaaguggagccugaagaugugacucaauugcugcaaucucaugauaaggcaugaacuuaugacgaguugcuuuuuauggauaaacaaagagaguaguuucuugauacggaaucuacuccuggugaggaugcugugaacauuguugaaauuacaacaaagaauuuagaauauuccauaagcuuaguugauaagcaguggcaggguuugagaagauugacuccaauucugaaagaaguucuacugugaguaaaacgcuaucaaacagcauuacaugguacagaaaaaucuuuugugaaaggaauaaucaaugcagcaaacuucaauguugucuuauuuuaagaaauugccacugcaaccccaaccuucagcaaccaccaccccaagcagucagcaaccaucaacacugaggcaagacccuccaccacaaaaaauuaugacucauugaaggcucagaugaucauuaacauuuuuuaauaauaaaguguuuuuuaauuaagauguauuuuuuagacauaaugcuauugcauacuuagacuacaguauaguguaaacauuuuauuaauauaugcacugggaaaccaaaaaauuugugugacuugcuuuacugcaauauuugcuuuauugcaguggucagaaacacaacccacaauaucuccaagguaugccuguagcaauguucuccucuuuauacuuucuuuuuaaaaauucagccugggcaacacggugagaccucaucucuccaaaaaacaaaaaaaauuagucaggcgugguaguaugagcuuguggucccagcuacuugggaggcugaggugggaggaucaccugagcccaggagguaaagacugaagugagcuguauucauggcacugcacuccagccugggugaaagagugagacuuguucucaaaaaaaaaaaaaaaaaaaaaaaaaaagagagagagagagaaaaaauuaaaagcuugaucuguggcagggugugguagcucacgccuauaaucccagcacuuugggaggccgagguaggcacaucaucugaggucaagaguuugagaucagucucaccaaaauggugaaaccccaucucuaucaaaaauauacaaaauuagccuggugugcaccuguaaucccagcuacucaggauacugaggcagaauugcuugaaccugggaggcggagguugcagugagccgagaucaugccacugcacuccagccugggccacagagugaaacucugucucaaaaaaaaaaaaaaaaaaagguugguuuguuuacuaauuuuuuaaauggauuagcauaacauaaaacauauaacauaaaauacaugccuuacaacaaaggucuuuguaacuguuugagauaaagcuguauuaagaaacuuucauuuuuaaacacauggcaaaaacuuucaauucugaaaugggugaugcuguuuuugacacuggcaucagcaaacugacaaaguggaggucacugguuuuaaaauaauaaaaucuuuucgguauaguacucuaaagaugaugacaaacauagaaauguggugacuauggaagggagauguuaaagugauacuaauucugauagucaaucaaaauaacauuucuauaaaaauaaaaucuugccacucaagguaauaagauggaaauuuacagaugaaagauaaauaauuuaaauaaaucacuaaucuguauuacugaagggagcacagaaaagagaacgcuaauccuaauuuuuugcuauccuuguugggacucuuauauauacauuaguaagguucugccaaagccgauuauguauuccuagauuugguugucaccuuaggcuacauggcaaucucaaaggacaugguaggguagguaauacaggauacaaaggaaaggcagaaagaagggucaaagaaaauugccauuguaagugcuaaaaccucaaauuccuugccauugcaacugucaaaagacaaaauuacaacaauuuugugaaagaucuuaauuggcuuuauuuaugauucugucagauguguuugaauaaaaaagcaacuccaucuugucuagaggcuggguaaaaugaagcugagacauacugggcugaauucccagacgguuaaggcauucuaagucauaggauaagauaugaggucggcacaaaauacagguuauaaaggccucgcugauaaaacagguugcaguaaagaagccugcuaaaacccaccaaaacuaagauggugaugagagugaccucugguuguccucacugcuacacugccaccagcgccaugacaguuuacaaaugccauggcaacgucaggaaguuacccuauauggucuaaaagggggaggcacaaauaauccaccccuuguuuagcacaucaucaagaaauaaccauaaaaaugggcagccagcagcccucggggcuguucuaugucuuuuauuccuuuacuucccuaauaaacuugcucucacuuuauggacuugcccugaauucuuucuugugcgagaucaaagaagccucucugggggucugaauugggacuacuuuccuguaacaauucuagaaucgggaaauacuuuauuccauaaaauagaguaagugacccaaggggcugagcagagaaguucaguuuuacagaaagagaagggcuaaagaaaguagaaacaaagaacaaaaagcagcuuggucauuucaaaguuacuuuccuccuaaagugggaacagaggaacagaaaaauacaggaauaacugguuaacauaaggcuacuuuuuguuguaagcaucaaaggcagagcgaaguucguuguuaugacaauugaaacuggcacaugugggaaauuugguuauuucucucuucugaguucuaggaaggucagauaacaauguaguuuugauuuggugagguggaacuuuaaguauaaaugacucuauuuugauuuuuagucugguccacuggggccuagugcaggagcuuaguccaaaacaaaggccuccuauaacuuuuaguuaacauaacaaaugauguuaugucaacaaaggcauuguccuccacauucuaaaauccaauuuaguguaggguuuaguauggagguacaucuaccugugaguuaggggagcuaaaagagcauaaagcucacuccugaacaugcugucucuuaccugcuuaaaauccugcuauuuagaaugaagccucaauaucucacaauggucugugcagcccugggucauguagaucuugccaaucccugaccucacuuuguaccacucuccuccucaaucacuguauuucaagccaugcuggccuucuuucugcuccucaagcacaccaaacgauuucccuucucaggcuuuugugcuuacuauucucuuuggcuacgauauucuucccuuaggucuuggaauagucgguucuuuauuguccuucaaucuguaacucuaauguuaucccuucagagagccccacuuuagcucaaguagaauccuccuuccucuuaguuucuauggcaucaccuguuuuauccuucaugguacuaacccugcuggauagucauccuauguaugucuuugcuuacuuauuuuuguucaucuacccaucacuagccuaaguuucauaaagacggggaccuaguccacccuguucucuacuguaaccccagugcuuagaacagugcucaguacacaguaaguucacaauaaauauuuauugaauggggccaggugugguggaucaggccuauaaucccagcacuuugggaggccaaggugggaggauugcuugagcccaccaguuugagaccagcaugggcaacacagcaagaacucaucucuacaaauaauaaaaaauauuagcugggcaugguggugcaugcuuguaguuccagcuacucaggaggcugaggugggaaggucacuugagucugggagauugaggcugcagugcgcgguauugcgccacugcacuccagccugggcaacaaagacuagucucaaaacaaaauuuauugcaugaaugaagaacuauaagcagaauuuugcaauucaagaaaauuuuuacaacagaguaggcagacgccauacgauaaccagaauuuucuuccuauuucauuugaaguuccccuaaaaagucuuucuuuauuaacaaagggaauggcuuuucuuuuuuucuacaccauauacuauuguaccucuguaguccuaccauuuguuuugucuauuguaguguauugucuauuugguuuuauucucccuaaugccuauucucuuaacuuucuuuuugcucuuuaugugcuaguaauuuaugccaagagaaacaaucugaguuguguuccuugcuuccccacccccacaauauguuucacauuucuaugccuuugcuuuuuuccauucuucucucuaaaaugcuuucauucucuugguaaugcuuauuauucuuuaagauccuucuuagaagucuucuuuucuaggacguuuucccagaaguuaaauuacucuuuaauucaucacaugccacauuauauuaaauuuaucuguucaauauggcuuguuuuuccuggacucaaaguaagaucguagaaggacuaucuguuuauaucuucagugccaagcucagaaauugucaaucugaacuucagauauuaaucuucaugauuugcauuuccucuucccaagccacaauuuugucacauagcguuaaauauaaaacacaauuuuaccaaaucauaaaauuaucuucuauuuguauacgaaguacacagccuaguuucauauauaguaccuuauuucauacuuauuuuaaucauuacuuacaucuuauccucacuucuaauuuuuuuacuucuguucauauugugagcagagacuauuuucuuuagggcucuaaaacagaauuuuauacuguaccacaacaauaugggcauucaucaaaucauguucuuuacacaauuguuauucaaacuuuaggaaauguaauaaacuuguaacaugacucguacacugggcuaagugaaaauaagauacugucuguccuaaaaaaaauugcuaauugggcagacaacucacuaauaaaugaaaaacuuaaauaagcaggaaauuuuggguucauuucuaaauuaauugugccagcacuuauuacuauacuuuuaaaggaagguugguuacauugucuuuauuuaaggguuuacugcccucuaguggaucaaauaaguaagucuaaaaaucuauaaaaacagcaaauuugagaacuguaaugaaagggaucauuaguauuuuuacuauuuguauuucaccuggugaaccccagaaaauggcaaaaaggcuucccauuuauugucuguuggacaauaauagaauaagaucguuucagacaguuacuguuaauuaauuuccuuugguguuuucauaauauuuccuucauacuugccaccuaguuuauuuuuguauuuauuuauuuauuuaccuaggcucuggggguguuuuuauacuuuguuuuauuucucugucucucucuacugcuugacuugcaguauaguggaugcaugucugaugaauaauugaaugaaacaucaggaauaaguaaauacuaaaauuaggaagauaugaugauacacuugggaacaauuucauaugugguaucuuuugcaguuuaucuuucuuuucacauuuauugggaaggaugaugauauaguauuacauuucuuucagcuccaucacagcaaaccauaucccaauuuaauaugcgaacauauuuauuuauucaucaguuauuaguugugcagcugcuaaaugcuagguggggauagugugauugauggacaaacagacaaggucccuaccuagucacuagacuuacagucuaguguaagagacagacauuaaaauaaucacacaaaaaauuuaacugcaauucuggcaaauucuauuuuggaaaugcauagugccaugagaaaauauaacagggggacuaauuuaguuuuugaugggaggaauggggaaagagaagaggauaguuaggaaaguauauaaucuuauuuuuaaaaaguauuuucucagggugguaguguuaagggcgauuuuuauuuucuuuauauauuuaagauauuuucuaaguguauugcuuuuauaauuagaaaaaaucaauaaauacaaucuaaguguauugcuuuuauaauuagaaaaaaaucaauaaauacuauaaaaaugcuggauagggacauuagcaauaauauacaaagaaaaucuugcuuucuuuaaaucucucacacauaaaaguagaaaugaggguagaaagagggacaaaaguguaaguguuggggcagaacuaauuaaggccucaguuggccuuugauuuuucaaagggcacauaccagggauuaccuaggucaauguccaggaaugaaggcuccaauagacuuaugcuuauuaaaauaugugggguccauguggacacacuauaguacauaucuaauuuaccaugggauauucuggaauacuugcuuucucuccuuuuagacaagccauauggggagcugaacuguaauccaaagauguucuacuaauuuaccacgaaaaauuaccaucacagggaagggacauaucagaagcccauauuuguauauuugguauaaccucauauuauacuaaaauuauaaacagaaaguugcuugaagaagagcuguuuggugaaucaacuauuuaauggaaucaagcuaaugccugaugcauuuuucauucuagagaugguuuugucagugguaccagauauauaaacucauugauuacaaccucugcaucccauuuucauacuagacaaguauuucucaaacuuuaucauauaucaaaaucacccagaaggcuugauaaaacagauugcugggcuccaacuccagaguuugauucaguaagucugggauaagggccugagaaucugcauuuuaaguucccagguaauggccaaauugcccacacuugaaaaccaguagccuagucauugagacuaucucaugguguguaacacuugugauaaacaugguuauaguuaaauccccaaggccugacagcaucuuagucucauuuggaugauuuugcaauucuuuacucuaauccauuauuuggugaucuuucagcuuaacuaccucauaaucaaguucucagaaggcaacuuaaucauuuaugaaaaaccgugcccauacaugcacauaccaacacaucuuuuuuucuucuuccggcuagacuagaagaucuagaaaaacuggguuagauuagaaaaucuaaacuaauucuuauucuauguuagauccuagagaaaaaguucaauuaaguauuuaguguaaacuggcaucuggggauggggcugaagagaacauaaaaguauaagaugugaauccuaucuuaaaguucauaauccaguuugaguucauuugacugcuuuacaguuugcaaagugcuuuugcaacauuaucugauccacucagagaaguuaaucaggucuggaacucaugccuucugaugaguagcuuaccagucuuucuaguccauuacucucuuugcucaagcuucacacuugaaagaaacuauguguauuugcuucaagacugugcccaaaggaugaaauuacuccuuuaaaaaacuaguuccacuucuaauggcauaaagaaaagaaaguaugacuaauuuuucucccuuucuucguuccucuccaaacccuucuugccuugcaugaaaaucuuugucaccuuguaauucuccaauuuucuguuucauauuuuacaggccaagaggccucagcuaugggaaggguggcuguuuugaauuguuuucuuaacacugucuaauggucuccuccaauggcacauacuuguuuaauuuuucuaaaggcagucauaauaagucccuaaaaaauaauuuaguaacauugacacgaaaauucuagaaaaguaagagaggcaggcaggagagugaaaauuaaguaagcaaaaaaacaaagagacaaaaucuucagugaaaggagaaauacugaugaaaaaugcuuuaaaaacaugaaccaggaaaaucuuaguacgauacaguuuuuccauugauaucauuuaugagacauuuauuacagggauggagaaggucacaucucaguaaaugguacuacucacuaaccaguaacucaaaccagauaccuaggagucauuugucauuccucccuuuccuucauaucccacaucacacucaucagaagguacuugaaucuacuuccauacuuagaaaccaucauucacuuuucccucauauauucugccaucaucuuaauccaaaucaccauuaucuccuguuuauggugcuggauuaaccuccuaaccaugauccggucucugcccaucuuuccagacucaucucauacaacuguccuuucuaaauauauuccagcuauacuggucuuuccuuagauucuugaacauuaacaugucaagcucuuuccugccucaggacguuugcacaaccuguucacucuguuuagaauguuuuucuuucccucuuuugcaugguuggaucacgcucaucuuuuaggcaucaguaucaacuccuuggaaaggucuucuuagaccagucuaauucacauaguuuccuuguaaauucuccuuaauuccauccauaaaagguaaguuccauuagaacaggaaucuaccuuguucaucauuggaucucaguaccuagcaauucuuggcacagacgaaagaagcauuuaacuaucugcagaauaaacaaauaauuacuuggugcucugugauccaguccuguggggucaggaaaggguuucugauuuaaaaggcuuugcaaacugacuaagaauuagccaggucagggacagggucagaagacgguuuggggugagaaggaggauagugcacuucaggaacacaaaagacauucuauauggcuggagcgguggaaaaccacuagggcugaagagccaggcaaaagucagauaggaaagagucuguaagucauguuaaagaguuugggcuuaaaccugagggcaaauaggagcgacugaaagguuuucaauggggagugccucggucaaauaugaacuuuaucagcccagcaauguggagacuggacuggaagguagcaagauugaaagcaggagaaccagcuggggcggcgggggagggggggguuacugucacagcuauguagcagucauagggucgaaccaaaauaaugucaguaaaaaacggagagaagugaacagaucugagauauucaagaggcugguagggacuggcuggaugugaaaaggaagaaaacuuucaagcucugguuuaagcacauggcucaguuaaaauauguuccuucuaagccaucauagcauuuuggaagauccccuuucagcacguacuacucugcacaguggcccacugaauacguauuugcacauuacagaagcaagagucgcgccuuuuccucucuauuuccgauucuaaaagcucacuccgagucuagcucgauggcacuguaaguguucaauaaacguucguuaggugauugcaaaagcacugagucuaaaauaaaauaacugacguuuauauucuguuacccucauggcugcccguuuacagagaaccacuugugaaaaaacaagcgccgggcucugggugggucucauucauaaugaaguuaagagccuccuuaggagucuccggcucuucggcuucccgagaaccccuuuacccagcucaccugggggagaagaccaggaacgggcccaggcgacgcacagugacucggaccggccgaacucaguagcacgccggcagccuuccaaucgaaucucccgcguccuuuuccgccg

SEQ ID NO: 15277 - RNA, 3996 nt, Homo sapiens
cuaguuuauuuuuuacugguuuguuguccacccuuagauaagccaagacuuguagagccauagcuagucuuuccuuccuggagcagagaugggggaagaaauaucaauuuauuucauauuaaauuuaccugcuacacacacugacccaauuuacuguucgcaacaacuccaugggguggggaauggcaccacuacuuugucaauaaggccacugaggucagaacaguuaaaggauuuggcuugcaaaacaucagauaagugaacggucuuuaguuaacaaucaguucugcccaucuccaaaguagagcuaagcagcaaagccuauaguacuuggaagccagcugacuucuguucaaauucuggcucugaccccuaccagcucugcggccuuggaugaguuauuuaacuuguuuuaguuucuccacuugugaaaugggaauaauaauaggaccuacuuaauggggagguaaaauuugaagaauugaaaauauaaaggauguugaacaaugucuggcacaugacaguuauacaauacauuuuagcuaggguuucaacuucgccauguuggcaauucauaauugcucacauuugaguagguuuuacaacacacucuacuuuaagacaauauuggcaacaacccccacccccacucuuaauacacacacacacgauuucccccauuuuccagaugaggaaacuaaggaccagagauuuucugccacuugcucaaggucagagagcuaagaaacuggcagagugaggacgagguccaggaccccuggcuccuucuccaguggucugccuccucaggccagaauuuauaugggcucuaugcuucgagguugcauuuguggccuuaggcugccaagccuuuuccaguuccuugaaggaacugaccuaacaaacaaacaaaaacuauuaaaugcaguaagucauuuaucugccaaaacaauguggugaaagagagauccaauaaaaagaggggcugaugagcagaucagaguauagagaucugagcacccuguacacucucccaagugggcaacugagguucuuuugggcccugcuggcaucuccccauuggcuuucuguuauccuucauugcaggaccuuuguguaugggcagcaagacugauggcuuccugaacagugugauuggaaaaauucugccuuuaucuuuaacacaguuauguccaaaauaauuuccucaaucagacucucaauuccaccauucaagacacagucaggauaaacacugccccucaauuauccugcccauggggcaagaaaaaguuuucagacucacuuuugaaagguggccugccuauugguggcuuuccuucacugcaugugccaaguaauccuacaaagugaaagggaaagagacucauguuuuacuuugggcaauuccuauguuccagggacagguagagcauuuuguguauauugcuguauaucauuuaauccuaugucgacacugagauauuaguaguauuguuucuuuuugaugcauaaagaaacaaacucagaaagcuuaaagaauuugccagggguuacauagcucauauuaaugggucuaaaauucaaacccaggcaugcccagcucuggagucugugcugcuuccaugacaacaaaaaugacagaucaugagcuuagcaguuuggcuuucugugugacuaugcagguauacaugcagccuuuucuuccuuauugggccacucaagaugguacaguuggaaaccucuguuuagaccuugagucuguuuacuuggaggcugggcauuauacuuaguuucuaaacaucugcucuccugacaccuagaaugcagaagcgcucaagcuggaaguccugacuuguuuugacuccaugugacaguuuguuucuacuaaaacucaugucauguguguaucacuguuaaugauuuugaacuauucagcccuaagguggggccccaggagcaauuuucuggguccucccuuuugaguguaaaaugaucuacagaaaaaugugucugugguccuccuagcaucccagaggcuacugggggcucugcuauggcuggaccaugugccaguucuggguucuauaucagggauuccuguccaugagcaggcggcauccucagcagcucauuccuacaucacuaucaccucugagucuuucuuuuauccacaacccaaaugccuuaccucauacuucuacugacacuguguagacaccagcuuuuuaacacccugagucccuccaucuuuuuccuuagcauuuucuucuuccuccuuuuuuaaaaauaauauuucuuuccacugucauauuauagucaugcuucucagcccaccaaagccuugaaaugguauuugacucccaggugugcacucuugacuuuugugcccuaucucuacucucaacagcaagccguagacaucugcagccauacguaaaguucugagcagucuucucgucucccucaugcuauccaacguaaagccucacaauguaaauccuguaaaucugaucucucuggaagucaaaugaaguguccugaacaucagucauaugucaggcaccugcuuucccuuaggcuaucuuaauugugccucaguacaacccagagagguaggaauuuuuguacccauuacauagauuagaaaacugagacucagagagguugaauaauauggccucacucaaacuccugagggucagaguuagggcugugauguuucuuugucuaauuugaaggucaggucuuucuaugacaaaguacuggcuagcauugaagaccuucauacuauccugucuuguucugcuuucuggaagagccaaguauuacaauaugcuauucuuugccguguugugaccagguuaaaaauuaaagcaagguaugucaacuuuaugccucagcagucacucuauaaagcagcaugaaaccacacauggccacaaauacacauuuaaaaugaaccauaacuuuauaagagacauuuagaacuuacaaucaaaaagccauuuauuaacaguucuauccacauucaccaauuagauggcccugucauuuaucuguuugaacaucaggcaguucuucaacuauuauuuuaauuaauuaauucagcccuuuuaucccuagggugggcccugggagacaccuggcuuauuuucacagcagucccugaugcucagcugucaagccacaucaugacuggcacuccgagcuucaugcaaggccaagcacuuaaucucuuuaacagagaccugucaucacuugcuuucacuccagcacagccccagucuguguugagacacaaugucucaugcaccugucccugccuucccauuguaacagccaccauauggguucagacccuucucaauuccucucugcaucauuguuccugcaauucacugagagccugcuuugugccaggcaccaugcuaugcguuucauauuccucuucucucauccacaaaaccacuaggcaaaauaggacuaucauccccauaucccccaagaggaaauggagucuuagaaauguaaagugacuugugcaagaucccucaacuaggaagcuguuaagccaggauuggaagcgagcucuauauugacuucgaugauugcguuucuuccacucuucugcauuguuagaaucuugccuuuaauaucuaagaucuaggaaugaaagacagaagcuagcuaggcuauauacuauauaaagggguaaaauggaaaagagggucuucagaaaaagcauggcagagggccugcuaaggggaaauaagacguaucaaaaaaacaaaacaccuguugagcagucuucuguggauguacuguguacauucucuuuacucucuccuuuguggacuuuucaguaaauucuguuuuguuccugauauuuauguacaguguauuuauuugguagugguuguagagcagguguucagggcuagcaggagaaggaagagacaguggacaguuggauuauauguugauuuaaaacag

SEQ ID NO: 15278 - RNA, 818229 nt, Homo sapiens
aagagcucagccucuuaacucuucuuccugcccauugcugagcaaugcuuuucuuugcuucuuuuuuucuuuuuccacuucaaaaucagccacgauggguuuugaauggacugacaccuucucccuucucagcccugggagccgauuuggucaggauuguggcaaaccgguauuucagguccccuuggcaacccccagugcacugucuccugaggauugagcuucuaagggacugcgaggagacaagacuucugggugagcauccacaccuuccucuuuguuucuuugcugccacauucagcauaggucgcuguuucaaagagaggagagguugguugggaggaaaggcuguccuggaaguuaggaaugacacauaaaaaugaacacacuaugcuguguuccugcugcuagggggagaaggagcaacaugaagauuccuaggaaugacaacuuaccauuuucaauuuucacccuugucauugcuugucuuaugaugcaaccuuagagugacacuugccacuggacguuggggugccuuuuuggccugagacguuugucagccauugaaucaaucaucccagcuuuccacuugcaccagaaggauuugucccugcucacagcuggggaugagcuggaggggaggggaccugugcagccuaugcacuaucucagaauuguggagacagugcuguguuuaguguagcauguuucuucuccacccuugguuuccuuuuuccaugaagaauugcuuaaaaauuauguauuuuuuuuucaaaaagggcuuugaacacagcaccaggaaggucuacauagcuauccacccuuauucccgaguucaacuuugggauuuguuuggggaagggggugcagagggauaaaggcaucaggagaaagacguuggucuuggugacuaacuccaaacaacagccaccgacaaaaacagugauguguaaauuacugauuuuuauuggacacuuuggggaauauaguuguuugucaggaaaugaaagagaauguuugugcuuauaaaauuauauggaaaaucaaugugguguuaaguauauuuuucaguuauucgagucaaggacuguucucuagccaauucuagcaagcacuaaaggagacagacuuccugaagcccagccaaggggccgaacagaaagcccaagcugugguucauugcuguucucugucacuuggggaaaugccuggggugggugugaagggacuucuggagccaugcaaaguugcaaauguggauguuagaccuucauuauuaacagcaaugcucaggacugugcuaaacagagcacucugaagucuagaccuauuucugguuuuccuuuucuugugcuccaacccagggauucuaaguacugagccccugucacagguggggugaucccugcaggagcugggaauucauaaaagcaugcugcaggggaggagaaaugggagaaaauggaagccccaccuuggcucagugguucaagagaugccugucauuaguagaagugggguguuuggugcuacuaaauggaccugugguucugucuaucccugggccuuggacaaggauaugaaaggagaguguagaacagccagggccucugucccuuuggaaagcacuugacacugcacccuugcugggggucuuugacaugaaggaauuaguaagaguaagaugcugagcaaucuacacagagcucuuagaagaugaaaaauugacggucaagaagcuaccaacaaaacucaccugugacuauaaaucuuuaccaauugauaaugugauuacuuuuaagacacugaauuggaagccuacagucuucacugccauuccuucacuguguaacccaaggcaaaucuuuggcuucucugggcuuugcaucccuuuguccauguacuuucuuuucacugggucuugcucugucgcccaggcuggagugcaguggcacgaucucggcucacugcaaccuccccuuccuggauucaagcaguuucccugccucagccuccagaguagcugagauuacagaagccugccaccacaccuggcuaauuuuuguauuuuuaguagagacgggguuucaccauguuggccaggauggucucgaacuccugaccccaagugauccacccacuucagccucccaaagugccgggauuacaggcgugagccacugugccuggccuccauguacuuucuuauaaggagcuucuuaagaccuuauuccucuaaauucugugauuuuaugaugagggauucuuauugacuaguggagaucacagcucaguggauaaagauggggccuagacugagagggaggcaaacuuuguuugucgcuuacuagguguauguuguaggcaggucacuuagccuuccuaugcuuccgauuccucauuugaaaaauaaguuuuugguuaauguguugguugauuggucuuucuuccaucaguagaguuguggugagaauauaauacacaguaguacaugccaaauagugaacacagggccuccaccacagauacaugcuagcuguugauguuacaaaaggggguaaagaaaacuacuuucuguuaaguacucauuuuuuuuuuuaacuuuuauuuucgguuuagugguacaugcgcagguuuguuccauagguaaauugugugucguggggcuuucaccacccagguaauaagcauagugcccgauaaguaguuuuucgauccucucccuccucccucccucccuccacccucaaguaggacccagugucuguuguucccuucuuugugaccaugcggacucaauguuuagcuccagcuugugguaacugagaacaugugguauuuuguuucugguccugaggaacacaacagauuuuaacaguguccuacugcugagacuuacaggaacggucacaaaaguaaauaauaaauuccaacuaauuauuaucaaagaccaaaaugaucccuuuguaacugcagaguagauccaaucaaggacuacauuaaaaagauagucacagcaaaaaacccagaaaaacaaacaaacaaacaaacaaacacuggcauuccacuuuuaucuuuuccacuaugcaucaguuucaucaucugugaaacaggggaauaaugaccaagaacuauugaagaguuacuuguuguaauagcuacaaaagagcuuucacacagugcuugaggcacuagauaaauggugccaguuguuaugcugacauuauuugaaauuccugauuuagaaaauacagaucaaaguauaaacaaaaccuaacgccguuuuuaacauaacuuccuugagacuugggcucuguuuucuccacaaggaaguuucucagugccugucuucuuucauuuacucauucacucauuguuuucuaaagugauggguggagauaacugaaaauauuaucuagauuuuacucaaguauuacaaauuucucaaggcuuuaaauuguuuugcaaauacuauccccaaauguuacugcucauuucagcaacagaaucuccuugccagagagcagcgagauuugggggugaacugucucuggcugacaggacacagcuggcugugacugugaaguauggcaauuucaggcccaaagaagucucacaaaguguuugauaauacaaaugagaaccacaaauccuuuaaaaauacaggccaugauuggccucguucucauuucuauuaguguugaaauagauccaauaagaugccuucagagccucaaacuaaugguuagauucuaugccucauuucaaagcccaaggauaugaguucgugugcauacagauuaagccaaaguuuccaaaaagagaguauaagauguucuaaaauauuuuaaaauauacuuaucaaaguuaggugauaaaaauaccucugccugguacauuauuuucaaaugcacuugcaauaguauuugcucaucaauucuguccuguggauuucucugugaaccucuaguaggagucgcuucuuccuucaugugcaaggagacaguauugugugcuucccccaaccccacucacucacucacucacucacucagugaauuacaaaucccuuauauuauguugauuuuuccuccaaugcaaaaacauuaaggaacaacaguuuagguuauuucuuagcugggugugguggcucacaccuguaaucccagcacuuugguaggcugagguggauggaucacuugaagccaggaguucgagaccagccuggccaucauggugagaccgcgucucuacuaaaaauacaaaaauuagccaggcauggugguguaugccuguaauaccagccacucaggaggcuggggcaagagaaucacuugaaccugggaggcagagguugcugugagccgagaucaugccacugcacuucagucugagcagcagagugagacuguuucaaaaaaaaaaaaaaguuauuucuuuagaagcaaaauauguuaugaucucaauuaugaggaggaaauaggaccaaaaacaaauaaauaaaaauaccauucuaaggguagaaauacuauaaaauuugaauugugguuaucuuuaccugguagaacuaucauuuucuuaucucuacuuuuccauauuuucuaaauuuuccaugauauacagacauuauauuuaagaaaaauauuuucauauuuuuaaaagaauuguuauauaaaguaaaggugcuuuuuuagaacagcauguuucuacucauccaaauaguaacuaacauuucacuuuugugguagcaaaugucucaugugcaucauaccugacuuuuaagcaaguauucaaaaugcauuuuacaguuuacuacuuucaugguaugcuggcaauaaccaggcacgcucugauuggcuuagcuuaacuuuagcucugcauucaggcuuaauucuaggagguucauauccccagacucugacucagcagcuaaacuaugugauggacucugugugcagaguuguucagggaaggagucuguguuuagacuuucuuggugggccuucaacacaagcugcccagauauuuuuuuucuuauuuauuaauaacauuuguuggaauucuuuucugauuauuaaggcaaugcacguucauuauagaaaacauugaaguuaaauggaaagaagaaaauaaaacacccacaauaccauauuuccuccaccaagaaauaaucacuguugcacacuuaugaacuuccuucccuuuuguggguauguuuauaggagacauuuuaagcagcuaagauuauauuguauauacgugugugugccuauguauguauacauaugucauguuuucuaaugucauuacaacuauuuuuuacaacaauuuuuaugcaugcauaguaauacauguaccauuauuuagugaaccaauucuuuuuccuggacauuucaguucucuaccauuccaacuuuuguuaauguaaauaaugcugugauaaacauauauaauuaauguuucugucuuugauuauuuccuuagcauagauuacuagaauuggaaucaauaagucaaggaacaucaauauuuuaaaaacuuuuuauagucaaagaaaugcaaaguugaacaguaaugagaggugaauuuguguauaucaaacugaaaaaacauuucucacauuacaaacauuaggaauuauuuuucuuuuucaccuuugacauauugauauacgaaaacuaguucuuuaauauuguuuuaauuuucauuucuuugauuauuagugagauaaaacucuuucauguuuauuagcuguuugucuuuacucuuuuaugaauuuucuguuuaugcccuuuguccauuuuccuacuaauuuuuucaucauuucauaaaagaucaaucuuuaugaaagauacuaggucuuugccacucuauuaaaaaauauuuucucaguguuauuugccuuuuauuuuuuaaugaauguuuugguacacagaaauuuaagccuuacauagucaaucuauuaguaucuuucauuacguuuucuuccacuuaucauccuuagaaguaccuccuuauucagagaucagaaacucacuuucagcauuuuugaguuuguuuguuuguaauauuaaaauagggugugaucuguggcaagggacaaaauucugugaauuuugucagguaacuagggcuucaagaggcucuuucuaccucuugcgucauuagaagaaacugagcauuggcuuuccauggugcccagugggucuggagauacagccacaggacagaguagcaagcugggaucugcuaaaaauccagaacaggaauuuuuuuuaaguaaguaggcauggggguuucaaccaucauguagcaaguguaauucuaaauguuagugacugggaagucccauggcagcagggccuccacagaagcagguccuaaaaaguaagucugagaaaauaugucuguguguucuccuucagugagaaaggagaaauguggcuguggucucagguggcagauaugaaauuaaaugauucugaauuagagcuuugcucugggucacaucugacaacucgauuuuccucugucauuuugaggcaaugguuuuuagcucggagcucugucaacagugaauucugcauagaggaagagaucagagucccagaccaguagauuagagggaggugguagaaagaauaugggcuuuggagcucuacggaccagagucuaacacuuugcucugccagcuccuagccauguggcuuugagccuuaguuuccuuuccuauaaaauggagacaaucagagucagccuucgugguuacuccgaacaguacaaugccucacauacagcguacucucaaugcaugggugcuuugaaaacuaauugauuugagagugucuugugaguccuagguuaaaaaagcagaggaucguguuugccaguccacccaagaggguucucaugugccaccaaacuacagggacuuaauuucuccaagauaaaaaucaagagaccugauuuuggccugaaaaaggauuuguuugcuucaaauugaugaacuuauaugaaaaucuaacaaugguuuaaagguagaauuauauccaguuguacauuuaauaaaauaauugaaaaaaguaaaauuacaggaaaaaaagaagugucccagaaaaucaggcaugccuucauacacaguauucagugccuuucacauuggaaacucuucaaaccuucuuagaagguagcccuguuuuuaauugaccugcauauuaucugaguauagcuugcacaugugauaauacugauucaguaaguugcuauaaagaguuacuuuauuuugggaggcauuuauuaucacuucuuuaaacuuauguuuaaaaaucucuguggcuuuauauauuagguagaauuaaauaagaauaaaauaauggcaaagcuaaacugcaucucuuuauugaguagcuagcuaggcaccaggcacugugcuaguuccugagacagaaaaaggaggguguggagaugguagcaggaagggaguacaauggcaccaaauccaucagcuuugccauugggaguucaguuauuggggagaaacauauaaaugugaauaucucaauggugaugucagacccaaguaaaacuucaaucccuccacccccuuuugagcacuuuaagaaauaguauuauuacccuuaaguauuuaugaauuugaauuaugugacaccugugagaggcaguacauaaauuuaaaaacccaaauccaagaccuuuugagucacugccucaagguuuagaucuuugaaaguacaagaccuucagagugucaaagaaggaagccauagggaugguacccaggucagcccccuuacucuauuaaugcaggagccagggugcccaggaagucucuguccccggacucccagugcuccucacuccaauccugggaagagcacccuugauacccauaugccugcagcaaguggguggggaggcugugaagagccgagaccugaacuccacccguucacucuguguaaccuacaagaaguuacauguucucucggauccugaguuuugccauuugaaaacagggauaauaaaaaucccugaaggcagacauccagggaugcugggaggaacaaaugagaggaugucugugagagauccuugagaagagagcugcaaacgcauguacacuuaaggcauuguuaaaacgacaaagcaggggcuaggguccuuggcacacaucaaauacucugguuucaaauuauccaugaguccuuccaagucaugcaaaagcaucuaguuuuuuuauguuucugugcauuucuaaauagcaaaugagguagagaaagcuccuaugugguugacagaucuuuaccugaugcaguagaccagcgccauaaacaaauuugagucuaaauaaagggaaaaguaucauuugaaggaggaaaaaaauggguauuucuuagaacacuaaagauauaugucacauuguuuccacgcccuuggcagcuggagaagcccuuuguucgucugagaauagaauaauguauuauguauagguuuacucauaaaguuaacauguuaggcauacuaaguuuaaaggugccaucuauucacacaguguuuacacauuuaguaauuuaauuuacuuuaaaaaaucuuuaguguggucacgaacaccugaaggaaguccucagcuccuugucugugaccauuugggagcaauuugcagaaaccugagcccaccagaaagcgccagcauuacaggaaaaaaaaaaaaaaaaaaaaaaaaaaaaaagccuggaucuucuggauuuuguguucucacaagugucaagcagauucagaaaucacugauuuuaacaaauggugaaguggggguaaaguggaagaaaaaacgucuuuucuggagacaacuuuugccacauggaaucuaguccaaucaaccucacucagaaauauauauuucuuccaacacaucguuucaauucauacuuccaccaucccuaucccacccucaucagaaaaucuagcagcauagaaaugcuuccauaugcuagaggcuggguuccccaauuuugcugaaggggaaugaagaaaaauguaguugaguagccagcuuucauagaggaguaaacacuuuguugcagcacauauagauugaguaauagcagcccucggaguucaccauaaauaauuuugcaagccugcaggccucggcucacugcuuauugagguuuugccacaaaauggccuauuagcauggauuuaauuauaauuuacauagaucauggaaauaauccucgaccaugaaaauaaggcucaaugauucugaauuuagaaauauuuaaacugggaguccacguauggcggacaguuuggcaucagaaacacuggaaucuagucccugcucucugaaucuagcuaauugagugaucuuggaccagccaccacaucccucugggucucaauuuuaucaaugaauuguggagauaauaguaaaaauaucuacaucacagaguuaaaugaaauugagucagcaaaaagcacuuugccaccuguccaacauuaaacagauaucuaugcuguuguugauauaaagcggagaguccacaagugcagugcagagagcuagcuuuagagccagacuuucugagagucacucuugauuccaauuccuuguguuacauucagauuuucuggcucuuggcuucuguuuugucaucuguaauauugggucaccaacaacuccuauuucacauugcugagauaugcauauggaagaaucugcuaacugugaaccacuccaaagggaccaugucuacauuugcucuacauggauccucauuccuuagcacagucauugguauguuguaaauacaccacaaauauauauauauacacacacacacauauacauauacauaugaugauuguuauguuacauauugucucagaacucagggcagggccagguaauauguuguuuccaacuguaaaucucuccaauucaggauuaggcaaguuauuacuuguuuuaucucucaauggcuguuucuucauuucuuuuccacgcucagauuuggaaauguaaucagagaggggagggaauacuguuccaugccagccucaugauuugcccagacauacagcuacugaguaguacagacagaaguggaacucaggucagguuaacacaaaacucuccucuuuucuucguucaugaaugcaucuaacaacuugaaaguucaacuguugccagaagaagcccaacacagaguaggugccagaacuggcugccuucauuuaugagcacagugcccacuggaggcaaaaaugaacacuacucuuggauuucaguacucuggcuuacucuagagaguuaggaauuauaaucaugcauuauuuugcuugguuguagguaaacaauucuccguggcccagucuugggaaauuauuuuagggaaaauucaaauaccugucuuaaacaucugaaucauucuacugcaauaauuuucuaauaaaaauauuuauuguuaggaaaaauuuacuaagccccgccccugcacuuaacaaaaucugugacaagccuucuaaauagaugcuguucucaauuugauacuuccaaagacaucuuaagaggaaauaaucaaaucgccaaacuuccuccagcucuaccuucuggcaaauagauuccauuuuuuccccuuuuaccccagccuuagacauauuuauugaucuaacuagcaaagucaaaauaguucuuuucuuuagauagcucugcuagcuucacuaggaaagcauguuugggagguuucuacauuagccauugguuuucuucuacaggagauaaaaagaaaauucauuuauugucacacgugggguuucacuuuaaaaugugcugcaagcaacggaacgucauuucauuuuaucuaauuaauggcuaccauggguuaaguauagcauucugcuuagaauucugugcguaggauaauuacuacagauacauauacaaaauguuauugauacauauaguaaugggaguuuuuacaauauuaugcuuuuaaagccuuuuaggaauaccauggucaugucuaguaaagagcagugugaaauuagaauuuuaaaaugcuaauauggguaucaaauaaagcugagcauuaacccuuguccauggcagauaauguuagauucaucguuauccuacuguucuaccuugacuagauuuguucaugugucucaaaauuuauuuauuaagcaugugcuaggcauuagacacacaguagucaauaagacaggcaucugcccuccugaaguuuguggaacugcagggaagacuaauauugaauaagcagcuacuggcaaugcugaauguuauuuucuuuaaaggcaaguauaacagucaaaauuaaauauucucuuuuucugaggcuguuacaaauaccauuuucuggacauaugcucuuucuuugccuagaaugucuggcuuggcuucccugugaaaggaaucuuggagacaaacauguugucccauguguucccugacccccaaagcagaauuagggucuuugcugcacuguguucccagaacaugauucaagcccuuuuauuaagaggcuguuuagugccuucuaagggauuuggcccugaagucaggcuccuuggauuugaaucaaagcucuucuacuuacuagcugugugcccuuaaauaauuaaauuagccucuggccuccacuuccccaucugcaaaauggaaauuuauaauagcauauaacccuuaagauuguugagaggacuaaauaaauucaucaacuaaaaagcacuuaaaacaaugcugggcaugaguauaugcuuaauaagcguuggcucuugcuaucauaccacuaauuaauacuuuauauuuagauuggaauuaugugcuuaacaugagacccucaauuuacucaucccuucauuucuagcacuuagcacaggguuuggcacacaguaggugcucauauaauauuugcuaaauuacugcaauuauggugaauccucauaaccaugacgcacagggcccagaucaaggaaacuugggucaauggcacucuaggaacuuggcuuaugccccacauaugauuuuguuccauuucuuggugaauuaccaguaagagggaaaaaaguauguguaucuuuuggacaaucucuugaugugcuccuuggcucuuuuauuuaaaugcaugcauguucuccuuggguuccuuggauaccauagaaaauaacugacauuucuuuagauucagucaacacauucuuugaaugaacaaacaauaucaugccucucuuauuuuaauuaugccaagcugcauguaugagaguccuacaacacaaugcaauuuuauuuugucaagugccuuucaucucaagcugcaucccuggcauucaaguuaaauaauaaauuauacagcacaagguguuuagggaggaggagaguuaaaggaccaaaacaaaggaggaaagcugugagaacagaggaccuauaaucagauuuuucaggacguccagcucuccauccaguugugauuguucaguaacguuucagacagaauaacuggaauggggaugugguuuagcaaauggcuuaaacaaugguuuugguuucauggugaugacacaguugcacuguauuugucgugcugcuuuggagcucuuuauguaccaugcagcgcuuucuauuuagaagaacaugucucaacagacaaaaugcuguucccccucuguguugucagaagagaauugaaauggcaguggagaguucugauggguacugcggaguccauucaugucugagaguaagagaaugagagaucugauacugaaauaaugagaauuaacauuuauugauacucacugcaugccaggcauuauuguaugugcuccaaauacuuuauuucaggggguuagcaaacuaugacccauaggccaaauccaccugcagccuguuuuuguacagcuugagagcuaagaauguuugcauuuuuagaagauuguuuaaaaaaaggagagaagagaaauaauagauagaagaagaauauguaacacagaucuuauauggccugcaaagccuaaaauauuuacuuucucuuuuuuuacggaaaaggcugcugaucccugcucugucucauuaauacagcccaugcaaugaugugaaaauuuuauuauucccauucuauaauuuggauacugagucuuaaaaaggauaaguacuccccugauauuacacagcucgucaguaugauagcuguccagggaucacaaacucaaauacuuauaggacuugaguaauauaaaugaauaauguggaaccaguaggagcugugacagugcagagggcacaucccccuuuuaaaaaagauugccgcagugcagcucagccaauaguggcuuugcaguaaugguugacccauguugccuagauuuucugaucuuucaagaaaagucagaaaaccagauuuuuauguaaaaucuccuaauuuuuaaauguuaguaacugauugaaaaauuuuaaaauacucuauugauuaagcaaagcauguguguagacugaaugaagcccaagagccuccaguuugaagccuuuauuauuaugaauucagcugguauaaccccuucacuuuacagugagaaaacuaaagaguugaaaggaagggugacauuuaaguaagauuacagagcgagugaugggggagccuaagcuauuugccuauuauuauuuugagacagagucuuccucuguugcccaggcuggaguacagaggcaugaucucagcucacugcagccuccacuuccugaguucaagugauucuugugccuuagccucccaaguagcugggauuacaggugugugccaccaugccuggcuaauuauuauuauuauuauuauuauuauuauuauuauuauuauuauuauuugugagacagagucucgcucuguaccccagguuggagugcaaugguaugaucugggcucacuacaaccuccaucuccuggguucaagcaauucucccaccuccgccucccgaguagcugggauuacagucaccagcuaucaugccuggcuaauuuuuguauuuuuguagagaugggauuucaccauguuggccaggcuggucuugaacuccugaacucaggugaucugcugccuugggcucccaaagugcuggaauuacagguaugagucacugugcccgaccuggcuuuacauuuuaacucucuauugagcacugcucuaauuucuauuuaguagaacagauguuugguaaguaggaauaauuucuuauagacuuaucuaaaccacuaggugcuauuagaagauaacagaacaucacauggaaugggaagguacacauugaaggucaucuagagccucuuucuccuuauaguuuuggaauaaucagagaggguugcuaaaacgcccaaggucacacagcuaaguuggggcagaagugagucucccaccucagacucagcuuuauuccaguaguuucccuugccucauuaugaacucugaaucuuugaagugccucuccaaugucuccuuuacuaugccuugugucauacccagaguaugguucuaguugagccuaagcugagauucaccccucccacccaaguuggaaguuggccugaguuaacuugcuuucaggguggugaauucuaagagagcugaagcagaggcuagugagagaaaaagggaggcagaaugacagcauuuuuucagcuagugagagaaaaagggaggcaggaagacagcauauuuucccaggacaguaaggcuacaggcagcagcugacagcgcuguguucacaagggaaccugugagaucgagagcacaaguaaugcugccuggggcccaggcagcccugagcggaagaggggcuucuuguuuuuuuugcagugaacacagcacaacccugcugagggcuggagggaaggaacucgaugucuuuccacaccuuaaggcucuugcauauuucagaauacccagaguuaaaacuccaggcauggugugcucagagaaggccauagaagcagguaacagugagggucuaccuuugacuucaaaggugguggaaaguagugaguaucuugcagucaaagcagcagagaaggcuaagugugugagacaugccugggcuccuggggagagugugcaguaggagaaaugauuucugagguucuguuuacgcauauuaugcacauagggcagaacgacagugugauggguaccaucacuguucuuguggucccauuuguaccugggacaaauuagguuccauaugauguggccagcauagagaguacagucuaggcacuacucgaagugugguccugggaccagcagcaucagcaucaccugggagcuuguuagaaaugcagaauugcagccccacaccagagcuacugagccagagcugcgcuguauaacaagauccccuggugauuugugaugacgguaagguuugagaagcucuggccucgguauuaggaguaacagcucuaaagcaaacuguggguucuaaucuaagaccugccacaucuuuguugugugauauugaccaagugauuuaacauuaccacaccucaauuugcucauuucuaaaaugaagauaauaaugguuuuuauuuauaguguuguugugaugcuuaauugagauaaccugugaagcacaguaauugagguacaauaagcgcuuaguaaauauuagcuacuaucaucaauuauuacuuucugcaauccaggacuucuuaucaaagcauuuguagaagaggauuuucuaguucccuacuguugccuuaccacuucccuuaguaacucaaugagcuguccaccccaacacagucugccaguaauuauaauauuaaaaacagcauagcugcuauuuauugacauucuucaaauuauuagaaucugaaacuacagaucaaacaucaucccgguuacccuuacaauaaccaguuaggcagauguuauuaucuauguuuuaaagaugaugccacucugccucccggauucaucuauaauccuguaaacaguggagccacagugcuucucagagaaagagcucaagacccuuguauggguugaauaccucuuaaaauacuggccuggaagaagaguuugaacuucaguuacacacagaggaagaaacacacuucuaccucuguucuuucccuaacaccuacuaaaaugacagagaaaugauaagaaagcagaaaacuacaaaggaaaaaagaaccaaugagaagacaauagcauuuuggaacuauaaagcagauggacaagaaauaauugacaggcagaccugagaaagugaaaccuaagcuaucaguggaaaacauccagaagggaucugauuuucauugcagagcacuaggaaaccucagaaaugggaagccucaggcauuucugaaaguaggggccugggugggguuggaaaaaaggaaaauugguuguuugucuuaagguucccuucuccguuuuguuuuccugagugccugcacugucaacccccaaggagaggacuggagauuuacugacuauaguaagugagccugagaaagucuggacuucuggaaaacagcucagcuaaagguagauauacugugcuuaaaaaaaggaacaggagaaguaaaugaaaucuguauagaaauggugagacuaucucccaauggugauagucucagcuacucaggaaacugaggagcgggggaaucacuugagcugggaagguagaggcuacagugaacugugaccacagcacugcacuccagccugggcaacagagcaagaccucauuucaaaaacaaaacaaaaaacuaaaacaagcuucugaaaguuaaaaauaugacagcagaaauaaaaaugucuacagaaggauugguaggcaaagcugagaaaaucucccaaaaguaaaacaaagagacaaaaauguagaaaauaggaaagagaagauuaaaaaauuagaaacagucugagagguucaauaucuuauucaauaugugaauaagaugacuuuggaacuagagaacaaagaaauuaucaaugaaauaaacaaauuucucagaguuucuagaguagaagaacucagccacaguucagcacauuggaugaaggaagacccacaccgauccucauauaauuuugaacucugggaaaaggagaccauccuaaaaauuugcagagagcaggaaaaauaaaaaguccacccaaagaggagaaagagacaaaauuccgucaguuuuaauaagcaacgcugaaagcaagagacaauaaaaccaucagggucauuaaaauaauaaagaauguacuuucaaucuagaauucuauaaccagccaaagcaggucucaaaaacuuuaccuucuauacacuuguucucagcauaaagaggaaaaaaacaaagaggaagauacaggauccuggaaacaaaagguacaaauacaagagagagauccaauaaaaucccuaggaauacgguggcaagggaucuuaaaacaagaacuaugcagcaggacuagaaaguaaggagccuauauugggaacaguuuagacaaaaggaaauaaaauuucuaugagaaagggaaggggaagggaggagaggggaugguaagggaggggaggggaggagauagauugauauacugcaauguacugagagaagauuuauaauuugauaguuuggggaugaaauagcaauagguaccuaaaacacuaagcaaauaugaaaggaaaagaggcaauuauuaacucaagggaaaacaaaaauuaaaacaauauaguacauaauaguacacuacauggcuuaguugagaguaauuuuucacacauaauaaugacaauacuaacauuaauaaaaauucuaauguaagugcauugaagauauagggaaaagggaagugucuauaaagaggaaaaaguuaaaugaucaucuucaauaguaggaaguauacugauaguuucuaacaauuaaagaaucaagaauauaguagaagcagaauauuuagaaauauggaaauaaaauuuagaagaaacagcucaaauaguuaaaaugguugccucgggggagagggaauauuagguguaguuggauggugaauuguaggucaguggacucuguuuugcauuaaauccuugugugauauuuagcuuuuaaaauuauguuuaugaauaacuuugacaaaaauaaaguugaaaaagaaguacuggcauuuugggccuccaagucuuauguugaagaaagagggcucuaaggauagcaauggaaguagcaggcagaacauuacugggucuucuugucuuccugaaaaaugagagaaaacauaguaagaaucaucuagagauagagaggcaagggagagaacacugaccaaaucaggagcuaugaguucuagcccugauuccaucauaugugauccuuucaaaccucaauuuucuuaucuauaaaacaguauuucuauucgaucuuccucacaaugcuguugugaugaucaugaaagauaauagauguaaaaugcuuuguaaauuguaaagcacuccacagauguaauggauuaucauuauucuacccacguauaagauuggcagacaguuuacuauauuauaauuuauaccaucuggcuuauuuuuguuuuuuuuagcaaaacuuuucuuauagcaaaaauagaaugaauuccuuauggaaauguuuaaauacuaaaaagcaaaaaaaaaaaagaaacuaaaaauucauuuuaaucuuauuaagaaauaacuacugguauuauacauuugguauauauauaagauuauuuuccacugaaauauauauuaugacuauuuccccaaauuacauauuuuucuacagcaucauuuauuauuugugauggaagaaaggagcaauagauagaagacugauagguuaaguaaaaacugaguuauaaguuugguauaaacucauagcaaauuuucuuuucaaaaaauuauauauauccuagccauuccaauagaaaaaggcuagaaacaauaccaacccaguggcgaugagcaacuccuaguaacaagacugugguuucuaaaaaacauuucccauuuaaaaagaaaggaggagguccuggacaauuucacgucuggcuuaggaaagauauaagauuagccuagaacaucuuuuauuccagaaagaaagaaagaaggcuaucaaacacuugagaaucaauaugaagauguuugccacagaccaaagaugggacaauuuggacaucaauauauaaaugaaaauauauuaaacauauuuaaauacaugagcucauuacugauuuauaaaauagaaacacacacacacauugucugccucuggaagauucuuuuuuuuuuuuuuuuuuuuuugaaugaaugaaugucuguuuuuauuauuauuuugggggugggagaacagaguugaccuuccuauagacugguggcucucagcuggggugauuuugccccccagaggggacauuuggcaauguuagaagacauuuuuguuugucauaauucggguaagggggugcuacuggcauguagugaguagaggccagggaugcugccgaaaguucuaccacaugccugagaguggccgacaauaaaucgucagguccaaaauguccauaauugucaggaccaaaauguccagcugaggugagaaacacugcuguaaagagacagugagaaauaggauuggaggaggaggagcacaccuuauaccacaccuuuaacgucccacaaguauuuuggauuauuccacaggccguuagaaagccagugaagguuuuugaguagagaggaugaugaaggucauguuuaggaggauuaaucuggcuguuguaugcaggaugcauuaaugggugggcgggaccgccucuggaagauucuaaggaaccaacucauucuuuggaaaucuggcaaauaaaaugaaaaaaucaaauauuuauccuguccuuuuggguaaccaaauaguugaugagaggaaguuucuuuuuauugaaguauuccuguuaaaaguaaggaagcaaugauagaauaucaucaguuugcaaacucuagugagaugaugaauguaggaaaugagcaucaaaggcugcuaacaauacaaagacuugugaaaguacacaguaccaucuauaaagcagucuugcaaaaaaaauuaacucugaauuggauugagccucuagaauaaauuacaaguuuacaggaaauauaagacauagaagaacauguuaaaccacaccagaaggcugcaaucaauaaccuggauugcaggaaacucugcaggacaaacaacccaaucucuuuaaaaguaauguacaaugggugcagcgcaccagcaugacacauguauacauauguaacuaaccugcacauugugcacauguacccuaaaacuuaaaguauaauaauaauaaauuuaaaaauaaaaaauaaauaaaaaaaaacuagacggaagcauucucagaaaaaaaaaaaguaauguauaagcagggaaaagaauagauggcugaaaaccuauagacagagacuuaagagauaaaucaaccaguuguaacacauggaguuuguuuggauccugaugcaaacaaacgaaaaaaagagaaauuuaugaaacaaucagggaaaguccuucaaaauaagggggguagggaaggguguagauaaaacaagauuggacaugaauugacaauaauuaaagcuaaauaauugcuauaaucaauuuauggauuuuuuuauuuugggggaaauuuuucauaauacauuaaagaaaggucacaaaaauauuaugacuccuuuccagauucauuaaaaauucuucuauaacaugaucuauaaugacuguauaauacuucaucauacaauuguguaccauaauacauuugaucauuuaguaguuucuugacauuuaaauuguucccaauuggccucuauugcuacuaacacugaugaaaccccuuuauauaauuuuggggguccacccaucauuauuuuccgugaauuaauuucauuaaauguagacauagauaccuaggucaaaagcuccacacaauaaaagguuuugaguauauauugccauauuauuuuuuggaaagguuguaccaauauauacccauuggcgguauagguaaaguuaacuguuuucuguacauguuauucuucucuuacauuuucucauuugauaagcaaaaacaaaacagaaaaacucaauguuuuuguuucuuguuuucuuggaguuauuaaugauuuaaauauauguuacaugccuagcuguauauguuuaugguaaauuagcuuuuuauguccuuugugcuuuuuuuuuuuuuuuuuuuuuuuuuuuuaagacacagucucacuccaucacccaggcuggagugcaguggugcgaucuuggcucacugcaaccaucaccucccaccggcgauucucuugccucagccuccucaguagcugggauuacaggcgccugccaccaugccuggcuaauuuuucuauuuuuaguagagacaggguuuucuuugugcacuuuuuucuuauaaauucauaagaccuuauuauauauuaagaacaguagcacauuuucauguauguuucaaauacuucccccagaauuuuguucuuuguugauuuuuaucuuggauuuuaaaauauacaaacauuuuauuuuuuuauacacugacauuuuucuuuacaauaucuucuuuaucaucuuacauuuuaaaaggucuuccuucuucacauccaaaaucauauacauugucaccuauguuuucuuuucauauuuuccuuuuuuacauucagugugaacauuuuuaaagacauacuauagcccucucccagugguuugucaguuaccucaauacaucaauuaaaauguguaucuugugaaacuaauuugaaacuucaguuuccucuggguuacuuuaauagucgacagacuugauagugauaauauaauuuaacuuuugugagcagcuacuaugugucuuaccuuguuuacuugcuugagauuuauuuaaguaaauauaucauaaucacugugaucucugugauuaaauucauaggcuaugucuauauaauaaaauaguuugcaacuuaguacagccauuaugaaaaacaguguuaaaagacaaacuuuaaauuuaaaggaguuuaauugagcaaugaaugauuugcaaaucgggcaggccccagaaucacagcagauucagagagacuccauaggugccucguggucagaacaaauuuauagaccaaaaaaagggaagugaccuacagaaaucagaagugagguacagaaacagcuggaugguuacaguuuggaguuugucuuauuugaacacaguuugaacauucagcuguguaugagugguugaaguguggcugcugggauuugccaagacucagcuauugcuauaggcgcuuacuccuaaguuaggcuuucaaucuugucuaccuguuaaguuagguuacguucguccaugaggacucaaguauggaaguauggaguccuucucagaccauauuuaguuugcuuugacaacaguauggagguuucucaacaacaaaacuaaaaauagaauuaccauaugauccagcaaucccacuacuggguauuucuccaaagaaaaagaaaucagcauaucaaaggaaugccugcacccccauguguauugcagcacuauucacaauagccaaaacaugaaaucaacuuaucucuccauccacagaugaacagguaaagaaaaugugguauauauacacaauggaauacuauucagucauaaaaaagaaugaaauccugucauuuagcagcaauguggauggaacuggagaucauuauguuaaguaaaauaaaccaggcccagaaaaacaaaugucucauguucucauucauauguaggagccaaaaaaaugaucucauggaggcagaaaguagaacaauaguuacuagagucugggaagcauuggagguuggggugaagagaggcugguuaauggauacaaacauacgguuagauagaaguaauaaauuccagugcuucauagcacaguaggguggcuacaguaaaccauaauuucguguagauuucuuuucuuuucuguuuuuugagacagagucucacucaguugcccagacuggagugcagaggcaugaucucagcucacugcauucucugccucccucgagcaauucuccugccucagccuccugaguagcugggacuacaggcacccaccaccacgccuagcuaauuuuuuuauuuuuaguagagaugggguuuugccauguuggccaggcuggucuugaacucuuggccucaagugauccacccuccucagccucccaaagugcugggauuauaggugugagccacugcacucagcccauugaguuuauauuucaaaauagcuagaagaucugaaauguucucaacacaaauaaaugauaaaugacgugaugaauuauccuaaauacccugauuugaucaucacauauugcaugcauguuucaaaauaucacauguucuccauaaauauguacaauuauuaugaaucgaugaaaaagucaaaugucuuuuaaaacauaugcaaguaugaaaaguaauacaccaauuuccaagguauuauacacauauauacaccuauuuauauuuagauggauagaacuauuuuuaagauauauuauacaugaaaaauauaaugugcaaaacagaacaguguauaaguccuaauuguccuacagauugauaaggccuugaaguacugaauugcagucugguuugggaguaguaaagaauugauuuucuaggguuguuguaaggauuaaauguaugaauauguguaaggcuuuaggucagugucugacacgucauuuacaugaccaucauuagaaucacccuacagagacuuuggucauuuaguggaggcucuuuuguuuauucugucuguuucauucuugauuaccucacccauggucgucuggacaaauaugcagaucuaaugaaggcugcagaauuguaagacuaagaaauggauguaauuuacuuuugcagaggacuagcaccugucaccugaugcaugaaaaaagcaaauccacaugaguggcaaggaagucuguuaggcaaaugaugggaagagauaggacaaaaaauuggcgcaucccuuuuggagagcaucacauggcauuaagcaugcaggagaaugcuuuaggagagcucuuuuugaggagaccagcccucagaaagaaacauuaugcaagcaaugucagcugauacacuuccucucuguugugagaguggaggcugaccuaaucagggggaugcuuccaccacggaguuuugccagcucguuaccuuugaccacaacagaugcugcuauuuucugaucaguguuuucccugcuaucugggagcaaaugucaguggaggaguacaaucugacaucagaaccauuacaggcucaucugaauuugagccccacugcccaaaucauaugccuucaaaggcagaaaguauaccguuggcauggagauggaguaaguuuguguaaaauacccccuaucaacagugcauagguauauauauguucacaggcauuccacugcuuaggaaggaggggagcccacauucauucauucauuuuagaaauauuuauugaacacuuacuuuguggcaagcacugugcuaggugcuggggaucacaacagugaacaagauacuccuggucacuccacuuaugaaacucauauugauugcaguugggcagauuuaaaaaguaaaaugaaugcagaaacaaguaacugcagcuucuaaaauauaccaugaaggaaauaaacagggugcaaccauauagaguaauggacaagauuagccauaccauaaaauguauugccguucaugcagagcucacuucacugcuaguauuauuauuauuauuauuugagauggaguuucgcucuuguugcccaggcuggagugcaauggcacagucuuggcucaccacaaccucugccucccagguucaagagauucuccugccucagccucccgaguagcugggauuauaggcgugggccaccacaccuggcuaauuuuguauuuuuaguagagaugguguuucuccauguuggucaggcuggucucgaacuccugaccucaggugauccacccaccucagccucccaaagugcugggauuacagaccugaggcaccaugcccggugcacugcugguauuauuaauuguaucuguccauccauccauccauccauccaauaaagugugguagcugagaacaauccaagguggacuuuggccuugccauuuauuaguuaugugacuguauaauuugcuuaacuucucaguuuucugacccauggauuagggauaauaauuauaucuaccacaaaguauagcauuacaauuuaaauaagauaaugccuuuugcucauccccuggcaaaaugcucaaugcaugcuagcuauuguuguuauuagcauucauuucuucacucagugaaggaauauuuacuaagaaccuguaagugccaguacuuugcuaaacauuucaggaugaggggugaaauggaggacaagcuccaaucauuucccuuuuagggaauauguauggugaacccaagcagaggcuuuccccuuauuuucuaugagauaauucaaaagucauuguuaaucaccaaauccccaaacacuagcuucuaauaccuauaagacagaaagacaacucacagguuagacaaaccucacagaaagacagcucacagauuaaauggagucagucagacagaaaaucaccaccagccucaccucuuggcuuuuaaaaauggggcuaugcugggaaaggcaaguggcuugggaguucuggagagcuggauucugauucugauucggcugagccagaaccucacaagccucaguguguucacucucccccucuaguuaucacaauucuaugugauaacacaccguggaagcuccagggccacacagaaggcucuucaagaaugucucuuauuccuucuuuuaguucuagccccugcucugccucuuuguuugaaccucucugggucccucuuccucuuggugcacacuggaaguaggauuccagcaggcguggguacaaggauugagucaaucaacagaugcggaggcccuuugaaaaggugaaagggcuaugcuguguaagguguuauuauuauuagguuggggaaauuacccacaggguaaauauuucugugagacgaaaaucagagaugcagauguaaccucaccagggaacuauuuacagcaacuuuuccaaagacugagacuauccucuggcaggcacuuuucucacccucuaauuauggaaguuugauggcauuuaucaguagguguccaaauccuaaguaaccaacuugcauauuugauguggugucagacaacaggcaugaggcauugccucuugcuccucagugucuucuugcuuugaaguacuuacucccugaaacaauuuuauaguaacagcuggacucugaagggaaggauuuuuuuuuugcaaauaaauacauuugcuaauuaaaacuugcccuuuaaagacucacauuuucuugaccccacuauauguuuucuuuugcuuguaacauaucacagaaucaauaagggcaaugcaaacaucuuuaauauauacaguuucaacagcucucauaauguaucugccuccauaagaaugcccucucccccucucuagcccagcuacuaauuuccccugauuuguuaaaugccuccuuauuucacucucagagauaaaacucaaaacgcaguuacucuucagggggagugggaacgguggauugaaaagggauaaagucaggggagggggaaugaucauagccaugucuuuguguuuuuuuaauggcagcuuuaaaaaguuuuuauaauggaauaaugaauguuuauaguaggaagauuauaaaaugccagaaaaaguauaaagaagaaaauauauauuacucauaaccccaucacccagaagaaaacacgguuaauauuuggcauuuuuuucuucagacuuuucugcaagaggguuuuuauguagcuaacaauuuugaauucucuuuuaaaauauuauauaugacaauacuaacuuuuuuauggcacgaaaaacugcaaaaacacuuucgaguagcugcauaauauuccaacaaaggcuguccuccaguuuacuuauuuuauuugaccauuuaggcugcuucaauuuuuuucccauuauuacaaauaauguacugucauuauauccaaucuccuguuuuucugggcaauacguagagcuggcuguuuggaggucuuaggcugaauuuuacaacuaguguuuccuauggcacagagcagccauauaggagaaucuccgguuagcuauagaguuagauuauaacaugguagcaacugaccuuuuuuccccccucuaaaaugcucccugaauucuacuuccuccugaauacucuugacaucgcaaugaguaguaccaccuucuauugagauacccaagcuugaaaacugagugucacuuugggcuucuccuugcuacccccauccaaucagaaaucaaaaucauccucaaucucucucaaaucucuccucccuuuucuggcuucauugcaacugccuuaguuucccuaaaugaccuacuuuuuccugccucuacucuuccuaagucaccccaguuaauccauuucucuacacugcugccaaaucaucuuuugaaaacacacucaagaucacauccuuccucuucuuaaaagccuuuauuaacugucuacccuccuucugccccaguaccugaacuuucaggauguuuggauccuuagccuccuucaggcccugucaaaauccaauccuagaugcuagggacucaucuagacuccuccaagacccucccccaauauguccaacucugcuaugagugucucaugcuuuuguccaugucaucauacuauugccuguaccuaaaaagcaucuccccuccuuucacggucuagcuaauuccuugccuucaaaacucagcucaaggccagguaugguagcucacaccuauaaucccagcacucugggaagccuagggcagaggauugaugguauuugagaccagccugggcaacauagugagaccucaucuguaaaacaaacaaacaaacaaauaaaauuaguuuggcguggugugguggcacaugccuguggucccagcuacucaagaggcugaggugggaggaucaccugagcucaggagguugaggcuucagugaaccaagauggcaccacugcacuccagccuggaugacagagugagaaccugucaucuccuaugggaagucuucccuuacucccaacaauuccauugggcaucccucaugauuagauucagguuauucaugucuaccaggaauaucacagaagugauauguccuucccagugcacuauaucaggggccacuugaugucuauuugucacauuccugcuaauacugauuuuaaucacucaagguggagucuuucagguuuucuauugaaaaguuacuauuuuccccuuugaaauuaaucaguaucaugugggcagauacuuugaaccuauauauauuuuuuguuucucaacauacuuucacccacuacuuuuagcaucugggucucauuuuucucacuggucaaaugaaaugcauagacugaaagugauuugcaaaauuaucacucucaaagaucccuuucuuauacucccugucuuggaucuucuguaaugaaagaauuuguccaccaaaccaauguuacuccuucagguacaugugucucauuuucucaguguacauucaugaaacaugccuacugaacuguaagcucagaaaacagggccuguuugucucaccacugaaugccgagaccuaucacagcaccugccacaaaguagguggucaagaaauauuuguugaaggacuaaaucuaacugccaaucacagcugaugcccagcauuugaugucugcagugaggacacaaaguugauaaaugcuauucaaaggcagagacuugacauuuuaguuaaucucagaggcuuugucacuggucacuguacacuuaucauaaagauuuuaaaaauagauuggacagauuguguggaaacuucccacccaccccaacccaucccugccuuucugagaugcccuaguuaugagauguugaaggggcauuccagcaccccacguuuauaaucugugaugccuuuauaaucagcauauggcaacuggcuagacagucuccucaccacacagaagaguuuucaaaauagccuaccccuccuuucacauuuaugugaaauuagcauugucacauuuccuccuucauugacuacuuuagaucagagagacacacuguagcagaagaucaugaaggaaguugucuuaaagaaggaaacuaacauaaauuaagcaucucauauacacccagugcuuucuuuccauuguucucucuuuuaauccucaccaaaacuggugaagucgguaucauccauuuuauagaugagaaaacugaagccggguaaggggaaauggcucgcacuaaguccuuuagccagcaggcagcagggcuggagugggaauuccuccagucucuuccccaaagcccuuccaaguugccacucagucaaacuaccgcucucaucacauaaaaaugcccuucucuuggaaaugugcuugccaucacgauccaaacauucgagggacagaaaucucuuggaccgcaaucacugcuauuuuuuaagugauuguuaucacgacucaguagcuguuaccaugguuuuggggaaguuguccgaggaaggagggccuuucuuugggcaucuugcaugccugaagaaggaacucaagaucucagcucuuaauuacucugauugugcugcaguagcaacuugaaagagaccgucccuagaaaaguguuggggugggggguguggaguaacauccagcgagcaggcagaagggaggcccugggcgccagagagacccagggaaaggcgaagaggagggagaggggacgagaccgugcuacggggagccuggagagaaagccaaaggaggaggaaagaacaaaaggcaagaggagaggaaguacaagaaaguccagaaaggaaaagagaaaguuucagaaaggggaagagaaagcaagcaaggaggguaaaagaagaaagagaccagaaagauaccgaacugagagagcucggagaacucgagaaagcaaaggagguaaaaggagagaagauggagaaggcggcggagaggaagggggaaggagacagaggaaccgagacuggggugagggagcggccgcgcguggcccccggagaggcgcccaucaccugcguggcgcccccccgcgccggagugcggcccugcucccagcgccagugcgccgcgcggcucgccggccucguaggauuggcuaccgccucccauucauguaaccugcgugugcgugugcgugugugugugugucucucucucgcucgcccucucuuucuguguguaagagagcgagggugggggacggaggcaggcaggcgagcaggcagggaggggaagaagagaagggaagcuauuaaacacacacacacacacacacacucacacacgcgcgcgcacacacccgccccaaccccccagaagccucgggauugcagcuguuucauguggggcagcagugcuggcagggacgccggccgggagcggccgggagcgggagccggucgugcgcgcgcggcuggaggcucgcuggggcuccgcuccccgcgggagcuauuguuggucucgcuggagcugagcgcagagcccggaccugcuccuuccugggcgccccgcuacggcucgcggagcagaggagccgcgccgccgagagagagaggagccaccggcgcggcgccuugccucccugccgccguccucgccgcuuccccggcgguagcagccugcagccacgguaaggcggcgugauccgcucuacggaaaagcgccuuggggaccgcggcgacgccucgccagcuccaucgcccucugcacugcuggcccgggcaggguucggguagcucacgcggcugccgagggcuccgggagauguuugcuugcuccccuggcccaggaggagggaggcuagggcgcggguggccgaagaggcaagcuguucuggagccuggagccgccgcagcccccggagcccgccgcggacuggagccugggagcaaggguugggggagggcagggaggugggaagcgggugggagggaggcggcgcgccccagguucgucugccucucccggaucccguuccccgccccggcccggucgccugcagccccucugcagacuagcucgccccaggcccccgucgggcgcuggaggagcccgcgaggcggcgccgggcuucagcggcugcagccugcccugcggggcaagugccggcugcagcagccccgcacgggcggugguuggagcucagauccuggagaugcgaccccagcuccucgcccucugcaacccgcggggcgcccgccucuccucaccgggcgcccggccgcgguauugauguucgucuaggagccaacugaggcugcagccgccagauggacgcuuggagggcucccgggugugagugugacuguaugacuacucucacccccagcuucgggaaaugugcucuggguugaaaugugaucaccgagcuccucagucauuuuaauugccauuuuuaaaugcggucguuacauuggaggagcagacuggaagguaguggggcggcguguguguguguguguguguguguguguggacacacacacgcaaccgaggaauacacaaccaacuacuugggugaagggcgggggguucaccuagugaguccuucuuggcgggggggucgggcgaguuagcugcccgcugcccgccccuucucugccugcccccgccuaggcgagguuggaaaguacuggaaauucagcugcgugguccuuaacuuuggaaauuggcuccgcuuucagggcaaaauguuaaggcgauuuaugcacccgcguccauguggaugaguguauuacugcucaguugggugcagagcccucaacaguaccgcgccaagcccccacccgaucucuaacucccucccacccccuaaccguggagagaggguuuauagaaaugcaguuaucuguaaaccaucgacgcagugaaaggggcgcagggaggcagccagaguuuugccugaaccugcauacuggcuugguguuuguagcacacgagaucaccccgcugcuuuguagaaggcggugguggggcaagcucgggauuccaaucgccggggugggggguggggggaagagggugcccauguacugagcucugaggccgaguaaggagagagaucugcugagcggcaucgcgggcaauuacauaagcugccucggugauuacccggaacugugaugcgagcucccgguucucgaaagacaagccugaaaguuugccugcuuggggaguguaaguaccggggcgcccccaccccggccuggguagcuaggauacgccucgcaccacggcgcccacuugugcgaugggcgucgggugcugaugcugcuguccccaaagaaccgguuaccgaggcagggacuaagugggggcauccggaauugaucgcagaggaggagucagucagaacugagguuucauugggucuucagagcuccaagucuucccucggagguguuggaaggccuuccagggaacgccguuuucagaaacugacuugguguccuggggagccccaaagccccucuuuuccgcccuuccugggcgccccuccuugucuuucaagcccugugcccuucacguguuuagaaaccugcccgcggugccuggucccccuuggagaugcccaggcagcccagccauccaggcccacgcuggcgagggguuagagggaguagaacgcuggcucugccgggcugccacccuuaccuacaccuauuccugguuuccugcgcuagcccggcgcugauggggacgggauggggcuggggucggguauggcuuccguuccuucgccucucgccucugcagacagcaguuugcuucuguugcguuuauucuccccguuucgccgcuucccuccagcgccgcagccuguguaucacguugaugggcuuugauagagaaaccacaguaagaguaugcuuuuaaaucuugauuuucgucuguagggggauaagccaccccagcccugacacagccguggggaacgcugaagucugggacacauuggcccugaacucccuuccccccagcccgcagucaggagauggugaugugcauggguggggaguguuuuguuuuugccacauuccagcguccugaaaccucucguccccucccacugaaauccccgaucugucugaaucuguuccuugcuguaaaauaaauccucccucccgcagaccuguggggcccuucggauuuccugccgcugccaugauccuuaacaaugcgauugaaaagccagugcucggcuggaaaaaaauccccaggugccagccggccgcgccuugaccuugcugaaggagccuuuaacccggcugccagaggggcucugguccagccgugggaauccaggaagaaggagggcgccccggaggcggcuggguuagcuccccgggcagggcgggaaucaggucgcggcggggaccgcagagggggaggggacgggacuccgcggcaaccuguuucccggcgagccgggcccgcgcaucccagcucccucgccccagccccucguggcccgccucccccgccggccuccaguugucuucgugguacaggagucggccgcgacucccucgcgcucuccgccggaguccgcgggacgccgccaacuuugggcuccucgguggccggagcagcggugcgaaccagcggggcggccgggugggcggggccugggcgggaaacuggagccgagaagaccgcguuccaggccaaguuccagccgcaagcgccgcgcggcacagugcagggucccggccgcgccuuucucccguccccggcccggccgcguuccugcggacucacagcgcgcuccgggcgcucugcaguugggcuuucagcgggggagcccuucucgucaaaguuacgagggguguuuucacugguggugacagugggaacuaguuuucugcgcgccugugugugugugugugcauguguuggggagcagagagauuugcagcgaagucacacauagcacaaaaaacagguuuccccuuuccagguguuauaagggaaugcugaggaggaauccguuuucuccggugaggguguugacgggaagcccuuccacuuaguggaacuggaccuguuggagcugauugccuggagugaacgggugucuccuuuagcggcaccugugugccguagguccuuggaaauguuuggggaacugaaaguccucaagauauucagccaggacuuagggcauagauguuugugugcuuuuagggggcuaauucggggaagcuuuuauuuccagcaugugucuugaacugaggggagggcagggugcggaaggcuuguggaauugccaucuucuguggugggggaagggaucagggacggagagcuuugguuuucuagaaagaguucuuggguucuuccucugcucucaucuuguuuucaucaaggccucuguuuggggguggagguagaguggugcgguaagcggaucagccacccuaauagaccggccuugaccagugcggaugccaacgggcagaacuagugcuuggucugaacaagaaccaucaaaggauaguucuauagugaguggagugaccuggaauaugagguagaaggcuagguguuagaguaauggguucccacggacucucuuccaauagaaucugauucuauuugguauagucuccucaaucuuuugugguuuugugggaguaaggugauaggaugugacuuuaaucucuuaacuauuggguuggaaucauggcucuguggccuuaggcaaauugucuuuggagcuucaguccucuccccuguaaaauggcacaauauuacuuaguuugcaacacugucaggguuuuuuuuuaugauccagucuauaaacuuuauucagauuuuuccaauugucccaauaacguccguuauagcaauagaaaauccuggcuuaugaguucauucagcuuuucaugucucuuuaaacucuuuuaaccuagaacauuuccucaucuuuuuaaaucuuucauauuauugaacacugucaguuuuaacaucgauaaggccucuggcauacuguggucccuucacagaugcuuguuccuuucuaccuccuuauccccuuccaggaagcauccugcauuuguuggguggagauugggcagagaaaucaacagccccgaaagaaccaccaaccuugcauccagccuauuuaaaaccagcuucaaaugcgugaaaugaaaauuucuuuucuuuucuuaggaaagucauuuccaguuuuguuagaauuugugcuucauugagucccuuuuucugacagaguugcauccucaugcagauugacauguuacauaacccgauauuuccaaaucaaaaguuacaaauaagggaaaagaaggugauuaggaauuaaagauuguugggcaacacaagcaaaagacucaauuuaagaugccagcucacacucuaauugugcuagagguugaaggaaaaugagacuugauaagcaccaguggugcaagucuccgcccgggguucucagccccuguccuggucuaacaaacagcuacacagccccagcccaaaccuuuuguaguuccugucccaguaacuucucccacauccauuaaucuaaaaaguuaaacaaaagaagaauaggauuuaaaucaccuccuugcagauuugauuccaagagccuagcaggguaaaucaaugucaauucuagaucuaaggggccgauuucuaccugccuucuuacauggucuaucagcuuggcuuuuauuguaacugaaagcugaaucacuccaucuuugcuuugcacuggcagaugggcugugggggccacuuugaaaguaauaugccccaguucucagggagccaagcaaacauggaucccugaauguucucuguauggaaaaugucuaaugaagccauguagauauaugugccuauugcuuccgggguuauauauuuauuacuuuuuuuuucuuuuacagucuuuauucuaaugaccaaaguaauaugugcucacuguagcaaauucaggcauuacagagaaaagcaaagccaaaauguuccaccacauuuuggguuguaccuugugacuuuaugaauguagaaaaaaugaugagauccuaguauaguguuuugaaugcuuauuuucaucuaaugauaaagcaugcaaaacuuuucaugcucucuuuuccuccuacggugacauuuguaaugcuacauagacccccaauguuauaguaugacagauauaauuuaaugaguaccuaauuuuuugacuuuguguuuauuuuuuuuuauuaucauaacaagacuguaguaaccauccuuguacauacuguguaguuuuaguauuuccuuaagaugaauuccuagaaaguagcauuucaggguuaaaggcagauaccauacuaaagcuucugucacacaugaaaagcaguuagguaaaccaugaugucucuuucaucuuuuuaaccagaauauggcuauuuauuuugcagucccuuacaggcuuggaagcccaggugguagaagaaggcaggggugacagucaaacuucaagcagggaauuugcauaauuuugagcuguucugcugaacugauacacaaauucuuuuuccaagaacauuuuucuucccuggcucuuggaaucaucacuuucuggagugcuucagccagcaauggaguugaaauauguaaauauguuccucagcguuguagguggggcuggcuccauggugaaugacaaauaguuccuccgagaagagugugugucuucagcauuugcugaggcuguggauuucccccucccaccuuucuccuucccuuugguucagaggccuuaaacuggccugggagaucuuacaaagcaaacaguugagacucuaccccacagcaagcuuaucuccaccugcuguauggcauuuuacuaggaaaaaucaaccccacggagucucccuucacaguuccagggcccaaucaaucaaucaaucaacaugccuacaugcuauuuugaaaguggaaauuguuaggcaucuuguccccucuuugcaugguucaaucaaucagagggugcuuuugccguuaccccuucucaagugugggauuucugugaccagaaaagauguguucccuguaguuagauagcuagucaucugacaaagaauucaguggaaccagugggggaaguccaguccucccauuuccaaggugcccccaugcucagcaggagacaugaggaguuccuuuagaucagguagagaggucaccucaggauuguuucacgguguggucaccacagagggagcccgcucuguugguugcugacucugacuucagacaacgguuuagaugcugcuuugauacuuaugccacucuaguuucacuagggaaggugaagggguguuucuguucuuugucauguucugaacaucaaaucagagcuuuucuuucauuuggaaaacagaaaggaaacaggccauaugggaucuccagagcaguggucagcaccccgguucccuuucccuguguguucugcacuggcuuuacacaauggcaucacuguagccucacccaauagugcaaaaggguaucagaggcaauugguuaaucauuaaaauccuuaagaacauuagguuuuaagaauguuuuucuuugaaagucgauuuuucucgcugugggaugaguguugauuucugaaaggcuggucuugcacccuuugaaagucaaacaaaaggguugcaguuaguacauuuauggccugggguaaaccuugccaauuccugaugccaguuuuccucacuauaaaauugguuugggagaagagagugguuuccaugucuuguuaaguuagugcaaucucaaacucuaaugugcacaccccuaguucugggaucuuguuaagaugcagauucuacuucauuuggucuggggaggggcccaagaaucugcauuuuucgccagcucccaggugcugccaugcuccugguccauuguccacacauggaguagcaagauuucaagcuaucuacugcucugacuuuauuucagaaagucauaaucaugaccccuggaugucaagaggaguugcuuauauuuguagaaugacacuauaaagggaugugcccauucuuucauuuuagauuuggggaauaaucuuuauuuccacaaacaguggaaauaaagugcagaggggcagcaucaguccucucauccugugauccuauaggagauggaaaaugaggcaagaacaaaacgaacacauacucaaugcuuucugugugucagagaaacugaagcucaguaaggcugagcccagggucacaccacuagaacuagcauuugaugguaggccucucuggcuccuaaauccuuguuucuccuagaauggcaacuuuguaacuuucgagaauaugccauguaauucaaacugauaauuuagcaaaguguuucccuuuagagguccuuuuucugggccuacuuugaaaguggaucgagacauguaaaaauuugcaucauuaucaugcaagcaauuaaagugcuuaagagcuuaaaagcaauuuguucaaguugguuaaauauccacccuccccaaccuuguuuguauuauuaauuuacucaucaaacugugacaucaaaacuauugugaagguaaauuucaguaucuucuguucgguaaaaaacuuuuaaaugugaagggcuuguauugaugagguccacagugaaaggauccaguucagggugagucagagaaaccagcuuuuuacuaaauaaacccagcucugcuuugaccucaggaugagaacugaucauuuaaacguuuuauuaaugugcaauuauucugagaaccagucagcaaugcagcucuuugcaaacauuaauuagcugacccucacaucaucccacaugacagauaaauagcauucacguugcauuggagaaaacaaauggacacacagagaugagggaggaagaaggcagcucuugccuugaaagaaaugugguagaaguagguggaauuagaagaccauguaaguuuuuuacuucauaaauauuuauugagcaaugcacuagauaaucuagagcuauucuaugcaauauaguagucacuagucacauuuuaaacuaaauuuaauuaaaaugaaacaaaacuaaucauuuauuuccuugguugcacuagccagauuucaagugcucaacagccacaugugguuaguggcugccauacucgacagugcaguuauagaacauuucuaucauuguaagacauucgauuaagguugggauuaaaaaaaaaugcaaggauccuugccauugugaacuccaauguaaaauuuccuaaaacaauagcugacacauggcaacuacugaguaauucaaguugugguuaaguucuuugggcuaaugguuagggacccagcuucuggagcuagaggacuggguucauuuccuggguaugccacguacugaauguaugacuacagguagaugacuauuuaaaugauguaugacuacaggcagacuauuugaaugcucuaugcugauucaugcugcuauuuuucacuugucuuacuagcugagauuauuuuuaaggcaguguuggauccuggagagggugcugggagacagguacucuccuuugcugcugguugaaaugcaaauuaauauacccuuuuagguaagcaauuuggcaguaacugucaguagacuucggaacacuuauuccguuuaguccaguauucugauucuaggaaucuagccaaagaaaauaaucagagaugggcagagaaaauuuaagaauaaaaauguucauugcaguguuauuuauaaaagagaggaaaaagguaaacaauuggguggaauaaguaaaauguggccaagccuagcagcggaauauuauucaaagauuacguauuguuuugaaaauguguuuugugacaagggaaaaugccaugauaaaaauuauguuuaaaaaauacuaaacacuauacugcuaaaccccaaaaguauuuuuaaaaguagauauuuguugaagcaggacuagagaaauaaaguacugaguaguagcuuaugaauuaauagaauuuuugaugguuuggggaagauuguuucgacuuuuuucuuuauuaaguuuuguguuuuauuuauuuauuuaauuuauuaauugaacuaaccuaagaaaauuggcaacggugcgucccugugcucuuucugcuauagaaugccucagagacuccuagcugcuccuaaucuguuuuuucuagcacguuuggaacuucuggcuuaucuauucuagaguuugucugccuucaaggccuagauguucuuucuaauguuaaaacugaauucucuuuauggccauuuaaguacauuucuacauguaguaggugauucugacugagcagcaugggguauugcagaagacaucaacuucaaagauggaaagaacuagauucagacccugaaccaucaucaccuccuugccaugggaccuugggcgacccuucuguuccucaauguccucaucuauaaagagggaagcaauagaaucuaccccauaucucauggcuguguggauugugcucacuucagugggacaucuggcacauauggguaaauaaaaaugcaaaugucuuccaugccuggggugcagcacccuuuagaauguacacuccuuuugugcuugugccacucucuugagauuguaggaucaucacucuccagaagagggagaguaggcaucaggugguuacucaacaugaccccugccauaagggcuugugaauggcaggcucaggaccuggacagaugucuggcugacucugagucuuaugcucucucugguacagguuuggaaguucuguucccaucugggccauuguauuuugcuuauugguuucccugggcugcaguucauuguggugccauuaaccccucaacauuucccagccuugcuacuuguuccucucaaggaauaaauaaagcagacauuccuuuuuuuuuucuuuuuucuuuuuuuuuuuuucgcagguugaaugauugaaacaaacaugccuaacuaaaaaaguagcccaacgcugcuaagugacagcagccaagccacauuccaggaagaauguaaacugcucacuagugguucagcucacuuuuugccaccuugaaacaaggucuccucccaaauuucaccucuugguggcuugaaagaggcacuaaauuugucaucagcuacaacucccaguucucacacuuucuaucugugggaccuuggucaaauuacuuaaugucugugugccauaguuuucuuuuccauaacauugggauaauaauaagucuuuggcaggguuguugguaggauuaucaugcaguaaucuuugugacaguguugugaguccuugccauccuugaaucagcaccauuauuuccaaagcuuuagaaguaauuuauugagguaccacuaagucacugcuucauuuuucucugcuacugaugguucucccauauauugcaguuaaguccauauaagacuaaggccauauaagacagugaaaaaaugccaacagguuuuggguugaauucucugcuuugcuaccuacuagcuguaugcauucaagcaaguuccuuggauugucuaugcuuccaucauuuuuuuuuuucaguuagaaaauagaaaauagaagugucuaccuccaaggguuguugugggauucacgaaguagcuuggguagugccugauaaucacugucuaugugaaugguagcuccuggcauugcucuuuuccccacuaucuccccaccucucagcugcugguccgcuggcuccugcuucuggacccugucagcacaguccgguggcgagugcagguguuuauuggggaggaggcgggagggggaaggaugugaauagagggagguucuauaggagucuauugcagguuauuucaggucagacucugagaggaccccuagcuuucuuguccccugaaaauaaaguugccuguagacauagaaaaaccaaagggcucuagauugagacagcagauccuggcucaaauuccagcucuguuucuuugccaccuugcaccagcuugaucauguuaaaaaugagaaugauauuacaccuguuucucugagcugcugucaggcacuagauuuagaguuacuugacccuggcggugcauuagaaucaccuaggugcuuuuuaccaaagacuagcaccaugcccccaccacagauugcucuacaacuguuccaggugggaacuagucaucagaacucuguaaagcugcccaggugauucuaagguacagcaggcuugagaaaugcugcauagaauacagccuuacugaauguuagucuccuccauuuucaaagcagcauaaagggaucuuauauugaguaauuuauguacgaggugagugaccuaauuuguuugagccaugggacugcagauaugguaaucaagguuucuuucccaccccugcccucguuuuuggcaaacuggggcauuugggucagaaaaguggccuucuuacucagccuguccucuucugauuccaacacagcugccuucugagugcugggaaaugccuggcccuugccuggagaugucaugauaguccuuugaccuacuuuuguuucuuuucuguucacuucugggcugugccccauuaaccauucaugcacaacccuccaccaagcuggcaaggccucagcauucuucaaguggaagagagaaugcuugauuucuguccacauccuauaaaaugcuuaucagaugauaauagcuuuccaggguuagugacagagacuuagcaugacccaaaggccuggaggcucuucacuuaugcaugauuuggugauuuuacaucucuuagacaauaaauuuuugguugagaaguacuucuacucagcggucugauuuuuucuugagaucuucucaaacccaccucaaacuggggaaauguguuguauuuuggagagggcuuuuaacauuuaaugugcauagguaccaucugagaacuuauugaaaugcaaguucugauucagugggugggagcaugggccucagcuccugcauuucugacaagcuuccaggagauguugaugccgccagucuaaggccacacuuggcuuagcagagcucuaagaccuuggucuuccuuccugcuucugcuuucucccuucugucuucuuagguccaggagcaucagaugcagacugucauugagugaauggaaucugucaguuuugugcaaccguuugucaguauuguuguagccucaguggaggcaauuguagugugaaguagacagaguaaauaguggccauuaucaucaugccguggaaagauuccaguuccacguauuauguuauacucuccaggcuucuuuuauaucuucaagcacauuaagccucauggcaccuuguggaauaggcagugauuuuuauuacuaggauaaguauuacuuugaaaauuuuauaaccuuuauuauguuuuuguuuaaugugguuuucuucugauuaugacaauaaugcauauaaacaacagaaaauuuaggaaaccuaagauaacacagagaacaagaaaaagaacccauaaucuugccauggagagguaguuucuccuaaccuuuugauuuucuuuccaguauuguuucuauguaaaauccuaauucucaccacuacccucucccaccauaauuuggagcacauuacacacauuguuuugcaaccuuaaucuaucacgaucguuuccccguuccauuaauuuuuccuccaacaugauguuuaauagcuauguaguauucccucauaaggauauaccauuauuuauuuaacuaauuuucuauuguuguauuccauuucucaccaccauaaauaaugcugagaucaacauuuucauguaguugucuguuuauuuucuucaguccaauuucuuuacuugaaauuucuaggucaaagauaaugcagcuuuuuaaagcuucugacaaugugcugauccgugaugggccuguggaagcauggaaccaagaccagggucccucuagucugguaguaguuugaccagggaaguuuucaucauucuuguguuguguagggaguuucaucauucccauuuugugucaccaggguaccaugguggcacuggagaagcccugagcagacagcccccucugccacuucaccuccugguucaugugugcugaacugcaucacacagggguagauggucacuaggucauuaagauugaucuaggccauaucuugcuuccuggaucugugaagguaucugcaguuuuaaaggagagaagaaaaggggaaugaaagguaccaauacugugucuaucaaauucuagauucauauauccaacugccuccuugcuauuuuuauuugaauaaucucauaugugucucacaccuaacacauccgaaacucaucuucccugaaagaccugcuuuacuggcaauccuuccuagcucagcuaaugguaacuccguccuucugguucacaggccucaaauuuuggagucaucuuugacuccuguuuuuguuuucauaccuuauagcucagccgucaggaaaucauauuggcucugcuuuccagccauaaccucacagcggaccacucuucaugcucuccacugcuaccaccuggguucacuccgaucuucucucaucuggaugaucacaggauccucuuuguugaauugugugaggcauuuggccuauauuaucgcauuuauucacauggagcugaguaaggucuuguuaguucccauuuuccagaggggcaacagggacucaaugagguuagacaucuugccugaggucacucuaccagugagucagggagccaggguccccuacagacauccaccuguccguaaagcaaauguuccucuccaggaggugcugguuguaaguucaugagccauggaggggauggggaacuugaauaucuuauaccuggugggaggaacaagauacacaccaucuuuugaugucaucugaacuuguuagcuaacauuuuuaauagaagauauguauccucuucucacaucugccugcacugaugaacaaagccuuguuucaagaauuaauuuuggaaggagauacuccuuucauagccuacuccugaaggugggaaauaguguggggaaauucauucuagaccagagugugggugauggucucaaggccucaaaguagguuucugaaagacccccacauuuuggcacauguuugugcacaggugugugggcacacaccuauaauuuacagcacauuccuagaacuuuucaagucaaaauguugccuuguucacucuuaugguuguuauuucuugaucuguugucaucacaugucucacuguucuuuccccucaauaaucauggaauuaaauucacuuguucagaaguggaccccagaggcaggcaggcaggcagagaccaaagagaugucacagagcuuauaccagagggaugggagccaaggccacgugagcagguccugccaccucagauagauaggccauuugugccccuacugugugcuaagaggcaccuacugugugcugagcacagcaacacugccaacagucuuguuaugcuccaucacugacuauaugaguaguguugccaggauuugaauuuggaucagucuggcuccaaguccguguucuucuacuucacuuuucuaggacucaggagaacauggccaggaguuuagggcuagucucuuaguagcuaaccaagagucuuuccccaaaggcuccagacacugagaugugcuagggauguggggagagcuggcuuuaguucagcaucagccagaacaucccagaagagauuagacagcuuguggagggagugagcucccugucauuggaggagggcaagcagugcugucaagucuauuaagaagcuuccugcagggggugagaaauuggacucaauguccuccugaaaaguucagcuacagaaaggcugggucccuuugguacacuccucaccuugauccuuagcaccguuguuaaguauacugauuaauccaaucaguaagggccugcggagugagcugggcucuggaguagaugugauucaagacagaaaagcaggaggguacgccacucagaucucaaggcacuuaggauccaguuaaagguacuauuaagacauuaucagcugaagagucagacugaccuaaguuuaaaucugggcugagccacaacuagaccaggcuuucucaacuucggcaccccugacuuuuuuuugugugugugaaauggagucucauucugucucccaggcuggagugcaguggugugaucucggcucacugcaagcucugccucccagguuuaugccauucuccugccuuagccuccugaguaacugggacaauaggcguccgccaccacgccuggcuaauuuuuuguauuuuuaguagagaugggauuucaccguguuaaccaggguggucucgauauccugaccucaugauccgcccgccucggccucccaaaguguugggauuacaggcgugagccucugugccagccuuuuuguauuuuuuuuuuuuggagacagggucugguucuauugcccaggcuggagugcagugaugugauuagggcucacugcagccuugaccuccugggcauaauugauucuccugagcuuaaaugauucucccaccucaguuccccaaguauaagagcuaggacuacaggcauccagccaucauaccuggcuaauuuuuguuuuguuuuguuuuguagagacuagguuuugccauguuguccaggcuggucucgaacucaugaguuuaagugauccuccuaucucagccuucccaaagugcuggcauuguaggugugagcuacugcaccuggccaacuuugccacaaaugaccagauaauucuuuguuguaggggguguucugugaaucacggauguugggcagcaucccuggccucuaucuacuagauuccagugccuuccccgccaauugugacaaccaaaaauguugacagacauugccaaaaguucacugagcaaagaauugccaagauuguccgucccugguuggaagccacuggacuagcuuguaugacuuuuggcagacaaacuaaacucuugguauuaguuccaucuuuuuuaauguaugacaacaauaccugcuguaagaaugaaaugaaauagcauuaaucaagcuucuaccagggagccuggcacaaaguagacagacacaucugagaaagaaccuucacacccagguuagugggggaggcagggaagcuucaaaaagugggaagcauuugacgucgacuugaaggaugagaacauauuuuccaaaaggacuagaaguauugugauuauuauuauucauccuccuuccucuacccuugcaggccuccucucacuugcuggucacuccuucuucucuccuguaaaaaucaaccaaagagacucuucuaaauccucagcuccuggaaacaggagauuugguucuggccucacauuuaacccucccugcgccugcugcuccaggagugcauagacucgccccuuguucuggagcaggccaagaaugacccguuuccccaccuuguuaaguaugaauuggaaauuuguacccaugcaguuuccuugcaaaaaaaaaaaaaaaaaaaaaaaugcacuuguaagcauucagagcuggcuugaacgagacaggagcuacaaaugcaguugaauauuucaugaagacccuuucaaaccacaugcucugcucuuguggaugguaugggggagaaagcacaggcuacgagucagaccaacucaguuuuagcccugacucuuuaguggaacuuugccguaggaagugucuucacuucccugggccucgguuucuucaucuguacaauggcggggguggggguugcaacugauuugggauauauugugagggcuucaggagauaauauagguaaaggaucuggcagggugccuggcacaugguaggugcuuagucaauguuaccucuccaguuggaaucuuccuguucucuucccaguaucugugcuuuuagggacagcauagucuuucuggaugacacaggccaauggcaugggacuccuugggggauuggguuuaggacagccucccagccuucuccuuuuaacuuaagcuuugggauuggguccggcauccuuggaaggcucaccaguuggucuacuuuagaagacaggaugcaaagaauucccucugauucaaauggcccagcugagcauacuuucaguuuaaaaauaagucggccuaucagaaggcuguuuuaaaauguagaggugacaagcaaaugccugccuuaccuuuguacaaagaggagugauuagaagagccaaaauagaagcccagagaggcuccugggccacagucccugccccaggcccagaaccagccuugggucagacccucccucccucuguucuaccagggagccaagguugcuguaaggaaaacaagaggagugugguguuuuguaacuauuuuuauaccuaccucagacuugauguuagugcuucugaauuauuuaacauuuuucuuucucagcuggccucuccagcgaguuucucucuugggguggagggaguuguuuuuuaggcacucauggaggcagacaaacauugacugcagggccucugcuuuuuuuggggaaugacauucuuagguauccuauuaugaauuaggggccccauauuaaacauaggugacagguauuauagaugacagguaucuagucuccauguuacaaaaagagaugguaaguaaauugcccaagaccacacagcaggaagugaaggaaucaggauucaaacucuggucuuucuuacuguagagcuggugcugcuucuacugagcuggacugcugcugcucuguccuuuacucuguguguguguguguguguguguguguguguguguaagaaccaugugggugauuuaauaugguacuccuuaagcuaacaggccccugucaccauuagcuuaaggaguaccagaucaaaucacccacaaacacuguggaggugaacagaguugagaagaugagccucagaagguugagcacugagaagcagggaugugguucccuugguuauugcauccugggggaaugggaagauuguugcagcccuagcaggaggucccuucauugcacuucacaggcgccacguguggggugugcguuaagagcccuucccucacagucuagccagccucuugaaagggguaucugcaccuugggccucauugaagggggugaugauuggcagcucuaaaccaccccgacaacaggagggaaugaacuggacucuuaucugcugccucucauaauuaaaguccaucauagacuuuuaaugggcauuuugaaauagacauccugguuugaaaggaauccuacuguagaucgagaucagccucccugcagaagcacugucuugcugauaacuguuuuuuuuuuuuuuuaauuucagagccagggaagauuacacauuuuccuuguuccguuccuuuagcuccuauuuaauuauuggugaccucgagaugacucucuuucaagcauuuuaaacuccucauucuaccuugugugaaaaccccguuagaauuauaauaugaacucucucugggagauagcccucugcaaauuagcuaggaacacuuauuucaaaagugcccaucguuauaguuucaauaaaaaucacugggguaaagcaguuguuaguaauguuaauaacagcuguauuuugauaggaaugcacuuuaugacuauaucaagcgauaucacauucuguuaaauaaaguaauauuugacacagguaaauuccuugauauuaaauuucagauagcuguaugaaauacuagguucuccuucacauacauauggaugaaaguggcccuaccuuuuuuuugagggggggugacuuuauuuaugaaaacauauagacaagguaauggaaugauauuccaagauagccucuuaugugaaauaauuugauuuaaagcuuuauaagcauugcaaaaauugaccagugugcuuucgaaugccucuacuugugauuuugcaaagagaaaagcaaagggagaguagggagagucacguuuaaaaaauaguuuacacauuuaaaaaauacucccuaccagauaccuuugugcacuccucgacucaucuaaugcacacacaagcacucuagaagccugguuuucacuuacagcaaagcuaagugaaagcuuuggaagguuuggaaagcuuuggaaacuucuggaaguugaaguaucaucccugaggcuacacugcugguggaauuagcauugaaccuggguuuaucugacucuggagugacugcuccuaccucugucccaucccagcuccagggacuagguuucaaauauuuuuuccguauuguguggaugugugagcauguggagggguaauaguuuuuucuuuuuuccuuuucaccauaggagcaaauaaccaucccccaccccccaaaaaaaaacugguuuguguccaaauaaguuugauaaaugccaaauuagagagguuaauguauuuucaugcugcagaaagucucagagucuucacuaugcuuaugcgaaucuccaagagaggcauaaauagcacauaagaguucccaaacuucuaauaugaguuuucuuuuuucuaaagcaaaaccauuuuuagcacucucacaagaguaggguuucuucagaagcucuuugggaagugcuaacuuuguggauuucugaaucuguaggguucugauuaugguuccugucuuagugauaugguccaagcaggaagcuuggagaguccugcaggggcugaguguuucccucuugggaggcugcaagcugccucucuuucugacaucuuaguaguucagauaaaugaaaugcguuuuuguucuaacccuucccaaccuauuuuauggaaaacaucaaaguauuuaaauacaaagaguaaggauuuaacauguuaaaaaaauguauuucaaaugaucaggagggagaaaaccuuuaccauagauugggaaggauuugcauccuugaaggagcuaaaagacaaagauaagcuuuuaaaauacauauauggaacaaagagaacacaguggguuggauucaaaauauuuaaaucugucuuauuccauuaagggaacuuuaaaauaaaugguuucucauucauucauucucucucucacucacacacacaugcacauacacauaaaauaucacauaggaagucucauacucaaacucccuccccgcacccaccuuguaucuugaaggaacuaaggaauaauuuggcucaccuagguagcuggggaaacugaaggcccagagaagggaaggaguuugugccaacccacgaagccaguucaugggacgucaggccaaggaguggagauguggaugaugucugacaugcuuugcaccccuacuguguagcagaccuaaucucuuuaccuccuuacaaccaaccagguuauggguguuaucuucauuaaagcugaggaaaugaaacuaggaaaugucaagcaacgugacccauggcugguaacuggccucauagugggauuugagcccauacaaaguacauaucacacugucaaguccagaaugugaguuuccuuuuugccaaucuaauuuaaccaucucauccacuauccaucccugacuuacuagacagagcaagguagccacccaguuaccuucugaugagucaggagggaacacauccauccccgugccgugggugcuaagggugccauugggaacauggaggaagggagcugaccucuuaccugugggugugaacagcucgacugcccuguucccaagugcucuggugguuuauaagcagugaggugagucacaaagcagacaaaggccacugacucagcggguagagggaggugcccucaguucuugauucaacauugccaugacuugcugggagugguuuuugauccuuccauguguuuuugaaaagccagguaggcuuuucaucuccuucaccacuuuagaugcgaguuuguccuggaggcagggaaauggcucagcugcccucgugggcuucugucaauccuaugcuucaaacaaguaugagcuaagccuagucuagaugugaccuggaauauaaacaauccaaugaguuugacuuccuucagagguggcaccuggagaggccauacauuuauucaagugaugccaccauugcuaaacacaaggcuguaugccucuuugggaaugugggaguucagucauucaacuaaugucuguuaagaguguccaauuuccaggcacuguaaaagugcugggcaaagucagaggaaagccaaucccugccuucaaagagaugacaaccuguuggaagacacagccacguaauggaguaauuggagugggguguaaauguacaggggacauacaagagccaccucugcaugggggcagucaggcagggucucacagaagaggugaagcaugaacuaacuguacugaagggucaucagaguucaccagggugaccagagaggacauuccaguugcagggaauagcauaugcacauccacaggaaaaugagaaaucauguuucaguagggcuagagcagaggauguuguguugggugguggagccauaugagggagaauagauuggugggauucauaagagccagaauuggcguuuagagccagcuuguaagccacaugauuggcuaugacucaacagauacaaguggcaucuugcaaccauuaguaucaguauucuuguuguuuucauguccugcauacuguaguuucaguguuuuugcuuguuuagggaaauccauuauacccuaaagaagcaaguugauaagaaauccccacagagagauucuagguaggugcuuuucaguagagguuucuguaaugauggaaauguccugcaucucuguccuccaauaggguagccauuggucagaugcaacuguuggacccuugaaaugcggcuagaauagaauuuuaaauuguauuuguaucauauauaauauauaauuuauguuacuuauuaugcauccuuguuugucauauuuauguuugcuuucuauuaggcaguacuagucuagugcgaggagacagacaaucccacuacugauacauacaccguuuaaaguauacuguaggaaaagggccuuccuugaagccugcaccccagccaggaagagugccauuaaagagugacaagaucugccuggaggucaguaagaaaggcuuucaagaggagagaacuucuuauuacugggcucugaggguuuuggcaaucucugaguagggaaauguggagugauucuuccagaggagagagcaugagaaaagguguggagguuccagaaaagcacauaccugggggauauggagugggaugaggcgaccucaggaagaaagaaggccacaaggagcuuggauucuauucugaugaagcaaggacacuuuacauagaugaugucauauugcaaguaugagcagggaugucaugagcauuauccaggacuauaggagacauacauaguguucuucaaaggacaauguaauucuuuggacauggggcauaaacaccaugguucaaagccaagcuuuuagaagcagaaugcgaaguugaaacuucuucuacucagguacagcucucuuugcuaugugguaauguuuacuaccacuguggucauguuuaccaaccacucuugugguugguauuuccuguaaaucuuuaaguccaaacaacggcaucugggcacaaaaaaggauaagagggaccaguccccuuugagccaucaacaaacagcccagaggaagacgcugaaguccaaagaggcuggcugaccugcucaaagcugcugagguuucccuugcacuacacugccuugcccuuggugccaggacuuagucucugggcuaaaggaaacucuagacauguuuucagugcuuacguaagagucaacgcaugaaacacaccugccuuuaaagagcaaaaguaaaguucuuuuaagccauuucuucagcacaacauaaaugugcuaaacauugacauucuuaugccagcccuuagauuugagacucucaguuaacuacuuuccagauaucuguuuugcccuuaauguuauacaguauugagauauugaucaggaccucagccacaguauaucuuggcuaaacuguccuagguuucuagcaaacaaggaaugacugugugaguggcaagaaagcguugauguuacaguugccuguagugucugucuuuuuuuuucuuuuuuuuuugccauugucugguuauguaccaaaauccuaacuguaccugagauagaagacgcaagcuuugcgcaaaagcaguguuaguagcaggcauacccuacaggauuuggagcagagaccuggagagaaacccugagccugccaccaauuaauuugugacuugaggcaaauuaccugaccuuguuaagccucaguuuccccaucuggaaacccggaucuuaauaccaucucguuagguuguuaugagggugagaugauacagugcauguaaaccucuuagcaucauaucugucacauaguaggguuguaccuuaauaaacagaaaccaguaauguuaauuuuaccaaauuuuuauguuauagcugaagaguuucuuuugucaaaaaagaggcacaugaaagaaugcucaguaucauuagucauuagagaaaugaaaauuaaaaccgccacaagauaccacuucaaacccacucgaaugucuaaaauuaaaaagacugaccauacacguguuggugaggauauggagcaacagaaauguaaaaggagacuacuacuucagagaacagcuuggcagcuucuuaaaaccauaaauacauaccuaccuugugacccagccauuccacuccuagguauuuaccccagggaagugaaagcguauugagauacaaagaccuguacaagaauguuugaggcaccucuauuuguaauagccaaaaauuguaagucacccaaauguccaucaacaggugaauggauaaacacauugugguauauccauaaaauggaauguuaaucagcagugaaaaaggaauaaauucuugauuagcccaacaacauggaucaaucucaaaauaauuauacugaguggaaaaagccagacucaaaagcauguauacuguaugauuccuuuuauguuaaauuucacaaauugcagaguaaucuauugugauaggaagcaggucagggguugccuggagagggugaaggggugggagggauuaucaagggggauggggaaauuugggggaugaugugaauaugguuacuauuuugauuguagugguguuuucacaguuguauacugauaucaaaacucaucagguugugcaauuuaaacauguacaguuuauuguauaucaaauauagcucaauaaaguauguuuaaguuaauguucaguacaaggaaagacaaaucacauccucaugcuggaguuuguuuacaagaugaugaguucucuucagaugccaccacagugaguggaguuugacucccagccccagcacucacugucaccuugggcaagcuacuuaagcucucugagcugcagcuuuuccauaugaaaguggagaugguaaaccuacaucacaucauuccuggggccuuugaaggaguuaauauacauaaagcccugagcaccgagucugaccuauaguggaugacccaaaugcuugucuauaaugauagcauuauuuauuauuuucagguaugcggaauacuuaaauacccuaaaccaccuguaaacgaaugaaaauucacgugagucaaccugggugaaaaccaaaaugcacuuuacuuccuugggggcauagacaugagugcuuccaaagugcucugaaacaguuuguucuuuuugguugauuaaacaugcuuuaauuucacagaucccaguucuguucagcagacauucuuugaggauuggaaggacuucccaaaggaagugacuaaucauagaaucuuagaaucggacaagagagagacagucuuaaugcaacccugucaucuuacagacauggaaacagaggcugaggaagaaaggugccuuguccagggcugcaaagugguggggugaagagggaaccggccuccuggccccagucagcaugcuugccccugcaccacgaggccucuccccuaagccaggccgcuuuccacagauagaacgguggcaaggucagcugaggccgugucuaaaugaucagaauuaauggauucugaaugaaugagguuuucugcccgaguuuuagguucaaggagcucaggaggcacccggccaagguuuugacauuuuuugcccaugauucaggcagggcugcuugguuggguuccaugucucugcucagccccucucucugugaucuguguuucagauccauuuauauaagacagcuuugggaauuacuguuuuaaaaaaaugaaaaagcaaguuguguuuuuuuugcuucugccauaacauauagggcucaaagaguuacaucuguuuccaguggccagcaacuuggaacaguccacucuuagaggcccaauuccagaagacuggcacagaagaagcuuucggcagcagguugauacccuucucgaguuugaguuggcauguuuuacuugucagcauaggcaguaauaaggcauauucagauggcaucucuauagccacucuuucuucugguccuuggaccaauacucugggauugggaggcaggaugauuacagucccuugucacaguguggaaagugagacucagguuaguucaguggcuucucaagaucaccagcuacugugcagcagagguugaauccaggucuuccagugcagagucgaaagcucuuuuuacuauuccaggccagcuauucugggaugucucuuagggcuuugacuuugaaggaagugcuuuuccagugcgugcaugugcauguuugugugcguguguguguguguguguguguguguacacauguguguauauguguucaugugugugugaguggaguugcagggcaggaccaagggaucugucucccuuugagagcaaagucaaguugaauuuugagguauagagauaaauuauacguaucuuguguuucuguuacucuuuuuuuuucuguucuuaauauaggguacaugaauaagcuccaugcagagccacaaggaauugaucuuucuuuuucuuaaaauauuugccgucuaugacuuaucagugugugcaugcauauguguagauauauauuuuucuccuuuuuuuugcagacaugauucuuuuuuacauacuuuagcaugccacuucuaaaagcaaggacauucuucuacauaaccacaauaugauguuuauuccuaagaaaaguaauaauaauuuacaguuaucaucuaacuucuaauccauauucagauugccccaauuguucaaaaauguuuuuauggcuuuuuuuuucuccuaaacuaggauacaaacaagauuuaugcauuacauuugguugguauguugaaccaacauuccuaauaagcaguuuucaugagcuagaaucaucugcaaauuagagugaaacaacccucuccagcugaggcagcuguuaggggcuggccgugaaggucucaugggaaccuugugucuucucucucaugucugcugaccaaucaguaggaggagcuggacucucugugucaggauggagcgugccagggaggcggggaaagggaaaggcagagcugccuagcuucuugcuggaaaaggcuauggaguccaaggagcugaaaccugcaguccacagccagcuucuuaggaagcagggaguuuucccaaaggaguggugcgcagccuggagugugagccuguagacaccuugggaacuggggacaauugcugggagauuugggaauccuaugugaugaaaugagggcagauuuggaacacaaggugcccagaauguguguuuuuacucugacuucauuuucugauucucauucuauuuuuugguuacagcccuuugaaaaugaaccugcccuuguggacauaaauaaauagguuuuuauuugcaguagccugauuugauggccuuuaguuauuaccacaucauuaggacaugcuguaacuaaugcuucacaaagguacccaccaugggugccucuagcaccugcccuugccuuuguuauguagugacucauaucugugucugccuuccuuucuggacugaguguugucuaguuccauucuuaauacugacacagugccuggcuguggugcaaagaagaugcucauggaauaggcugcagugauccagaguuguaagacagaauguuaugggagcagauaggagaagaaaaaauaaaugaaugaauggaugcaugcacgaaaacaugauaaucaggaguguuuuccaagagguuaguaguuggaaguuacugggagaugggaugaguauuuauuugauacauauuuauaaaguauuuuuaugccauagugcuguuuuaaucacuuuauaaauaaugaauuuaauuuucuuacaaaccuaggaaguaaggacuguuacuuuuccuaccucguaugugaggaaaccaaagcauagacagguuaggugacuuauccaaggucacauggguaguaaguuggagcugggacuugauuccagauaauucagcucuagagucuacuguuagccaccucacucuguguggaaugggguuggguguuccaaagucagggaaaucacuugguaacugguggaccccaacugucuuacgagggcugucgcuaaggcuguccugggcuuacagacaacagagggucugucacccagcugggccaucaugagggagcuggccaucuuugccauuccuggggccugacaucucacagccuguugguuauccuuacguggcaggcuuucagugaugcggaugcuucuugagaaugcucuugggcuuuaccaaccggcuaacuugcuagcagagcugggaaggcuguguccucuugggguguucgggagggcuccugagcuguccuggugguggcacccaguccaugccaggccuggccaccagggccugacuucuaacaggaaggcugagccagugcagcucugugguuguggcugagccaagcaucagugcucugcuagacuccuuugugaagcuggagucaggaauaucggcucccacuaccauagaauuuccucuugaagaugagcauuuguugauguuuaauaauguuguucagugguuugaauugcugcccaauacuugucuucacacauugacagagcugaaauaggacuaucagaggaguagccuucuagaguuggaagagaagugaaacaucccauccacucuguuaaggcuuugaucacuuccauugaacaaauucuuccugagcuuacaacugugccuggagaugagauagaggaaaccaaaaaccaaaaaccccaaaaccucaaggagcuugcaaucuguuggaugucccucuuuccagcuuuugguggaaagaaagacuggagggagaagggcuguagcagaagagcaccaagaagaugcaauaaaugacaagggggaagagaggaaggcugcagcgcaaggccaggagggugguguagccuaagugcagcauaggcuuuacagaccuaguccugauucuugcuucuacugcuuacuugcuucacgcuggagagcaaaucgcuucuaucauguucugagucucaguuuucucaacuguaaaaugggcuaauaauacccccuggaagaguuugugugggauagugccuagggcauuguauuaguuaucaucaaacaaaagcaaggggagagccauuuagcacaaggguuuauauugcuacacaucucagcaggcuuuuaggacaauacucagucacagccacuguggccucuagauuucuagggagccuaaugaaaauaccauggccuggggaagaucaaggguucaggagucaggcagucuguguguccuacuagcccagaagcuuuaaacuuacccucucugagccucacuuuuccuaucugugaaauggccaaguagccuggauagaagggccaggaucuaccacauggaagcagaaaguacaagcuaguagagaauaugggugcuggcccuguaaugagugaccauauccacuugaguguguguuuguauguguguguguguguauguguguguagaggggcacagggaugauuaacaaggacagagguaggcccgacauggagaaagguucucaaagaacccucccuguagaguacaggacuuacuauggagguuuagagagaagguaagugaaagaaacgggcaagcaagaaacucacacuuauuaaaugccuaccacguaccaggcacuucacaucuccuaagcuccuagccuucacuguaaacccaucaggcaggcaauacuauuccuaauuuugagauggccucaggaaaggucagagaaggcaaauaaauugcccaaagucacagcucuuugaauuccaaaacucuuuucauauacacuucucugccuguucauacauauguguuaggacaggacuauauucugggaaaaagauggaguugauaucaagugauaauaguguaauuccuguuuauagaaacaauuguaggaggaagccauuucaaaguggucauuuagucaguuaauauguauugagccccagucaggcacaguucuaggugauggggaugcaguagaaccagucucucugcccuuguggagaacugagaagaggaaacaaguaaguucagaaagugaucagagaggaaauuaaacagugugguaugauggagcacuggagaggugcuggggaccuuagauauugucuuaguuuggguucuuccuaaagcccugagaaaaggauuugaguguagguaacaauuugcaaggugauuccaggaagccugcugagaaaguaaggaagugaaaugggaaaggaagggaagcuaauagagcaagcuuguccaacccgcagccugcaggcuccaugaagcccagaaugguuuugaaugcggcccaacacaaauucguaaacuuuuuaaaaacuauggguuuuuuugcuauuuuuuuucuagaucaucagcuaucauuuuaguguauuuuauguguggcccaagacaguucuucuuccaguguggcucaaggaagccaaaagauuggauaccccuguaaacagaggguaauuuaaugauuagguuaccacugugggcaacuagagcucauuccugcugggacccucagagggacacugacacauuugcuggacuauuguuccaucaggggccaagaaagcugggguauguauccaccuacagauguuccucauugguuguggagccuccaccuccagagagucccaaagcagagaaauaugugucugacuugaguuaggaagcauuuauggaguggaagcagucuauggaggcugcagguggguugagggcauccguagugucugcuacagcuggugugcguggucaggcagacugcauuugagcugagaccuggacuagagggggcagcuauggagcagccagaaugguuccgggggggcuauucuuccacccuccuucaugggaaccugcagcuccaagaguuaaagugcaucagcaaaggcgcagcuggugaaauucccuagccacgcuggauuccugccgccccucauuccauuuuaacccuucuccacugggucacacaaauaugccucacucuuaugaaccugugaauagccuuagaaauguaugccucaucagaugauuucaguccugcucuaugccccagaaucuaccuuuaaaugcuuuaaacacuccuaaacagcucuaaaaugugcccaaguguucccaccacucuaccacacagcuauuuuuagcuccaaugccaauuucuauuccuuaguauaaucuuuuuuuuuuuuucuggaagagaagcucacaacaaaauuuaucucuacagcuuauucuaaaaccacuaacucucacgcaugugcgugcgcgugcacgcacgcgcgcgcgcgcacacacacacacacacacacacacacacacacacacacacaaaauaucccucauagacaacacuuuauaauucaggcaaaggaagaccaaaaggagaacuuaauacuucuuauuuauuccauucaacaguaaagugccuuaaaaaggccaugcaauuauauuguuaugugauaauuauuaauucugcuaugagcuuccacugagcccagaucccaucaagcaccucuaauuuugccuacaaguccuucuguaccaccugaugggugcugggaaaagagcugcccuucucaacuccuggcauuuggcuuugauggguuuccacugcauaugccuuccuuuuucaucagccaccauuuucuaacaucuuuaugcauaaaaaagacaaacuuauugggaggaaauaucacaaucccccaaaaugcaauuuucuuccuuuccaucuccaauaaagcauguaguggaaaaguuauuagacauuuuuccuaguggauuguuugucaauaauauuaacaaagccaguguguugaauaccuguauaugccagguauuugggagauuauuacagagguuacauauucuuguuuaauguaauccucaaaacgauuuuauucaauagugauauucucuuuuuuagauaaguagcucugccucugugacuugcacauaaagcaaauggaaaaaucaagguuccgacccaagucugucuaauucuaaagcccacgaacucauaaccuggcguuucucuaaguguggucuccggaccagcagcaucagcuucaccugggagcuuguuagaaaugcaaaucuuggccagcauccaguagaguuuuuccuaaguuuuucucuaggauuuuaaccaaaaggaaaagaaaaggaaagauggcugggcgcagugguuggcccagcaugguggcuuacaccuguaauccuggcacuuuggaaggccaaggugggcagaucacuugaggucaggaguucgauaccagccuggccaaaaugaugaaaccaugucuguacuaaaaauacaaaaauuagcugggcguggugaccggugccuguaaucccagcuacuugggaggcugaggcagaagaaucacuugaaccugggagacagaaguugcagugagccaagaucaugcuccugcaccccagccugugagacagagcaagacucucuuaaaaaaaaaaaaaagaaaaagaaaaagaaaaaaugcaaaucuucagguuccacccuagaacuacugaaugagaaacccuggggaugaggcccagcaauuccuguuaaccagcccuccaggugauucuuagcacagaaaaguuugggaaacacuaucuucacccauuuguuaacuacugauaaagaguucaacuaguagaugaacuuugaaggagguuaaaauuuuccccucuucuuugugaauguaauuaaagugauacaaauuucaacaaauguauauuuuucuucuagaaagcaugucuuuuacauuuugggagguuuuaacuuucugucaccuauccugauuuauaucuaggucucgcuacuuauuagcagcaggaucuugggaaaguuacuuaaccucuguaagccuugguuccaagucuguguauugcagaugagcaggauucuugugaguauugagucaggaucugcgaaagugcuuagcacgauaucaagcauaucauaaauaucuaacaaauguuagcugauuauuacuaauuacaugauugguuugcuuguuagcuauuauuaguaacaguuucuaaacuguuuaaugcuuuuaaauuauaucccucauuaagacguccagcaucaguuuuauaaaacaguuuucuauaacugaccuaacuuuuaaauccugccauucuuauguuugacucuuagcaguaaguagaaugaucagaguaacugucuggaagagaccaucaauauucccauaaaaauuauuuauggaaaucugacacauaguuagguacucauacauauucguggagcaaugaauugagugaaugaucaguccacacaggccacuucuaguccaaauauuggccccauacacugacagguugggggucaggggcaggaaacugucucuuguucucuguugaugggcccagcacagagcauagagccuggcacagaaguagauugucaauaauuacuugaugaucaaauuuuuuugcuuuccuuuugauacagauaugcuuuguuuccuuaaccucuucuaucauaauaugcuuugggaucugauaaggaaagaucagaguaaauauauauuucucucccuguauacucugcugcccauauuuuuuuaaaaauacaguuuuuaaagaauuaucaaauaagacuuaggagccaggagaccuagauucuccauucugcuuugcugccaggcuuagaugugacaaaggccugacgcuuaacucuuggguucuuuuauuccuguguaaauggagaaggcuggacuagauagguguuuuccacgggggacugggaccaaaugguugcguguguuaccuaagcacgguguuaaguaacauuggaucacauggugagaaagucuuguuucacuuccucuuuaaucuuucugauuuaguggaggagaaagccugauuuuggcacugguagguauuuaauaccucgccaaugcuuguucaucucccuguuuaacagagaccugaguuuggaugaggaggcaacaguauucaccuuguuuuguucaucauauucauuuuuuaaccuuuuuguuuucuauucaugaaaagaugguguuuuuuucacuuaagauaaugagauacauuuuccuuuuaaaauaaauugauuccagaaacaaagagucaguugaaugugaagaaaaauugcacuagguuaauaauagagcagauaggcuggggguguggcagaaauccaaaagauggaaggagccucaugccacaaugacugucagcaagucucgggugcuacaguguagggagaacagaaccuugucuuuggucaagauuguaugucugcacagucaggccaagaaacaucagcccuggugcggugguuaaggcuggaaccaucaaagugagcccccacuccaaccuggagaucaccguagagauucuggucccagcucuggggcagggccagaugugugcauuuguagacaccuccauagaugggguucucgcccauccggaguuccagauaaggacaugcaguuaagagcacaucuaggagcuaguuguuuuuuuuuuuuuuuuuuuuuuuugaaaucacaaugcauucagagaaauuagauggacaaaaauguuuaccacaucauuuuuauaugcguaaaucauuggaacacaccuaccugcuccacauuaagauaagaguuaguuaugaaaucccuggacaaaauauuguauaucuauucaaaaugauauauauggggaacuguagagauguagagaaacguuuaugguacaauggaagguggggggaauaguagacaaaauugcaucuauagcuuuauuucaacuauguaaaagacauagaaacaauuacaaguaaacauguuagaguguuacugguuguuauuucuagcuaaagugauuaugugucuuucaaaaaaugucuuuuuuuuuuuuuuuuacauucuaagccuucuucuacaauucuaaauguugacuaugcucucccuuuccugucaaaugacgagcaucaaucagaccuaauuaaaauccuguuucugucuugacuaaugugagaccuuggagaaguccuuaacuuugugauccucaguuucccccacugaaaauugggaagaguuccuuucucauggguugcugugagcaguaagugagaugaugcaugagagacacuuaugagggugccuagcucauaagccucggaagaaauaguaccugcauaauaauaauguuaauaauaauaauaauguuauuguuguuauuguuuuccucauuauuacuacuagugaauuugaaaggcauaacaauuuacuaaaccaaagagucaagcuguaaaaaauguaauucugaaguuccuccccucugccuguugcauaaacacacgcaggcaugcagagugacauaagucaacaaaugcacaugugcacacagucuucucuggugcugcacacucccugugcuaggaguuuccauauccacagguucaggaacaagaggacaagcuucaucugguccucuuugucuacuauuuugucuacuauucccccaccccccgcugucuucuauuguaccauaaacauuucucuacggcucuacaauuccccauauauaucauuuugaauagauauacaguauuuugucuugggauuucauaacuaacucuuaucuuaauguugagcagguggguauguuccaaucauuugugcauauaaacacuuccugaggcaucuuuuaucugucagacuccuugcucagcacacgcaacauucuuuuuauugucuuuuucuaaaaaaaaugagguaaaauucacagaacauaaaguuaaccacuagucauucuaaaguguacaauuuagugguguuuaaaacauucacaguguugugcaaccaucgccucuauguagguccaagacauugcaucacagcaaaaggaaacuguaccuauucagcagucacuccccauuuccccuuccccaauccccuggcagccucuagucuacuuucucucucugcaacuuggcuuuuaaauuucucugcagccacacauaaaauuuaacccuuauguuuucuuaguugugcucauugagcuuuuuccccuuugccauuugguuaaagauccugugaaaugaauaaguggacugaauccccacuuccuuguuuggaaauuuuagguucuuugcaauugaaaccaaaaugucugugugaauucauuuaaaaagcagauuuucuuuuccacaaaggauuuggggcuguuuggggcuuaauuauuaugucaggugauccagcuuuaguccagaugaggacccuuuguaagaagcuuugccaugagggcagcagcuucagcggagggucaagguccuucugagcugggaggcugaaauggaacacauguggcucugagccagugaagugcuuucuugggacugcccugcuguccaggaacugaagcuggguucaaaugcugacugucauucucugggcaugugaccauggccaagcuaauacacaugaugagccucaguuucugcaucuuugaaagggugaucauugugaguauuuugcagaggauuaaaugagauaagacuggugaaccacccccaccaccccccucaaccccccggauuuuuuggccucauagcuuugcuucuaugcaugaagugcugaaugccauuucugguacugacucagauucuucaugugccagucuggguacugacuuguggaguggauagugguugagggaagacaacugggggugggaggaaugggagaaugugagugucgaggggugggcuaccucuugggcacuggcaauuacaugacaguggaacagcauugcaauuuaguuuuguguuuuucauuguaacccaacuggcaacagaacagugaugggagauggaaaggguaucaaauuugacuagugaguugccccuuuuggucccuuccuuagaguaagccucaguuucuucaucugcaaaauggaacuaucagugccuucucugacuaccucgcagaguugcugugaagaaaaagugagauaaaaauguaccugaaagcauuuguaaaauguaaagugcuguauaaauguaacugauuauuguuucauuuaaaagacaugguuuuguugauaucucaugaaaaacagugcuaguccucccauuuagucauggcgacaaccuuuuugucauaaaugugcaugggagaaucguugguuaguagguguuuuccuuuauccaaguggucugagcuggaaaauauggagaauuccuucacuaaagggccauaucuuuugacucuauugacagcaugucauguggaacucaaaacugccuucgugaaugcagauagauugcaucuauuagcugccucuugucaucaugaccugccagaagggaaaauaaaaugugccuacaaauauuucaauauuuauguugugugaagguuuaauauucauuuggagcagugaauggggaaagagaaaaaaaaguccacauccuuuacuuuggaaauugcucaguucaacaagaauuuauugaguaccuacuaugagcuagugagugaaugauaugcuagugucuaccaaagaaagacaccaaauucuaauauugacaacuucauguuugcauacuuugucagaagccuuggagaaucccaaggucaggagucuuugcucauuccuaugggggaacugaugaaaucugcccagagguuggggaagagggaaguaggugaaauggcugcagaggagagguguuuguaguaaaauuggggaagagaggagagugggaggggguggaucagaccucagaaacacacuccuaccuguuaggauguaggugugugcuugcacuugugggugggaccaagagacaggugucaguagccuggaguuauaaaaaccaaaaugcauugaauaauuggaugggaaaccacacauaagaaaaggacucuuagcaaguguauuuuuuccagcaaugcaaaagugaauuuacaagcauauuguuguagcugugaaggggcaagcucuacuaaagggauagaugguacaugaaaauaaguuguaaaauguuguuaauugaagaauauguugauaauuugugucacugauauucaguguuuugaauauguugucauugucauuucucauuauguaaaaauauaauaauuuuacaaguucacuggugacuucauuccccuaacccuauuuuuuccccaauaagguccuaaauuccugaagccugacuucuccugccccagggguuuucagaaaccuaacccccaugguuggcgagggacugcugugugugaaaugguaacugcccucaaggagcuuacaaucuagcuggggguaaaugacuugcacaugaacacaacuagacugugagcuucuagagggcagggaccuuacccuagucaucucucuucucacccugcacacccucccugagggaucucauccauccccauggcgucaaccaccaccugaggacccucuaggccugaauugucuccugagugccacacccagcucuccagcaucuucaguguuccuccccggguggaaugcuccacagcacugccaacucaaccugcucaccaaaacccagcuugucauaucuccucugggccagcccuggcuuccaggcuccuggacuuggucccccagaucaaagauccaggggucacucauuuggacugagcuugauggaaaagugcuuauguuucaauguuaaguaaacuggggagccuaucaaauguauagacaugaugaacucauugauguuaaguacauagauggaaagagaaaugcuucagaauguauuagugguugccucuaaugguaaaauaaugauugacguuuucuuuuucugacacccuugugcuuuccaaaucuccugcaaaaaguauuuauuacuuuuguaaccagcaaaaaugccuaauaaaaaugauugacaggucuccauuugagugucaccuuuucugggaauuauuguuuauuccuuugcaucucaaagagucugaggcuccgggguuagacagccucagcacgugugcuuacccuguuggggaacuuguugcacuguguucuuucuguaaaucggcucuuccauuagucugugagcuccgagagggcaggaaucaugguuauucaucucucauuuccagugccuagcacaaggcuugcauacauaacugcucaauacaugcuuguucuuuaaaggaagagagggagggaaggaggcaggaaaacaaaaaggugaaggacaccagaauucucaaauguuauaccuccauggaucccuuguauuauuuccuguccccaagauccuuuguuuauuaagcuuuugaaucuacuguaccacugauuuuucacucgguaguuugaauuuuucuguuuuuuaguaaucauaggccuuauaaaucccaaucagagcuucucagggccaagucuggcauaugccaccugcugucccaagucugacuugggcagagugcccccugccugacaccuaggucauggcaugcagggcuaucuccaguucucuggagcugaguguaccuucuggagcuucuuuuaaaguggaacgauggcaaacugcaaugucugugggaggaggagagcaagggaacagauaacauaagaauagaagugacaauugcaaacuucaauuguguguuuccucugugcaggcacugugcuaugcaucaacacgcacuguccccucagcccucacagcagcucugugacacaggcacuauuacaauugccauuuuguaagcaaggaaacugaggcuuaaagaugcauuagauggggaaacuggaauuugcacugauugcagagcuuaaguccagcacugcaucccucuucugaaguuccaggaagagcacagggaggagagggcaagagagaugccugucaggagaaaggagcaguguuugcaauuucagagccuuguuuggggaugugccagcauagaggaguuuagccccgaaggcacaaagcccuucacaaagucugugacacuccugaaguuguaggcaauuuguuccagguaugugcauugucugggaaggucuucaaaggagucugugugguuaaaaaaaaaaaaaaugguuaaggaagcggaccauggagcagaaaguugcagugacuggauucuggcuccaggcugcaaauuuaaccauugaauaucacccaacaggauggauauggggauauggucuuguugauaaagcaucucccucacacaagacuuggagaaauaauccuggagggugugugugugugugugugugugugugugugugugugugugugugugguguguguuuaugugucucccagguauuuagaaucaacugauuaccaaaucaaucaacaaauauuuauucuagcagagacuugauagcucucugguuugucaggguuguuuaaagaaggauuucugccuugggugggaguuugggcuaaagagauaauaauaauuaccauuuauugaguguugguugugugccagccaacucugcugggcacuuuauauacaugauuccacuuaauccgcacaacaacaccgacaaggaagguuuuauaacccauucuuuacagagaaggaacucagaggguuugaauaucuugccuaaggucauaguaauucaaucuguguaaguagaggagccaaauuugacucuacgucuguuuccaagauuccacauguuucuguuucucucuuuuuuuuugaugugaauguauguguuuccaccagaacuaagauccaucaaguuaucaaauuaauaaacaaauguauucaagcaagacucgaugccuguuaauuagccaggcuguauuauaagggagccuugcuuugaguagcaucuuggacaagaucgccuccaaguuccucucuaauuuuagggucuccucucaaauuccaaacaaucaguuuuaaauuuuucugauaaaaacuuauugcucucccacuccccaguucuucuuccuuggcuaugguagcagggaccacaaucuuucucugccuuccuaacagauuaguccuuguccauaagcauuucaaauaagaagaaaauacccauguaaauaugggaaacaacuacucauuucagcugauucuccuuccccagagaagaauauggaaccaguagauuucugcucauugaaagaguuggaacucauauucugugccugguggacuggcuugccuucaggaaauugcucgcuaaucagagugagaaauggcacaaaaaaugcugggaaucauuugggugggugagaucuggggcugucuuuauguuucugccuauggaaagucaugauacaggguaguuacagugacaucucccugcugaauaaauccuguucuuuuguaaugaagcauggcagccaggccuagcacacuucccucugcacaccauccugcucaggccucugugccucggcugugcuguuccuucugcuuggaaugcauucacuguguccacuuagccaauuccuaccuauucuucaagccucaguuccaguguccccucgagggcaggcagugcuuucccaucugcccuagguccacucuaccagccucuacuugggcccccagcauaccuuaucugucuuccaucuccucaguuuagaaccuaacacacuguggcacucuuuuuuuuuuuuuuuuuuuuuuaaagcaucugacuaucuucuaucacagggccagguacucaaaauauauuuauugaauacaguugaauauauucugugaucaucccugaucauguuaaguucuauuggguccauacuauuuaguagccuaacccagguaggacuaaaacuaagccacuuguuugugcagcaguuucugauuacaagugguuuauauuccuguccgcacucagugaagaggagcuaccacuguuaguauuuccauaaugugaauagaugagaaaaccaaagcauagagagguuagauggucugcccagggucaugcaguuuguaaguugcaguggcccacagcccagcucucucucaggacccugagagguaaggcuggaugaacauugcugacuguuaaaagcaccugaccacugagccaggugagaugcgcccaccccuacuugucugcugcuccugaagauucacagguaaauugagccucuucuuauuggauucuauuuugaacucauggugcuggggguuguccuagauuaaaggacacaugagguggggaguugcaaagcauaggaaaaaaaaaguaaagcacagaauguguagcaaacuugggccgaugcugcauuuucuaccuucugucugcacuggauuccuuauaauuugucuugcacaaauugggauaaauacaaacaagcacacauauguaaauucauucauuuaaaaaauaaucuuucugaaccuuaauuuuuccucgcugggaaugauagucuuuugugcaaggaugucacacaaauuuaaugagaaaacucauauaaaugggccuugcauggugacagagcuggcauuuccagacuguuuuccuucuaacuuucuaccaugcaaccucuauuugacaguaucuguggacugguuugcugauugcucacaagccccagaagaaaggagggggaaaaaucauacaaacugcccuaaguuuugggccacucagcagccagcccucccuaaaaauucugagauaagagaaacauugccaauagaaguacugugaucccccagaccugagugcccuuccuggcuuuugccuuccuggcucacaaagccuccuaacccuuugcauucucuacuuacucuuauucuguaucugguugcugggguauccuuccuuuuugaccaugaguggcaguuaccucuggccuguaaaggaauuauucagaugccaaaaauuuggagauagccaguuaacucaggaaaugguauccggagaagaagcaggagugacacaucuuugggguuccuggguagccauguagcacauaguuggagggggcaggcuuugagucacucagaacuggguuagaauccugacucuguggcuuacugguuuuccagcuuuguuccaguuacucaguccccugggcuucaguuucuuuacuuacaaaauggggauguuaauaacaguaauaccuauaacuauggggcuauguugaggaugaaauaaaaugauguauaaaaaucaaugagaacacugccugguacauagugggcuaccaugaauuuucuguccucagccaugacuagcuggaauggccuuuuccuucuuagcuccugcuuuuccuugaaucucaucccuuugaguguucugcccuaacacgucaagccaaauucugugacuuccucuucugaggcccagaggucugccaucugaccuauagagucccugcaccugcguccuugacuggguucugaagcccccuugacacagugcucaggagaaacucaaagaggaaaugaaaggcagagucccuuguaucaaugacagcagcccaggcucccucaaccuuugccuuggcaaaccgacucagacaguauuuucauuugauucugucuuucuuggcuuugguugugacucauaaagcuauucaagccacucuauuuucucugccccugagagacuaaaugguccuauggagugugaaccagagaggagagaggucuugggagacccaguggccaccaugccugaagguuagaggggagaaccaugcaugcgucauacaaaagaaagggaaguggacgcuuuggcuuggccgcuggagcgcuauuaugccucuagccauuccuuugccggccucccaauuauggcugcaauuuggcagccauuuccuugcccugggguggaaggggucccugcaaagguaugaacaguugggcugcuuugggagccaggaaggcagaagugaccauuuaggucuggggaucacagggcuucuauuaagaaugguccuguugucucaacuuuuaggagggacugaacccugaauggcccaauuuugugugauauuuuuaccuccuacuuucugggacuugcaauaauaaaguaauuagcaaaccaaucuauagcuacuccuugaacaagaacuagauauaaagcaugauacaaagaaccaugagagauaagaagcuaggaugggguaagacacaaauuuaaaaaaugccuaauuggaccauacagugggggagaauauuaagacucauacaguuggagugguuggaauucuaagaagccauuaggcuggucaagaaaagcuuacagaaggaucaagcuuucaucugagucuuaaaaauguguuggccaugaaguacuagagauggaugggaagaacauaggcagggggaaggucugagcaaaggugcauccaggaaaauaaaugcaugaggacuugauguuuguugcacaccugcugagagcuagacacuugguaugccuaccaacuauaaacuaagacuaauauuauugccuccauuuuacagaugaguaaacugaggccaaggagcuccaacuagcucuuuggcugcucaagaacagggacaaauaugucuuacuuaucucuguauccugaguacagaguuccagaacaggccucugauaaauauucacggauauuaaaggccauaaagcagagccaggauucaaacucaaaauccccccaaggccuguguuauccaguuauuggagugaguaugaaaguguuucuaaaagaggagugggcaguaaauguccagagaggauugaggggaauucugaguaaaauccaagagguaggaccugaugcuauaccuucugggagccauagaaagccccugggcugaguaauccgaugccuguggccuuuuggaacuugggcgaauuugucaacaacaacacggagcuggugaccgauugagugggucauguuuuauccucuugcugcauuuccucagagcacccuguaugcccgguccucuucaggaauguguuccugguggcaaguucuuguccaaaguauccuccaucuagacugugaacucugugcaguuaggaauggagucugugugauucaccccuggauccucaaugccuggcccuggaauauaguaggcacucaacuaucaccugaugugucaauuuuagauaacgaugguugguaccuauacagaucauuuccagaggcgucuugcugacagcaagggacuggaaggaaaauagcugaugugaagagauggcaggagauguaggaauucagggaggaauuaguuguuuuuuucucuguguugcaacacuuggcucaucuguuugggcaccuucucccugucuugauuggcauauuagcuuccuacagcugccauugcaaaguaccacaaauggaaugguuuaaaacaacagaaauuuauuuucucacaguucuggaagcuagaagucugaaauccagguguuggcaauguuggcuccuucuugggggcuccagggguggaaucuguuccaugccucugucugguuccuggcuucuggugauugugacacuccuuggugcuccuuggcuugcagcugauaaguccagucucugccuccgcccucacauggcuaucuucucucuauaucuucaugucuucacagggugguuuccccacucugugugccugcuugugucuccuccucuuccuauaaggacaucagucauacuggaugaagggccuacccuauuccaucaggacuacaccuuaacuuacaucuugauuacauucacaaagaccuuguuucuaaauaagguuguauccacagguaccagaaauuaggauuucaauauagcuuuuggaggaacaugauucaacucucaguaguucguuaucacauauuaguguuaaacaaaauaauaccucuauaugguguuuuaugggucaugcgacagugaugauugcauuaaauucucacacuaacccuaaggguagcuggcauaaucagcccuauuauauauucugaaacugagguucaaaaagugauuugcucaaaauuauacaguguagaagugacagaaggaggaggaccugaagcugggacuuccaacucauauauuguucucuccccuugugcuucugaccuugggagcugcugggaugcggggguaggcaugccacccuccucacauccccacagggcucacaggaugcuugaggagaaccaggugcucuguaaauacuuguuggcuugaauugcauucagaagcucacccuugcucuggagagaaccuucaaggguagcaaacaaugacuuuuacugaacaugucagagaguguaagccaaauuuugagagaacuaggguuuagugagucugugggcauuuccgcaggugagguguugaauucacuguaccucauuccaagcugcggggagccaggguucaauucucacuuucuuccuuucagagaacaagccugaggccccugccaaggcuucuucuccccucucgucugcuccccucccuccuucagugucacccucuuccuccaggccuguucuuacucugaugcauccuccaaccccccacugccagagccagacagccaucugcuccucacucccccgugucuccgauggccccagggcaaaguccagacuccugcugacuguagcacgcacugcauccucuggcagcaccaccuauuggaacacacccucacauuuguguaugacacaaauugugaaacacaccgagucccuucaguaagacuuggcucuucaguggugcccauaugcaucguggagugcccgccucugcuccucugggcaagcuuucugaaaucccuguuuccucagccugccuuuuuugcauuucaaucucauuugccauuguuaaaauaaaggagcugaccagagggcugacgcagucccaucaguuuaagacuucagaagugggaaacagcaggugugcuuuugccccuuguuaggcuauaagaagccacucugacagccacugaggacugaaggauggcuuugcuguugucccauuuugucuuuaaaagcauccugugaaggugcuaggauuaacuuagugugaagaugaggaaacggagacccagagagauaucugucuaggaacuugcccaacgagcugaguuugaauaucgcuuccaccagcugccagucauguaguuuugggcaaauuucuugaucucggagccucuucuuuuuuaacaggaggaucucugagacuccucuuauauuccacaaggcuguuuugaggucuaaacccaguaaucuaccuggcauacaguaagcacucaguugacuguagcuggauuucagaguggaaagaagggaaaaccgugacagaaaaauagcuacaaggaaaagagguuaggagccuggagggugcagaagaggcacgaaaaggggaguuaucaggcacugugggggguuugggaaaugacacuagggccugauagugcucaauauuugguguccaagauaggagccaaaauggauuucucacuaaauucuuaguugugucuucacucccuugcuguauguggaucacucugucccuucggaauguuaacaugcugggaaauucaugugucauuuuggucaaacggagagaaagggagagacaaaggucaggaugggugacugaagcagcccaagaaagaaaacauguuuaggaagaccuuaaacccuacgucaugcuuuauaagucuggaagaugacauucagaggggcucuguagcuugcccagaguugcacagcaaguagauagcagagauuaggacaccuguuucccaggaccuauuuaucccugcugugucacagcgaugcaggacagaaggggcagggcccaggcagcccaaucugggaagccgggaccugugguugauugccuauauccugguuuccuuaccccaaauccuugugauccaggagcacacaaagaaacauguggguguauauucucccugcgacuuuccuuuucuaaagggacuuucacuagcaagcaacccagccauccuggcugcuaauguaaccugucacuucaaugccccaaggccaucagcaauucacaacgugcguaucuccuaauuagccaaugaaguaacuguuccauuucccuugcucccucugccuccaaguucacaauauguucucuccugcucagcuucagcucaugucuucuguuucugcccagaacuucccugugagcaaacaucauaaggaaaggguuaucuugggauguaagacaggggauuaagguuuccgcucugagacccagcuccaucuccaaacccauccuucagaguuccuggggcuaagccacuguggauguuggcuguccuugaccucagaacuggauuuuucugucugagaacaggcugauggagucuguguugguuauaaguaaauguuuucuguaauaucaacugcaugaaagaggaaagccaauuuuauuucuuggaucccaauaauauauugauuuuuuuuucaaagggaaauaaaaaaucauuuggcuaugccaaaccaauuuucuguaucuuuugguggaggggaacaauaggagugcucacagcugucccauagaaauaauaaaugcauguccacaguccaucauugaaagcccuuggggugagguguguuucagaauuugguuuguuuuuagauuuuugaaaggaaauagggugcauauacuguauauuaugugauacgucugaggcugugcuccauaaucaaagccauuaauuucucugcagcaaaauguaugauuguacacacuaaguaggaaagauaaagacaguaaauagcuucacauuacuucaugucagguuuuucacccaaugaguuauaaaaaaaacccaaccuuuugguuuuagaauuuuuugagugucaggauugauaagggccuguggcucucugauuaauauuugcuacuuuacuauauaaauucauagagagaugaagauugccuguaugagacugcauaaaucaauuuucaguaguucccaaagacauguggaccucagguacccuaggggagccugguuccacuuggcaucccacaggcuagcacagaucaggcccugaggaaggaacugagaaacauugggugaguaaaugcaucugcaggcucacuguuggcacaaggucuguugggucccaggaacuggccuacuguugaaauuaugauggaaaaaaaaaaggaacuauaaaacaauagcaauagcucacccuuguagaacucuuacuauugccaggcauuguuccaaaugcccuacauauuuuaacucacugaauuuucaugacuacacuaucagguggcaacuauuuuuagaaaugacucccccaaguucacauaguaaguggcagagccgggcuuggcaccccagcauuuuggcuucugaguucacacuuuuaaugacgcugccucuuauguaaaaaccauguccacuaaagccaggcucaagcaaacaagaguuagacuggcaagaaugaaccuccuuaauaaaauaauaugcauuauugaauacauacugugugcuaggcucuauacucagcucuuuguauuauucuacuuaagccucuaaauaacuauauaaaguagaguuucaucccccacuucccaggugaaggaccugaggcucagcaguggaggacauguggggcaggauucaaacccaggacacauuggccuggagccaaggaucuuggagugaggucacagauacuggccuucaggagcuuacauggaagcccagggacuaauguggcauucugagaacagcuggagccagaccgaucucuagguuauaugccagcauguugaggaggacuagaaagacucugaaucggccucucuuuccugacccuguauucuugguuaguuucacuuucucugugggccccagcuucugaaaaaugaggauagcaguaccugcccugacuguuauagugggugauacuugugauucagggagcuaaaggauauuaaagcacaauuugguucuuucuguucucuugucuaugcacagaggugccaggaagggaacuauauccaaguacuguagagagcaaauggcgucuuuuggaagaagagcagaaggggaagggacucuagcccuuucccauuaacugugcuggcacaggccuuggaguaccccucccccaagacaaggaagggauggugcugguggcucugucuggucuuugguggucccaagaaggucuccuggaccccucucuugcccugaccuccuaugcccauuggcugccaagcccugcacuauuuccucuuccuuuaaccucugaggucugcauuucccaccccaccuucauuccacugcucuguauuaggccucaccugcccaagccaagacuaaacgauggcugcuucccuggccucccuguccccagucucucuuccucaaaucuauccccacacagcugccagaguccuccucuuaacaaaaacccaccauguuacuuuuccaucaacuauagcaggagucagcaaacguuuucuggaaagggccagguaguaaauauuuuaggcuuuacaauccaaggggugaaauugagucuacuaugugaguacuuaccuaauaagagagaaaacacauuucacaaaucuguauugaugacauucaaaauauaauaauaauugaguacuuuuuugugacacaggucuacugaugggagaaauggaacuucuuuuugugggggauaacauuuugccuaauuggaguucaaauuggaguuugcuuaauuggaguucaugcucccuacaaugaaauugauugcaaauauugaucuguaaaaaccauucuuaguucucaggccauacagaaauggauuuggccugaggcccauaguuugcagaugccuggacuauagcaaugcuucucaacauuggcugcaugcuggaaucaccuagggugcuucuaagaaacacugaugaugggacucggggccuaggcccauuaaacacuuaucucugugcugggcacaguggcucacaccuguaaucccagcauuuugggaggccaaggcagaaggauugcuugaggccaggaguuugaaaccagacuggucaacauagcaagacccuugucuacaaaaaaaaauuaaaaauuagucaagcgugguggcacaugccuauaaucucagcuacucaggagacugaggcaggaggauggcuugaacccaggaagucaaggcugcagugagccaugauuuuaccacugcacuccagccugggggauggagugagaccuucucaaacaaacaaacaaacagacuaaaaaaaccccacucgucucugggcaugagggcaagauaucaguaugauuugaaagaugcuucauaauucugaccugcagccaguacugagcacugcuggccuacaggacagaggccaagaaccuucccugaucuggugcugccaaccucuccaaccucuuuuccuggcucuucuuguguccagccuuuguccaguaacaccaagugguacuuucuuauuucuggguuuggcucacacuguucccucugggaaugcacacaucccaguuuuccuccauuaagcuuuagcuccgguguccuccucuucuccaggaagaugcccucuccucuccaguuuuggagucacuuguauuuugucaugcuuuagcaugccacacugugcauggaauugcucauuuaccucuuggaacccuccaugacugugagcuccaugagggcaguggccacaucucauucuucuuggaugcuuuauagcuggcaucccaucgaguggugcucaguaaacauuugccagaggaauaaagggauuaggcacaaacuaaguagccugggaggaacuccugccugugugcacgaggccccacucuuacgcccaaaggagccagaucuagugggggugggaaugaagguauggcaggcagugguuuguuuccuauuccugguacaauaaucaccaguuuauuuucugggaaucucauguuuucuguaacuugcauuuucucacauugugacuuggcacuuguaaagcaacaaagugguuucccuugaauuuuuugguuuuuuguuuuguuuuguuuuuggucugugaagaauuuugcugcugaaaaacugagucccugugugguuaaaaggaaagaaaguaugguugcuauauuggcaugcagcaucccacugcauucuuucuguaauuuuagugcaguccccacugucacuguuucugaaccagccuugcucuggggucgauccuuguguugaacucacaucucuguugcuggggcccaggccuggcucuaaccucagugaagguggcaacugucuccuuccauauagaaacucccagaacauuucaagacuauuugugaaaggcccuguaccaccuuucacacucaaaacaucuucuguuuauucaaguuuugaguuucuuuguuuauuuuguuuuauuuucugagacagggucuuauugucacccaggcaugaucauggcugacugcagccccagccucuugggcucaagcaauccuuccaccucagccacacaaggagcugggaccacaagcacaugccaccacaccuggcuaauuuuuguauuauuucuagagauggaguuucaccauguugcccgggcuggucucgaacuccugggcuuaagugauccaccugccuuggccucccaaagugcugggauuacaggcaugagccaccacacccagccuguuuguuuauuuucuaauguucauaaggggaagagacuaggucucaggucauaagaggauauuagagaguuucaauaggguagggaagggaagggaagggaagugaaacucauuuaugaaguacaugcuauguguguuccauauguaaguguggguacaagcuucccccacugucauccugcaacaaccuugcaauauaugugguauuauacuuccaacuauuacagaagaggaaacaaugcuggguagauuaaaugccuugcccaaggucauacacaguuaaaagguggaacagccaaguuuguguguauaaacuuuuuauggacauaauauagcauaaagaaaacugcccaacuccuaaguguauagcucaguggauuuuucauaaaauuaacauaccaauguaaccagaacuuuaaauagaacaugaaauagaaugugauccccccucccagucucuaucuuuccccuuacuucuugcaaaguuaacugcuauccagacuuagaauacuauagauuugguuggcccauuuuauaauuuaauguauauggagucacagagcauauacucuuuuuugucugcuccuuuuacucaacauuguguuugugagauuuauccacguugcuccauagagucggaguuuauucauuucauugcugcauaguauugccguuugugaguauacauaaucuauuuauucacucugcucuugcuggacauucgguuacuuucuaguuuggggcuguuacaaauggugcuucggugaacauucuuaugcaugucuuuugguacuaauuuggucuugggguggaguuucuggguuauaggauauguaucuguucugauuuaguaaguacugccaauuuuccaaagugauuguagcaaauacccagaagugcaugagaguucugauauuuuugcucacuaaaaaaauaaaaaaaaauuuuuuugcucacuuaaaaaaaaaaaaaugaacucaacggccguguucauuuuagcuauucuggugguuguaugguugugucucauuaugguuuaacuugcacuucccuaguaucuacugaaauagggcaccuuuucauguguuuacuggccauuuggaugucuucuuuugugaaaugccuguucaagucuuuuuuccagaucagguugucugcuuuuuucuuaauuauuugugggaauucuuuauauauucuggcaucagucauuugccagauauuguuaauaucuucucccauucuguggccuuuuuauuaucucaguggugucauuuggugaagauaaguuccuaauuuuaaugaaauucaguuuauuaaccuuuuuccuuuuugauuagcacauuuuaugucuuguuuaagaaagcuuugccugcugcaaggucaagaagacauucuacauuuucuugcaaaaucuuuauuguuuuaccauuuagauuuagguuuguggcccauuuggaauugauuuuugugugaaguaugaaaucgugaucaagguucauuguuuugcauauggauaaccaauagaccuaacaacgucuauuguaaagaccacucuuuccccacgguaccacagggucaccuuugccauagaucagguggcugaucauuugugggucugcuucuggacuccugcaguuaaaguuucaggccagggcuaucugauucuaaaguguaucuucuuuucauuauucuauaauagaaagaauuugaguaaaugauuuuggaacaaucuaaggaugaaagaacauaauaugcuguuuuuuugagggggauuguucugugcuguuuaauagagacacaacagguacucaaagucucaaauggcaagugggguuuggagggugcaggugugugguaacuuggagggaggaggggcacagggauccuguguccacagacuaagagagaugguguuaggaaaagugcugccaacaggcugaaacugugaaccaggaccuuugaaaagcucuggggauucccaaaggauaggggaaaaauauguuuuucauggaauaacauggauaaaucucacaaaucuuucuauauuuucuauagcuguaaaguaaagcaaauuuacuuuagaaaagggguuauuuuuugaauaagaauuuguaacaguuagauuuuaaugaggguacauaauuuguaauuaggcauuauucgcucuucaaaaucuuguucuaacuggguaauuaauugcauuuuugauuauagaaguuaauccauauauacucucaucuuaacaggggauuacuuuuuuguagaugaggcacaaauagaggguuuaauaaccuagcuucuuucagucuucuaugauugaaaaaucucccgaucuaaaauaugugaucugaaugaacauuauugaccaucugguggaaauuacccaaaauguugacagugaacuuagauuagugguucucaaucuuggcugcacaccaugaagggaacuuugaaaaaaauacugaugcuugggugacagccccagagguucugauuugauuggucuuggcagcaaucugggcaucuggauucuuaaaagcccuuuagguguuuauaacguggauccaaggugaaagccacuggccuagagagaguuaauucacucucauggaacuagccuuucuuucucuccaaugccacuuugggcugcaacccuauguugugcagcccacaucauugcucggugaccacaggcuuuagaaugugcagugauuuuucaugaaaggguggcuccugaccauccauuuuauuuuauuuuauuuuauuuuauuuuauuuuauuuuaauuuuauuuuuugagacggagucuugcucuguugcccaggcuggagugcaguggugccaucucggcucacugcaacuucugccuccuggguuuaagagauucuccugccuuagccucccgaguagcuuggauuauaggcaccugccacuacucccagcuaauuuuuauauuuuuaguagagacaggguuucaucauguuggccaggcuggucuugaacuccugaccucaagugauuugcccaccucagccucccaaagugcugggauuacaggcgugagccacugcgugcuccgaguuuuguggguuauuguuaagcugaccauccauuuuaaugccucacugugcaggugggaaauccgagagucagaaggaagaaguaguuugugcauguucauacagcaggugagucagugauagacugggacugaaauucaacccccccgcaucucagaccaggagcucagaaucuggcacggucagcagaggggugaggaugaugagcagcauggggaagugggugucccugacuggagggaaggacaccaaauggggaugcucugaagcccacagaucaagugcgaggcuggacgcagaccaggugcuccaugacuguuguugaaugaaaacaagaagcaugccugcacagcaucguguuauuacuaucaauguuacucuucauuucgcaaaagaaauacugauuagguccuauugaggaaaaugaaggaauuguauggauucaggcccucugcuauguucaguuucuauucauuccuccacaagcugggucuaaaacacuguaaauuaacacugcuguggcacugaaugaaauuccuggucaucaggcuggcaugugugccugucugucuggcuggcuauuuggcuggcuggcugguuagcuguguucuagcagaugaacccauggggaagaaaggaagggggggcagguuaucuugauucuagugcagaagguuuccuugguugcuucauagaaauauggggcucaauauucuggcagugcugaagggcagggacgugccuuaugugaacauucauuucugugccgugguuucuuguucaaggcuugacacacagaaagcagggcagguuuggugcaugaaugaugaauugaaaaaucucuauuauucuaauauuuuguugaucaaggaugucaguaaugugguguuuuguuuuagacuacaguaaaaaaauagaaacacauguauauauaguggggagugggaggggucaagaggagagagaaacaggaucaggagcuccccaccggccaugagcacccucccuggcccacagcuugcaucuccagcacccacaccuggcacagaacaugaagacacaccagugagguggugauugagcagguuuacuccuuacugaguuuguggccaugggccugaaauaucgcagcucccuuccugauuugcuucuugucagauucucaucagaaaauagaauucaucccagaugguccaaauaaagagacuugaaugaaggaaguguuuuguggaaguggagcagucaggguuaagggaacaaauaagagauguugagggcaccuggggguggaaccaaaccacccaggucuaaaggggcaaggcaaggagagaaagugguauuucugaagccaaaagagagcaaggccugauggagaggcugcugugggcaggagcuggcauuguagugcuaggcagcacugaagcaaggcggaggcaaggcucuuccccuccugcccuccccucuccugcuagugcuuucuguuggccaaagccagugagggguggccagaaaggggacucagaggguacaccuacuugaccagccuccugggcacagagcagggcagaaaggcagaagauggauggcggggccagggugcaguuggagaagccacagcacacucaugaagggaagggucuguaggggcagagggagacccaggaggccacaggcagagcgugccugcucgcagccccugggggcugugugcuucagggaaguaauuaauaccauauccaggaaucucaucccuggacccauaauuacauguacaggaauuuuuuaaaggguugauggcagugguuuuaaugucucauaaauauucuuccaaggauucuccccauagagaggagugguuucauuucucaggcuugaagccagcucugagccuuugaagaagaggcucccagccucuucucgggaaacaaaucucacgguagcaccccuuccccaguguccuccucccccucccuacccuccaucccuucucccugcuucacugaggacucaggucuccauguuuacaagaugcucuggacuucauaauugcuuggauucugccacauaggaggcuuccuucaggaaguauuccaggauugcugccaguagaguuccugaggcugaucucugcagggcaugggggauugcagaugcugguaaaaacuuucuugagaacuccauguuugcucauuuugacuaaauucuggacugagaguggcauguacauaaguaggaggcuuucauuccaccgaaagcgaagccugcacaaggcagaggaaaagaaacacaagacagaaggaacaaaagagcaugugucugaagcccccagguuaaggaaggguguucacagagaccaccaccucuaauccccagagaacccucuggcacggccacugccaauucccucaguugauuuggcucagguguggcuggcugaaggcugcccggccagacgaguuacauuugaaucuuggcccucccccuaaugagcuguguguccuugggcaacucccuguaccuaucugauuugcuauuuucuccuucggaaaauuguguuguaauuaugucuaaguugagauaauuuaugcaaaaauauucuaccaccauaucuggcacgugccaaaugcucccuaaaugugaccuaguuugaaaccccaccuuggaaugaaccaaagccuggacccucuuguugucauugaaauuuguguauagcccguccauugucaaggccuguucaaggaagagcaguguggugugugggcucuggaacaggacggccuugguccagauccugccucugccacuuacucacuguguggucugagggaaaucaccuaaccucucugguccucaauuuucucaccuggagauaacaugaguacugacuucauauggcugucaggaggaacauaugaaauagugaaugcucagagcuuuguaccgugccaaacagcgcucaagugaacgucggauaucacaguacuccuugaacccauccaauucaaauaucccaaugcuuacugacucacugucuaccuugcacacuagaugggcugcucauuugcacccuaauaccuggccccaaauucgguccagaguuuaaugaacucaauucggucaacggguugaaugaacgcuugaguggugagcaaacguuggggacucuugaaacacagggcuagguccuguguguuagccacugcagaagccaugguuacaacagacaaggagccuuggagcauuuuagaaaccugaugcauuuagaaagcugugcacacugguucuuuccuccuggauuuuuuuuuuuuuuccaggccauuugagcugugggacauaauugcaucauuggcuauaaagacugcuuuccugaggggguacuuguuuagaaguuccaggccggacuuggcuacccuugauugaccacuugagaagccugauaauggcagggaauugggcuaccuggggagcacuguugccaaggaaaaaagcaagcugguguagcaaggaggucagaagggcuaucugaccugcacggaucaugcacucaagagucagggcuacaaggagccugccagaggccucggaggaucuagagaggccuguuguguucuaggcuccugcauuuggggccuuagugugaguuaucuccacuaauccuccaagaauucuacagggaaguuauucucauucucaccagacaguugagaaaccaagauugagaauggcuuauggucacacagccccaagccuuacuacacagccucuauucuucgaucuuccuuacaaagcuucuggcuugguuuuccagucugcacauccaggaaccuccaacauucaauucugaguaaugguucuauugccuuuccguaagaaugaaacgaauuugaugaacauuucccaaaaucuguuuccuggaacaagcauccuuggagugcuuggcuacaaaagcguucugugauuaaacacauuugggaaauuccccuccuucuuggagguucacagugugcauucccaaguucaagauucugagaaguccugcaguaaagaagcuauaauaagccagcuuuucccaagcuuaugcgacaaggaaucuuugcuuuguuaaugcuuauuaacauccuacagagccaaaugacucuucaguaaacacugaaauagaucaaucagccuguucccaagaccugacucagcaagugggcccccaaggauggagauucucccaugauaccaccccagucccugaaauagcauuggauucccgccuccagcauucagaagcauagugcagccuuguguugucauucauucucuuccucucuucuuuuuuuuuuucccuacacugucuugauguggaaaaugcccaugugugccacucccaagaacuauugauaacuuaugagaaaucuugaaggcaaacaaaagguguuuagacaaucuugcuuugcuuuucucauucaacauuugcugcauuucuggagauguugccaucacaccuccuuuuauaaaaggacauugggaggcucauagcugcauguguugggggaaggagguucuguagacagagaacaauuguccugcuucucucugccccaccagcccugcccucacuuucacccccauuauugacugccccguggagacagaaaagggcugaagagcagacgaaaguggcuggaacucaacaugucuaaagcagagcucuugaucccccagccccugacaagccagucucucccucagcuaauccccaucuguaaacagcaccaccauuagccccguuccucaagccuaaacccuagaagcugucucauuuuuccucucccucaccacccucagcccauccauuguccaggccuguucaaggaagagcagugugguguaugggcucuggaacaggauggccuugguccagauccugccucugccacuuacucacuguguggucugagggaaaucaccuaaccucucugguccuuaauuuucucaccuggagauaacaugagcacugacuucauauggcugucagaaggagcauauaaaauaguggaugcucagugcuuuguacagugccaagcagcacucaagugaacaucagauaucacaguacuccuugaacccauccgucucuccaucucaaauuggaccacccugauccaguccauugucaucucucccugaaccacgucaaucguaucuaaaagggguccuguuuccacucuacgcuaguacagucuccacacagcauccagagaggucuuccgauaacacggcuauaacagccucacuccccugcauaaaaacccucaaaguagguuuagcaucacaauuaaaauaaaacuuaaacaacucaggccugaccuggccugggagguagcucuuugacuuuccuugugcuguucucaaccuaguccacugcuccaggcacucugaccucugcucuguccuugaacccacgagccuuucucuccuccuggccuugcauaugcugcuaccuauugcuaacccguccagcacccucgcuuguaaaggccuuccccugggccugucucugccagcaaaaugugcauuuccucacacucucauugucuuauuuucuuaccccuacaagcacuguaaccucuaugagggcagaggcuugggcuuaccaguguguuugcagaaagaaugcagaagaaggaauaaagaaggacuguguuacagguuuccugagccacacuuuccucauuuucuuucuuuccuuuuuuuuuuuuuuuuuuuuaacagacagggccucauucugucacccaggcuggagugcauuggugcaaucauagcucacuacagccucaacuuccugggcugaaacgguccuuccaccucagccuccugaguaucugggacaacaggugcacacaaccaugccuggcucucaucuucuuucuauuauccauauuuuacaggugaggcugcugaggcagggaagguuaagacauauuuccugugccucucaguucauuaguggugguucgaggauucaacccccagcagucuggagccugcaccugccccuucucugcauacugugugagugggagcccagucuggacauaagguggaguguggaagugguucagagcaaggcaugcccccaggugacagucuggaccgggauuccagaagaaagaccuagauuauuccucccaugcuccucacuuagcugggcagccaugcaauguuccuucuccaccagucuugcucguuuucaucaucuucuuuccccuguucuuccccaguugcccugucaggagcgugauccccacauccagacuaaggccuuggcagggaccaggauaaagagccagagaagggccccaggcccccuacuccauuggccccuacaggugcaggacagaucuugguggcgacaggucuccagugcccaagauccaggcaugcacaagauuuccuaugagacagaaaagcauuaguuccuggggagaagcuguugccuuucuaaccuugacauuuucaggugguaccagcagcuuuguacuuuaauuugccuuuuuuuaaaauaaaaauuuuagaccagugggucuagaaaagucaauucucaaggaaggcacggagaguaaagaugaugaaaugagaggauguucaacuguguuuaguguuugagccugaccucuguauuaugggaaagacacacuuaccgggaaaagauccuuggcugguuacaaaaggaugggaaaggugcccuuggcagaguaaaauaucucuauuuuuuuuaauuguauuuuguuuuguuuuuuggcuuguguuucuuucuaggacguuauagcuuuccaguaaaucacaucuccacuuucuagggaguacagaacacuuuucuuuuagggccacauuuaacccauccagcuucccucuugggaaugcuguccaguacuucccuugcaagugaaggcuuagcuuggugacuggcacauagugagcacuagguuagcacugacacuuauuugcauaacaaaaaagggagaacagaaguaauuuacauggagcgacugcugugugccugucauuauacuagggauugcauguaugugucccucuuaauccucccaaccacucugcaggugcgaacuguuacucucccaucuuaucagcuagggaaaaaaaggccagagagagaagggacuugcucaggguuagcugugaaugagaugaagccuggaugagaauucuaguucugagagagagaguuucagagcugggaugacaugcugggugucuggacccucagaaccauccacuagccagcugcauugguuuccuguggcugcuauaacaaauuaccacaaacuuggugauguagaacaauagaaaucucuucucucacaguucuggaagccaggaguucaaaaucaguaucagugggcuaaaacaagcuuucaacagggcugugcuggaggcuccggggagaaucuguuucugccucuuccaguuucugguggcugacagcauuccuuggcuuguggccacaguacuccaaacuuugcauccaucuccauguuaucgccuguguguuugugucaaaucucccucugccucuuucauauagggacacuugugauagcauuuagucuccaaccagcgaauccaggauaaucucuucauuuuaagauucucaacuuuaucauaucagcaaagauccuuuuaccaaauaggauaacaugucccuguuccgagggauaguaccugauaucauugggagccauuauucagccgaccacaccagcacuaggggcugcauagagaauaagcacagauccugagauucugagaguacauguggagaggaaggaggaggggcugagugugagccacucugaggggacauaccacccuggcaagggcaggauaggcaguuagcaguggugccauucuuguccugggggagggacauacacauugcccagcuucuaacaagaauuaaauuggagauguugggaccacuguucguucauucauucauucauucaucgaaaaguuauugagcagauauucuguaccuagcccucgggagcucauagauaggucaagggacuauuauauagacuauagcaagugcugggauggagaaaugugcuaucaagaagggaagucuuccaguagcaggccaggcuuaaacugagacuguaagauaaguaggagugaggcagguagccccaagacagagaaaggacacuuuagcagagcagcauuagcaaagcuaugugaucaagacugaaccuguuuucuacaugcugagguugcccaaucguucauuuucaggcugagacaaaucuugggugaggacaucaagagacagguauuugaucuuguuuugaguucaccuacuaucuuugugccucauaucccuccauccacauaggugaaacccaccaaaggagaagggacagcuucugcaagucucugcagcugacagggcuugucuuccauuggaugcguucccuguuguacuguacauguggccaguagugugcagacaggcagacuggccagcagugaagucugaaugcaaacugucugcuaauuaaaggcuugucaggucuaaggaauccagucccccaguguucuugguguuaacacaacuuuuccuuuagaauguaaaagugcauccuguguuucucacuguuugaguaguuuuucaaugcccuuaggauagaaagcagagcugcuuuccuccccucccacuguggugaucccacaaugcuaaacuuccuacugccagccacaccgcccccuucuagaaugccuuggguuuuugcauacauauaccccucaucugcgacacucuuacucccauuccgaccccaucaaauccuauggccuucaggucuccucuuaaaggucacuucuuuuauugcauuuauacagcuuugauuaaauauguguaugucuuaauugcuucacauuuuucuuccgaagggcaggggucuaugauuauuuuguugacccggucuauccuacguggcagguauguguuagauauauguugagugaaagaaauaauaauaacaaaaucaaauaaaauuucagaaguaaaauacuuaacaggaggauaaucauacauucacucuagguaauauucuuuaaccauuaaauaaguuuucagugcauuuuuuaaauuagaaaaguuuauuauacugaauggaaaaaggauaaagagcuaugcacagucuaauuucaaguuuauaaaauucauguauauucacuugaaaaucuaucaaaauauuggcuauggauugugaagcuauaggaugacuguuguuuuuguccuacuuuuuucuuuuuuccaaauuuuuuaaauaagaacauaugacuucuguaauaaaaauaaaguaucaaugaggcuccuuugagccaucugcuaucuugguccuuccucaaaugcagcuuuaaucuuuuacacacauuacaggcucacuaggaaugaauuggaggcccccacuagaaugauuuaaccaaucaacuuguucauuaacugucaugauaucuucuguguguuagacaaaagauuuagaauaauccuuauuaugggcuggacaaagaaaauauuugaaaucccucucucucauuucuuuccagucuuucucauggaauucccacagggacuaaugcccagaaaaaagggcaaaguggcauuagagucuuugaaaggagaaggaguucaaggcuugcccgucguugcagccaaagcagaacucccaugaagugcguguguguuuacuaauuacccccggcuugcaaccgcauucgccugcuucguaagcacuuugggacucuguuaaaacuucacuguaguaaugccuuucucuagacuauaacuauuuuagaaauuaacccauuaucauuuuuuucucuuaaacuaccaagaguaaagcuuaguaauaauuucuauuagugagccugugaaaaaacuaggauccucauauaaaacaaauuuuagaaaacuuuuugaccaagcuuauaccaugacuuagugauaucauuuuugaacucuucaggauauaauccaagguuuauguguagauauaucuauaucuauauagauauauagauauagauauauauaguuggaaacaaggugaaauuaauaucugacacuaaggaaaugggcuuuccaguaauugugcucacucagugggcuaaaugcaaccauuugaaaugcuaguuuuaaauaacaggagucaguauguaaaauguuuaucgccuuaguuucuaugucgaugugugggugugugcaaauuuauguauaaagauugaggcgacaaaugacuuugccacauagggacacagauguccuccccacacccaccucaaucccugcaaaaguacggguauugcuauuaauuauguauuaauagccauguguguuggaggcgauuuggaggggucauuguggucauagcaugggaagauugaucuuugaagauuucgguccucaaagagugucuugaauuuuaucuugguaaaucaucagaugacccuucgugcuggcuugaauucaugaaaauugucauguccucuuuuacuuguugagcucuguggauaaguauugauuguuccugguccaucaacccaggcuugccugcaugccccccucuccuaccugcuuuccugccccagccuuggauggcccucaccccaauuguccuggaacacuugcuuuccucugccugggaaugcaugaaaaugaaaguaaucucuaguaaucaggcccuugagcuuugaaauaaauauauuugccuuugacuuaaugauaucuuggggcuuacuuuugacucuauggugagucaggccuuuauagaaaacaaauauauuuuauauaacauuucauauaagguuuuuaauuuucauuuuuugaaucaacuaccucaccauauguuaccuuuuagauuaagaaaaacguuuucauuuuuuaaaaugauaauuuguauugcuggagaagguacaggaauuugauaauuucauaugaucuuucgaccuccuucuucuuuccuucacugcguuuauuugcugauucucuucucaccuucucuuugaaaugccuccugacuauccauccacccacccacccauguaucuacccaugaauucauucaccuauccacccauuuauccaaccagccagccagccaaccuuucaacgagccauccauccauucauccagccagccagccagucacccagccagccagcuaacuauccacccaugcauccauucacaccuucauucauuuaucgauccauccauccauccauccauccagccagccagccagccagccagccagccagccagccaucuauccacccaugcauccaucuacaccuuuauucauucauccaucuauccagucagccagccagccaagcaucaacccacccaugcaucuauccauccauccaugcaugcaucuaacaggcguugaguaucuacuguuuaucagauacuguuguaucagauacagcagugaaaaagacaagauucuuuuucuuuacauauauuuaaugucuuuagauauauauuuuuuucauaauuaagaaaaacucugcccuaaugaacaaaacaggcccaaacuuccuauccuaagcauuucguugucucuuaucugcaguuugaauacagcuccaauaauacacuuuauuggcugcacgguugauuccccagcaggcuguggaguccauuuguguccacaaugccuugcccaagucaccuuguccaagucagcuauauccacaaugccaaggcuugccauccaucucccuuauguguaguucucuaaguuaacuugaaagaaggaggagaguaauguagaaccugauauuuauugagugccuacugcaugccaagccccauaucuucaugagcucauauauccuuccaaacaagauuccccccuccccucccauuucacagaagaggaaagugaugcuuagagaagucaaaugacuuguccacauucucaaagccugguuguugcagaccagcauucacaccuaguucuaccagauucuguuacaaguccucucugcugacauuauuggcucugagcaaaggaucaguuucugguuucacacauuaguaaggauagcagcugagagauaagcuccaucucccuaccccacauccuugcugauuuucuguagaaacucuggaaagggagagcccugguucuucuaaaggaacaggggcuugugugguucugacacagcaaagucauucacuucugcaaacauauaauuuuaaacucccuuucuugcagauucucuuauuacauuuuacugcaaaagaaaaugguucugccauccaaaucccaucauaugggucuugacuguauuguaaacccugggauguccaucuaauaaguauuggauugacccuuugagacugggauuggaaaaaauaaaaauaaaaucaccacucaaaauauauaucacaagcugggguaaugauacaaaagucaaucuuucuauuccaaacuuuuggugacccuucuaaaagcucaugaaguucaucuauacacgagggggauagaggcagggcaggagcacugcuguuugggcucucaaaggauuucuuucauuuccuacuccaaauucuaucccugacaccuugggcucucuuccucaguucaucgcagcugccauucacaccuaccucuuaucucugcucacuuuguaaaugguguuuggggaccauuugccccaaucaucaggauaaaagguagcucugagcucaggaaguaaaauaaagucucuuucuucagaauuacagggggcuggugauguaggugaucauauuugcuaugugcauuccccaggggguuucuugacuucacuaguaacaacaauuaucauauuaacaacagaucuuauuuccuuugugaauuuucucaaggaacucaugaaauuugggaaccacaguucccuagcuugucugaaagcacaccuggggaggggcauggcuaggggaagagaagcaaagagaucugggauguugugaagggcaaacucuucaggcagauuuuauccuucuagaauaugugauaaggaagcccaugggggcugugaggauuccuuggagaacuaaagccaauggugagcacuguguuucagggcuuguuaggaucuugucuuggcccauaucccaaacugguagaggugauuuuuuuuucuacaugucagaguccuagaaccaagcccacaacauucccagccggugaccagaagcaagcccaacucuucuccagcugcaguaggcaucacccagugccuccuaaugggccugagugggaauugcuguaggcugugcaccugggacagaaagcacauguguacuuaccuugacuagguagugccacauugcuuuccuccagugcuaccccaaucugcacucacacugacaugaagccaccuguauccucuaucccugcauagcuucugacacuugagacagagcucucuauuuuugccaaucugcugggugcacacauagcuuauuguuuaauuguuuuuguuuuauccuuucuuugacacuacauaaguuugaguauuuacauacauuuguuggcuuuuuggguuucucuucauugaauuacuucuccacauccuuuguccauuuaucaauuagaguuccugacauuuucuugucaauuggaaggaguuccuaguguauuauaaauaccaaucccuugucacuuuuagguaaguaucuuuucccaaacuauguacaucuauuuuaauuuuuuaagcaaaaacguuaauucugggauuaccaaauuuaucacuuuuuuuuuuuuuuuuuuuuuuuuuuuuuuaccauaggaguugugccuuuaggaguuuuaagaaguuauuuaggaguuuuaagaaguuauuuaagaagugaccuccaggucacaaagauauucuucuauguuguuuucuaauaacucacagagaggacaggagcaugaggcucagguuccucccaacagaagccccacgcuuuaggaauugcagauggacauggaggauaaagaguuuuguuuuuucuccuucagaggaccucauaagccaaggggaaggcaacuaggcagagagggcuuuaauuaaauuuucuauuuuuuaauuuuucugaacuucaggggugcucauacuucgcaugauggagggaauaguuaaugagugcagguuucccccaggagggcugccaccacaacggcuugagaugaggcggccagcagcccccaucucuacuccagucugauaagcuguggugucaggcacagaggcaccugugaaguuggaagacaguggaaaggaagaaggugacagccugugcugucaugauaaugucaugguauggagggcccuggccuccgucguagggggcccaugugaaggguuggccuccauggccugugagcaggagccuggcucagggaaccuggggccucuauucuuggcugggcuuugcuuccuggggccaucccuugaacacaucacuccuacaugaugaugaauucuagaaaauuaaagcagggcagggggaguuugaaugucacccuuuuucuuacugaugaggaaacagacccagaaugaggaagcagcuuacggaaaauugcaugguuugugggcuggagacccagggccagggcuccagcugcuucaccuggaaaaauccuggacuuuggagacagacaguccuggguuugaaccuagcucuaagagccauuuauuaaauaauuucacaaauaaaggugauguuugccaccauggucagugcuuuaagugaaucuacucagagcugugaaaucuugggggaauuugacccagucacaguugagagaagguucuggaaggauaugggcuaaggucuacagaugaauaaaaguuaagcugguagagagggaagagcuuguaggauggacagagggaugguuggaugagugacaugagccugaguuuaagagguugacuauuucuucacccuguccucucucuuagccugugaaggcuugcugguaaauugcuaaaucuggcagagaaugaggaaaggaagaucucuuucccuggcuaucaauuguuugaguguuucacuuaaaguugagcaccuguucuauugaagugcccaccucuguuccucuccauuucuuugaacccuaucacugguccuugggaaggguaaaugcaaaagaaaaaaaaagugaaagcaguguuaaucaugcugaaauguaaugcgccccucugaaccuuggaagaugagaaauuauacaugcugauuucauccgcuacuuaacucagggggugacaggcugcaauugaagaggcuuuggcagguuaagugcugcaaacccuugcccaggcucuuaagcaucucucggaaaccucugagacucguugguaauuugguggugucauuuggagugacuccuggcccugccagcugcagggacaguucccaguuaaaaaaaaaaugauuucauucucagcuaggauguggucuguucuuuuuuugucuggggaccggagacuguuaagggaaaagagaguggggaggagauucugcaaagaaauaaaagcagacaagaaugggcuuguguacauugcaaccaccaaagcccccucaacaaagcuucaucauuacuggaaucaggaaagaaaagggagaaaacuaacauuuauuugacauuuacuguguaccaaguaccugucauuccugaacguauugacuccacacaucuccgcgagacagcuguuguuauguggagaaauuaggcuaauuaauuugcccacuacgaugaugacaacaaugaugacgauggugauaaaagcuuauauuuauauggcagagacuauuauaaacuccuuaucugcauuauucacuccucacaauaacccugugggguaggugcuguuaugauccacauucuucagaugaggaaaaucaggccuagaaagauaaaauaacuugccccuuagcugguaaauggcaggacugggguucaaauguaggcagauugccugcagaaccugugcuuuuaaccacuaggauggaaguuggaaagcaagacugacauagucuaaacauccuugcccuuucagccacaccuggcugucccaucucauacugauauaaauaguauuacaggugagcauguauggaauguuggccaaggguggccucuguacuugguugacauuacugcguauuuaauucucacugucucugucgagguugguggacacugaagcucagagaggucagcugaucugcccaggaucacaaaugcuaacuguggcucugggccacuuuuuaagcuacgugguuucacuugcuggcuuauuucauuaaacauauaaaauaauuccuggaggcuuggucuguugaaugagcagugauucaacaaacugaguggcugcucuuggcuucucuguggugggagaccaaugagcacagugaugagacugacccaguccugcccuggaggagucccuagucuuggggugggacucuggcguuggugccuuccugccccgaauccccaagggccgcagcgaacucacaugguaggacuuugccucuuucaaccccaugcugguuuccuuuugacuaaagaaacagcagccuccaccugcuuuagucagauuuagauguagcaagugauuaucacuuauuauugcuauuaaucugacacaaaggaggcuugaaacucuugauccucagaaauaaaagaccccaccacccugccaaaagaaagaucaauaacuuugcaaauuguugcuuuuugaagccuucaaggaagaaguuguguuuuuuggucaaagcaggccauuugaaugucacauuuguuaugucucucuucuuuuucuuuucuuccaauaauuugagucaaaaugaugauaaaacugcucuauuuuuagguaguuucagcagguuguugacacauuggauuagcauaagucaguuauuucugaagcuccuucauauugccaagacaacuauaagcaaguaaauaauaauauauuuuuuccuuucacaaguagcuauggacaaaaugauggcaauucuuucauuguaccuaaucaauaacauaugugcaucagagaaggugugauauguauuaacucuuggcagaaggaauaggaauuuaaaggaaucauuuucauagacucuccuggagagggaaaagaagagggagaggaaggggagggacagaagaagagagagaaauaaaaauaaucuuucuggcugacucacaggugguagcuucuuguaaaggaauccuccaaugagaguaucggggauucuaguagccaugcauauaaggucagaagguaagaaagagaaaaccgcacguauugaguagguuuaccuuuguagguguucacccauagauucacuucaucuucucaauuuugccaugugaauuagcccuuaguuucccaauuuuacagauaaggaaauggagccaaaggcccaagaaaagucuuguugaaagugauccagccaauuuguauaagaaugaggaugugaauccugguucaaauaauuccaaaguuuaguguucaucuuuuguagcacauuuuugcccaagauauguaaaugauaccuauuguauuauuauuuucugauccaaggaggaagaaaauauugauaagucucaaaugggagcugugaaugggugacuaggcuuucacugauauauagccuucuggcagagcuauaaaaugaaugauaggaacuuuucuauaaugacuuguaucacucauucauucauugauccauccacuguuuauugugaugugauuucuccuguguuuagaucuauuuuaacuucuggcuacccuacugggccuagaaacacaagaaagaauauaguaccuucccaggccucaaggagcuuacaaugaauauggcagagacagggaaguugacugccaggcacuguacaguggagcagcaccagggaauuaacaccuaauguuagugcccaaagagaaaauuaccuauugguuacauuaccuuuggaacuccaugaauugcuccugaagcagagagaucacacugugagaggagcacccaguccccaucauacuuccucaggacauccccuaauccacagccugugcacuggcugcaggggcuaguaagcccuuaaaccugugaaucacucugucugccaccuccuacaaacuguauaguagcaguugcauaaggaacacacaccuaugacgcacauuucccuugcagcuuggcaaaugccauaguaaaguuuauuccaagggccuuuaggagcccaaccagccugggucuuccucaagaaggugacacaaagagggcauuccugagaagagucuuggagaaggacuggaaggcucugcaccuccgcuaaugcugcccugagucaucgguggaaaccuuuucacagcaucagagcuggggauaaaacaguuguggggaggucucguggaaagaauacaaccuauaaaauggccacagagugccuguuuugcagacuguuuuaaggauuagacagguuaguaauuuaaaggaucuagcaugauagccacuagcuuacuguggcucuugaucacuugaagcaugaccuuugaccuaagcaugggcucucuugcuuagagcccaucagugucuuccuauugauuucaaaguaaaguuuaaaguccuuaacauuuucagaccuuauaugauccagcuccuaaugccuuaccccaccacagguuuuuucuacccuugccucuacccgcaccgggcaucugcauguuccucaaucauacuggguuucuccaaugucacuuccuccauggaaccucccagacccccugagaucugguggagcugcccuuguccuugggcuuagcuccuccugcuucccucugugccuguugcugucaugguagaacacuaaccuaugcaguagucagaugcuaaugccugucuccccacugcaguguaagcuccaaagggcaguagcuguggcugucauguucaucauuguguccucagcgccuggcccagagcuuggcaaaaauguuucuggaauagacaaugggauuuagagaaggcuggucagaaggcagcaggggucagccucuuguggguauuugccuucugucucugguaggauuuuaacacccagggacuugguuauuuuaaaaaucucuugauuucagaaccucccaauuaaaagauccuggaaucauucauaauacaguugcuacugggagcuuuucggcugucugauuuuuuaggggccaugaugggccuaaggaggaggaagggcccaugggcugggauuuuccuucaucaaagaccagcaaacucuuuauucuuuaggaagaaaguugucacaacaaagggacacuuaccuaauguguaauggguauuuugggguagauauagugcuuaucccagcucaaagccucuuggggcugcaauuuuuagugccaggaguuggaaaacaauuuucuauuuauacuuugcuaaauccuuguaauuacauauauuuuccugaaagucugaguggcaaucacauauuuauccucgcaaucaaagccauuguggauuaucagguaaauaccucauuaguaagauuuugaaacaugucucccaacaguuuuugcuuucuucauaaaaacaacuaaauuuuaaagaaaaagcaauguaucuguuguacuguaaauuccucuagcuaauuuugauuaucccuaucaaaugcacuugagaaaagagauuuacaaagugguaaauuaugaagacugauauuuaaagcaaauguaggacaauuaguacaguagacaggaccacaggcaugaguguuagacugggcugggguuaaacugucacuguggcauuuacagauguguaacuuggggccucagugugauagaagccucaguuuucuuguuguaaaauuaggaugaaaauacuucaaagaguuacuggauuaaauuagauagugcagaugucauguaacagauguuuaauaagugcucauuauuuuuuguuuucauuguuaaauaauaucauauaauauuucauugcccacuaauaaauuggccucauucagauuuuuaccauagcuuucccauaccuacggagauuuuagguagagcuacaugaauuuuggagccaccuucugauggagacaucuggggguuuuggggaaagggaaucagacuugggcagggaaaaaauagugagauuaugagggaacaagaggagagagagacuacagaggaacccuuuccuccaggccuugucauccauggcaggcccauugggccggggggugcugagauuuaaggaaggugcaugugucugucguauucacugcuuccucuccagugcccaucagguacaggcucuggcacaugcgguuauggagcauguguguguuuaaugaauaguuuccaugacagagcuaagauuacucaucuuuucuuuucauagacaguaucuccucaaugauguaacuuagguaaaauaagggucacccaaagcauuuuuccaucucgaucagcaaaguaaccauucaucucugggaauaugauggcauucagaaggugacagccaacagcuccaagugaaaacaucaaaguaauugaacauuaaguugaaggaccagacccagaaaaaauucuuucagcuuaugugucacuugcaaccaagccaacaaagucacggucauuucacugaaacaauaaaggaaggaaaucccaaagugcuucuaaguagcaaagauugguguaugagaugaaauguauaggauauacuacauaaaaauuagauggauaaaauagauuuuuuccuaaguaugugcaaucuauuauuuuuaguaucauuuaguaaaacaacaugaagacauuuuauuaguuuauucauaacuuuggucccccagcucaaucuuuuccaaaagaauuacuaugauaauuauaucauaugaaaaucugcacuggccagacucugugcuggacacuuuacacacauugucucauguaacccucacauugccucugggagauaaguguuucauccccauuuaucagaugaggaaacaugaguuucagagacagcggauagucacaacagacugcaccgauaccacacagcugggaaguggcacagccacaagucaaacucagguuagucaaauuccauaguuauuacaucgcagguuauuuucugauaauguaauaccuuucccaguuccacauuuuuuuacauuccgguugggagaaaaccucccaaggaugaguucuaaacuuaaaugccuguaggaauugggcagauggagcaagugggcuggaugggaauggagaacacacagcaauugcccuaaaaggggcagcugccgcugaacugcagcacccuguggucagaaaggaaggugaguguuuugucauuauaccuuuuauuguuccaagagaaacuggaaaucuagauuuuuaauguaaaguuuuauuauuuuaauauauuuucaguuaauuuaauuaaaagaaaaaagcaacuguacuagccaacaaaacauaucaggaguugcaauccaccugugugagucaguguccaaugaucugcuugucauccacgucagacuaaucgccagucaggcaaugugcuuguuccaacauuauugccacugcugacaucuuagagcucucucccaggaauauucuuuggaacaagaaggugggccacaccagaaaaucagucuaaaaauaacgguuaaagcucauugacugcuacguauuuguaagcauuuugucuauguuaauuucauuuaauccuccaacacucccaugguagacuaucaugcuucucuuacuggugaaagaacagguucagagagguugagagacuuacccaggucacagagcuacaaaaauaguagaauaggacuugaaccuaggucuggcuggcuucuaaaucugugcucuuagccucugcgcuguacugucucccacaggcucuauaaauacugaugagcugccccaggcauugcuuuguucaguucccguuguuccccaggauuggaugucagagagugugggaacuuguucuggaaaugaacaccuugccuggaaaagcaucagucuuccaaguaaagugcucugugcaucauaaaaccuucaauuuagcuccauuauauuuuagguccaugagggauagauugcaguuccugccuucccacugauuagagcauccuauuuccguguauacaguaccuauuagauggugcauuuugcagaauuagcucccugaugaacagguauuauuucccccucugcugacaugcagcagcugucugcgcucauuguguucaagccucugcaccugaaauugggaagugaggugaaauggugcaaaacucagcaguuacacaucuuaccuucaagcuuaaagauguguaagaccagguucuacugauuguaucucuuuugcuacuuauaugaacuuggacaagccauuuuaucagucuuggucucuauuucuucaucucucaauuggaacaacccuuuuuccuaacuggaugcaagaaucucauccagaaggccucccgagauacauaugauauugcuccaacaucugauacuugucacaaauauguacuguguugaggcacacagggccuaguuuuuagacuggacuuguaaguaaacauauguuacuugcauuucuaugauacagguuuuauucugcuacgugacuaaccaaauuguccugacaccauuuacugaauagucuauucuuuccuccuauugauuugacugccacuuccagcauauuugaaaucccacagauacauagucucuguauuuuuuuuuucuguugcgauauuuauuuuccaucuauaacacacaguuuaaauaacauaucuugcuaucuggaaaagcaacuguacuuucuuucuucuucuuuucaaaguagucuauuugugccauucagggucucugcaggaaauagacagcacucucaaaaggggugacugaagaguucaaugaauggacuauuuacaaagguguggauaaggacagggacucaagaagcagugcugaagcccccagagacuagcaacacugggagugugacaaaacuaagucuaaggggugaagagaagauacacguauuagaaccuaggaaaacuugcucgauggaugaggauucauugaaggguuuggagcugaugaugaauuuaguucauacuuaaaaaauaauuaucugacauugugguagggacaugaacuaguccagcagagaacuguauuugaggcugguaagaaugaacacucuaaaaucaugaaucugacacaaguuacguuuacugcaauaagcacaaaggaucccuuuccagcuaaagacaccagagaucgggggaugaucccugaguucagccucucaaacuuccccaauuucugcagagggguggcacugauauuaugccugcuggaucucauaccuucacccaugucauuccaaaagucuagcauaauccucuuaaauaucaucuggaccugacaucuggguucuaaggccaaugcuaccagcaucaucucacuacauugucacagguugcaugauaauugcuaggcaucagacauggacagucacauggagcucuguaauaugaccagucuguaauaaugcacauuuggucugcuguaucacaggcuuagggcauugugggcagggcaggaagagaucauucagagacaguuuuuaguacauucugagacaugauggguugauauuucuacaacacauuuugcauuguaguuguggguuaaauuuaagaaauuccccucuucacuuuaagaugaucgcucaguauauaacaagaaggucuuauuuauagccugcucauccauaaaguuacccuuaaauaaagucucgagagaauugguaauucacacggcuaaaaaucugacagucuauuaaaauaccaaacagaggcauuuagcuccaucauugucacugggauaugcuuuuguaguugaagugauaucuccuggcacaaaugacaauuuucagccugauuuuauauccuugauuuugaaggaaggaauaugguuggugcagcaccaucuugcgugcuucuuggucauaccauugaugacaagcuugaucaaagauaaauuccuacuccaacugaggagggagagguucccuaugugaacagaaucaacacgcugauccugagugggaagaaaugucaugugccuuucuauuucauucauauauucuuucuuucugccugaucacauacauuauuaggauuuuagggaaaacauucugaaacuuaugaauuguacaagaaauuuuugaaaucaguuuaacaagcauuuguuguaugcccagcccaguaugagaaacugggauuuggaaaugagaauauguagcucuugcucauggaauuaauggagaagucagacacauaaaugaacuauaauaaagcagaauaaauauuauccaacugcacaaaguaccauagggacccacugaggaagaggcuguggcucuguaaugaauagaggagggauguucuuugugucugaagagacuuugaugcugaugacaacuuuuaucuaaguaaggauacaguuggagguuaucaacuguacaugccaugcguacaguuuguguccugcuuuccccacauggugacauaagcauuuuucauccggcccaugaacgauugacagagcuuccugccucugcuucggguccugagcaucccugucuggcccagagcaucccugucuggcccagagcucucuggggauaccaccucauaagcugccugauaaucauggcuuuccaggccucugaucaacaagauguaacuuuuaaaaguuuuuuaaaagucugaucugcaguuuuccuucucucuagguaacugcccugcuuuucuuuacccauugccccuauucucacccuccccccuucgaccucagcacuucccagcagacuuguucuauuaauuuuuaugagacuuuuaugcuuuuguuuuguuuuacuuuuauuggaaaauuucaagcuuaugcaaaacuagaagugacuguaauaaccuccucauguauucaccacccagcuucaacaaugaucaauaucuggucauuggauuauuuugagucaaauuccaagacauccuauuauuuccucuguaaauacuuuaguguguaucucaaaaaaagauuuccccaccuuuuaaaaaaaaacaaaaucuggaugauguguaagaauuccuuaauagcaucaguuaucccauugcuguucauauuauccuguagaguuuuacaaccaguuauguuuaauacuggauucauucuuuuuuuagugccuuagucuaucacccaggcuggagugcaguggugcaaucauagcuuacugcaaccucaacuuccuaaguucaaagaauccuccugccucagccucccaaguagcuaggacuacagguaugcaacaccaugcacagcuaauuuauuuuuucuuuguacagauggggucuugcuauguugcccagacuggucuugaacuauuggccucaagugauccuuccacucagccucccaaagugcugagauuacaggcaugagccaccaugccuagccauagauuuauucuuaugccaaaaaaaaaaaaaaaugccuuuuuacuuaaaaaaaaguuugcaaaaauauaauaaaaaauaaagguguuuuucguuuuuacuacacuaucaucaguaucuagcuccgugccuggcccauagugguuguucaguuaguauuuauugaaugaauggcaggaaggagggagagaggaagcuaagaaguuaggaaguuagaggucaggaaggaaaaaaggaaaggaaaggaagagggaaggaagagggaaggagggagagagggagggaggcaagggaggcaagggagggagggaaggagaagggaagaaagaaggaaggcaggcaggagggaaggaaggcaggcaggcaggaagggaggaagggaaggagggaaggaacgcuuagccucacuacccacauuaguuuuuugaaugcagcuucuuacaaaggcauaauuugguacucugugaucacgcuaugcauacaguuuguguccugcuuuccccacauggugacauaagcauuuuucauccggcccaugaaugauugacagagcuuccugccucugcuuuggguccugagcgucccugucuggccuagagcucucuggggauaccaccucauaagccgccugauaaucauggcuuuccaggcuucugaucaacaagauguaauauuggcauuuacucagcuggcacugugcuaaaggucauuuuaguaauauuuaucauuuaauuuccugaaauugucaauccuauguuuggggaagggggcagcuuacuaaguggaugaagagcuaauaauucuaaggcaccugggaggauuccucaucuagcaggacugcugugaugauagcccugauuuuaccagagcccagaagccuuuaggaggagaguguuguaaaggagugauauuuugggggguagcccuagagcaugguaaauaaagcucagggcaugguaauuacgacguuaauauuucaaaguggaaacauuuccauuccauuuaaucuauuuccaucucucaguuagccuaaugcauagugauacacuugagcuguuuugauguuccaggaauugaguguucuugugguauguuuuacaguccuuauuuaccuauaaacauaugccacacuuggauaguuguugcuacaagugggcaagauaauuuagggguuaucaaccaaaggcauacauuuaaccaaaaaauaaauugucaucaauuauauuugucucccccaucuuuauuuuggaagguuggaagaaguuggugaauggugguuguuuuugaaaagauuuaguaccugcuguacuaugggcaauacugucuuccaauaugacuugccuguuuaaaauuuggccuuuaaacaugcuuugagaacugcaaagucaauggguuaugaucagguugggguaccaccauguucaagagcaggaauuuugacaaagucacauuugcaaaaccccacaucaucauaguuggauuaaggcagaaugcuaggugggaguggacaacacccccaggugaauucagaaugguucaagcgauucccuagaaaacuggauagggauuguccccagguuagguuuuacaaacagaaugcucucacagcaagucaggcugauguaagaguuggcuaugaaaguggccucaggacagaaggagaaauauucugaaccaaaucugcaacacaggcaucuuuggggacaaccuaaaagaauguguagcauuggagaucaugccauugcuuugggaacuuccagguaagucuccaguccucagacaaggcaugugccaguuacugcccuguuuaguggaccauuuaaaaggacgcugcccacagucacucaaugaagcaucucgcaccauguggaauguggcaccagcaccucauuugcucugucuccuagccuuuuguugggggcagagugaaagaagagaagagggucucuggccugggacagauuuuucuuguugguaaaauuaagauaacaccuucccacccaauucccuccagcagcauacugaggucugagaaguagauucucuuacuagaauaugguagacaucaaaaaaaggaaaucucucauauuauaauauucauuauggauauauaguguggaaacgauugcugagagcaagcaccagaucaaagacaaaggaccaaaaaauggcauuauucuauuagauauaaaaaugaauaggaaucauucugcagauuuuuuuuuuuacccaauacaauaacacuuccaucauuuaggacuaauaauagugaugaugaugaugauaaugaccuugacucauuugugaacaccauuuuuuacaaagcccuuucguuaucuauuaucuuucuugauccucugaaugaccccacuagauagauauuacagggcuaauuauuuccaugugauaaaggagaaacuguaagcccagagggcuucuguggcuuaaccagggucaaauggagaauagagucaagcuagaagccugaacaauuccagaaguggucuuucuccuaaacugugcuguaaccuagccccacgcuguaguaguaguggugaugacucuacaccaggcacugggacaaacauuucacaugaaugugcuuguuugauccuuacagccagccaggaggcagauucaauuaguaucccuucuuaguagaugaggaacuugagggaggagaagguugucacuugccuaaggcuacccaacuaguuggggggacuugauccagggcuccccucuugaccacuaccccacacucuugcagaagagguuuaaauauagaagggagagaaguucuagguccucuccuuggauucacguccagaugcaaggcagggaucugcugaugggcaccuacaccuugcauucaucuugcccaggugauggucaucauccugaccacugaugagauccaccacuggguggcucacagugcuacugccuggggugagucugugggcccucgaggcaguagaccuaaguaauaugaaagaaguucugccuugggccccucaaaccccugggauaggaaaugugcucccauaagaagaucagaguaauuuucauuucuaauaucuugacaaauacuguauugcauaaauuuguuccacugagguuccguaauuugucacuguggucucaugugucagugugagcugcagcucuauuaaagccagcuagcuauaugacuuuggcugagguacuuacuuuucuagucucaguuuuccucuucuguaaaaugggaggcugugacaugugucucaccaugcucacaugauuuugcugcagacugugaacaaagguucucugaaaaggaauuugagggaaagagacuuuauuccagugaacaguuuguauaaugggaagacauggccuuugguguaaacagaagaagguguguuccagagaacagagaggguucaauuguuuuguuuguuuguuuguuuggagauggagucucgcucugucacccaggcuggaguguaguggcgugaucucgguucacugcaaccucugcuucccagguucaagcaauucucuugccucagccucccgaguagcugggauuacaggugcccaccaccacggcuggcuaauuuuuguguuuuuaguagagacgagguuuuaccauguuggccaggcuggucuugaacuccugaccucaggugaucugucugccucggccucccaaagugcugggauugcaggugugagucaccaugacuggcugaggguucaaguuuuauagcaaaaguucucaccuaaguucacaaucaagucuguucaugcaaaugaaggauucaaacuugcugaguuuugauuggucaacauggcugagcccugauugguaaaggcaggugagcucuaguugguucaagugagcucugaaauucuaaaaguuaaaaagguuuggcuuugguuuuuagggaacucuugucaacaaauggcuucuuggcucucuuuuaaauguagacccaguuagccgcuagggauccaucuugaaggauuagcucuuucagguucacauuuguucacaacaucaaauaaaaucauacauauggaaauucuucauaaccuaccaacacacugcacacauagaauauuauuuuauucaugccagcuuaucuuuaggauagacuuaaacuuuucagacuucaaauucuuuuuuuguuuguuuguuauuguuuuggggcuucuuugcauaugacguagggagaauuaucacauaucugugcaacuuuaauuuuucagcaacacauaaucagaaaagggauggauugagggucuuuguuuuauccucugaagcuacuguauuucagaccucuuugguacacaggaacacuuaaguauuuggaggcaggcugaugggucaccacugagucuuucuuuucuaaguaaaaaucaccagcuccuucaaccacauuacuuauuuuaagguagagaaaaauauaaauuuaagcuuugaagcagacagaccugugcuugcauuccuaggcuuuuuguaucuuugugugaccucuuugagccuugacauccauucucccuuguuaaauggcaccaaguccuuaugagaaucaaagaaaugaaauaaaaugcacuugcaauagagugccacucaccaaauguucauuucccuugacuuccuucaagauucccuguaaugcauuaaucaggacacuggguaggguucaucagccagcucugccuuccccgaagaucuccguguccuguccuggaaacaacgucaacuuaaaauaacguuuauaauacaaggaugccauucagugagggcuuacuaugugccaggcagaguguuaaggacuuuuauguagcuuucacuuuuuaacuuuauucucuaucugggcaauguuauaaacugacuuuguaagugcaaaaaccaaggucacaacaaaaauaaacaaugggucugcauuuagccucugcagaugaaaagcggugagucuagguuuugccccaaagauuggcaaaauucuucuguaagacucacaaaguaaauauuuuggguuuugcaggucaucuagauuuugucacaacgacucagcucugucuuauaguggaaagcagccauagaggcuaugcaaauaaauggacguggcuguguaccaauaaaacuacauaaauaaacaaaaccuggccaacuggauuuggccugcaggcuugaguuugcugaccccagugguaaacccucuuuuuuuuuuuuuuccuccuuuuucuucuauuuuaaucacauaucucuggcugguugaucaugaguauauccuuuguagccuuucuuggcaguggauauauaagcuauaagcuauuuuuacagcuuuucugauuugcuugauugauuauaaguguuuuucagguaccaagcgucacuucagacucauuuguaaaccaugauacauuagagaucgucacacuucuaggauggcauguuuguggggugacagaugaggcuuaggaagucuaagcaguucagagucuggcuugucagguucaaggcgaaaacuauuuuuuuccccaaaaaccacguuaagagacaguccagaaaugagauugcuuaggucagaaagccuuccuggacuugaccaucaggauguagucucucccucucuacaaauuaucaaccagaagcugggcuuucccuguaagaucuguuuuaucagauagauuuaaagggaaggaaaaccccccaaagaaaacaaucucaauucaacuaagacauaaggucauggaaugucaaugacgaucugguccaggaggcagauggccaucuuccuccagcccucagcaaguauuucucauuggugccucgugcugguuaagcuuuguuuuccugccccauaagguaaaaguauuuagggcccaaagagcccuacauccuuucccccugccugucccccuaccugggagacagcuuuaucccaacauuuaagaagugaucuuguucauaaauugccagccuugccaaugaggguauccgucugccugugucucucugucauuuuucugucccugucucugucauuuuucugccccugccucuuucuccggcucaccucucuuucccucacacugccuuuuuauuuucuacuucuuaagaaagaacuugggccuggugcacagaaagcccucaaaaaccauaauuuguugcgucucuuuuugugucucccaucugucugcccuuuugucucccgcucucuuccucccuucuucucugucuccuuuuucuucccuuuggaauaaaugcacagaggccagagaggaggcugcuaugggacuccacagcuggccggcaaagagagcaaggggcagaauuuuccccuugccucucucgccugcccaggccugucuguugggaaugucccacuccuaaucuuccaugggggucaugcacauccuucugucagcaacuggcacaaaucaauuugcugcaggcagucaugcuccguggcucucucuguucccacgaugucacccaggcaguggugugaggagcccauuuggaaggagcaggucuauugggugggggcugggcaugauuggggcagcagaggggaggucacucuuggcuccaugggaacccaaagccucuguggcucuagacgguuguggucuuacccuugccuaugugacuggugauuguguuugggucaggcauucagcugaaaccaagagcuggcuggcagucagggucaccccuaaccauaugccucuccuuccuagcccucagugcucucugcuccuuccagccuucuaauucauucuggcagcagcaggacagggaaagggugagacauuggcauguuuuggagauauucaggaacaagacuccagaauucagugccagccgaauuauuuuuucuuagguauuuacuaugcagcacauauguuuccugaaucuuuuauacauguuaucucuuuucauuuuaugaaauagguauuauuaucuugauuuuacaaaucagaaaacugauguuuaguuuggauuugagggggcugaggaaaucaggaacuagaagugacucccaguuucauuuguuuccauggcacccagcacggggcucuucaccuccuuggcuccaaucuaggcuuguugaacuguugcacugagucacaagugauuagguagaugaucaugcccucaacagaaaaaagggaugucagaggagaaacaaguuugggauggagaagaugauuggucuggauguuuauuccacagagauagauuuauuuauuuauuuauuuauuuuuauuuuuuauuugagauggagucucacucugucacccaggcuggagugcaguggcgcaaucucagcucacugcaaccuucgccuccuggguucaagcaaucuugugccucagccuucugaguagcugggauuacagaugccugccaaucacgccuggcuaauuuuuguauuuuuaguagagaugagguuucaccaugcuggccaggcuggucucaaacuccugaucucaagugaucugcccgccucagccuuccaaaguucugggauuacaggugugagccaacguuccuggccucaacaaagauuuacugaguauccccucuauggcaggcacucucccaggcagugggauagacacuaaauaaaucagacaaaagucuguguccuuguggagcuugcauucuaguaagggaaggcagacagcaacacaaucagugaguagaugauaccauauaugagaaggcaagagugauaggaagaaaaaccaggaaauaaggaagguugugaugaggaaggcaugucuauugcaaauuaaaagaggguaagauuugaacaaagccuuaaaggauaucuccuuucagggggaaaaccuuaaaaauaccugcgggaaaagcauuccuggcagacaacagcaaguauacagccuugagguaggcccaugacuggugcacaggaagaaagcgaaaaggaaggagaguauggccggggaggucaagcaaggaggcgaguaggaaggcagugaggucugagggagguaggggaggggucaggccacauagaaucuuggaggccagugugaggauuuagcuuuuacucagagagcauagaggguaauuggaggguucugagcagaagaaugacaugauugauacacuuuuuaaaaaaucacucugacugcuggguugagaacacccugaagggcgugguaguugggagcaggagcagcauuagaaauuagaaguuagaagacugugacagggccaggaguggugacuuaugcguguaauuccagcacuuugggaagcugaggugagaggaccacucgaggccaggaguucgagaccagccugggugacacagugagacccccaucucuaccaaggaaaaaaaaaaagaaaaaauuagccagguaugguggugcacaccuguagucuuagcuacucaagaggcugagaugggaggaucacugaaguccagauguucgaggcugcagugagcugugauugugccacugcacuguagccuaggugacaggguaagacccugucucaggaaaaaaaaaaaaaaaagccaagaaaggaaaauaaagagggcugugacaguauucugggcaagagaugaugacagcacggacuaagguguuagcaguagagguugcuggaauuugcguaugaggugccugggugggaaagacaaaggugaucccuagcaguggucaguauggaguuggcagcuaauucgugauuguugauuaaaaagaagaaaaucugggagguuggagaccuuuuucuuaguguguacuggagaagcagccccguucugaagccccauucugaagacuugggauuucuaacaggaggcacaguuaugugugaacuugucugauauuccucacucgucuggaaguuuccugagggcagggacuaugucugcuuuaucccauuagucccagugcccagcccaugggccagcacacaguaagcgauaguaggugggcaaugugauagaaugggacacgagaacuugaucuccacgcacucuccucguccuccggucuggcuuccuggauccagacaugagacuuggcauuaucacaggcugggauagagagaguaugaauucuccucuaggcccuacuaucuaacugcuuugugagucuggacuguguuucuguaucuauaaauugagguuucagauauuuauucagcaauauuaauaaucucugccuggauugcauuccagagagagcuuuccuggccacucaaaacaaguccccuaacucucucuccccuuucccugccuuauuuuuuccacaauaccugccaauaucugaaaacauugucuguagguguacauguguguguugcauuuauugccugcuagagcauaaaccccauaaaagcagagguuuuuuucugucuuauucacugcaaaaccucuggcaccuggaauggugugugcuacauagaaagugcuaaauauguauuuaugaacgaaggaaugauugauugauugauucuggggacucaacaauauguagaaaugugcuuugcaaaccacaaagggcaaagcaaaugaaagguguucagcuauuauuauaaaucugcugcacacuuuagcauaguuuuaacuccucccacagcauuuuccaaggaaacgucggugaaaucuuuuuuuucuauuuggguuuucuucaaaaagaagaauucugacaaccuaauuuaagagacuuccuagguguggaacucagugauggauccucaucucuuagcaaccucacauaggagcugcucaccagguaaauggggugacaauuucaagugggugugcucagugucagggaugagacaugugauaggaggaaggaugagaccuuccccagccgguggaggggaacaaaccuaaagcaggagucgggacccugguauuguaguccugggcaagccauuccccuuugagccuccuuuccuccauacagugaaggggcuuggcaagaucccuuccagcucuagcauucuaugauuggcauuuccaguuaggcacuucgauaaaaacgaucauuuauugggcaagucccugugugaagcacuuuauuuguaauauuccaucuaauccuaauuuuaaaucuguaagauaggauuauaauuauccccauuuucuggaugaggaaacugaggcauagagaagauaaggucacuguucacaugggcugccauaacaaaauaccauaaauuggguggcuuaaacaacagacauuuauuuuucacaguuuuggagguuggaaguccaagaucaaggugccagccaauuggguucccacugaagaccuucuccccagcuugcagauggccuuucucucuuccucuucuuaugaaaccacuaauaccaucaugagugucucacccucaugaccuaaucuaacccuaauuacuuuccaauaggcuaguguccaaauaccaucacaguggggguuaauucaacaaugaauuuugugaagaugcaaucauucugucuguaacuauugcauagcuagcaagugauagaaccaaaacuuaacugugaucaguagcuggaauuuugacucugaggcaucuuguaugaucccuguguuuugguaugggauaccaaugaaggagauucugcuguguuggaaaaguucuuugggaggcaaccgguguuugcuaugagugccaccuccauacaguugggcaccauggcaguacugcacaccacuauauccucgguguagccuuauaccagaacgugaaagauauucaaucagugucuauuacauaaaugaacagauggcucuguuaaaagacuaaugacuaugguugggcacaaaaggcucaaaaaaugguuuuguccagguauccugggaaauggggccccuugagucuuaucaaaagaagugagaggggccgggcgcgguggcucacgccuguaaucccagcacuuugggaggccgaggcggguggaucaugagguccggagaucgagaccauccuggcuaacaaggugaaaccccgucucuacuaaaaauacaaaaaauuagccgggcgcgguggcgggcgccuguagucccagcuacuggggaggcugaggcaggagaauggcgugaacccgggaagcggagcuugcagugagccgagauugcgccacugcaguccgcaguccggucugggcgacagagcgagacuccgucucaaaaaaaaaaaaaaaaaaaaaaaaaaaaggagaggauagauauaauuaaacaucugauuuauacuacauuacuccagcugcauguuccuguuuuuauagacagggaaauggaggcugaaggaagcauaggucccuaugcuaagcagcagagaagcggcuugccaaaguucacacagaugucuggagaguguggcugucugcggggcccuacugcaaacaguguaauaccaaagugccaagagaaugagguccucccuggggaggcacugagcccccaccuuauaccuccuccaguggggaaagaacccuggcccuaaagugagucaagugggucuccaucaucuuugaguucaucauggggaaaauaagucagccagccuuauagccuuguccugagguccauggccuauuaggaguuccuugaaugguuaagaaaaugcagaggaagccaugaggguuugguauaaggcagcucuagagucucccuacaggaccaguguaaaggcaccgugguggugacuagugggguauggggguaagaggcugaaggaccugccuggaagcuuuauuuauguagcagacacauuuuugacguggccugcauguuuauuuggugggagcuggcacuagugaaguuuacauggaagcuaaaacacugcucuuccccaacccuuaauaaugccaccuuugauuuuggaagcgaaagaacaguuucuaaguaagaugcaucccuagugaugagcaaauuggucugaaaggggaaagugaaacccaggauagagcuuggaggggaccugugugguaauggaggcuucugcaaaggcagugguuuggugggauaaggagagaaaccccgaaccaugagaucaggaccuaagagaaagcagagaucacagggaucuuuuacauuuguucaacuaauacuguaugguugcaaaucacuuucagauacuucauuuucugagcucuucacuuuggccuugaggcaguugggggaaaaugguuuaugcccauuuuacagaugaggaaagugugauugucagggcuuaaguggcuuucccaaaaaaguuaccaggagaaggaaagugaagcggauuuuuagaauuccagcuccagcucuccuuugcuucccuauaaugaaagcaggugacugacaccaagaacuuggcuuugggaacagggacaugguagaucuuuuugcagagauggcaauaacaguaauaaauaguaauuacuaauuacucguaauagaauaagcguguguauguggugggagguggggguugaagcagcaguuucaaugaguguucaauaaacacauguuuauuacuauuccuaaggcuaccgcugcugcagcugaaaaugagugccuacggugugccagacagcaugauaagcaucugucugcauuaauucucaaacacccccgaaggcagguauuguaauucucauuuuauaaaugagguaaccuagguggaaaggagaagagacuuacccagacacugagguacuguccggcugacaucgaagcuguguggcucagacucuuagcaccugaaucaacaaauggcauuuguauucaucaugcuuaaugaucaucaucgcgaggaggagagucaaauguucucugggggauuacagcugcugcauaguggaaugagcuagaauggacuucggaguuuuauuugggaaugucuccucuucagccaucuuaugcuuuucagacugagaucaggucgucaggacugaagggauagucuauuuuucugucaacucuauggagacaugugauaauuacacauuuuucuuucugaagaaagaccugagaaucuauuucaauaaguucccaaauaaugaugcugaugguuugugaaccacacuuugaguaguaagggucucaucuccaagcuccucauagcucaaaaacuguucacuuggaaguccuauuaaaauacauucccaccugugugugcuggguccucagauguggccagauaauugaaauuaucgguaagguauaauaacagauaauuuauuaagcaccugugauuugcaaggaacuucucaauaauguaugaaguagguuauaguuuugucuguuuacagauaaggaaacugaaguucagagagauaagcuuaccugaacuccuacagcuaaauggugaaacuagaauaugaacccuagucuuugccccucugaagagugugcuuuuuccguagauucaaauuaugaauauaaacuaccccauaagugagagauuaagccucuugauacacuuggccauuauuucgcuuguuauagagauuacauaggugaaacgugucuugcaaauugucaggacuuuguugauguuaauuuuuguuauuaguaaucaaauaacauggaauuuaaugacacuaguagcauggaaaaaugagagagggaaguguguaaaucaguauuuaagcaaagcauaacauuuguaauaaugucacguaaauucaggaauaggaaaacccaagaacaaugaauauccauugagaaaaagcccaugacauuagagaagaauaaaacagaaagaaauccacccguguuucuuggcuuugcucccuccccuuuggguucagagaauagaauugagacaacaccaaaggggguggguaaagaguuugaacaaugaauacacauuaccagcauccgcugaguaucuuguuaacauuaaccugaugcauugcaagugagcugcaguuagaacaguaauuacaguaaauagaauccauuuggaauucucaagcaaauaugaguggggaagaaagaugggcugaaaaaaaauccauuacccuuaggaaguuauggaagcuuuggauggcagcgauuucuacugugaauugcaucugacuaagaagugacaacaugagugaaucuaucucagcucucaagugcauuuagaugguaaauaagaugaauugccuaaccauuccagccaagugcaguuuccugaaauauuugucuuggcaauuuagguagaaaauuuagguaaaauugggcagauggccugauuacucugcuuccuucuuugcacugcugguuuuuccugaguaaaaugaaauauugucauucuggaagggucaaaaggaagggcccagcaugagauggaagaagacagggaaggauucugagacuuucaaaauggucugcacucuugcauguuggucaaagagaaguuuuguuuucaaagacuccagugccagucuaccuggucaggugcaugcagaccccuucugggggugucauguacucucuuucuguaaguuccauagcuccaaaccagcuuggcuggggcaguuucauggguaugagaucuccucaugggccugugucuuucucauucucuggcucuucccucucugcccgaguagcgagugcaugcccaggucagacucccuucucugacuuccucaccucaccuccccuagcccauagggaagagacguaucuucccucagccucugguucacuaaagccucaugcuuugagcacccccucugccaccugugugaguaaugguugaaaaacucaggaguacuuagccuggaaauugggagacucgggcaguaugagugaguuuccauaugcucauucauuuauucaacaaauauuuauuaagugccuacuguguaccaggcacugucccaccuaggucugggaguagauggaaugcaguuccucauugugugaucugggaugcuucauugauaggagaaugcuuuaaaauagggagaaaacacugauaucugaaagggagaaaugcuaaaagcagcaucucugugaaugcagcugggaaguaucugggauuuccaagaccccaucuauguucuuugugccagcuaaggggauguccaccguggcagacacaagccccugcagauccaggcuccugcagacccaggcaugagccuggggaagcagcccugccucagcucucagaguucacccaaaggaccccagauggcugaccuucaacaucuuguugauugggugccaggacaagaacuaauuaguacugguaacaagcuuguucguuuuucagagagcacagagaagaaaguggagauggaaauaauguucuggucucaaacuauuuuuuuuuuuuuuaaacuuagcuacacuguauuuucuuuagaccauauuaagcauuggaguccuuuuuaaaaaggugagucagggccauuuuuaucaagcaucagcugaauucccaacacucuacuaucugcuuuauauagguuaacauugcuacuuuuuuaaugcucacaagaacacugugaaggagggauuuuuuuugucauacccauuuuauaagugagaaacugagacccugaaagccaaagcucaggcucuggagccagcagaccucugugugugacccagcucuaacauuuuccauuugugaaaccguaggccaagcugcuucacuuuccugagccucuguguucucaucuguaaaauagaaugauuucaaauaucugcaucauaaggugaaaagugauaaggaucacuuaaccauaaugcaugugaagcaccugcucccaugcugggcacagagugcuuaguggucaguaaaugcucucuucucccucuuccaggggccaggaggaggaagcuccucauucccauccccuugugcccaagcuauccaugcuagggguuggcugcagagaaggcuuacugaugcucagggugagcugcgugugccagugccucggaagcccaccacgcuucagggcagggccaccaggccauggagagucaguccagccaccacagaaaaaugaaugugguggacuuauccucaaacaacugugcaaacaccccccagaggcccaguuuuggacaaggacaggaagugaaguaucacauucaugcaaagcugcagggcgccagggacgcaggcagggggaagggaacugcacugagaacugcugaagguaaugagcccaacuggaauccagaugacgccaggcuggcuuccuggcccuggagcugaggcuuagagcagaauuucucagccucaccuggacuuuggaaucaccuaggaagcuucaaaaaauacucaugccugggucccacuccugaugacuuugaguuaagugguuuggagugcagccugggcauugggauuuuguagaacucccccaagugauucucugugcagccaggacugagaaccccugccuagaugauggguuuggagccccuuggauguucagcuccuagacacacaagagacugaaagagggaggccacgcaguuccuuauuucuguguggcccgcuguacucccagccaccaucccucccacccucuucgccuccuccugcccacuggcucuguggucuuagccacaaaguccauguuccacauuuucagagccugccuuccccaugggacuuuaucucuuccgugccucugcucacccaugugcgcuauugcgaagcccucuccucaucucaucgcgguccaugcagucacaccuaccuuugacaaucacaggcuggcuucucuggucaacucuccucaugucagcccaaaaugaccucuccauaucugcauucuggcagcacagagcuuggacagccccccugguacuugggccaggcagcuuuauacuuucuaguggggugcaauagcugccuguggggucucaguguccucugugauuguggggaaagaccacccacccagugugcugcacagcuuuguucauggcccagagagaacaagagcagcauucacauugcacccaaugcuucugugugcacauucuccuuuguccucaccagggcuucuucuggcaguaggauucuuauauccauuuuacagaugaagaaauugaggcuuaggguauauuugcuggaacucacccagaguuauuauagucuggacuauaaguccuggacuccuacuuuaccacaccacccauaaggaaaugucauagagaaugugaaauaaugugcuuuaggucauuguuacaaauaaucuaguuugaugaaaaguucuaguuuccaagggcagacauuccauuuuuuacauccuucacacaagaauucacugaaccucucagagagcacagagaggccccaauucagaggucugcucauucuacaguuguuggaggcccaacaucuacccuuuuacccuacuuucugguggaagagaccaacgcuuacauacauaaucacugcacagugugugcugaguucaaguucuagcucugucauguucaugaccuguaugacuuucuugggucaaguugcuucacuucugugcucuucacuuuccuccucuguaaacuggggaucuaguaccugcccagcugcauugcaguaagauugagugugauaaugccuguguggcacucaggauaggcauggcacguggagggcacuggauaagugcuggucaugaggagcugcagcaugggcauggaguugcaagggaucccagaggaggcagagggaacccugcugacagaucucaguuucccaucgcugcuaugacacauucccacaaacugagugccuccuaacuacacagguuuauucucuuauaguuccugagaucggaaauucaaccucagucucgcugggguaaaggcguuggcagggcugguuccuucuggaggcuccaaagggagaauccauuuucucacuucugucaacuucuagaggugccugcguucugugguguguggucucuccccagccucacuccaaccuccugcuucacagauccuacacuaacuccgagucucucacuguccucuuauaagaacccuuguaauuacacugggcccaccuggauaaccuccccaucucaagauacucaaucaccucugcacagucccuuuuaccauguaagguaacauacuuauagacucuggggauuaggacauaaguauuuuuuuuuguugguggggaggcucauuuuucagccuaccacaccaggggagggagugcagggacgauuuccuaaggaggcacauuucagaugggucuugaagaaugaguaggaguuugccagauggaugugcaggaaugggucuuucaaacaaagcaagagcaccaaggcauagaaggaaagccugccauggauagagaaagguaaggaguucauggcaaugggaaaaaguggauaugagagaaggaaugaugggcgggaaggccuuuuaugcugugacucuagaagcaaacgugugcuauggcagcagcugccagaguccucucugugguaugaugucccgugcaggaaaucuugacauuccacccuagcccaguccagccagccucaagaguaucauuuuccagcuuguaguguguaugucuggccaucaagagcugguggucccuggggcugucacauuugucuccauuuuuuugccuucucugccagcaccaaagcucugacagaagggcccuccagacucccccugaccccaccucccugggcugggcucccaagacacagcaccuggaggaucaacuccaguaauggaagacaagacccaaugccccuuuauuggaagccauuuuccuucucaauaucuucaggagagguagaccagcaaagugacauuuccacugaaauaauuuuucaauuucuuguaauaggacaugaaaguugguccagggaaauugauuccauucgaagcucccuuuguaggacacuuuaucuuccauugcggccucgguauuucagcaauuucuaaagcucgaggaagucucguuuaauauuuuuuucaccacccuggcagaaggcuuuuguagcucagcugaauggcucugcugaccugucacuuccucacguggcugccuguggcccccacccaugccuggucugccuaccccacauccugcacccaaccacggggagcagcuuggcagcuucccacacuguccccucugugcccccaacagggcugauuuauucucauucuuuacucuuucuccuucaucccuccuccucucuuucccucuccucccuuuucuccuccaucuuucucuuuugauauugcauuuuucccauuuuuuuucccucucuugcuccuucaugucucuuccuucucucccugugacucuugcccuaggauuauagcuaucacuuaaccaugggacccagcagguuacucggucucucugggccucagcuucuucaucuguaaaaugggcauaauaaggcacaucucacugggaugaugaggauuccauaguaauaguagggagagagggauaugcacaggagcagggagcaagugcugggccugccagcucugcacaggcgcccuugaccuuggcucugguucauaaaauaaagaaggaugcagaacugcaaccaaacugugcagugugauacuuuucaaagacacagcacuuuucaguuuaccaggacuuuccugaccuauuaccaaguuugaucuccacgacaacacuuugauggagauagagcaggcauccuagccggcccuauagaugaggaccuaugcucacagaauucaagugauuugucugguguucugucaucugcacuugugucaucugccuauugauucuguuguucuuuucucacuggaucacggaaugggacaccaaaggacagccccguccaacaauccccugcuuggccugccacucuccugaugcuggaguuggaguacagggaaaaccacuuucugcuggaucuuccuggcacucagagccccagcuuugugacuguguuguguuugagguuugagcaggcguugccaacacagcuccaucaucucccgcuucaaggcucggccuuuggguuucuagccccaaagugaacugagucaaucuccagaguagacucaacuuccauguuggucuugagucaaagcccauuuggaugcccugagcagacauuacucucagcuggauggcagcauucuccuccacaguugaggaaacugaggcuccgugagugugacuuguccaagguucagcugggacuuugaaccuagguccagccaaagacuucaggccuuuuggccucaggaauaucaagcgacuggcucaaggucacccagaaaauuuggaauucuugucucccuaggcugcauuccagaacauuuuucauuccauacucuauuuaggauaguuuggggagcuucugugagacccucaggccuagagccagggcuaaggugaaagaaguuacaauuaguguaaagucaacuuuccaccugcucuggcugcccagugauggaagggaugaccucaggucccuuggacaauuugggcaagggcagaggucacuuggaggugcugaggagguaauuccaaaucugcuguuuggguggcagucaggggccaucccguuucaaggauuagauggucugcuuacuucccagugcugaacgggaguugaacccaagcugacagcagcugcuuuucagaaacaauucccaagggagaaggaaaugaaaauuugccccacuagaaucuggaaucucagaugcagcagcucuucuuguugucuauaggugaggacaugcaaaccucccugguuuuuauugugguuggaacaugcugggacugcuuaauugauucaaucauucauuugacaaacauauuuaagcaucuguucuggggcaagcccugcucuagccugugggggugcagcagucaccaagcuggcaugauccugucuucacagcacucacauucuaggggaagagacaguugagaagcagucaucccaaauacgugcuugcgcaggacccucucuuccucugagacuugguggauagucauacaacuucucacagucucaaaagcagugaggggccauggaggaaggacccugaucuggcugugagaugccagcaagucuagguaccaccccagcugcagguuccuugucugcagaguguggauagcgauacccacuuugccccuguccuuggcaaggccuucgauggcauggggcagaaacccacucuggcaaggauggcugugauaaggucucagagaucuuuuugagaguccaaaggugagaacuccaauguagcauggccccaccaaaacaaaaaaauggaaguugcuagaaaccagggaguccauguggcucuguuuccccaguuuccccauuuccuuugcuuuuucauagguuaugguccacagagcuuuaccuugcgaagguccguccugccuacccuggccuucucaauaaccuacaacucuuagcaacccuuucuggcuauucuccccucugguaacuaccccagucucugcuccucaauuccaauuucaaauccucaaaggaagaaccuaauugagacaaaucacaggucacuggacagccaaagguuggaccuuccaagggacaaguacccccuucugaccuaaucagcugugaucacggugaggcacgaucacaugguauacacauggcugggcuguggauggaacaguuucucuuacaagaaaauguuguuaugcagcugccaucaaacaucugcuccucccagucugcccugaccaauguaaugugggguuuucuaaaaagccucuggcaggccgauuccuuguauauugaaaggauuuauugagugauugcuguuuacagaaggcuuugguaaauuguaaguugcuacguggaugcaagaugcaauaguugcugacaaaacuuaaacuuuucaaaggcuagcuuugcuggcuuuaggccaguugcuuuaaucaggaacaguuagcuugguaaccuccuuguccccucggcuauugcauuucccuggggccuggggagacugugccuugaauguggauuucucaaagugguuccaugcugugccccugaguggggcugggucucagccuuggaaauuacaguuugucucauccugcagggcacaauucaguaaaugucgaugugaacacugcccaaucccagcaacugggggccuccugggccacugaccagcaggagugacagacagcuagcaggaugccucugccuucuaaugguucuagaaaaagggcagggggguagagagaaacucaaauauguuacauccuuuugggccugggucuuuacauaccuuaauuauugcauguucauagcaauauuuucaaaguggcauuguaauucccauuuuacagauagaaguaaugaggcuuagagagauuaaguaauuugcccaaagugauagaaagcaaauggagcccaauccuggcucucuagauuccuuauugcauugugguaauagcuuauaagcacauaaccagccgauucuuucugaacaccuacuaugugcuggcuauugcauagucuguuauaccuuuuauaacagacccuuuuuccucucucaucuaauaccucuaucauuuaauacucuuuuuccucugucaucuaauaccuagggaaguaaguaugcgagauggcucuuguuacucccauuuaaccgaucagaagcuagaggccuggaggaggacagggauuugcucaaagcaaugcagcuaguuagugguggagcaaauguggaaucggaugcccugacuacaugauuugggcucuauggacuaaaccauaccuccuucccaccccucaagacacucuuccaucuuggaggggggaaaauauucaaagauuaaaaauuacauuuuuuuuccccauuuaguucagaucuagcuaacuucauggcacauguguuagucaggccuggauucaaguccccugagcuuuagcuuccucaucuauaaacagugauaaccuccaugaaagcaucuagcacacugcucagggagcuuagacagggaaucagcaaagagagcugcuuagaggaaguggucccagauggcccacuugaaagggagggagcggucugcugucuguaagagcucaucccauacuagucuggugauucccaguuacccuuugagaccccuaggcaaccucuccuuaucuuucaggcagaauuagucacugcaagcugcgggcuccuauaacucagucgggggaguuggcagucucuccucuuugugcaaaacauuuucccagaccauguccccucuaggcuucuccugagccaagaugcacacaggccuuaugugaaagacugagguggaacagaccucaugaauuaauccugucccuuucuggucucagugcuuauagagucacucccauacaucagagguacucuggugucuucugagaaggaucugcagucuucaauccugacuucaaacuuugccuuucccccuaagcugaguaggaaauugaugcaaaaaaauugauacaaauguaccaauggaugguuugggcagcuugagaagauacagccauuucuuaguuuaugucuucuccgcaaugcuaaucaaccugccuuauagcaaacuagcuguuuccuagcaaugccaagugacguagcaggauggcaucuauuuugaaucucccugaagugaccuauuggcucucuuugagcauggcaguuauugccuugagaucauguugccuugccaagggaagggggcuuuccccagucaugguggcgggagaccugucagguucuguagcagaaccagcuugaaccacaucaaccuggaacuaugccauacacuuguacuucuagaaaacaaucaggcccaaucccuguccuccgggagcucccacucgaaaaggaaauaggauuguaacaaacccugugauaaguguuguuaucaaggcaagaacaaaaucaagccuggaguuuucaggaauauuuuucagaggaguuguaagcugagcuaggcuuugaaugaauauaaguuuugaagguggcgaaagaagaauaacacauuuguuggagggcacgguaugaugcaggaccccaaaggcaagaaagaaaucaugggaaguuggugacaucacugacuaauccaaaccucuuucccuuagguguuauucagauuaggaguucuguuauagaauaagaaauucaggcuuaaaaugaaacagaucucuuuaugacaggauuucucagucauaugcaacaugcuaacguucauugugauuguucaagaucauaagauuguuggcagcauuuccuagacuuacugaugucucaggacacuuagacuaucuuuuaggaguaggauuucuuugaaccuaucuugcaaaaugcuaagcuacagauaggguuuuuuccugaggaugguuggagacaggcaagggaugccccugucagcugugaggagccucuagcagcaugaagugagaaugggauuuuacccugacagugcugggcagccauggaaagguuuuugcaggacccuguguuagaaagugcucagggaauagagaaauggugggucagggaggggagccugcagacugaaauucuagguugaaggcugcggugaaaguugcucuuugguaucucuugcuguggauguacaggcaucuccuggcaccuggccuaggucagggcacucagccucaauccagggugaucacauucagagacaucauugaggaucuccagaugggcccacucugagguccagcugaguccugccagacuauaugcgacacuguaaggcauucaccugcucagcagcaguucuuuaccuggaaagcagcugggaccugcucuuugauucuguugcuuguuuuuguuggggcucucauuccauuuacuuugucccacaagcccaguuagguagucaaugauguuugccaugcucgguguugcuguucucaugaacuacagaugacuuagacgaucauucugugugcuagaaaaggcagaauguguugucagcuuauuagaucaaagacaauaguccacagcaauagcccuuuucaagggagaggaaauugaacagguacaagugugaaacccauuagggaaaaaacaggcucuagagccagacagccuugagcucacaucucagcuccaugacuuacuggcuagaugaucguagacaagucacuucaccucuuugagucuuacuuuuuaauugcuggaaaaugcaaauaguaauacaaaauguaagauguugauaaaaucuuuacuacguacaauuggcuucauagauauuagguguaguuucauuuuucuuaggccuucaaacccaauaucugaagaccagacaugguuuaguagcagcagcugugaaaacaauuguuaugguuuugguugaaaaguugcuugugggaaggccgccagaaacuacuaugugcauaggcucugucaguaaaaggagagagcccuaaguuagggaugggucacuccuagccacaugccugucugggcucugcucaaagaucacuuuccauucuggguaauagggauguugacacauguucauucaaacaagcugggaaagaggaaugguguggaaaccaaccacauaaagauuaaaugaaagaccccagguauuuuugccuaaaaaagaagaugauggcaaaguagaggggaaguuggaucuauauuucaguguccagagcagugucuggcacauaguagguucucagugaauguuuguugguuggauggauggauggauagauggauggauggaugaaugggcaggccaugaaaucugacagaccuuguuuugaauguucuccuuaucauauauuaacuuugacuuuggggaugguacucagucuccccgaacaucuuugcaaauggggauagggaagacugcuguguuaugcucuucuagggauucagugauaaaaaguaugguaaggacugaacacugaacuuccugccuuggagguguucagugaaauuucuaccuuguuccccugcuauauucacuguugaagguugacaaauccugucauguagaaggggaauuggguauaccuccagaguuucagagugagacaggcggguugaaguuuaggugacuuucuaaagacuagaacaauuuaaaaaugauucacauugcucucauaggagugagaucccuggcaccagaggaggugagcaagcagaaguugugagcugcuuagccaggacaacguagaggugcagacuguauauucaagguccuuaauauucaguaauuuguaaugaucauucauggaaagauauauagucuacuuaagcucuuagucucaguuuauuuaucugagaagugggggaacaacaacauuggauauccaaacaaaaugaagcaaugggugagaugggaagagugcuuauaaacugugagguugcaaagagcagagcuugcaaacugcuaccccauggccacaauuagcccccagauggauuucggugggccggcauaagguuggccuuauuuuuuuuuuaaaagagauuucaugugacaguucaaguuguucaacuuaauuacaaagaaggaugaaagaugugaugacugggcccucauuuucaccuggccacauggagcugagacugagaacagaccugccuucuggccucugaagccauuugguuuguggccuuagucuuucaugcuaaauucuaggauuuuagccuuacauuccagccuguaaucuggaaauaaaccacuccugcacugcgggacugaaauggcagccuggagugauagcugaagguuuggcuucuggcauugggcuaccuuggcucaugucccagcucugcugcuuucuagcugguaacuuucaucaccuuucugguuucaguuuucucugcuauaaaauggggauaauaaucaaaacuacuuuacagguugugugaggaucagaguugugccugacauugaguacaugcucggugaacagcaucuauuauuauuaaagcaaagcauccucuuguaaugcaaaucauugucuccucuggcugauuagauuugugcugcggugcaucugagcaccaaaaccugacaggcuuugacaacuuugauuucagaacaaguguccuuucugcaugaguagcagaggcugcuggaacuagagccauuacauggcaaagcaaggaugcugucuggagccuccaccugaauagagaggcugguaggcugagcucucagccccugcgaggcuccccugcccgggguugcaggaagcacugugauuuaccagggccauuaggcuugacaauuuauagccuucccagggugagagggagcuaaugugucacuuacguuuguauaacacuuagaagugaguugaguuucccuccugcucuuuguuuuccucccacagucuccuuacacuguauccaguagauguuggggacacuguauccgguagauguuggggagcaugggcaugccccuccacagaguggaaaggcauggucacugugguuggcgccccagcuguccucuuaaugcacccugugagcaccacccaggccucccugcaacccacugagacaaggacucuguugugccuuuguuuuacagauaaggcaacaacagaggugcagguugcuuauaugagccauuagcugaggaucacacagcugugagcagugggaguggagucuaaacucaagacucuuacuccaaggccugggcuccuccaucuauaucaggcugggaaaaaaugcuggcugugcaaagggguaaaaaaaaaaaguccacuuaucagucagggacaggucagcccgucuccacaaggggaacacagucgccauuaugcugagcacaaccagggcuuuucucagcaaggcagccaugccuccgucccuacacaguucucuaacucugaaucauucauccuaaagagggcaagcaaauccucuucugcccccagggaagaccucucuuucccuccuuccuggccaggagagggaaacgucugguucccaacucuugccugaguuucacuuuauucauguuguuucaucugcagaucuuggugaggcagggauggccgacauauccucaugaccccacgugucucuguugcuccugguaagaaagcagaaacuggccagcccuuggccuugucugcgguggccccaggcgcugagaaugucaucugacacuggggcuguuugaaucccagcucugcugcacauuagcuggauggguuugggcacauugcuuaauggcuccgaaccuccuuuccucaucugccaggagggauaguaaaauuucacaggguuaauuugcggauccugaugucaugccuguggaccacauagcucucgacucugcuggcuguuauauuauuucccauuugauucucacaguuacccuuggaggguguuaauguggccauuccguuuuacagaugaggaagcugaggucacucauuuguucuugcauuugcccuuuauuaaguucugucugugcaccaggcugaaugcugggugagaaagagggaggauuaaggccugugaucaacucucagagagcccagggccuagugggugugcuuuucccccuagcccccugccuuucaggauucuagaaggcagggacugagcagaggccagcgauucaggaaguggcuucucugugcuucgcaucacucaagucccaguccuaggaguccccaucaauucuuccauuuuccucacucccauggccaguccauuagcaaggcuuaucaagucuaccccugaaccugguugugugcuggaauuggcagcucacaccagcuucaagaguugcuuguauaccauucuucccaguucugcuuucagugaugccauguugcuagcuuaaagucugccacaguaagaguguuuauaccauggaaauaggcaaacagggcuuuuccccuagagagccagucauuaagcacuuaacaacacaccauugcccggaucucucuccacugcucuuuauuuccacuucuaccauuuuagucaaugccacuuuccccucuucucagcagguucugcucagccuugccgcucacccuucugugauccauuccuuaccaggcagcuggagagauauuuuacaaauguaaaucagcugcugucauucccuucuuuaaaaccuucccguggcuucccagaacacucagaaugagaaccaaacuccuugcugagaccugcacagccuacucuaccugcccugccaacuucugaucucaucuucccuucccugcuaacccagccucugaugcacuggccuucuucguauuccuggaaaaagcugacaccuuccugccucggggcuuugugcuucuccugcugggacugcucugccccaggucuuugcauggcuggcuucuucuaguuaucucgauccucgaccaaguaccaccuucucagagaagucuuccuugacuaccacccccagcauagacaaguccuccugucuacuuaccucugcuccugcucaaagccacuuucuaucauagcuccucaugucuuuuauguuugcugcuuaauuugccaucucuccaccaaaacaaaagcucuauauugccaguaacugagguugggauguuggaggugccuagcaaauauuugaugaaugaaugaaagucugucuccaagagaagauguucccagcaaaggccucucccgucacugcugagccucagucucuuugaauccuuaaagaacccagcucugcucugaagaacuucuucuauuccuacccuugugccaacuguggagguagcaccagaucuggagacgacggaacagaaaucuacaugccaugagggaaaaggaaaaauauauugaggagaaaacaaaaaugcucaucuagugaaggcugccacuugcccagaauucuccauggcuuuugaacagcuuagcugcuucugaauggugucuaagaggucagugccuagucacaugguucacugggacaggucaguugggaugguucucugccagcuagaaggacaguuuuguagagacgguagcuuuuccuaugggaaacuuuuauguuauuuccaaagaaucucuggagucagcccagccuugggcuacaucagcucuggaaugcuggguaagucccugagccccuaggaaccucaguuucuucuucugggaagaagaagaaacugugaggugcuauguuaccuaccugugcuuacauauauauaugcaugcuuaacaucaggcaugguacauaguggguguucaguaaauguuauauuucucccucaguucuccaacucagaacagaagcgggcacguuguagaagaugauccccucguccaccacaucguugcuuacaggcuucuucccacacucuuccuguguccccgccucccucgguccccacaccgccaccaccaccgccaccgccucuuaccaggcauacagaacuggacccuguggcagcugcagggucacaguugugggguuugcugucacaggaacaagaagccacuuagcaugaggauagaggggcuuucuugcagucagcugggcagucugcaauaccugagagacagacucugucuuuccagcugcugugauuuucugaggcuucugaggguuacaaagacaaagcacucucuucccagcuuggggaaggaagaagaacaauguuagagacccaaaaacauggguuggaguuuaagaccugccacuuucuucuugguuccuggguaagucacuugaucuuucugagccauagcauccucauuaguugaaugagaaccaucacauccaaguaggaccauagaaagagaaggugauugucuaugcaaaauacugagccuaaauguucauucucuuccuucaccuuuuucuuaacuucaauagagcugauggcuaaauguuaggaugggucugaaagagaaauguuuugacuuccagaaaacaaaagaaagagaugccuuucaaaggaagcuuuucaaauaaucuccccaugcuuauguacccuugggucccuuaagguggcagaagggacuugaucagguuguggggcugucauuaagugcacugacgcaucuauucccuaaauugugcccuggaaacauuccuuuucauaguucauggucagggcuugaaaauuuuuaguucucaggcacugucccauuuuacuggcauuuaaaagacaaugguggaguugccucuuucaggacacccacagaggacucugagguaccaggauucagaucacuggacuuagauuucuuuucgccacuauguuuuuccauugguuuccuuaguaggucugguuuggggcaaaggguacaggacuuggagguuaaaaaaaaaaaaaaaaaaaaagcuuuccaauucugacucugcuuuaucucgcuauaagugauuuggggcaacaugcacaagucacuaagacucaguuuucuuaucuguaaaaugggaauguuaaugaaacuuaagucacuguguugcauaacucacuaugaacuuuaagauugacuuaaauucaaugagcuaauaaauauggaugucuuuuagagagaacaucuguugugguagugauguaugaauugagaaacuguaaaaugguccuuuccaauguacuuuugcuauuggcccuaaaccuucauuucuugcaaaggagugaaaugaaagguaauugacuuguagaccuuccucauugauucaaauuuaaaauucacuaucaucuagugaugaaacccggggccacugucucaauuauaguguuuuauuuuuguagaaauacuguauccauuaaaauuaucuauuucuauggcacuuaaaauugucaacacagucuuuuugcuucaccuucuggcugacuuauauaaccucacuuuacuaaggcugggggaaaaaugucugagcauuucuggagauuaauguucuguuuuaagaaucaaguccugaguaucacucaguucagggcaaaccauauauuuaauugagcucuuucugcagccagagcauuaaagggagagagaaaaauaagugagaugaggcucugcccguaaggagcuucugaucaaguuuuuucuuucuuuuuuacucauuuguuagucuguuuccuaauuuauauaauggugaauagauauuuaccaaaaugcuccauaugccuggcacuggaguguggagacagagauaaauagaccugguuccuucccaaaagaaggugucugccuagcuuaggagacagccaugaacaugaaaaagcucuagggaacgggacaaagagacucaguuaaaugggaacugaguguggaacaccaagcuucaugguucugugucagaauauggcgauucucaggggagagagguugcuuauuaaucccaaccuaguuccugguugcuauuggagaauccaaccugaaucugguggugagcaggacaggaagaggauauuggaaggauacaagaaagugacaguuuuccaugcaauacaacagguguugcaagagacaaaugagugaggagcugugggucuuuaggcgagggggagguuaguuuggaauggggaguccaugcuugcuuugcagaaaaggaagccuuugagaagugucuugagcacuugaggagcaaagauacaggcaaggaaggcauuuaggcaguguucacugugagcaaagguucaauguaggaaaggucauugaguugaccuuggguggccuggcagggcuggguugauguguauaggagaaauggaagccaaggggaaaggggguuagggacuuaugauaaaggccuuccacgacugucuagaagcuuguacuucauucugcaggccgcggggggcccaagaggguuuuugagucagguucuacuucagagaggugggacuuuuuaaacaacuuguugaucacacuauauuaggaaaucucuuaccccacaauauguuccugggauaaggcgcacguuugcucucuggggguggugguuaauaauaggcaugcaacccaaagcgggaacaggagacgcacgcagagaugcgagcaggcucauguuuaaugaguucacaaagugauuuugguuccuaauuuucacauuucccugcucucccacccuggugcgaaauuuccugauggagcugguguuucaugcucucuuaaggaugguaggagcagcagaguguggugguguaacuucuacugcugggguuaaggagccauuuggguguguucucguggagacaugauagagaucuggugaaucaucuguaucuuugacccagugaauuauaaaaugaucacaauaaccucuguucacugagcgccuggguagaguacuggguacuggguacuuuccuacagugagccuuugcucauaauaaacacugccuaaaugccuuccugagcgaguacuggguagccugaucucaguuaacaguuaaucucgacagagaggcauuugacaggggaggaugcagcuguuuggagacauuguguuaccugcccaugcucacaugcucacacagcuaguaacuggugaagccaagguuauaccaguggggcauuccuuucagagcacaacacaaacagcagacaaggcagaggggaaauuuuggggucuuuucauucaaacagcugugaguucuaauuccauauuggccacuucacuucuccaaguucccucaaaauggauguggucauuccuccuuuauagugcacuugacaggaugaagguagccuauguauggcccguguugggccucuagaugucagcugcucuugaagagucauuaaaaguguggacguuggggaccccacaccuccagcccagguuagaacucacuucucaggaaugggcagagccagcuaaaagaugccauugccagccuuucccuaaaacauccuuccucucucucucucuuccacgugccaacguuggaauauuccaacaauuuauuugaauccugguagaugggggagggccacuagagccuuucaguauccuccuucucagaaaaaccugucccuggcugaguggccauuggcauuucccugaaagggacugaaggcacagagagguggggccugccucuugggaguggucccuucugacuuccauuucaccugacuccuaaggcagagcagcugauuuauaauacucauuuugguucuggaaacucccuuuuagauauucucuguguccucugcuaugaacccuugauggagauggccuccgggggacagcagcagugucaucuacccagaauaaucaagaguucuuagccccuguagaggguucuccagggaaacagaaccaauagaaugugucuuucucuauauaucuauauauacaucuacauauauauacacauauauauguguauuugugauuauaucuauaucuauauccguauccauacaguuggccaucuguauccauggauuccaugcauccauggguuccucagccaacuguggaucaaaaaauauuugaaaaaagaaacaagccaggcacaguggcucaugucuguaaucucagcauuuugugcagccaaggcaggaggaucacuugaggcaaggaauuugagaccaaccagccuggucaacauagcgagaccugaucucuacauuuuuuuuuuaauuagcugggcauagugguauguacuuauaguccuggcuacuugggauacaaaggcaggaggauugcuugagccuaagaguuugaggcugcacugagcuaugaucucaccacugcacuccagccugggugacagagugagacccugucucuaaaaacaauaacaauaaauuuuaaauaaaggaaaaggaauaagaaauaacacaacaauaaaaauaaugaguaaaaaauacaguauaaaaacuauauaguauuuacauuauauuaggcauuauaaauaaucuauaggugauuugaaguauacaggaagauguguguagguuauaugcaaaaacuaugccauuuuauauaacggacuugagcauccacagcucuugguaucugugaaguguuccugcaaccaaucccccaaggauacugaaggacaauggcuguguauauguagcuuuauguauguauguguaucugcauguaugucaguguauauauguguguguguguguguguguauagggauggagaaaaauagauugauugauuuuauggaauugacucacacgauuguaggaacuggcaaguccaaaaucugcagugcagggcaagcaagcuagaaacccaggaaggauuucuaaguugaaguuugaggcagaauugcaucuuccuugggaaaucucagucuuuuaaguccuaguuggaugaaaucuacccacauuauggaagauaaucugcuuuacuuaaagucaggugauugugaauguuaaucacauccacaaauaccuucacagcaacaucuaggcuaguguuugaccaagcgauuggguaccauaguuuaaucaaguugacucacaaaauuaaccaccacaguccuugagaagucuugaccuagagggugcaucaccuuuuuuaggaagcucaggggucugggaaaggcccaguuugcugcugagucccccaacccagggaauuaucaccagauauguagcuagagagugggucaacguuucugagcaaguguucaguccucaucaugcuguaguagaaagaagagcagguagauuauuagaaguuugguucacuuauucaccuguccuuucauccagcugccuagccaauuuuacuauaugcugauuauauguugaguguuggguuaggccuucugggaucaggauuuagaagaaaaaggugucugccucaagaggggcccauacacaaauaauuucauuauagcaaauuuccaguaccaaaucaauaagacuuguuguguggaacugugcuuuguggaaacauuaaccuggauuaaaggucauuaugacaaaguaucuacugugagugcccaugauuacagcacagugaaucuuaauucuuuuugagucuuaggcccauuugagaauccagcaccagccauggagcuuucuccagaacuguguucaccccaagagacacugaauguuguagacuauuucaggaggugaagguacuggguuaaaacccucugguuuacaagguccuuuuuaugaggauucucaagagaaauuguaucucuucucaauuuuaagaauaaauaugccucuccagagaaguugauuuauuuuuaugcaguaaacauggaauugugugaacaauaacauuucauuguccuuguagacuucuagggaauauacaguagaaaccaaggucuacauguuaagagaauuaaacuaauucaaagcucaauuuugauuaccugcuugucuuuuuuuucccuuucucaucuacuaccaaauugcuuuauguuuaugccaaauugcuuuuuguuguguuguguuuuggggagaguguagaauuccuuuuaacuguuuaaucucucucuuuucuuggcacuagagcaggguggaaagauauagacaaauaacuaagaacagugacacauccuauacuaaaggagccuacgaggugcugugagaccacagccucaacggguaggagcagggccagccacauaauuugcaggacucauugcacagugaaaaugcagaguaucauuuucaaaaauuaagaauuuaaugacagcaacaguagaauauuaagccgggcauagggcucuuuuaagccucuagccuugugcagcuguguggauuagcauggcccugaauccauuccucauagggaaagaggcuuccugagucaggugucacuugaaaaagcugaagggaagaguaagacuuugccaguggagcccagcagaggggccaucuggacagagggaaccgcuaguacuaagacauagggauauggaguaagucacaagaggggauguagcaggagguggugcagggaaguuaaggcaaggugagcccucccuguuuccugucauuuacaucaauuccagucccagaagguccacaugaaacugaucucacauugauuuccaggcccuauguaaucccauuuuggcccagacaugguacauccucaucugcccuguugcaucugaccucugccuucucuuccaaguagcuugauauucccacaaugcacagggacaggccaaacagucauugauaaugugagaucuauacguagcccuucugauaccucaagcuuuugucugacccaaacuagcuaagauagggauggcucugagauauguuuugcacucagcauuuccaucuuuguuaugcuuugagaugucaacaagcuccgugaaauucugucagccccuuuggcaugucccaaguucucucucccuuuuuuuuuuuuuuuuuuuuuuuugguaauuuccugcuugugcagaaagucaucacaggcacccagugacgaguuguuugaacugagaucgccugcuuccucugguaaugucugccucuuuccuucccagaaagaauuggguaguuagcccccucccccuuuccugugauuucuugcugcucuuuuacaucaccuuuucagaugaaucauuugggacaucgaaccaucaacaguguugcuguaaacgcuuucugcagauucauaaaugagaucaugcucugaggagaagcauuaagcagcaauuugggaagcguuugaggcuguuuauuugccugaaaguguagcagccgggguggugggggaugcauguguugagucugaaggcagcacuuuucuccuccuguuaguguaggaaacaucucauuaguuguuuugguauccaggaguccugguguguccaggcuggaugagauaagaaggauguccugauuaaagccccucacuguccucaugaguaaacugaggcacagagaggccaagggacuugucuaauguuguacagccagcaagugguacacuaacccugaagcuaggccuccuucuacuucugagauagaauaauugcuaggauaaaugcacaucucuuaccuucuccaaaccucgguuuccucagcugugaaucagggaugcuuccaccuuuuugucaagauugagaagaggaugcuaagagaagcauuuaugcagagacaccuagcucaguuuuuagcccuguggccuuggcagguuguauagccucucugagccucaauuuccucaucccuaaaaugaaagcuauagggagaauuugaaaaccugaauuucagcagugccuggagcacuguaaucacuauguaaguguuagcuauuuucauuauuaucauuaucauuaucuucauucuuaucaucauuaucggcacagaauaagcccuuaguaauuauuuuuuccccuuuuauguagacagaguugcaauguggcuaaaaugcggguucuggauauaagcaaacaugaguuuaaaaccuggcucugccauuuacuggcaguguaacauuggacaagcuucucaacuuuccugagacuuaguuuaccacauccaagaaguggaauagcaauaguuacccugaggagcugcucgugaggacuagaaauaacucaccugucacaucauuuauguaaaaaauuuacaacgucauuauuucuuucucaacugcuauuuugauugauuuuaaaguaagauuccuccaaccaaagccgggcagcccuccucacacccuguguuugucgcaacaggagccauugcccacaauuuagauaguuugcaucaugcagcuguaccucaguaauuccaugcuauggagacaugaugaaaaagcaacuaacaugcacagcucagggaucuugguuaagugggugaccgaaacuuccacagguaaacacugagugcaaacgcuugcauccaguuucacuccuggggauguuuucaggagucagagggugcagaagggaagaggaaggggaacccaugaacugugccuugcguaugcgcucugggcucuccaugcucuacgaugagcuauguucuccugcccugccaggaaccuccacugcaguagaagguaggugagaaacacauggagggagggagguacacugcagccaaauuaaucacugguagagccucuaccuaauaagaaaaucuugucaaccaacuacaagcccaguugugguggucaccuaguguggacuaaggggacuagggauggagcuucaggaccggacagguuggagggcugcuggcuuagcaugggauccuccucuucacugcacaguagagaaggugguggcagguacugggacaaaacuucaguacccacuugcaucuuucaacacagagauaauguuguccugcucacguuagguaucuaguuugcucauauuucucaucccuuugcuaucgucuggauaaaggaaaagcauuuguuaucuguuagcaucgauacucaaggcuucagaucaggcugcgcguugcuggcaguccuuccagcaugcccaggaucauccauuugguggaacaacauuaaguugcacauacuugacuuuauauuuuuucuuacaaagauggugauuuuauaugaaucuauuuaagauuuuaggguuuuuucuguuuauuauuaaacaaaaaaaggagcaugcuguucauuuaaacacuucccuuaugugcucugaguucaauuuaaguuucuggauucauaagggugagcagauuuccuuuuccgaaaccuguaacuggaaauagacugucuucuuuuuuuuauacuuuacaaaugaguuugacugaaggauaauggagguacaugaaccaguagcuauacugcauuucuuauuauauaaguguaauguccugguuuaaggaaaagggauuuggagucaaacauuucgagaacacugccacuuacuguucuaugacucuaggcuagcuacuuaauuugucuaagccuccguuucuucaucuguaaaaugggguugcuguuaguuccaaucugccuuauggggccuucaucaagaucaaugagguaaugcaggcaaagcuuucagcacucucacuggcacaugguuggcccugaagugccaccagcagugauaaugcagcuauagcuguggcugauggcuggauuggaccagcuuaaagacagggaaucacauccaugacagccauccagucagaucacccacuuccucucccaaacauggagaggaguuuucuucuauggaguuuuggggacccucauacuggcucaugagaaccaaguguuaauuuuucaggaauucugugagcuaguuauuaaacagccauuauuaaaaauuaaguugcauaaauucacacuuaaauuauguuaaaaacaaagggacuaaguacuugacacucaccaguuucugguuauuuuacuacauuauacucuaccccagagguuacugaugucuauuuuaccuguguaaaacagguaaauagguggaaaugcuauaugauggcuguuaucacucaucucuuuccaacuccaccuucaaugacgucaacuugauagcuugaaaccagccaugguuggaguauuuacaccauggaaaucagcaaacacuacaaaucaagccuuuuuuuuccccucuucuggaaagucaguugucaaauauuuaccagcauaucuguggguaaaauucauuaauaagguuggcuguuucguuuuuggacaaauguugaugggaagaaaauccuucauuauauugagcugaaaugugucucuuccuagcuugaauucuaguuagaauuuucagugaguuugcuuucucacugguaaguaaaugucaugguuuaggauagugccuuggugccuuuuuauccccccuguucacaguguggggaacacgguaggcccuggggaaaguguugcuguauuuguauugacugucuuuguauucagaucaagauuuuuaaaucaucauuucucagagcgcacuauuucccucuaagcaucaaccagugucagaaaugcuuaaauugugauauuaaagaaauccagcuucaaagcugaauuuuacugaauuucucccucuuugaguauaggcuguuucuuacaaucacuggcugaauagagaaacacaugucauuuugggccaccauggaaagcuaguuggcuuccagaagaccccucucugugagugaccauccacccacacaggacaauuccucagugacagacaaaagcagugggaaaugucagccuacucagaugcaagacccggagaaaugaaagcgccaaguugggaaaacagccagaagcccauaggaaagagguuauuuugggacauuggggcguuugaaacuaaggcagaaaggcaguucaaugaguugacucuuggucaacuugguuggaguuuugaggucagacaugcugcaguucagauucuguuuguggcauucugauaugccauaugaccuugagcaggucacaaaaccucucugaccuuucauuuuacgaucucugaaaauaaggauuguaauacucacccuauuguuugucaaaugaauuuaauaaagauauaaaaguccaggaacauaauagcuaccaguaagaggcagccacucugcucaucauaucaagcaucaugacaacuaacuuaggguuccgaggaacuuaacagggcccuaaaaauuagauagccugucugcgcccugacccccccuucccagaaaaaauuaccuuuauagauuacagauauaucacuuggucauuuuuuauuaaagugaaaguguccaagcugacuucauggcucauuauggaggauaggcuggucuucauucugccauuuuguagaacaaacacguuuggauacauggaguugugucuuccuugaagcugaaaccgugugugaguguuaacaaaccuuuugucucauaacauucccucuauggagaauuucccaaagugggaauauugagcucaguauuuuauaaacugcuagccuggaagaaaauuauuuuaaaagucauucuuuuugucaucuuccauuagacaccaauuuccuaggcagaaucaaauguaggacaguguuguauaaaugaaauaacagacguguggcaagagguuaauaacucccauugcccaguucugaaaggaagaaaaaucacagagucacuucuacucuugacauuuuguucugucaccccuugaagcgaacaaagcaucuuugugcauuuuaaagagaccucugcuuauuucuuuccaaaguucuguagaguuuugccucugaauuuuuugguugguggugggcagugagaaaccuaagaaaucugccuguggugaggagcaaaacaccagggcuauugacuauaauccacaggcacucuugccugcccgccugcacuucuaccacugcuccuggggcugggggagcaaaccaucagaaauauuagggaauucucaguauaugaaaucagcaacauacaucgaaacauauaaacucacugcaauacuuguuuuaagggugauguaaauuguuacaaaauuucauugaaauaaaaaaggaagucaagagcacuuuaaaguaacucugcagacaguaauacucaacccagucuucucuguacaacuggguacgcuuguuagcccacacagacucacuuguccauaccuacauucgccaagcuguacccauauuccuuccaucauuugauauucauucaaucauugagcuaugguuggcuguuguuucuuuuguaguaacugguaaaagaugucgaaaccagccuuguuuauauuuuuccuuccccauuguucucucagugaauacauuuccuggaggcucaguaucacucucucauucuuuuuuuuauaucaguucucaaucuguuuuuauaucuuucauucucuuuuuuguaucaaccuauaacccucauuucucccacuaucugcuuccucuccugucucagaauccugggagauacuggauaaaaaucaccagugucccagaauuaggaaaaaacaagcagcgccuuucagacauuguugaaaaugcaauuccuaauaaugaauacuuuuuagguucugcuuagaacacucauauauagaguaacaauacuugcucuuacuauuagguuggugcaaaaguaacugcaguuucggccauuaaacguaauggcaggaaaaguaaugcauuaaauguaauagcagaaagugcaauuacuuuugcaccagccuaauaagugugaugaacucuaacauuuguuauucuuuuccguugcauuucauuuuauuucauuauuuucuuucaaaauucucuuuuggauguucuaaguuaauuucacagcucaugaaggggaugcaacuuacaguuucaaaacacuggcuuugagcagugcaucuuggacuuuaauguguacacacaaaucaccuugggaugcugacaaguggcagauucugauucuguaaguccugggugggacccacgauucugcaugucuaacaagcucccaugggauccugaugccgugugucuacagaccacacuuugagcaccccuguucuccagcacaaggauuguucagcaccauggacaggaggcaaaccugugccugcuccccuauccgcagccaaacaacaaaccuaugccucacccuguguuugaccucucugcaagacauguggcaacaguugaugaggaagcaaaggaacuuuccaggggccaugugauguugcagaaugcccuuuuucucuuuucuacacagaggggaccuucuggucuugagcggugaaccucugggagcagggccccagcugaggaguaggggacagguacaggauccagggagcucugcucgugagaaucauuccagcucuucucauuucccucuugagugcccugguuugcuccaguuccugccuggugacuuacugcagcucugccuuuauuuggggccuuacaguaaaggcucagaaugcccuucucgcagauccuuuuuucuaguaaacuccuacucccacgcuauuacucagcuuaaauaacaaggcguuaucugugccuucaucuguguuccuaccacccucugugcauaacucuuuagaacccuaagcauauauauuauuaaaaacaucuauguguuuaugucuucccaaaaaucagccagcuguucuuggcccuggccacauuagaaucaccugagaaguuucugccaaauacugaaacccaggccucacacagaccaguuaaaucagaguuucuggguauggagccagggcaccaauauuuuuuaaaguuuucuaagugacugugauguguagccaaggcugagaaucacugcauuacccugugagcuccaugaguauauggauuaugucuuacuccccuuuucuaccccuuuuccucuuccuccuccaaaagucaucuagcaccuugcaaaauguccuagacucccauaaagcaucuaacaaauaaguaacuaauaugacuagccaaacuuucucuggcaccuauuguaugccgggaaccaaagacugacauuuaucuguguaaccacgaguacucacaacagaacugugagguagaucuuguuuuccccuguuggggucugcgcuagauccaggguugugcuggagcugguuggaacuggcaccaccaggcuucccggccccaacuuccggucagcaagacucaacaccacagguaaacucaauucauuuaucuccaccauccauuuuucuagaguugcagggaagacauaaaauucuuauuaauauuauuauagcauacauuucuaaaaauaacagcagccccaguuaaaugccuucuguuugccaggcacuaugcuuagugauuaguauccauugccuuuauaauucacuugaguuucauggugacaccacgaggcaggcauuaucauuccuacuuugcagaugagaaaacggaggcuuggagaggcuaaguagcucuugcaaggccacacauucugaaaguggcugagcuggauuugaacccaggccuucaugacugcaaauccaguccuccuuaacagcucugcacauucuguacuugcaaacaugauuaucucauuagauucucagagcucaacagggagaugaaugacggguuuagaagaaaggcuugggcugcagaguggaggauggaugggagaaaggauuggccaccggggaguagagaaaauaaauggggucuccacagaccagaaggauuucacaucgaaacuggaaauggcccugccuuuacuccccuccccagaacuccaguaaucuuaguaucugucccaagacaguggggagaugaguccgaggcagggccauuacucugccugcuugcggagggaaacagaagagccucuguugucacugcuggagcucggugaugauagauggaggccauuuguugagucugaagccaucauucauggaggacaauggccugcugggacccaacacacuuggagaagagcaugaagcagacagaagcaggauuaugugaaacaaagucaaaggaaauuuguuaggagucugauuuccagauccuugaaaucagcaggaauggagcucuuucugugaaagaguuauuagcaaguguauuuagagcuaagggaaguucacuagcuuucugguguccauuaccagcaaacauuggaaaugauuguguaggauuuagcaaaggcuuauccuuuuggagaacaugacaugggauguauuuuggcaggaaaggagagucugaugcguguguuuuggcaugcuuuguuggggagaccuggaugagaaucuucagaacccucagcuggaguugucuuugucugcagcccugcucccuuugcacaaggucugggaauaaauaagugaaaggauuaauuucacuuggcuuuggaauagcauucucaaacacuagaaacucccuuccauuuuguaaucugaggaaaagugaauguugcaugccugaaaaugggucuuagaguaauaaaaacaacugaagucggagaaguaugaugcaagaucuacuuccuugccuuccguuuuuaggucagggagcaucaccagacagacaagcugauuauuucugacagugacuagggaugggguuuccuggaagccuuaaugaauguagaauuaggugggcagcgaauccugauggaaacaaagcacacagccuucccgugucagcuuacuacuaagaauggagugaguagcuugcccuggcagggaaggcucuguggaguggagauugugcaucucauuaagagaaaggaacagcccacuucagaauaugcuaguggcaggcuuggcagggguuggauccacucugcagguguccauuccaucuugcaccucaccacgacugguggcagccuuccaaccaagaaguguugggaacacaugcuaauugagugcuugcuagcugccugguucuuugcuaggcacugaggcuauaaaggugaauaaauucagaggugguauuuauugcucagugguuaagaacacaguugcuagaacaacauggucuggauucaagcagaagcucugucacuugcucaaccuuggaugugucaccugaccucucuaugacuugacuucuucaucugaagaaugggaaucauuauaggacauacuuucauagggaggcugugcaccuuaaauaugcuaauauauguaugguauuaaguaagcuaaugcaugcaaagcauuugcaauaaugccugguacauaguaagcauuauauaccuguuuuuuccugcaauuauuuuuaugaaucaggcaaauauuuacugaaaucucccuuaugucaagcccuuuccuggaugccagggccauggcagugagcagacauaguccguucccuccuuggcucacaguguugaggggcaagccacauaaaugacuacucuacacggcaggaagugauauguccucugagaaugauucagauggaguccuguggggagcuguagaugggagagaacaaggccagcuuaauagggaagcuuccuggaggagggagcucuuccuguggguuuugaaggcuaggaggaacuccucacaugaagauagcagggugaggguccgcaccagcccugccuuggaggcucuccuccuugugaguauguggaggccuugaacaguucagagacucauucaggacccugaagcaaauaaaaccaucccagggaaaaagaaaaucaaaauuauggccauuuaucugaacaucacggaauuccaagaaggcugcaagggcuuaaguugcagggcaauguuucacacaggugggcagggguagaaccuggaaggguuuggauugcuccaaaagaggaagagcaugagcaaagguguagaggcagggaugggcagaaccugucuagagaagggugagcagacgugugugguggccaccauguacacacuaggagggagguucaugggagagucaugaagguuaagcucaagggcugggcuuuagucuguaaaccagaaagaggcacauaaauuugauuucacuuugaagauuuuuauggacucauaaaaaacuguauauugugggcuuguaaaauaucagcccaaucugcaaacuaggauucacaaaguacgauggaggcaaagccugaggaaacaaguagcacauccgcugugucuguuccccucaaugccccagcugcccccagcacuuagccuccaauggcucugaggugagugccauagggaaccagggagaccagcacuuaaugggcagacacugugcuagcuaccugaccugugucacugucaucgcagaaguccugugaggcauaggcacagaaaccaaggaucagagagguuagguggguuugagauuucauugucucugacuccaagccucugccucauccauuuaggauacgggggaauucaguguacuaauuauuguuggaugcaggauuuuguccggucagaagcuagaaaugcccuauguacacucugagcaaucagaaugguuuccauuguguuagcuacgacauucgccaagacccgucuugucccaucuugcugcuauuugaaucguuaguauuaggcugaugaaggaaugaauuaaccugaagacuuucaucuccaagcagucacucucuaaaccaaaguuuucuagggguaacacagaaauguaaauaauguuuaaauaauaauuuauuuuuuaaaaaaggcugaacagaacccucuccuacccacuuaguugcuguagugagugggggcuucaggcuucucuguuuuugcauuuuauuucuuuuccuagaaagcaucagccaucccccauaaucauccccucuucccaagccccagaccugugucaguggcagggcuggaaaaacaggacucagagugaaggggauggggaaauaauuuauuccaagcuccccugccucagcugcuccaugccugggacaagccauggucuagaacaggcaggaugaaagcugcccguuguuaacuacagggcaacuuugauugaguggaaagaacucugaaguuauguggcuuagauucaguccugccuucucuucucuucuucuggccauggguguuauucagccaccucuaaaauagguguaucguaucuucuucagaagcuagggaauucagggaggccauaugagugcguauucaggcuagagccuggcaccuauuggacccccaaaacaacuuauuuugcugcucuccuuuauucacaagauagauaucauccuuaucagaguuuuggcuggccuuugguaugauaggccaaagucuuauuaucuuagacuugggaccauuugacauguuaacuuaauaucaagauggugucuggugagcuauuccauggcagucuuugcuugcaaccuccuuaugccacugagagagggaacugacaucaggcauuguucuucauuuuauuuggccucuguuucauuuggcaucuguuucuagaguaccuccuuugugccggggccugugcugggcccuggguagacugagcuggcuaaggcaggacccugcgucagggguuugggaguggcagacacaccgacagugguaauuccauguggcauguguugcuggagccagagacacaggggcugaggugcugagcagcaccacauccagcccugccuggaagggucaggacaggcucccacaggcagacccagauuaucuuggcagucaagucugacauggccagagaugggggaacagcaugggcagcagcacugggauggggagaggaugacacauucuggaaacugugaguggauuugugagcuucuucaggugaggaaaccgaugcuauaagaaaucagaaguaucuaaugaaucuugggaagucuugucuuuucucugggccuguuucucuauccuccaaaugagggccccuuccagccccagugagccacgauucucuaagucuauggcucacagccugcaacucaguaugaagccgacuuggaucucugccugcuuaucuuaucuucguauuuauauuuggaaaccugcuucuucuucaucuguuagaauugccuacaguacacacccugggaaugucucuguuuaccuugaugugcuaugagcacgauccaggguuauuaauaaaaccaggcggucccccagaagccaagggcuggagcacaaauguguagcuaacuuucuugucugggaggccuugguggcuaucacaagaaugcccacccuguaugggccccaucugaccuccagggccaggaugggaugaggacccucuuggccuguaugggaaaaacacugaccugcuucaucuuuuccuucccaaggcaaugaaauucgccuaccuguaaacccaaggggcugcaaacugacagcauauagauauguuuuggggcucacauucuguuuuuaauaccaaagaauuuaauauagaaacaaggacauuuuaccaaacauguggacuuccaccaucucuuagaaagucagauuuguuaacacuaggcucgccauccuccacugguggugaguggaugcuccuuuuuucagaagggcaugaguucuagaguuuaccauaguccccaccccuccuuauuaucuuaucucuauaggcauucugcuuugccacucugagcuucauauccuuugguuucucaucagauagugcauaauaauuacuugccuguuacugauauacccaaguacagagcacuguccagguaacaaggcccuuuccugcuccuuuucucauuccguccucacagcagcuugcaaaagugggugugguuauucccauuuuacgggugaggaaacuaaggcccagagaagugaaaugauuguucugugggucucgcacucaggagguggcucugcagaguggguggcauggccugggaggcaccaggggccugugcuagccucgaguuaacucuaacgugccguguagcccugugcaagccccugccccuuugggaguucaaguuuccucuucuguaaagugaggucacugcugucaauuagagguugguaaugugagcauguggcugggaaaaaauaacugaaaguuaccauuuucucccacugugaauauggguaauaaaccacaauagcauuagcagucucugggacuuuguuaccaggaggaaucagauauuuuuguaucccauuauaguuguugcagauaccucaaaauaucacuuacacucaucacuaccucacgguuaugauaguuaauagaccugccguuagaucuuguuaugacugaaaaaaaaggaagaaaaaucuaacugucucacaaauuuuucauuuuaacauuuugauagcuauuugaauauaaucgguuuucuuuguaaucuuauuuucauuuuaugaauuuagaaacauuucucugagaaaggguuuguaaguuucaaaaagguccaugggacaaaaaggcgaaggcccuugaucucuaggcugcccaaacuccugggacuccagacuccuugaggauuaggcccguggcuccucauucagugccaagcucugccuccggccucuccacccagccugagccaccuucuuaccaguagcagcuucugaggcaauucccugggcccugugcagccuuguuggcauucaguuacaucagaccaacaucucccaauuguugguggcugaagcugucugagaagcccaggaugggguaggaggagagggagugcaggcuccugccaucccacuggccuuggcuccaaguugaggucucccaugugggagagcacggugcugcucagaucucuaggucuccauauccucucaguuuucauccuccccaccuggaagauccuugguggggaaucuuggaucuggggggccugggcaauucuuguucuuuugcagagaaggcagcugagacacagagagagcaaaaagcccagggucacgcagaauggaguguuugaggaaaggaaagaauggcgagcaaaaggaaauggggcugcugagaguggcugagccaugcuggggccugucaccagggcuggggucacaucuucuaugaggacgagugcagggagacugguugggaggccauuguggaagcucaguugagagaugacuauggcuugaauaggguaguagaaacagagauggugagaaguggacagaauugggagagauugaggaguuagaaccagcaggacucaaagauggcuuagaucuaggggguucagugcaggagagagcggugucaggagugaccuagguuucuagcuugugcggccgguggaagguggcaucacuuauugagauggggaucagcagaagaggacccuuuggagagaaacggugaggauuggguuguuggcgcucugaguuugaggugaacaggugggcccaagcaccacaacacgugcuucuaguucccgcugccacucugcaucuggggcaauucacauugccucucugagccuccauguccucaacuauaaaacugggggaguaaaaccgacuuuauaggguuguugugaugguuauuaugaacauggaguggaagcaccuugcacaugguaagucaucagugagcacagguggucugauagugguugauuuuacuuaaacauauauccucaggaaucuuaaaagauccuuuuacaaagaggcacaucugguacauuuucucccuuacgaaauaaaauuuggaguccacgacuauggcagcagugguggugaugaugagucuagguuuucuuggcuguuugaaugaaggacauacaucugccuccaccauuuagggaguugguauuguacagagggggcaucauugggcuggaaugcauaauuugaguuccauuucugccucagcagccucagguaggccacauaaucccucuaagccuugguuucuuugguuguaaaugggcauggugauaauauuugcuucugaggaugguuauaaaaugcagacuaaaugugugcauguagaguucauauaaugcacacuaccaggggcauaguugguacugaaugaaaauuacugucuugcuccuuaugugaccauuucuugccuuagggaagaaaauagaaagugaccucaggcccuucccagcacgaccucagcccaccuaucuugcccuggucuucucucaccuccuuuccuuacuguggucuagccaccacaggcaacagcacuuuccccacacaccuucccucggccuaaaugccccuuucucauccuuugacuaucaagggccuucuuagucuccaggcccaggcaagugugcuccucuucuauaaagcuuuucugaugcugccaaggaggaucccuggcccugucucccauaucccugaguggaacacugucacucagcccucucuugagcauuuuccagcacucagcuuuggguuacagaacagcugugucucuuuuaccauaaagcucgugugccuugucucuuacagugucauacaacccucaaagaugagcacaggauccacacaaaaacaucauuuaacugcauggaauugaauuaauuggacugguacaggcuagggcagcagcccagucacccuguccguggcuccagacuugaguggugcagggaucagagggccugaagcagaggagccccugcgccagcagagucagagaggaacagcuuggguggaugguuuugcaguugguuccugaaaggacccuccacaggucggcucugaggcagccaggcccacagccuucaggauuugggcugcuguggccaggcugcuagaaguugcuggcaagggugaccaguggcuucacaaaugaaguuagggacacuuuccuugggccuagaucagccucggcucugcagcucugucccagcuucccuccuagccucaucccucuagucugucucgaaugcagccagacugauuaucucaaggacaaaucuggccuucucuuuacccagcuuaaaagccuuugguggaugaccgcauugcuagaagcuggccccugagcccuuuguagucccugugcucggucagagguuccgcaucuccuucuaaagcuuguacuucucaggauguaucuacguuuuaagccucuugccacagaccuuuuguuuugaaaagauugugcucaugagucucccuugaagucugucuugcccauuccaucccgguagaguugaccucuuccucacuggaucccacuauagauaacaggcuucccauccaccaguaacacuuuggaccuuuuuagugcagugagcaugucuuauuaaccaugauuaguaguagaaaugguaaaagcagugaguauucuuaaggacugacuugaaggccucagcuagauguuugagaaaugcuaauucucacaucagcucugaaaggcuggcauaaagaucuucacuuugcagauaaagaagcugaugcucagaggaguuaaguaacuuucucagugucacacaacuuacauaagccagagcugggauuugaccauggaucaggcccaugcucuuuucacucuucccagccaccaauuguaaucugagucugacguucacaguaagcaaucaacauugcuuguuaaaugaaagagggugaguagaaaguugcugaguggagaaguuucucuuucaagaagagcugacuuccuuguuuuuguuuuucuauuaaaaaggcuuucucacaugguucugugggccuggcugaaaagaagugacaguaugaggcaaccucuuagauuguucuuagacuuuccauguuuuuagguaaauaagaaaaucuguuauuucugcugcacaacacagaaaacgaucucacucugaaaggaaguugaugcagagugucuucagcuggggagcaccugcagcggaggcagcugugaugagagcacccagaggaggauacagcuggucuuuggaggccaguuaauacauuaggauuucacuuuuggccccacuaagccacgguagguugguagguuguugaggcugagguccuguggcugcaggacaguguucucauccuaaauugcuucacaccaccaugacugcucucaaaaaugauaccuaaacaagagggagggagaaaggacaaaaucuuugacucugaagaaaaccaaagugagcauguuucaaggaccugaucagcaguggauguccagggggaaaaauccaaggccugauaauuaaugauaaagcuggaauugacagaccauggucccuggaggagagcucaucuuuacucagacauccaguggcaaugcaagcaacucagcuuagaucaacagacuuuccugaaauuggcuuucgcaccucaagaguagauacuuccaucucaagaaggaucucugagccauacguccagcucaagaagcaucucugagccuuaggauuccugggacuuugugagcagggagagcagagacuuccagaaagaagacauuagcuugcaccuucucuagcccuucuuugccaaguuacugggaccuuucccuugcagguugugacccacuuagcccuagaguccaccuugauacagugagacacccaguggaagccucagcccuccugguaggugaagccuggagguucagaugcccuucuuccaacccuuuucccaaaguacccagggcuuaccaggcuaucucauauuccauucccacuccuaccauauuagcccaacacacacaacugggcuucugcccugguuuccuguuuagaucuuugguuccugccuggaacuggaagacucuuuugaacuucagugagcuuggauggcuucuuaacacgcuaccagcccaaaccccaucccaaucacccuagcugcccggggaccuauuugaguaggccagccauccaucauuaauaaaaauaaaucaugauuauuaguaacuaaaauuuauaguaacucauuaaaugauuauuaugaugauugauagucuaaugguuuagagcaugacuuuuggagccaaaccuccuggguucaaaauccugucuccagcauuuauuuugugacuucaggcaauuuuguuagccucucacuacccccaguuucuaucuauaauacgaggcaaauaauaguacuuaacucacugaauuauuuauaaggguuaaaugaguuaauauuuguaaagugcuuaggacaaugucuggcacacaguaaauacuucauuguuagcuaagauuaucacagucuagcaauuagaauaauauucaccaacauuuguugagccuuuacuaggucauagacacauaagcacugcagcaacccagggguagguacuuuuacuauccccacauuucaaaugaaaacacagaggcuuagggagguuaaauaugccacccaaggucacccagagaggaggaaauagaaccagggguaaaacccaaacucugauuccauagccaaugcaacauuuaacaaagaccuaguggaccucaccaguuauuccaguuccucuuccuggaaucuucagcuauauagagggaugcuuaaauaaaaggaaucuugaagcagaaucuugaagagaggaggcuucagacacaggcaaggccaagaccauuuacugccuauuggucuugucuucccaacuaaaacccaauuucuuccagggcaggaaaugagcuuuuauucuuauccugugccuccuuggcaugagugaguuccuaagcccuccauaauaggccccagcaaauaucugaccugcugaccuccuucuacuccuugaacuaguauguuaguggccuaagaugaccaaagugagggcaucaacaccuuacaugcaacugaucauuaugccuaaggugcuuuguggugaguuugagaagaguccaaauuaggucaaggaaaugguggcucuacaccgcagccugaucucugacuuacauccuggagacccuauaggaaaguggggaaauacaauuucaguuaauucggugaacuaaaugcugaauugaggacaaggugaacucagggaacagggaagagauguggcuagagaaguacugagccucucugaccaacaaucaauucaagaaaguaacuucagaaaauauucauaaauacagguauugaucuauagacaaccaucaagucaauaaugcuaauaaugcaaauugguuuuaaaauguugggagagaaggcagugaauuagauauaauuugguauacuauauuagauauaauauauaauuugaaauuaaguccacuuaagaggcauucacugaauggaggcaaaacauaggguggagagaggaaggagcugcagaaaagcaugagacauggacuucuugagauacuuucacccuaguguacuugugguugcccaagccagagcuuugaguuuuguacauggagagaaauggaacaguccuucuugaauaggcuuaaauuagacccugcacauuugaagacaggacugguuugucacuggagcugcuuucugugugaagaccuguguuaauuucuuaugaaaaccuagaggugauugcuugauccuugaaguagauagguuauuuaaauauuuuuaauauauauuuuuaaagaaaguaauccaguaaguauuuauugagugccuagaaugugccaaguaccaugcuaaauuccggauagacagugguagacaggagagaccaagucucuguccugauuguauuaguccguucucgcacugcuacaaagaaauaccugagacugcguaauuuauaaagaaaagagguuuaauugacucacauucugcaggcaguacaggaagcaugacagcaucugcugggcuucuggggagaccucaggaaacuuaccauaauggcggaaagcaaaggggaagccgauacuucacaugacuggagcaggaggaagaagagggagcaaggggggugaggccaagagaacucacucguuaucaagagaacaguacuaagaggauagugcuaaaccauucaugagaauccaccccacgauccaaucaccuuucacuaggccccgccuguggcauuggggauuacaauucgacgugagauuugggugaggacucggauccaaaccaugucauucauagagcauacagccugguucucauuaaaccaaccaugccaaacagugcuuaaguacaguugugagaugugcugcaaaggaaacccuaguaaauagucagaggggcuuauuuaacuuagggguucagggcuucucagaggagauggcauuggagucgagaagccugaagaguucauuugggucagccaggcagagaggaaagcaaacaaccuuucagcccaagggagcagcacccagggucuugauauucgcaaaccugaaagggggccaguguggcucaauuacagagacuguggggcagauggauguaucugcaauacccgagcaguacagaagccagguucuggaagcagccuugugaggaaaaggaacacaugaaggacuuuggauuuuaucuuuaguagaauaggaaagugucagaaaguuuuaggcagaaaagauaacccaauuugcauuuaaaaaauacuucuggcuucagguggugagagaauuggaguagaagauguaggagacuacugggaggccacugcagaagucccccagagggaugauggugucaugaaugagggcauggagauggagagggagggaaaggagccaaaucaagguguauuuaggagguagaacugauaggacuuggugauugauuggcugugaguaguagugacaugcaggggggugucaaaacauguacccagauuucugguaggaaacagguacccagauuucugguggugcccuuuucugugauuagacaugcuggaagcaagcuaaaaauaaucaggguaaaagacaaauagcaaacccuuaugcagcaaccggaaagagauuaacacacaaaaugaguaaagcauaacgaacaugcaauucccaaagaaaaagugugaugaccaagaaacugagagaaagauguuuaacugauauucaagagaggcagauuaaaauaauuagguaccauuuaccuaucacaucaauagagauuuuuuaaaguaugcuaaugccuaauauuuaugggagugagaggaauuggcaugcucauguacugcugguaaaaugacaagugauacacucgggugaggagcagcuauaauuuuuuaaaauguuaagcaauacaguauaagcauauaaucaaacaacccuacaagaaauauguacaaagauauuagaguauuuacacuagugaaaaauuagaaauaaugcuguguccaucaguaggagauuaauuauaaaucuacauaaccauuuaaaagcaugcuauuuuacuaaauuaaagagagauuaaaauuagcuuguaugguaugaucccaccuuguaaagcaucugaauguacauuguguggaugucugugugaguauucauacaaaaaagcuuaaaaggaaguauaucuaaaaucauauugaugguguuaggugaguuuuuauuguauuuagugaauagucagaaagaaaauacuuuuuuuaaaaaaagaaaacaaacugcaugacugcaguguaacagagucugcaagaaguguugcccugagggaagccagaggaggggguacuaauucugacucagguuggugggagaagccuuccuggaagaggugucauuggacagagaaugaauagucagggguccauuuguguuccuguuucugcguaguuuguagcucauauucagugcagaaauggggagcucagcagaaagcaagcccaacccaguucuaugggacauucaaccuguuugcucucuggucauaaaaaauucaugccaauuaauuuaaaaccagaugacaggaaauggaagcuuagagcuuuagaaagacacuagacaacagcuucgauuaguguccaguauagucacuuugccacuuucuuccacuuccccugaccggguugggauuuuauacucauuugcgguggcaauggcauuccuggguauuagguuaucagccuuuucuauuuccucgguuacuauuuuggaucguugaagaaagaaucacguucaguucauauuuucaaaaugugguuuuagaaauuaugcaguuuuauaccaaagcgcucuuuugggaauguaaauaaguaucgauauaaucuagucacuuuacggaaaagcugaggacaauguaacaaaagaggaugacccugccuggauuugaaaacaacuuaauugguggccagauggcacagaauugcauaucuggggucugaggauggggacagaaacugagugcgcuccuggggcacugggguggguuagaagcaggcaagcagaggccuggucccggcuccuucaguuacuagcugugugacccuagugacuuucuugacauagacuaaguguuaggcauuuuuacgauuucagcuuugaaagaugaaagacuucaguucugaagucacagugcauugaaggacuucagaccagcuccccaaaguguagcaggggcaccacugggaguuggcauaguacauggaugagcgcuuucaacuccaaaacuaauuuauuuuaauaaauuguguguguguauguauguguguguguauguguguguguguguguguguguggauacagcaccucacaccuaugacuuccuagauauuguccgaaugguuuuaaugacaaauuccuuuacgcuguuagcaacguuguuacagaaccuaucuuaguugcaagguugcuuuucauaggagagaaagggcagaaauagagagcugcagaaacauuuuuugaaaauuauuuaaaaauauaguuaagaaaaaauaugaauugauuuggaaaaauuaguaaaugauaguagaggugacacauggauauggcaaaaauaugaaugggguaccaaaauuacagcaucaggccuuagacggcucgccgagccuugcugagcugcaguuuucuucccuguaaacucucccagggugguuauaaggaucaugaaaucauaucuguagauauuauuagcucaauagcugucacauaguagggacucaaauauaggaguuuccuucucuuuuccuuagccuugcuuuuucaaguuaaaaaggguaucugugaccagccgguccaguuucccuguuuuucuuuuuuuuuuuuuuuuuuuuuuuuuuugagacggagucuugcucugucacccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuccuguuuuucauaugagguaacugaaccuagacuagggaaagaccagucugagggcuccaaaaguugcucacuucucacucuucugggcucagguauggacagugccugucagagaccugaccacacaccuggaaaggccuuggagaaacugaugaaaaggaugggaaggaaaaugaguuaauaagggcaauggucaacugucacggccuaacacagguggcaagagaggaaaaucaugacuggcguggugcuuuuuaauaugggauaucuugauagccucugcucugaaaaaugguaaacucuauguauagaaggaaaaaaaaaagaaaaaaaaaagcccaaauuguuggacaugaauguguugagauuguggcccuuuucuuugcuuuauuucuccugguauuuuuaauggucuuuuauauuuugacaucuaugaaaaauaaaaagugcccaaaugauuggaaggcugaauuuucugugcugagaguugggcaccaucagcgagcguccugcuugacacauaacuauuaauuaucaugcguaauuuauuauugcacuucauuuuuuaguuauuuugcagccccugaccacucacaguuuucccaguuaccuggaaucauaaguaguugguaaccaauuccaggcauaaaaccgaugaugcguuuuaguccagcgaucucaaggcauuaauuguguuugucuucuuguuuugcagauggaaaaacugagaaucagagagggcuagugaucucucagacacuuggucgguagguaaguaaugaugcugaaagugaacccaaaacaagauaugcuucuagucugcacaaccuaaccccugccaggcccauugucccaggcuugugacuuuucuguuuugugcaauucaagucaguauugcacgagucaguaaauaagaugagccaguuugaggcauuugaguauuacuugcacuuguggcuucuguuugcucccaguguggaguugacauguuuaacaggugagucugugaaguccuuuuaggccauacauggccaacauugggucuuucucugggaauaguggggcuuauugaaaacugguccaugcugcaguuguugugacacucacucucccuucaauagacccaacuguuugguacgucaagaacagagagcucuggacuaguguggucaagcguucugggcucaaguccugcaaugaccugcucugugaccuuaggcaagccacuuaacucacagauucacucuuucugcuuucuuucuuucacacuguuuuucccaggguauuuagucccagucucggcgcugggcacugagaacaagauaaauaccacauaggccuuugaggaguucacaacccaaucagugaguuccuccauuuucccauuauugucucauuaugagacuuucuagcaucugcuuugggguauacaguuugaaggguacuuugugaucuuucccacaacucuauaacguagaaggaaguuguuccugccauuuugcaaaggagaaaacgauggcugaaagagugggccaaagccauaccuugaguaaggguuagagcuaggcuugaaacccagauuuacuaaaucuaaaacauuuguuucuaauaacagcagacuguuccaccugguaguuguagcaucugaauggucauuguugcauucuaccacuuggcagugaguaucauguuggggagauuagcagcacucugguggugggauaauuuucugcaagggauucuuuucugcaucuagcugauucuuccagaaagcaauguuuucuccgccugagagugaaggcagcugugagcucgcaguaagcugagaaccaagggaaaccugcuccaggcccagggcuggcucuaccaaguggcugggauuuagcauaucagagagaauucaccauggguggaaggagugacacagccccccggcccccuucuugugcagugaccuugcuguaaaacugcugcuuuuuuaccaaagcuuaaugauccuggacuccaagcaugguagcuucugcuuuugcugaguugucuugccucaggcaagacacagagaaugcuguggauuagaggcuaugcucuuuguuuauauggaucacaacuucuugaggaugaagcucuaggguucccucaaugucuggaauuucaaaaggugcacgaaugaccucagugaucuggcuuuucugucuuacaauauauguguauguugcgaauuaugaccaugguugauguagaugcaccuagaaugcuguaauguacaugauacgcagcuuuugugggaaugugacugugaaugugugggguaugggauuuugggggaguguguguguguguguguguguguguguguguguguuuaaucccugggaggcaauucuuauuaaaaaaaaaaaacacuuacggguguaauuuuucaacaagaccuagaaaugggcuuuuaauaagccucauuaaacucuuugauuacuaggggaggccaaucacucuuucaucuuggcucagaucacagcucucccuugcccucuucuuuggggucagacaaaaaugccugcuauucauauuggucucuccaaagccuuuuccccuucaccugcccucugcagcccccacucccaccccagugcuugucugaucucuuugcuucaaccucagcacagacagugcuggugucaggacugacagaugauagcugcaggugcuccuggaaccugagugucccaugucuugaguuguugcggcaggacacuuagggucuuuguuuaggaagcacuuugagcugggagagcuggggcuccuuccuuucccggggcgggggucacuuacuacugcaggcucucagcagaauugugugugugcaaacccuuuccuuuacagguugaguuuccccuugucugacaugggaggaggcgaagcucuguugaaaggcagguuuugcucuggacugccagcauucugccaggucuccugaggagagcugguucccagagugauuaucuuuccugagccaagagccaggugcucagugacaggaagaaagguaggcuuagcaacaggcuuaucaagcccugcuacaagaauguucauucgccuaaacaggacuggguuugugcguuuuuguuccucucugggcaccgucucaguucuggggcugguguguucugagcaggaguaccucugcugcuucucagaggcaaugcacucccugggguaugggcuccugucugcgucauccuugugcaucccacaguagcagcacagggaugagugugcagagggccagccaguguuuguggucuacauagaagaugcuggcuccaggcagcaaaugcccauuuggaguacccaugcuuuguauaauggaacacaccugcauguaacucuugacuuagcuucuuuuuuuuuugagacagaguuucacucuugucacccaggcuggagugcagugauggguucuuggcucacugcaaccucuaccucccagguucaaacgauucuccugccucagccucccaagcagcugggauuacaugcaaccgccaccacccccagcuaauuuuuguauuuuuaguagagacaggguuucaccauguuggccaggcuugucucaaacuccugaucucagaugauuugcccaccucauccucccaaagugcugggauuacaggcacaagccaccgcgccuggcccccaacuuagcuucuuacugaacgagccuacucacauucucugugagauugcagaaaacugauguugaggguguguccugcacaagccugcuuauucaagggcuaguggaggcuaaaaaccagccugcauuccaccugccaagccaugugucccagaggggcuacaucugcccagaagaagagacaucuuuuucaaauucagguaaagucaauaacggggcugguaguagccuuguuucuuucagccucaauuucuucaucauuuaccuaaauaggcuuuagggaugauuugugauuauccauaaaguauaagugacacauagagacugacaaaucauaguggucauuaguagcuguaauuguagcagcaguaguaguaguaaugaugucaguaaugauaaugccuuauuuuuguaguacuuuauauuuugcaagguucuuuuguauuugauuauuucauuagccaugcauuaaagacaggacuaggauugcucucucugggacaaagagaaauaugaugugacuugccuacugugagccccugaaggccugaccuggagacagcauaagccauccuggcaaugaugugaggucaagguaugcaaaacuggggaugccugggagagcucagaaccucuuucugccuacagguccaugcccauuaucuaccuugguccuagagggccugcccuauuuagaacauucugccugguucuugccagaaaccccauuggugugcuagccucuggucccuguggcugcagucauuggcucagaacgggguccaaaccggguaagccauugagcaucagaguccugccucacagccuagguggacauguugccugggccuucaaagccacccagacagacucucuaggggugaggaacaauagccaucucgcaugcauuuuccaaacaccccuuagucgcugcacuucaacucuagccaacagacauuuaugaagcaccuaccauauacaagacacucuggugacaucuuacauacaauuuuucccuaacacuuuuuuuucuuuuuuuuuuucuuuuuuuuuuuuaagggacaguguuuugcucugucacccaggcuggagcacaauaaugugaucacagcucacugcagccucaaacgucugggcucaagugaucuuccugccucagccucccaaguagcuaggaccacaggcauauaccaccaugccuggcuaauuguuuuauuuuuaguagagaugggguuucacuauguugccaagugugacccaccgugcccauccuacuuuuucugacuucuguaccuauuuacaagaugaauaaccaagugucaaagaguuaauaaauaugccaaagauuucauaauuauucagugguaaugcugggauuugaacucacauauuuagacuagaaagauuauguacuugacuuacauaaagcauguagcacacaguggcuagcaaaaaaugguugucacccauuagugauaguguuuuaaaaagugauuauuaauaaaguacuuaccauccugcauccuaacugcugguucuccugugguccuuucccauuggacugugagguuucugagggcagaaacugggagucucagccuuuaacaggguacaggguuuauagcaacugauugauaagugaaugacuaacaauauugaaaauggcuacauggcuauuugcuaagcauagugcuaagugccuuauauauauuauuuuaauucucaaagcaacccuauaagauagauacuauuauuaaagccauuuuacacuaaagaaaagaccuuaaagaguuuugaauaacuuucccagguugcauagcugguaaguggcugagcugggaaugggacccagcuugacugacaugaaagcuuggugcuuaaugucucacccagauauacuggccuccugcagguguuccugcaugugcccuagccacagccgaugcccauggccccuucagagaauuacugggaagcuaccauucaaauccauugccuucuaaugcagggcuaugagagguuuccauuuagaagagacaaagcuggugaaggcuaggaagcuguaguuauguaugaaagacagcaugaaaagccacugauagaauuagcaagaaaagggugacuuccuggggaacaaacccaauuuguaagacacaaguaggggcaaaaucagccucaagagguacagucguuugagcuccauggaaaacaguggggaaauguuucaguggcauuuacugugaguauuucuugaguuuggcaaguccacuacagcaugcucauugguggucgagggcaggagaaaggggaggucuuggugcauugcucucaagggagggcuuuugcuucuagugccuuccccaagaccucauggaccguugacuuguuucaucauguggagcuucaucuuaugcaagcugaagaaacaguaugccgguuucauugcugcaagauaauugaccccuugugacuucauccagaagguagcagcaacaugugcucuuagugaaagaucagcagcugggagacacauaugagcugggaaagagaggggcuuggaguggcucuggacgaccugggcaggacuaggauucugaucccugacuccugccagcaccagggcucaauuugcaugaaucaaggcuguguucuaaguccugggacugcagugaggggugcuagugcccucaucuauaaaagcuagaacaggaacaagugcuuggggagacuacauaugaauacucauuggcagagggagaaguaugcugauuaacagcaugaugaccugucagagccuucauggacuugucuuuggguggaaccagggcuuugcccuuuuggaggcuggcccuguacacuggaguaauaauacugcgccuggaagcuggacacugaaggcacuuacuuccccacuuccacccccucggcccagcaauggcuuuuaaaucaugcucugcagagcccugagagguuaaugaaauccucucugggauuuccauaggagauaggcagauuuucugcugacuucuaggcccccacccugcagauccucuucucccuguuugcagggugggcuuccuuguugcuaggguggauguuuggcuggcacacccccccaugaccaugcuguuugguuguagcugaucuccauucucauuggcagugugccuguaccacagcaauuauuaaauguuuugaauuuuacucuuguuugcaaaccuucuuuggacagaggaaaaccgugcuguuccaugccagcugcauccuaacuuaggcacaucauaccagugaucaaccuucaagccacugcuacacagaacuaaagcaguuuuuugucuuugagaaggguuuucugugcuuccccgugcauccuagggucacagagucaccuggaugucaccaauccacauggcuaugugggguuuggcuauuuguuuacugcccaucugcccccaccaccaucaccacuccacccagagccaccacagcaaaaacccugguuuucuugcaguggcagaucugaaagcuggaguuugucuuuuccaucccagccccuggcaugucucuucaggaggcagauagcaugcuucauugccugccuguggaccuggcucccagauucacucagcugugccuuuacaaacaaacagcucuaaaugagcaggaugugccagcuuuucugggaggauuccuuaugaguaccuacuauguacuuugcauucauucucccauuuaaaugucacaucuuucccuguuuggugucauuccaguugcacagaugagggaacacagaauaagccacuuucucaauaaugaguuucccaucaauaaaaugguccaaagaggaagaagacagucauuuguuguggugguaucagggauucuagcacuggaugguuagaucaucuucuggauuacaggaugcucaucagugcuuguuccaggaucugaucaccaccgagaucccuggauacugcagugguacaaagggagcgauggugaggggaguucccaagccacuuccauuguuuucuagaaaucacacacugauuucuaagaaagcagcagagguagacacuuucugccugugacuggauugaucggaugccaaaaaacccagauucuagucuagguucugcaauaagucuucuaggugacuugggaaaucauuuagccuuucucuuccuuuugcucaaaagaaauaacaauaaccuuaaagaguugcuauguuuauaaaauauuacauacauauaaauugaaagcauuaugccaaugagaguuauuagcacauauucuucauccuccuacugacaccuuugaucuaaaaugauuuuaaaaagugagucacggauaaaugcuaucucuucuagaguuggaggcugggaggagaacugacugagaaugagaggaauagagccaacccaucauuuauagauuagagagccuccaagccuaacuaaaguagaaacugcugggagcaguggcucaugccuguaaucccaacccuuugggaggcugaggugggcggaucaccugaggucaggaguucaagacccgccuggcuaacauggcaaaaccccaucucuacuuaaaaaaaaagaaaaagaaaaagaaagaaaaaagguagaaacuuaccucuaaccuaggcaaaagagaagaaagaauugauaacuuaucuuugaauuaccuugccaccaagggaaaaagagaaagcuaauggauuacaaauuauuccccuugguuaacguugagucuuccuuuguugaggaguaaguaaacauagaugacaagcuauuagcuaagcagagagagguauaguuugugcaggaauggcaaauacuugauguaguagguugaauucgccagaaccagacucuaggacagagauuugcaugcagaaaguuuauuggagcaugcucuuaggaucagcaccuguaagggaguaagggaagaaagggaggaguugagcugcaaagcaaucacagcaaaaaugucagcugauuccacagggaacucuggagcugggauggucuucagaugucucacauugagccaaagggaguuggccuuguugcccacugcagugacagcuguggacugcccacaggugacagcucucuugggcugaaggccauuccuggagacucaacugauaccugucagcagccaacagcaacagucccugcagcuggaggaaugagugucucagucccaaagaagguagucaggguggcacaucacagcauuaacuacauuuggccugugggcugccauucuuuucucccacuccccugcaaacaccacuguugaaacaacucuuuaccacugcauucagaugagggcucagaauuuuuucaaacacaauacuuuggauaaacauuaucaaucaucuggaauuugcucaugaaaaaggauccuauuugcuaccuuugcccucuacacguguaggaaacauuuauugauggugucauaauaagucuugaguguuaugauugcucuuucaagaucaaacaguuggcaaaccuuagacaauucccuguacgucuccugggagacaagauuuucucuuauuuuuccuuaugauggccucucaccacacuucauccaagcucugacuuauuuuccccuuacccuaguaaaugcaguuuucccuaugguucauuuuuuuuuucucuuuuuuaauuuaccacacacuaucuugucaucucacccauucuuauuucaaccagcagcccaccuuagacaucccuccuucccccuaguuuuauauuuccaaucauccacuaaaucuguccaccugcuuagccucucuagccuccauacaaacagcaaauuacauucacauuagccaggaaagaagcugacacuuagcucucucaagaugcuuucagaagauguaacgucuugcaagagacggagccggguguuaucauggaucugaagauaagcugggauuuaucguaggucuguugucucccaaagccugugcucuuucuuccguaccuuugaaauauuuguugggaugaucucuucaugaauccagauucucuuuacugagcuuugccagaguucccuguggaaucagcggagaagccuacauaguuugauuuucaaucccacaggucauugugaauaacugcagagugauaagaguuacuucaccccagugggugagcuggggacauuucugcuuucacugaacagaguauagagugcuaggcacagccuggcuuuuaagucuacuagcuuacuguuucauuuacuucugaagauauuccagugguaaggagacuuugggaucacaaacucacagucagggucuaaggguuggggagacacugaagccaaguaaagggcugguuauggcuuuugauaaaugagaacuguggccaguccagcuggccaggugccaaaagccuagcaguuucacaaggggaccaaccuggguuucugugcugaaugccugugccuauaucuaccauccuucuccuucaaggaagagguauuugguagagaggucuuuugcuuuuagcugagggccaguuccauugaaaccaaagaucaauuaggcuguugggguucccacugaggccccuauucuguaccagauauucagcuaagcaucccacuccuucacccuuaaggugugggcugauguguuuuugguguugcuuaaauagcagacaugggccccacagcuuccugaugcagugugacuucugagcucugacaguuuguugauaauacccucugcccuugagacaauuacuuuuuugccuagggaagaaucuagaauccucaugaugagugaaaagaugggcugauuugaguccucacucucuuuuuugcuacagauuugcuaugugaucuuagacagucacuugaccuuucugguccucaguguuaccucagugucaguguugaaaauggccauuauaaugcaucaagcacccuacuuguuggggaaccaggaguauaauauaggugcucuauaaaugauggauguuucccuuccucacccccaacucauuacuuagugaggucucuggagaaguguuuacuagacauucaugaucuacagaacauggauauuuucucaaggacuacauuaaaucuuuguuggaugacccagggcuggaugggucugggggucaucaucuggcacgcuuucucacuggacccugaggagacuagguuccguacccaauacuuucuaccagccaugauguggagaagauuccucuucauuuucugguacuucaccuauuccaucuuccuuucuaauggcauguaaccaagaauguucagaagaggccaccagggcagagugaaagucauccugccccaugugcugguuuuauaaaacgagaacacucucaugaucccuccaagacuuagucuucucguuuauaaaguagggcaauacuacuuuccuuaguagcauucucugagaauugcaugugauaauacacaugaaagcacacuucgcaacaaacauaugcaaauguaaaauucuaucuccuacgaguuuuuauuucuuggucuggccccuucaccaauagcucccaacacaaguuccugaauguauguggucuaugcagacagcuuauccaacaugcuauuuguggcuaucaaguuuccugaugaacuuuuaaaauuuauuuauguguuuguuuuccucucuaaauucuaagauguuuaagaaugagguccaaucuuaauucaucuauuucccaauuauguaauagaugcuccauaauuguuugaggaaauaaaugaagaugaaagaaaauuagaaugaugaguaccugcuucauaucugcuuauguaauccucacgccaguccuaaagguuuguguuauuuccacuucuauuuaaaaaaaaauuuuuuuuuugagacggaguuucgcucuuguugcccaggcuggagugccguggcacgauucuggcucacugcaaccucugccuccuggguucaaucaauucuccugccucagccucccaagcagcugggauuacagguguccaccaccacacccagcuaauuuuuuuuuuuuuuuuuuuuggauuuuuuaguagagacgggguuucaccauguuggccaggcuggucucaaacuucugaccucaggugaucccccccaccuccaccucccaaagugcuagaauuacagguaugagccaccgugcccauccuauuucuacuuauagaaaacaaaaauugaggucaaacgugaagccacuuacccagaauacauaguaacuaguagagcaagggaugauggccuuagacuccuggacuccagagcgagugcucauauucucuacuucauuuucucucgcucccuuucucuuuuuuucacauuauuauugugcaaacaacauggaaacaauaauaaaagaaaacagaaauacaaucaccuuucauugcaccacuucuagcaaaucagcuguuuccauuuuuuccacauucccuauagccucuuucuugcauacguuuucuguagcagcauuauugagauauaauucacgugcuauaaaauuuacccuuuuaaaguaacauuucaguauuuuuuuagucuauucacagaguugugcaaccaucaccacaaucuaacuuuagaacauuucaucaccccaaaaaagaaacccuuugcucauuagcagucauuccccauacccugcucccccuagcccuugccaaccacuccacuaaucuacuuucucccucuuuauggacuugccuguucugaacauuuuauauaaauggaaucauacaagauguugccuuugugucuguuuuuuuuuugguuuuuuucacuuagcauaaugucuucaagguuuauccauguuaggcaugaaucaauacuuuauucuugauacaccaacacccauacccacccacacacacacacacacauaccacauuuuguuuauccauuuaucaguugaugggcauuaggguuauuuccauuuuuaacuauuaugaauaaugaugcuaugaacauucauggacaaguuuuuauguggacauaaauuucaguucuuugggguauauaucuagcagugauauugcuaggucauauggcaacacuaugauuaacauuuuuagcaacugccaaccuauuuucaaauauagcuacgccauuucacaauaccaccagcaauguaugacauuuccaauuuuuuuacauccuuuucaauacuuuuuaugucuuuuuuauuuccuuguggguuugaagugguauguuauuguggcuuugauuuggauuucccuaaugaugaaugauacucagcaucucucuuuuuuuuuauuuauuuauuuuuuugaaacugagucuuucucuguugccaggcuagagugcagugacaagaucuuggcucacugcaaccucugccucccagguuaaagcaauucuccugccucauccucccaaguagcugggacuacagaugcccaccaccaugcccagcuaauuuuuguauuuuuaguagagacgggguuucaccauguuggccaggauggucuugaucucuugaccucgugaucugcccaccucugccucccaaaguaugcugggauuacaggcgugagccaccgugccuggccaauauucaccaucuuuacauguucuuauggcaauuuuuucuugucuucuuuggagaaauauuuauucaaguccuuugccuauuuuuuaauuuggguuuuauguuguuuauuguugaguuauaagaguucuuuauauauucuggauacaauugucugauauaugauuugcaauuuuuuucccauucugugaguuaucuuuuuacucucuugauaauguucuuugaagaacaaaacuuuuucauuuugaaagaguccaauguaucuacauuuuuucuuuugucacuugugcuuuuggugucacaucuaagaaaccauagcuuaaucuaaaguaaugagaauuuauuccuguuuucucuuaagaguuuuauauuuuuagauuuacacauggaucuaugauccacuuugaguuaauccuuguauuuugugugaggucuggagcaaacuucauucuuucgcauguggauauucaguuaucuuggcaucauuuccugacaagacuuucuuauugaauugucuugguacucuugucaaaaaucaaaugacuauaaaugugaggguuuauuucaagacucuaaauuugauuccauugaucuauauaucuacucauaugccaguaccacauuaucuugaauacuguagcuucguaguaaauuuugacauugagaugugggguuccuccaacguuguucuucuuuuuaaggauuaugugaauauucuguguuccuugcauuuccauauaaaguucaggauacacuaguaaauuucuacaaaagagaauccagcugagauuuugguagggaauacauuaaaucuauaaauaaauuuggggaauauuuuuauccaaacaauauuaaaucucccaauccacaaacaugagauaucuucccauuuauucaaggcggcuuuaauuucuuuuuaaucuguuuuauaauauuuaguauacaagucuuucacuucuuuuuuuaaauuuauucuuaaauacuuuauccuuuuugaugcuauuauaaauggaauuauuuucuugauugcauuuuuggauuguucauugcuaguguauagaaauacaacugauuguacauugaucugguauccuucaaacuugcugaacuuguuuauucuaauagcucuuuuguggauuccuuaggauuuucuauauauaagaccuuguuauugaugaguagagauaguuuuauuucuucguuucuccaaucugaaugucuuuauuucuuuuuguuaacuaauuuuccugguuagaaccuccaguacaguauucaaagaagugaugagagcagucaccuugccuuguuucuaaucuuagggggaaagcuuuuagucuuucaccauuaaguagaauguuagaugugaguuuuuuguagaugaccucuaucaaguuaaguauuucuucuauuuauaguuuguuggguuuuuuugucacaaaaggauguuagauuuugugaagugcuuuuuccaugucuaaugacauaaucgugugguuuuugucuuuuauggucuuaauguggucuauuacauugauugguuuuuguauguuaaaccgaccuugaauuccuuaauaaaucccacuuggucaugguguauaguucuuuuuacguguuguuggauucaauuuaauguuaucuuauugaagauuuuuauauuuuuauaaaaauuuguauuuuucuauuuuugggagauauucaucuguacuuguguguguguguguguguguguguguguguguguguuugugugugugugaugucuuugucugauuuuacuaucagaauaaugcuggucucauagaaugaguuggaaggauucccuccuuuuguauuucuuguaagaguuuuauaaagaauuuguguuaaucuugacuguauuuuggaaaacuuuaaaagguggugauaagaacaaggcuuacuacagcuaauagucaugccuuaucaugugcuugugucagaaaaacaacaacaacaacauccuacaaaugccagaaacaacacugcagugaagccugaaaauuuccuuacgggcagggcagugagucucuggccauuaugccaggcaaggugcuuaauacuggggacccagccugggacagaaugcuauaauuccugccuuuuuccugcaguuuuuuuuuuuccaauuuuaaauauuuccacacaaaugccugaauaaauacuccauugaagcaaaacuuucuccuucauaacagauaagagauuggccucuggaccacaugcugaacaagaccaaugcuuacaccauuaucuccccuggaauccauccuguccuccuagaaaaucaaaauauccacaaguauuaauagcuugccauucagguuaacaaaagaaucaaguguuuguuuuuguuguuuuuuaacacguaaaaaugaggaaagaauguuacuggcugaaauugguuagaacagagaagcaagaguaugagauugcacccuggaagccagcaguuucucugcaguaaagauaaugaugugagucccugaacaugucuaaaagagaguuuugaauuguggccauucauuuauucagcagucacuucauuaauucauucagcaacgauuuaugaagcuccuuuccugugccaggcccuggaguaucgggucacacagaaagaaauccaucugggucucugcuccuaagggccacccaaucugaugagggauauuggacucuauacaaacaauugcuaccaaacaugaucaagacuauaauguaggcauaaagggggccacagaaauguagagaaaggagagaucauuuuacauccuuuucaguacuuuuuaaugucuuuuuuguuuccuugcggguuugaagugguaucucauuguggcuuugauuuggauuucccuaaugaugaaugauauucagcaucuuuacauguucagaggaaugucagaggaaaugugauccacauggaaucaugaaagaugcauaggaaucugccuagugggccugugggacagggccuuccaggcccaagcagaaccagcaguucagugagaagagucuaacugcacauucagagacauucacaagggcucaaagguacagcgcugaauuggagagaccccagaaggcggaccuuaaaggaccugcuuugugaaggagucugaacuuuauccugggacauuaaagguuuuaaugguuugggaccuuuuucuagaacccaguuaugccagagaggcagaauugauaugagauuuggugacaaaggccauuguagcccuugcagaauuguccuuagaugggaugcaggccuccuggggacuugucaucaagcauacccccgcuaggagccuuauuuucccuccauggcccuacagagagccaucccacaucaccaagaggucaaacuaaaaguuuuuaauucugaucuugacuaugauuuccaagcuggggcagauaacucugaauuucacuuucucagugauaaaauaaggaccuugaugccuacuuccuaggguugucgugauaaauuaaaacuaaaaaagcauucuccaaaaacuuucaacaaucuccacuggacuaaagauggacccaucucuuaugaaaauaagacuaucaauguugggagcuacacagaccuggguucaaagcccaacucucccaauggcugcuugaccguagacaaaucagugaacuuucugagucuccaucuccuccucugugaaauaaaaaugaucauaauaccucccuauggggauugcugagaggaguaaguauaauaaucacugugcuguuccugggcauaucaaaggugcuaaggaguugccuuugagucugaaugugaacaaggaagcucccggaaggcugaggugcaucuccuucaucucuauaugcagagcguaacgccaucauuugacgccuaaagacagcccaguguuuuuguaguugaauucauuugcagcucucaacccuuuacucauuccagguuucuguccaguggaaaaacaaauugacugugaccuuuuagaaaucuaaauaaaucaaugaagaaaaaagauguuaaaccaccucauuuuauguguuuauuuugccgagugggccaaccagguauuaauuaguuugggcuucccuaagggagcaggcagggcccacagcuccugcucccacuaacccagccuggcugucccagauuuuccagcugaaagguagaccagcaucucuuucgcacuggggaguuuaaccugggagagauauguccuuaaugauguuucauacccaggggccucucaagaaaagagcuucaggaggguuaauugggacaggugacuacaggagccacaggcuuggaggcagggacacggagagaugggaaucacagccuccuaugugucccggggccaggcgugggugauuacagcagcccuaaagcagguguaguauagucugugcuccggcucgcuucuucccugugugguucccauguguggcauccacugcuucuccuguucccacucaaaugggagggggccagcuaagggacuuacaaagcccagagccaggcccuggagcugugguggcaccuugcuaggucuccagcaacuucacuuaguggguggcaggcucuggaaugaguaggauaugccugcccacuggagccacuugcuguggggagauggccacaaaaggaggaagguaggccuuuuggagcucuuuggaggcugcagugaacucugacuugagaagagagggaaggagaaggaaaagcuguggaaacuacagaagacugguaucuucagcuauuaauaaugcuguaacaaaauacuugagguuggguaauuuauaaagaacaaauuuauuucucacaguucuagagacuggaagucuaagaucaagaugaaacagguuugauuuuuggugagggcuuggucucugcuuucaaaauggcacuuuuugcugccacauccuccagaggggaggagcacuguguccucaaauggcagagggaacagaagaggcaacaaaagggggccgagcuaguucccuccaccccuuuuauaaggcacuaaucuauucacagggguagagcucucauaaccuaaccaccucccaaaggucacaccucuuaauacuguugcauuggggaucaaguuucaaagugaauuuuggagaggacacauucaaaccauagcaagaggauauuugauaugcaucugaaagggugaaaaagagcucaccagacagaaaaguacgcagagggaaaguuuucauaaaggcccugagaccuggaaggcccuggaguccuagagaaauggggagaggcucaguggaacaggaauaaagaguagagaggcagcuauggggcagugggauaggacaugaggugggaagacagguucugacccuggaaggcaggcuauaaggaguguggaccugguacucuggguggcagagaggcauauagagagaccaaguaagguuggccugcaauagcccugaaucaauucauuacauaauuauuuaugaagcuauacuaggugcucccaccuugcugggcucuggauauccaacaguaaagaagucagacuugacccugagaaaguuuacacuuccucucccuuucugccugccucucuccuuaacaccaucuuaccuguugcuacucucagaagauuguaagcucccaaaggacuguguuacucaucuucugccuggaguacucucucuaaggccuucugggaagaaggugaugaagaaacagcugugaaaaugaacauauugacacuuuagggaguucugagaucaucagauuggaaauccuccacagcuggugcucagccaaggagucccuaaugugguaaacuuucagcuuguagagaccacccuccguggccccagugugugccuguuugucugggaugugaggacucugcaggcaucuaaagguguaaacaccugugcacgugccugaaagcagacgugugucugggcucagaggugcauguugggugcuucugugucaugggcccugugcgcuugucugggucuggacacguggccgugccugugagauuucccuuuaggcucuguugguuucuggaggaugaagagcccaggccucaccuugaaaacaauccuguuguuugugauuuccugauagugacagugucauugcgcuugucugucccucgugcacauguacacacauacccagcaccacuugggagccgcaagcucugagaauuccugagagacugccacgggccacuugaguggcucacuaaugggcuagcuuccuuccucagagaaaugguccaggaaagguuucuggaaaugaaauuucaguaucaguuuaacgucaauaaaauacaacaaagaugaaguggcaagaauucgggugcuucugcugaugcugcuuugaugggaaagcucuuccgaugucuggagucugggaagagaguucuuucaagagguucucagcggcuccugcuggcuuccccaucgcaagcaggcccaggucuuuccuccugagccuuuaaucacaaugcugacagcaagguggacugccccaaaggcugcauuucuccaggugccaaaaauuaagccaguaggacagccgucaaauugacaaaucaguccauuuguccggccagucucauuuuccugauggagacaagcuuacaacguuguguuucuagacucaaucagcuauauucauugagucuauuccuuucucagugaauggccuugugaaccccuuaggcaucaccaacuccuaagucccccugccuugaauccucaucggaacaaggugggaaaauaagcaauggaaugaaaucaauaccuacuguuucccccauguauuaccagucacuccagaucuauacgcucucucucaaaucugcuuucucuuucuucucugagugaacuugagaaaccaggaggaccuuguuuuugcuaugcugccucaggcagaauuagcuuuuuuguucuuuugcacuuuguagaaaggaguugcaagacagugaguucucagcaggaaggcugcuuagggggccuucuggucaguacauguucaauuugcucucugcccucaccucaugccacugugcucauuucaagcugcauuucugggccaagauggugagaacuagccaucaaaauaaagaagacccucagaaaacuaugcagacuccaagagucagggccaaaagcaccuuugggguuucucugucugcaccccuauuuucuagguggaaaaaccaaggcucagacaggccuaauaaguuacuccaagucugccugacagcagcaggcccccaguucacauccccucacuccaaaaucagcacuuugcuucccugccccuaacuauggaccgugcagaaguagcacacucacaccauuuucaaaagauuuucugccaguguugaaacaaacaggccugaugacauggugaaaagccagggcuuuggagucacaaagaccuggguucaaaucccaucuuugcguugauuagacauugucagggggcaaguuacuuucacuucuuugagccucaaugccucaucuguaaaauagggauaauucuaccccucucauagaguuauuguaaagauacaaugaaaucauguacacaaaauccuuagcaguguuccuggcucagaguaaaucgucaacaacuguuagugcccccucuaucuggaagcugacaaauucaauuaaccagaaccacccauccucaucccaaugcccugcccauuucccaaaacucccuguuugcagaaucauaaaucucgugucugaaaaggagcuccauaaaucaccuggcacagccccugguagcagagcucucucuguaucuggcucaguguguucugcagucuuuugcuggcucagccugccucacuccuuacuguaagcagaagaauucccaccagcacagccaaaaaaacagaauaaugcugucaguggauucuacaaaagggcuaauauuagcugggcaggaggauuggggguggggguguaccuauauuuggaaucuaugucuucagcccuuuccugaggcagcagaaguuggggggaugggggaagggguuauugccaggauugggcagagcagcugggcuaggucuccccuucucucuguugggugauuuccuucuccccaggauguggguggcagaggaaaaaggcugcugggagggagaggggaggcugcaaaugguacccccaaagcagcaaggaguauggcagugguagaggcccccaaagucuccuguaaggaugacagggccauuggaaccuagcuguagagaguccuggagggguggguucuguaaccuucuacuccaagaugggauccaaagagcauguuucuggcugugucuuccuggagaggccuuggauaaaggcccaggcaucagggggcgcugggccugcgcuaggagaaagaugcaugccggauguaucccuagcagcagcucuuugcacauucucccaccccccuccaaacaucuacacuuucuuucucugcucuuaaacucaucuuggggcuccagugucccccucugugaacacuuccugccuccuggagacccugcuagcccuucugugcagguuagaagacaaugcccuuccuccaggcagacauagcccggcaccggggcacaaggcugggugagcagagugugagcuggcucugaggucccuccuguccucaugucuuauacaguaugccauuagcaagugaaggccacagcauacuguauaaguauacuuggcaacagcuuuggggcugaaugaaauggccaguggccugagguccagucuccuagguaguauagcaggaugauucucaguaaggauccuucccauaccaggucuugauuuuccugcccuuaaaaugaggagggugggugagaugcccuccagggucucuuucagcuuuacagucuauuuaucugcucguuuuuaggcggcauaaugaagauauaaucagaaaagcaugugugcucuaccuuccccccacauaaaacccauaugauccaaagagaaauggaaauuacuuuugauuuauucauggucugauguugcuguuaucugcucccuucugcuagggucuuaggcuggaccaggaggccugucuauacaggaugcuaaggauuaccugucacccagggagaaccaacuucuauuugcccucaagcugcaucugcagcuguggcacuaugauggcccugggucuggaaguuuaacccaacaagacuugggaaacuugaacaagucugcaguggacuuaaugacuguuuucuagcaucaugucacuguuuugaaacgguuacugggcugcauuuucugucuuccuuuuucuaucuuggagagaugggcaggaaucagggaaggccuggggaguggagacaaggcuagcaggaaaaugaggaaaccaagggugugaguaccugccugguggaguuguguugcucucaauugguuugcuuguuugcaggccgcagggcagcagugucuucucaccugcagagugcaaagcgcauuucugggcuggcacagaaacaugcuugcccugcuuugccuacaggcaucuuuugcacauaaauaacuuaaaagcaccaaacuuugcaggggaaauguuugcauguggcuugcgucugagaagcacaggcauacacacauaaauguugaaggauuaaacacacacaaacacaugcccgcaugcgcgcgcacacacagacacacacacacacaccccgcucacacauacccagcaccuucuaacuucuuugaggauuguuuauucccaugaauagauuuuaacuuggugauuuuuagagucagggaauguuagggcuggaaggaauguaggagauuauucagucugucagaguuccaacuuuuacugaccacaaagacaucuucaaaggaaguuuuacagggauccaaaguguauaaaauacagaaaagcagagauguucuggauaaaguggugaagugagggaggguugcuuccaggauuccccugagcacugugcgagagccacugagcauucccaacucccugcaggaaacugaggcccggggagaagucuucuggcuaaggucacauggcaagugaaggguggggcccagcacccaugccaaagccaaacccuggggaaacucauuucccagccaaacuaaguugaaaaugcugcuuucuuggugaaccaaaccagcauccucucuacuacaacaggcuuccacuguuacauguuuaagccuuuuucccccccaauuuauaacagacucaucaaaugccacagcuggaagugccagcuccgugguuuuuaaucucucuucugcccaaugcugggguuucaccaggggauaggagaggagggguggccuggugagcccugccuuccacuucaccauacuaggucuucucuuaaccauuuuaccaagauuucaucuggaaaaauauaaagaagaugcagggagcuaccuuaaacaaagaagaagcuugagaaacucccaugaaguauaaacuuccucagaugaucaaaucagcaacuugauuuaguugauuuuguggaaagacacugaacuuuguaaggaaauuccuguaucuuaauuuauugcaggaccagcaugucaucucagccuuugcaaaucugagagugaaaaacgggaugcauucugcaaaagaccuucacgagaauuugugagcaaauuuggucgccaauauguaaccaaagggaccuucugccuucuguccuuagucccugccacccaucuagguguuuacauuugauguuuauguugcaggcaccuacaagcuuggguaacuuccccacauuaggacuucccuccuaacauccuccugcuccacauuuaccaccccugcaccccuggccauuucagcaucucaggcucuuccucauuucccccucgcacaguggggugccguggaggagugcugaagcuugcagaugcugaggaggaggccagcauucuucccuuucacugauauuggaucuggcaagcugugcacagccuugucuugccagcccgcugccccuggagggccaggcucugauucucccucagaucuuugcaggggucuccuuaaccuguuguuucaagguuuguuccuggcauuaaaucuaauaagcucagggcugaugguuugauccagagcuuguuuuaggaguucagggcauuuacagcgcauuuacaggaugcugcuaacgaggcuuucagaacagccagccaaccucgagaucucaggccuuuagaaacuggguuuuguggaggcaguggggcagugcaugacaugggcccugguuccaggcccggcuccaccguguacuagcuacacaacuuaaccucuuugaacuagcuacacaacuuaaccucucuuaaaaaugagaaauauaccaaauaagauugcuuugcgaagcgauugaaauaauguaaggaaagugguuggccuguggugggaauucauuaaauagccauuucuuucuuuaucguuucuagagcaccucaugaaacccaagucccauggcuccaugugaugugacacaggucagaggucagcauccucuaccuaagaguucuguccaguaacucuccagggagaaagacgaggggagaaucacuuaucaaaugucauugaguuuaagaugguuacuuuaacuuuuuaacaucucugaaauuaggaugcaucuuacaguugaaggcaugucauaguucaacuggcauugucauuggagguuauuguucccuuuucucagugcaacaauuaugcauggcagauugauagccccauuuuacagauggagaaacuaaggcucugagagguaaaggaacuuggccaggacacagauuuguuaagcgguagaaucagaauuugaaccaaggccugacugacuccaaagccugugcucuuuuggguaaguguaaagagagaggcugguuucucuuugcuucuuaggaccaucccugagcagaucaauguccagggccuaaaggauguuuuauuuuagcaagcaaaauugcauacauuacuggguguccgcuauguacaagguacauccuaggcauuggaggcucagugguaaacacgauauagauggaguuaaaguccaagaaacccaagcaauuacaauccauuuaauauggaaugccauggcagcaugugagggggcccuuaacucaggccaggggaagcuuccaggaggaagugaccucugauuugaaagucagcccagcaaaguggguuuggggugguggggagcaugccccaagcagagggaagaacaugugagaagaggccagaguguguguggcuugguuggagaaacugaaagauccagcuuugcacuaccaauaugguagccaacagccacaugugacuauugaggacuuggaauguggcuagucugaauuaauauguaccauagauauaauacgagaugugcccuggauuucagagacuugggaggaaaaauaaaagaauauaaaaugucccaugagugcuuuuucuauauuagguagcaacauuauaauauuuuagauaaauaaaauuucuuuauagaugaaauaaauguaacaucauuaaaauuguugucauuuuuuucuuuuugcuuuuuaaauguggcuacuagaaaauuuaaaaucacacagguuucagaucugaacuguucugaaaacaguuaugaucuaaacaaucccucuagccacauacacucagcuuccaggcaaugacuguugaauggaaaggagcuugcagcagcuagaaacuugugagaaugcuagaguggaauccaggacugguugagucccucugggaggugggaugugggagguggaaaaagcacuuugugacuuuagagucacaaaggccugaggcugaaaaucccuauuuugccauuuacucuuaauuugacuuugucaucuggaaaauggaagcagacaucacuaccuccuaggguuguuacaggaaccaaaugagaucaucuauguucucauuuuauuuaacuaugagcucuguguguguggcugacauagucucugguacacagcaggugcucagugcaugggaaguauguuugcuuccccuucucuccuuuccuggagugggagaguuuggucacuuaaggaacaaaaagcccucauuacuagguggucuugccaagagguagucccaggccagaggccaccacuuccucuacugccaccccaggacccugugggagagagcugggggaguaggugggcugaagagcccgugccaggaccacucuggcaaguucaguguugugguugaagaguggaaggugaagaccugggcuccacccagccccgccauuaaacagcuggugccuuagguaaggcccucaggagggcuggcccugccuuuccccucaugagggaagguaaggagguaagcucagcaaacacagacuguuuacccacuguggcccuggggacacaaaugcaaauacgauucagccccaucauggaggggccauggucucuuauggauuauggaccuauaaauagaacacuccagauugguaugaaaagugcaaauaaauggcaagagaaccuagaggagcaaguggcuuugccgucucuaaagcccuuuagaaagacaagaaaaagucucuguaaucaucuuugucuuuccgauuagcauucgaugaucucuucaaagacauaacccuuuggggaagaagcuuuaucgggcggcucaggaacgcuggcuguugaguucaguuugaauguuccccuugcagcuugcuuuuacccuagaucuugagaucuucacuggggucagaaaggcauacaaguaccuguuggucuuuuacccccagacugacuaauuccauucuuagccuucagaagucaucaugaaaaaugacuucagaagucaucaauuuccccagcagacaaacucaaugaccuagaucagaguuuccaaaccuuuugugacugugggaauuuucuucagucuuuugugauguccuaauacauagaacagaagaggcaaagcugcuucugguugggaggaggggagcuguucucccaccugauuugcucuucugugagcccagcccucugcuaaggacugaauucagccuguucccugccaucguggggccguauaguugaguaacugcccugcaaauuauacaagggaaacacagagaggcagccugaggcugggaggagucauggugggcuuccugaaggaggugaugccuacauagagcuuugaaaguugaguaagcauuugucauggaaggaagugaaguggagggugcucuagauagagagaaugugaacagcaagcagagcuggaauagaaaugaaaaguucacugggaugggggugagagccaugguuagugagaagcagugagaggagauacaugggagagauaggagggcccagaggucugagaaacccuuagguaccauguggggaguuugaauuugauccaguacagaugaucccaaaucauuuaggaguuuucaguagauaauuaugguaauuagauuuuuaaaauuuuauauagcagauuuguuugaauauaauucacaugccauacaauuugguaauuagguugugggacuagaggcaaagucacuuuggcuacaaaguggccaagggaauaaaaucacuggggaucauuuuggauggcacaugccuugugcacacccauaagugcuaagugccaguuacacccucauuguuaacaacccaaacuggcuccacacacuuccaaagccuccagggaggaaagaacaacagagggagcuaagccucaaggcuccugcagguggccaggcaggaggagaugcugggcgaaaggacgguggugcuagggggaugggaaccuggggacaaauccagcaaucacugaggagucuugguggaguggggcugcaugcaggccugugcuucucugcgaggcccuggaaaggaaccugcugggaguggagggaggaagaggggaagucagggauagcaggacaucuacagagccagagggugaagagaaagcccagaaguaguuaauccugcugguugaauuguuuuuauaaaagacacucuaaaaucaaauagaugaaauaaaaccacaguugccuuuucauuaagcaugccacagaggccccuuguucagcagccguugucaaucagaucugggccauugucucuuuccccagcccccuguaauuggcaucugucugggagaaaacaaauaaaugccaggcuggcauuuuaacuagggcagcaaggagccaggggcacugcuuuucagagucugccuggccaucggggcaggcgagggcccugaggagcccugaggagcccugaggagcccugcucucucccagguaggggugcagccucgaguccccacccacgcagcucccuauuccccuccuggaagaugcugcucucaucuuugccuaaaauuguggcucuagagagugcuuuauuucugcuuucugucuguagaagccccugggagacagucuguaggaaggcuuuauuuuuguuuuuauucucuucaggaagccaugggaaaaagaaaaaguagacacauucucuggcuaacuuuggauacaaccacuuaauagcaguaacacagcacucuuguuaaauaauacaaacagaauaaaacgaaaauggugaauuaguuauagcuuuauugcagcauuaggagauaagacuaucacagcauaguuuuuaacuaagaauuuuguaacaguaauuuuagcuacuacuuugaacagcauguucauguacaggugauucucauuuuuuacaguaguuauguuauauaaaguaggugggaauccugaauuagugaguguggaaccuuugcuccuaagggaaauacaggguuagguuccuguaagccucugaucaaaacauuuuugucagcucauuaauacaucaucugguuucguguguguucuauuuaaagacaucuuaucuaauauauguuuuugauuccuugacauugaacucucagccagcaauccuauaacucaugccugaaugaagcuuaucuagcacauacauuuugcauauaacacauauuacagccuucuugcacuuaggaacaccagcuagcacuucagcacuaugcuugguggacauuucaagcaaugaaaucaccaacaaaaagcacagcacaaaaaugugaaaaguguaguacuaaauagauugcaaaaaggaaacuuuuuacauuaugagaguugggacaagaaggcagaguguuguuuuguuuaaccucagcugggaacuuugcaccugaugagucaaauuuuucaccucuuuaugcaugguccacaaaugaccaugauaguguuggguuugggguuacaaguacauuucugggaauagcaaaauucacaaauacaauuuugugaauagguaguccaugaauaauaaggacugacucuaccuuauuucauuuacaucucacucaugcccaaaacucucauguuuugauauaggaaaguaagauuuaaagagaagaagugacuuguccagugucagauagcugaaaugugguucauuauauuauacuugggucaguuaacuacagcccacaggccuguugccuguuuuguaaacaaaguuuuacugaaacacagucuauucauauacauauugucuauguagcugcuuuugagcuacaauggcagagcugaguaguugcaacagaggucauauagcccacaaagcuuaaauuauuuacagcccagcccuuuagggaaaaguuuguugacuccuguaguacuccagauuuucucuuugaguucacaguugagaaaguucucucuugucucaauaccagaauuuuuugugcuuuucccuggcaauuugucuuucccucuugaacacugggaauuuuauaccugauuauauuuccuucuuuacacugauguuaagaaguuuaaagccuaguaaaacugcagauuccuagcacucgcuugauaggaacagaaaggaucuuccauuuugguuacacuagcaggauguuagauuguuuuggcacagucaaaaacucaaacaauuuauaggugauacaggugucugggauuuuucaguaaugaagugguacaucuggggcaggaccugggcucuguaagaaucauaguuuucccuaaugagacaaauaccuacuuucugugaauaaucuuuuuguuuucaacaaacuacaguuuaucaagaauuuauuaugugccagauacuggccuuaagugcuagucauaccuuauauaauuuauucucuaaggaauauauuguauagguuaagagagucuauaccauggagguaaagaugauuauccucuuuuacagaugaggaaaugaaggaccagagauguuuuaauuugucuaggucacaaagcaaggaaauaggagauuucaaauuuaaagccaggugugucugacucuaaaccuuagucccuacuauauacuccauuauucuauauaguuuaccuagcaucaaccuuuaucuuuccaaaucucagaauuagaacuaugggcugaacagugaggcauuucuggcauucuucucauauuaggacauucaucuuuggauuugaacaggguaaauggccuccacagaacaguggggcagggcaggugcagggacuaugucaagaguagacauauggagauugacaagaaggcuuugcaauaggccaaguaugugaugaugaugggcuggacucuggugcugguagugaguuuggagaggcauguguagguuguagagcugauuagaauuagaacugacaagauucaguucuugauuacauguggauggugagaaagggagaggaaggugacaaacaggucucacuuuguggcuggaguaacuagguagaugguggggccaaucaugagaccagagaagaagcgauuguggagagaagaugaggagcuuuguuuugggugggugaagaaugaaacuccuauaagauauccaaaaugcucacuugugaaugugguaaccuuuaucccaacguguuuuguaucucauaauuuauauauaugccugucucucccauaaaacucugugguacugaagggcagagauccuucugcuuaaugauccuuuguuuaaugcacgcaauggcuucaauuuguuuuuuaugguuacucuucuagacaauucugaaagucuuaucagucuccuuggucacuacuagugugccucuaaaaaaagcaaaagucaugcuuuggccaauucagagcugccucugucucuaucaaaaccaauaaauaccugcugcugcaauguuauugcaccucuuaaacucuuuagugcacagcguaaguggaagguuguaaagacucuguuaagggagccucuacugauacuaguagcaaagauaagggccuacugacaccaguagcaaagauaagggccugugccuuucagaaggaugggcucuggggcacaggagcuccuccugccuguaucauuccucuucuucaacaucagcauagugaauauuuauugaacaucugggcauuaggaugaugcaagguacuuuuuagcagaagcaggaaagcuccauaaaagcaggcauuuuugacuauuuugcucauugcaguauucccugugccuagagugugcuugguaugguugacacuuaguagguaugcaguagauauuuguugagaagauuaaggaauguauaaagauacuucccuugaugcgugagaucuauccauucaucuaacauuuacugagcacaugucagaucuugagucagaccuugggaacacagaauagaucagcccugcacucaguaagucuuaugacguaggccagcuggucaaaggaucacagucauuccugggagaaguguuacaacagcaguaagagcugagugccggagaggcaagugggagugcuacuuacuccaccugggaaaucagauagggcuucccagaaggagguagcauuuaaucugggucuugaaggaugaauaagaguucugagaguaggaaaugagaagaaaggcaucagagagaggaaaucuuugugggagggagcugagacaguugccauggucauuuacaagaaaauacccuggguagaaggugagagacgggaacagauagcauaaccuccuaggcugagagaaggacuagguuuuuaauccaaagcccuguuuccuccccaucucucaugcuguuuuauuauaauccuacuggaagaugagaagcgagaaagauagaguuuauugauaggagagaaauguuaaaaaaaaaucacacacaaggcugacauggauauauaugugaaaaguagaugaaagcaaaauggcucagagccgcacacuccaauggaaauauaauauuuuuaauuuucuaguaguugcauuuaaaaaaaugaacagaaacaggggaaauuaauuuuaaucauacauguaacacaaucuauucaaaauaucauuucgacauguaauuuguuuaaaaauuuaagaaaaauguaaauucuuguuuucacucuaagucuuugaaaugugauauguauuuuacacuuuggaugagccgcguuucaagggcuccauagccacauguggccaauggcugcaguauugaacagugcaggccuagacuccuaaagucuuuaucacgcaaugugaaacugaagaaccaaggaauguccgagacccacccacucaccccuucauucaugugccuagggcuucugauauaaagucaaacaagaaauggccugugucaccagggagcaugcaguuucaugcauuacaaggcagugagcuagccaucuaaaaggaacugagaucugucaguuuguccggggucucaaacugagggcuguaggcugugugugccauuugauuuuuccuguacuguaucucaaaaaacauucuacccaggcagguguuaugcuucgucuacaggcagcugaacaccuuuggccccacaccuggcugccuccacucauuagguugccugcagacccucugcagacauuugccuuugauaacccaggaacaggugucucugagaaauccuaaguguugacaagaccagagguauaaacagaauggacuuagagggcauccaagucgugguuugcagccccugcuuauguucuagaaucaccuagaacaguuuuugaacauacuauuuugggaccccaccgucggagauucugauuccauugguuugaaaugggaaugggauccaaguauuuucuacaaguccuacccugugauuuuagucccauuuccaacguguaacugcugggaaaccacggcccagagauuuuguuuguuugggcuggggucacguaguacaccagccuccuaaucccaacccacugauguuuuccccaaacaacacugaggggaagaggaggcccucagaaccuuccuugaauauucaggagguauugccacacacccagagcuuagagcagggggacgggaauccguuacugcuguguugccucuucaagaacaaagcccuugucgguuuaccacucugggaagauugccaggcucaaguauuaauaauaaucccuuuguuuuguaaaugccuuauaauugcauaaauaaagcuuacuuucucuucuuuaaugguaaugagccuuauuuggcugauugguugauuaauaauacucuaauuccacuagugacaaaacaggaaggccaaaagauagauguugagcccggguagcuugggauuguaaagcacccgugccggccauguuuucacugcucccgugguaucucagugagaaggauagccugguuucuucacagucggacacugauaaguaagagcaauggucagcaucagcaaaacggcgcuugcaguuccuacuugaacaucucuuuuuucucauuacacaauguccauucuggaagaccuaaggaagauacuacaguugacucuagaucaaaguggguuugaacugcauagguccacuuaauacacagauuauuuuuaaaccaaauguugauggaaaauaccauauucaagggaugcgaagccccguaggccaugcauagggaggucuaggcccacuuuucucauaugugguuaaguuugcacagauuucaauaaacuggaggguguguuggaaucaguuucccauauauaccaagggagagcuguauucgucccugguuuuaguagcauuaacaguggugcugguccuggguuacuaggguuacuguuagacauuggaaauugugauacugauuaaaacuaaucauguuuacuacuuuccauuggcuaccuggacauuuaggggcaaaccugcauaccaccugcaacaagugugaaggaguucucagcagacauuuucuguaguaacaacagcucacauuuuacugagcauuuauugucuacauggacucuuugcaccuuucuuucugcaaacuccauguuucuggaaaaacuagagugcacgucucacuuuuguaaaacaagcaauguucucaaugcccuugggaaauaaagaaacucauuugaauuguagauuuuugugcuguacauaaugaccucguuacuucaccauguuugcggugccauuugcugguuuuucagacucccccuugacuuacagacaaggccaggugggcccagcugcugccucugaguuggcugugaacucagcuuccuucuucucagcccagcaaagucucugcucuugcuaggagucagacggccagagcagagcccugacggggcccacaguuguggacagcuuugcacugucaugcacuggcccagagacaaagggaaacgggagggcuuuuauuggucaccugccuccaugcauuggguuccugauagauagcagauggagagacacgggaguuaaugaggucugcguucuggccaaaugcuuuccaucuuccucucgccacugagcccauuggaaaagaauguugugcugggcagguggucagggagagcuacaaaagcugagcuuucagcaaagguguuagggaagggagagagauagcaugcacugauucaauucgacucaauucagggaauauuuauuaagcacugccucuauuagucaccuauauguaucaucucauuuuuuuccucgaagauauccucccauguaauugucauuauccucacuuuacagguaagauacuuaaaagacucagagauauuaagaaaugugucuaggaucacacagccagccuaaggcuuagccgggauuugacucuaagucuuguucuuuaaaccuaauacaccaagcugcuucuccaagcaccucugccacuugcugggucacacauuccuuuuuaaauuguuuucagaguuacaucuugaggucucauuucugaagcaucucuucuugcuguagugaggaaaugggguugggaaagagacggaucuucaaagacuaggggaaauggauggaacgagcaguuuacaguuauaaaauuuguuuucaguucuagcaagggcuaguaguaauuuagucaucaagacuggcguccacuuccuuuggggcucccuacccugagccagauguuuuuuguugaaucugguaauuuucaaagaagaguccagauuggagugucagaccaauggcugggcucugugaauagagccugugaaagaacacaggaaaagcacccauaaacugugcacuacacagcacuuugcaaccucucagccuuuccaugcccucucacagcagcccagugaggcaggcgucauuauugaccccauuuugugggugagaaaacugagccuccaagacuuuccuggguccagugcagagcugggacccaucgugucucagaagaugcagguggcgccuggcacgugauggguacucacacaccauugaaacuucagacuccuagcucugaggcuuuugucuuccaucuuauggucucugccucaagaaaaguaaucuaucccgaaggcuauuucuucaaaauauaagaaaauccuuacagggcugugaucucauguuccuccgcaggccccuuuggcauccccauggaccaugcauaugacuugcuuucauccauccagagguuauaagaaaccaaauguuggcagcauaacaucuuucuuuggagggacucagaggccugccccaguauuugucucugggggucaggaaagaaauuugagaggcugcagaggaagaagccacuggcuuuguuuugucaagaucugugcuuuuuaaaugguuucaucuccaaacacauagcgcuccuccuccuaaagaaaagcaaaccaaaaaaauuguagaagccaucacguccuacaaaacccacagcucucucucucuguauauucccagcccagccuccagacccaaggaaggugggaagagcuguccccagggguuccuggugugggguuccauauagagccgaagauacugugggggcucauucccaagccaagccaaucuauuuuaggacauuuccaucauccccaaaagaaaccaggaugcuucccccagcauuucauggaaucacagcaagcauuucuugaaggaauucacaggaacaggccuagcaugggaccgggaacagaguuugugucuaaugaauguccauuccacagccccuggagcaggguuugguacagguuuguggggucagaucuaucagcuuuccccacacacaagcauggaggcuacccugcuaguucagcucaguuuuucugcagaggucgaucuccagguaugaaauuaugucuggacccagggucagggggucguacuucccagugaacuuuccacacaaaagguccagucuccauggcucaggucagaaauuacccacuagacagccucccucuccaaccugccaggucaaggcaaauaggaauacugcccccugugccucauggcaaauugucacucaauuauggccacuuuagaacccagguuaucacaaauugacuuggcugaucucucuaaauugccucauuuucaucuauuucuuuugcucuguuuccaagaagaaauucugagcucaggaaacaucguuuucauagcccaguugucccuuuggucaaggaguuguaagagaggggaaugaaguggguugggggaagauuuggcauuaucugggguuggauccccagaagaaccucaggccagucugugucaggaguagggaauacugggcaggugggagggcccuuuuggcaguaaugagguacagccuuggagagccuugaguuggcaccggaggcgugcugcuugaggaggaagaagggaguugaauuaaagcaaaugguaauuuauggaguccacagucacgaguccacugagucccucuaccgcauacugggcaacagggaagaacaaggcagaucuccugccccugaagaguucucuggucagaaaacagacagaccuagguucccugguuccauuaccugaaguaaaucauaugccuucuuuagccucagcuuacucuucuguaaaguggagcuaacaaucucuauuuuuuaaggugauuguaaaagcuaaguaagauaauauaugccaaguauacauagcacauguccagacauauggaauguguucauuaaagggauguucuuacuauacugcugauaagauguaggugaggcauccugggguagaaauuaaggaagcacucgcaaucaggguggagccaucacagggucagcacucagugccuccugaaaauuuuuacccuuggugccucgcucaccuuacccuagucacaacucugauguuaaguaaugauugaaagugacuaucggcucaccgaugcccuuaaaugaaguuauauuuugucacaacaauaucuauucucacaugagaaacagauguacaacuauguuugaggcacaauguuuguucauucuacaaaaaaauuguaaccuccauauaaaaagccacuucucuccaccacccacagcccuccagguggcagugcucacuguaucccacuaaguugauuauuaacaguuuccugcaucacauagcucuuuaacugguaggucugagaaguggccauaauaagaugcucagagcccagggaucuugucagcaagcgaugugauauuaacccaucuugcgugacuacaguaaaugacaacaaaagagaguuguugagauuuuuucucuuuuaauugcuugcugguaccuagcgccauagugaguacauaguagauguuuaauggauacuuggugauugaguucauggguauagggauggauggaugggugugcauggauggauggauggauggauggauggauggauggauggauggauagauggauggauggauggaugggggaguggauggguggagggauggauggauggauagguggauggaugaguggauagaugcauggaugaguggaugggugagugaguauauggguagguagguggguggauggauggauggauggauggauggaugcauggauagauggauggauggacagauggcuggguagaugaagauagauagguagauuucauuagaauguauguucuaggaaggaaggaauuuuuacauauuuuuuucauugauguauguccaaugccuaggacuuaacauguaacagauaguaaauauuuauuguugaauuagauggauagguggaggaaacaguguaugaauggguagaugcacagauagaugaauucauacuaguuuacuuuugaacaguacuuuacacuuuacauucuguaucuuauuugauccuugaccaagcugugcaaaguagucugcguagguacauaacugaugaaacccuccuuuuggccaagcaauauucucauuauggcacaccuacuucuguccuaggaacacccuccaacuccuuugagaaauacgagcuaauucaacacugagcacgugaccuagugcacuguaauucucugcauugugaaccaaauaugugugaucuucacuauuuuggaaugaaccagaagaaugaagaaacuaucccuggccauacagcuaguagguggggggggccaggacuggaacucagcuucagauugcucaucucgggcauguuuuucuucagaugagcauaaagaugauuugccugccuagagaggugggcggcuugcaugaauaaaugacagacacaucauucuagugagccagggagccggugggggagcacuugcuuaaaaagagacaaacagcuuugccugagccucccugguugaaauaacugcauccgcuuaagccccuggcucuguuagcagacaaggauuaugugaugugcucagaagcccagccaucuauugguauuuaaugcauucacugucaguaaagauucccuggugcaggaggcugauaggauuuagagaugcaggcaggaaacuucucacauuuggaaacugguguauuacaagucaaggccacuuucacuuacugcacacuugaccuugugaaauaaagcccuguccuggcccuuaccaaggaaggaugagaaguuguauagaguuauugaagggggccagccuuagaauucacaaagacuugaguuugaauggaggccccacugccuacuagcuuggggaggcuggaaaauggaagaaaguaaugcuuucugaccauccauuguauaauagucaccuguaccaguguggagaugcauuaauucacuuaaaccuuugguuagcccugcagaauguagauguaguugucuccauuuuacacaugaaaucaaggcucagaaagguuaugcaucuuguccaaggucucaucaucguaacuaauagagaggccuauuuaucugacuccaaaggccuauuugucugacucuaaaacccuuuccaucucagcacaugacaagacaccaaaccccucuccucuccccauuaauguaagggggauaacaccaaguuuuccacccaaccugucuguaccauggauugagugaaccccucaccucgcagguguuugcaggaagaaggcuuaaacucuugcaccugagcagacucucauucugcaggcuguuuucaccauggugcugguggauucucacgugacaagucuuuugaacauuugccaguaccucagcccuucuaguuaaaaccacauuaucuaugaugauccuuaaugauagcauuuguggagucaggaugcucuuuggucucaaguucaguuugaaauuuccccuucugagcagcaaugugguggccuuaauaaugggccagugugagauucugugugaccugcucugauagccuguguauuccuuuuuacuccagaaaccucuacuagaggaggcucucaaccucccuggcagaugguuuggcagccugugugucaaagacacgugucaacuauuucuaguuuauuaacuuuguugcauuagcugugggccccuccacccuccacccuuccaagaugcagaugaaaagaagcaaguggaucaguauuugcuggccauuguuucuauuaggcucaaggagcaccucuggcugguguccucucccucuagcugaggacauuugcaccacagccuuggugagcuccuggcacuagauucagucuuuaccugaaacuggaggugauuaaggaacagcauccugaaugcugagucuauaggaguucauugaacuauuaucucuacuucuaaauagguuugggaaauuuuuuuuuaauucuuuaagaaguggcauaacaacccuuugggacacaacauucagauugagaggcuacuaggcuggcccagaccuugggccccagucugauacuugaggccuaguuccuuaguacacugaacaaugcccaccaugauugguccauaugugccccuccagcccaucuccuaccaccugcaugcauccugugcucaggccaccucuucugccuggaaugcuccugccuuccuucauucacugcucugucucucauauccacaacaugcccacuccugcuuauccuuuaaauugcagcucagugguugcuuucuacaggaagacuuugucacugauccugacuagaugaggagccaucuguuaugucuugcucaucuuggucacuccacaggcccuuaguaauugcacagugaccagauggauggaugaaugaggacaugauuaguaacguaacugaguuuccaccucacucucaagcccuauucccagaaagcccuaucacccaaugaaagccugaaaucugaaagucuccugugugaggcucagaguccaggagccacaaaugagacaggaccuuuaaaaguuaaaauccaagagacaaagucauugauaaacagcaggauuccuaacagguccagacaaaccugacauggacagucuuaaagauccagccucugaacccuuugaacucugagauggaaacucaaaugguucucuuguaggugacaccauuuugcagauucucacugauugcuuugguuucccacuggugaaaucgaguugucagaucuccaagcuuuggcacugggcaguccuggcuugggauucugguucugccagugccuggugauguggccuuaggcaaagcaguuacccucuuucagccucuccacuucccuggaaaaugaggacaugaaaugcuacaauacauggcaaguguggggaacugauaggcacucaaauggaguaacugaggaggguugagagaggagcaggguuucagaaagccggugagauagcgcagcaccccaggauuagcaacaccaggaaacuguuacuacccacuaggccuaaauaggaaagggcaggaguaguuacugagagcuauggcuacaggagaagaugcuggacagcagccaugccuuagguagaagaaagaagccacuacuaacaacuauagccuagcagggaagaguugggggaauaaacaacccagccucucucuuuucuguccucugaggcugguggcuccaauagccuaacccuaaccggaagucaaagggaaaagaauuccauugauaucaccccaaaagcucagccuccuggggcacagaaaagggcagcgaaggguagagaaaagagcuggaggagcaaagacuguccagcccagcucugcucugacacacagugcuuucucaggacaggccacuuucucuuaccuuauuuacaucucuacuucaauagagaaagggacagaagagaagauugaacaaaccugagcuuuccuuagagucuuaacaagauuguguuagggacaaaaguugaaauggaaagaaagaauaaaggauuuuuaauuuugauuaucuguggauuucuuuuauccauguuaucucuuucugccuguagcugggauaauugaaaacucauuggcuucccuaacuuuagcuauucaauguguugaaugcacaucaaagguguuuuuguaaggagcuguaugccgucauuuuuaauuaauuuuaaauucaguuuuacauuugaucuaauaaagucaaaugaaucuuuauuguucagauaucacuaacuggugaaauaggucaggcuuuccaagaggaguucuuugagcuucuuugcauguauaaauaucuucugccagccgacucuaggcucuaaaggauaccuggcugcaggcuugcagggaucuauguaagacacggaggcguuaggaacaugagaggccggacugaaaagacugugucagcaucccaugcauuucacacacagguccuucugugcacugggcaccaugcugggugcagaguguaaaggagacagaggggucaccuguacucugcagcuuagucccacaggaaaauaaacuuggacacuugagauggaaaaauaggcaucuuuauuuuuccucuucaaccucccuaacuguggggagauuugcaccacgcccccaauucugcggugaauuccagaccuuucuggucacccagcggggcugcugcccaugcccccacaagcccagugggacccucucacuuugggcuucccaucaucugcaaggcauaugacgcccuuccagaacugggaagacuuuuccuuuguccccuccauggcucucaaggaugcauggaaaagcuucuauucuacccgaccuccacugucuccuuccaccucccaagccccaguuucuuauuuuucugauuauucccagggaagaacaacucaagcuugucaaauaaacccacuggggugauugacacuaucuuuccuuccagauccuuuccuguacaccagcugcuuguguaugugacucuccuccacucucaccucaccagcguggcauugaacacauuauauaauauuaacacaauauuauagucaguugcagcacuuaauauaagugauuuuugaugugugcaaggguaaggaaaacaaaauggccuuuaaucucauugccccaguaacuccuguugacuuuaaaaaauuggaugugcaugaucagaaaguacagaguccagaaagucagaaaagaacgcgugacuugucuuagcuccuuagcugccucucuccaaggguggccacagcaaaagaguuuucugcuauucuuccguaaaagaaaguguaggcucauauuuuauuuauaccaaagagcccauuuauccucuguucuuggguuuucccuuugacaacguaccuaggagguguuucacuaucaguccuuacaaaacuaauuacucuuguuaacugcugcauauuuuuccauuguugaaugugccauacaucguuuaccucagucucugcucaaagacacuuacguuuuucuaguuuuuugcugugacauaugccuaucuuggcauguuuugggggauggguguaaguggagaguaaauuucuaauaauagaauaaaugagccaaaaaguuuuaaauuuugauagguauugauugccaaauugaccuacaaaauaguuucaccaguggacacucccaucgacagcauaugaggaugccccuuuccuguggguaaacacuggaaaauuaucaagcuuuuccauuuucaccaaccugauagggaaaagaauguaauuucacuguuguuuugaucugcauuucuuuaacuaucagugugaccaagugucuuuucauauguuuacuagcuguucguauuuguucuucuguaaauagaauauucauauucuuugucuauuuuuuucuacuggauuggagauaaguuugguacuuuuaugaaaccaaaagaaguucaucaucgauuuuauuucaguuuauuuugagauucugaaucaaauggggagggaugaaggucuaaacgucuucauccucucuuacuuaaacagggaaaccucuguagccucuuggacggucugcccauucccaccccacagaaaacagggcgauuaauuauuuaggaucccaucgguucagaggagaagcuguaccaaucagacaguuccccagcagcugcuaaaguaccaggcacuaagacgcggaucagcugugggacucugugucauccauuuagaugagggcuuccucgacugccuauugugagccuccggaggucacauccuugacaucaucugcuggaccaugaagaucaucagcaugccaaggagucugacaggcugcgauuauuuuccacuccagugcaguguuuguuuguuuccuggcaugaaggggauuuguuuucccggcaagcucuuugugcagcagacaccucauaaaaggaaaauagccucuuugggaacauugaugaguuugcucaggccuuacgguggucaggcccugagugugaguuugagugagugcaguuuauguuuuuggccccaguggaugggcuguuauuccuuugucuguucauccauuaauccaacaagcauuugcugagaagcaauuugguacagaaguuaaaaguuggggcuucacagacagaauaagccuuaguuguugaguuuacuuucgugugacacuggguaaguugcauuccuucuuggagccuuugucuuuucuucaccguaaaauggagguaacaaugucuaucucagaauucuaaaaucuguugauauaauauauguauuaagcaacuguacugucacaaucaugcugcauuaacaagccacuugaaaauucaguagcuuaaaacaaucauugacucuuacucgucugucugggagugagcuggggucagcugaucuaaacugggcucugggggguuuaacuccaaucagcagguggauccgggucugcuccaugagucucucauccuccuuggacccacaggagagcuggggcacauucuuuucauggcagcagaagggagaggucaagcucccuaguggguagggaaaugcacuccaccuguaguaggaaguacugaaaaguccagggcaaagggcacgaggagaagggugaagaauuaggagcaaugauucaaucuuccacuauagauaguucacagcacccaguaguugcccuaguuuucuggccgacaaacuagagaguagaacugcuucagccaggcgcaguggcucacgccuguaaucccagcacuuugggaggccgaggcgggcggaucacgaggucaggaguucgaggccagccugaucaacauagugaaaccccaucucuacuuaacaaaaaaagaaaaauuagccgggugugguggugagcgccuguaaucccagcuacucggaaggcugaagcaggagaauggcgugaacgcgggaggcagagcuugcagugagccaagaucgcgccacugcacuccagccugggcgacagagcaagacucagucucaaaaaagaaaaagagagaacuucuucgcagcauccuuuuccccagggaugacuguuaaaccgugugcugcuuucaauucacagauucuguuuauuucauaauuccucagccuuccaaagauuggccaccuucagaaagcaaaagaaaaccaacacuccgagagcuuuuacaauuuuuucuuugcccuuuuuauuccauaguuuuguuuccucucccucauuuucuccuuuugaaauuuccauuaguuguauguuagaucuucugauuugcccucuuuuguuuugacagaucagucauauuuuccaucuaguucccugugcugcauuaugggaaauuuccucaagucuauuuuuuauuuuacuaaauaucucuuuagcuguacuuaaucugcuguuucauucagcuucugaauuuuaauuuuagugauaauguuuuuuuuucauuuuuucgaguuuuauuugcuuauuuuucaagcuuauauuuucucauaauuuuauuauuuuaacaugauuuuuauuccuuuaucuuuuuaguaauuuaaauacauguauaaucuaucagaguauuuuaguaugucaagggugucaaaccuucuuguugcucugcugguagaguguuuucuugggugauuucuaauuuuuuuguaaucucauuuucaggugauguaguuugugauauuguuuuauuuuuccagugggauuucccugcauucaaggugauaaaagugacccuacagagucuaaagagcuauuucgugccugauuugagcaagcaacuuagagguccuacuuguccuaggacaguuuuuacauuaauuucuugguuuaggauuuuagcaacccacgggugauauaaauuugaacuucaugcuugcauguggugcagguuugaguuuuuauacaucauaggcuauuuauuuuucuguccaaagcccugagcagaaugaagcuucuugguuuccuaugcagcuggaugggcaaacaucucauacauggagggaggaaacccuuccaagguccagaccuuauucagggugucagagcuuaguuucaacucugccucacauggcccagagcuacaucuuuuuucccccacguggauguuaaaacucuagccucuagcuauuaagacgugugccugugucucauauacuucuggccuacuaugucuucagcucuuucacuuaaagcuuugguuaaauguuucuuaauugcuuuuuuucccaauucauuuugaaccacauuucuauauaguuuuggugggaagagagauccauaaaaccagucuacuauguugccagaaacagaaguucaacacuuauagcuucuugaagcaccacuaguggauccuuucauuuuaaaccucuuucaaggauacagcccaaagaaaugcauguuugugaaguaauuguauagccagacaccuauuugauuuaaaaagcaauugaaaguuuaagcuucgccuagcaaguuguugucuaaauuugccuuccguggacaucugugaucaucagaauuucaauuauuaauuuuuaacuagaagcaugggaugauuauaaaugccauuaagacauugaauugugucuaauguuggguuaauagaaggcaauauuugcuaggaucgcuccuuuuuuuaaggccuggaaaccaggcauccuccauuagaauagcaaaaguuacagcagaacuuuugaaauauuuucuuaaaaaggugcauagaacagugggguuggccuucagugauugagaauguguggcuuucuuccccauuugggacaaaugccuucagucuaaucauucccaggugcaggauucaaagucacuagauguguguucaaauucuagcucugccacuuccuaccuaugccugaccugagccuggcauccugcuuugccuuauauguggauuaucucauuuagccucacaauugaauuucuaggcacucuguuaaaagaaaauuagugccggccaggcgugguggcucacgccuguaaucccagcacuuugggagacugaggcaggcagaucacuugagaccagaaguuugagaccagccuggccaacauggugaaaaccugucucuacuaaaaauacaaaaaaucagccgggcaugguggugcucaccuguaaucccagcuacucaagaggcugaggcaggagaguugcuugaacaggggagacagagguugaagugagcugagaucacgccauugcacuccagccugggcaacagagcaagacuccaucuaaaaaaagaaaagaaaauuagugcagggcacaaauaggcagugugcugggaaucacugaugcacaauaaaaguuuacguaauaaaugaguaaugccgccacuacugcucauagaaauugccuguucagcuccuauuuggugccaguuacuggaauagucaccugacauacaucuucugacuuaaucuucaaaacuuccugagauugcuccuauuuuaaauauggggaaaccagcagagaguuguuagauaaaucccaaggccacauagcuagggagugacagaucuggaauucaaauccaagugucugguuuuaaaugaccagcuuauuaacauuguguauagagaaaguaaaggaguugguguaguauuucucacauaaauacugcgugugaauauugcgauaccuuuggguugcugagaggcuuuuuggcauaauuccuguuucucagaaaaguuucagauggcugaguuugguggguaaaugaauuugaaauagaacccagcacugucccugacacauagcagaggccuaauaaauauuuaugauucaaucuauucauuaaugauuuacuugcuggugagggguuaugcugucauaccuuuuaaaagguagacuagaagcaugauggaaaaugcaugggcuagauuuggaauuacagggaccuauguucaaaucucggcuuuugugcuuacuagcucugugcccauggguagguagguuaaauauuucugugccucaguuuccucaccugcagaaugggaaugaugaauaucucuauaguuuaugugaggauuuaauaaguuaacacauacagugcacuuagaauagucccuguagguaguaaguacuagauaaaagcuauuauuuuuuauuguaagcacucaaacaaauaagaauuauuaguaauuguuacugcaugcuacuaggguugugucaaugaugcuaaauaaaaauugaagaccaaauuauugcugaagaucaggugaaaacaccuggaucccacagguagugucaucggaaagcugaaauucagaaaauauucuucuuccucucuuccucuuccucuuuccuggccuucuagaaaccugguaaccagugucugcugucacuaauguggccagaggaaguaacacauuacaaggaaugggugggggagggaagcuuugucuucccucaaauggagcaaaaacagcccauuauucaaagucucugcuaggggaaaaaaaagucucugcagaaaaaguugaccauaucgagcagaagaugcuguaguuuccauggcaauuaaugguguuaagugcacuucauaacucaaaggucucuugugaagaugcaggaggagaaggcagaaagguguguaugguuuuuuaaaaauaguauuugaagacuuuuucccccugaaaauccuuuuacugccuuuaugggacagaguuuuauuuuugaauccuugggaagaugugcaaaaugacuuuagggaugaaauuaccgacacaguugagaugcccaaaauagacguuccccaaagugugggggacacuuaugaaagauucuccauacauuuacucuguguggccagcaaaauguugcuuucuggcacuaaugggaacucuguaauacuguggucccuagccaacaaggaagggguucacucacucuaaugcccagaacugugugaaccuucaggaaggagagguuugcaggaccucuuuucuaacuccugaaucauguaggccauugagugaacacucuguauguaucccaugccuugccugugccagguaccuuguggggagcuuugcgcagguaucucaccuacuucugaagguagucgcagucucuucauucugaggggccugagccucagaggagcugaggacacauggggacauuaaguuaaggcaggccaccacaaagcucccaaugagccacgucaucuugggcucuuccaccuuccaccagauggauggccagcccugcguguuuauaagggaccagaggacaagccaucaggguagacagggcuuccaugcccuccuacaaagaucuggccacaggcaagggcuacucuauguguauugcccuuuaccucaguuucccccgguuucuccuucuccuguaaaaacagcagaggaaagaacauauaacucuaaggcagugcucaaaugcuuuggaaguccagaaaauuccuucaacugaguugucuuuugguuuuaaaaaaccuuacugcagaagguaagucuaguauagaaggagagcauguagucacuagcagcacuguccugggacagacauggguaaaaugccaguuccaucacuuccuggcugggagcccuugaggauguucacauauuucuguugcuguagaauaaauuauuaaugguugcauugcagugcuguugugaggaauagggauaaugaagguaaacucccaacacggggucuggaacugcuggguccucaauaggcaguggcuguggaugaagacccuuucugcagucgaaaagggaaggccccgccuccaggucauugcacaaggccuggaaucagcacguucuucuucuucuuuuuuuuuuuuuuuuuuuuuuugagacagagucucacucuuuugggcaggcuggaaugcaguggcgugaucucagcucacugcaacuuccgccucccagauucaagcgauucuccugccucagccuccugaguggcugggaucacaggcacuugccaccaugcccggcuaauuuuuguauuuuuaguagagaugggguuucaccauguuggccaggcuggucucaaucuccugaccucagguaaucugcccaccuuaaccucccaaaaugcugggauuacaggcgugagacaccgcaccuggccagcauauucuucuuauacacugaauuccaucuguccuguucuuaauugucucagcuuuagacucuggggauauucaggaguucccucuagaagagaagccuuaucauuuugguuuuguuuuggggguggggggguguuuuuuuuuuuuugagaaauacaauauucauccagaaaagggcacaacacauacauguacuguccaacaaauaauugcaaugugaacaucauguuaccacuacucagggcaaaaaauagaacaccgguaauauucccaaagcuuucuugggcuccucccaagaaacaacccucucccucuucccucaccuccaccucguaguaacacacucaugucguggagaaccucaucauuccuuuccuuuauuguuuggcaucuaaguauauguauccagacaacccagcuguuuugccuguuuucauuuuucauacaaauagaaucauccaauacauaucucucuguaucugacccucuuugcucaaugucaucuuuuuaagagucauccaaauuguggauaguuccaguguguuccuuugugauaccccaucauccagguauccagaaguuaucgauucuacuguuaagagggguuuggguuauuucccguguuugacuguuacaaaugauggugcuauggacauuuuuguacaagucuuuugagaaugcugauguguuggguauauaccucagaaaggaauuagagguucauaggccugguaucucuagcuuuacuagauaaugccaaauuauuuuccaaaguuugcugacuugucuuuucauuaacuuaugcuguaaggaaacaacucugccagucuggucuagggaggccccaguuuccucaccuauaaaaucugagaaauaagucauaucccaagguuuuauaaagauggagugaaaugacguuuaugugcuuagcauauaucuagcacagaauagguucuuaauaacagcuaacacuuauugagcacucuauaaauguaggccaugcuucuggcccccucauuuccccuuucagugcauauauccuggaauuucagccugaaauuauaugaggacguuaccacuugcgcuguuugucuuucucucucucuuuuucucucucacucacucucucuuuuagauuuaggaucuccuguuuugcuuuccuuuucuuuucuuuuuuuuuuuuuuuuuuuuuuuuagacaaagucuuucucugucacucaggcuggagugcaguggcacaaucucagcucacugcaaacuccgcuucccugguucaagcaauucuccugucucaaccucccgaguagcugggauuacagguacccgucaccauggcuggcuaauuuuuguauuuguauuagagacaggguuucaccauguuggccaggcuggucucgaacuccugaccucaggugaucugcccaccucagccucccaaagugcugggauuacgagcgugagccacugcacccggccaauuguuuucuuuuucuaucuuccuuucuuuuucuauaaaguguuauaugcuagguacuuuucacgugacaucucauuuaaccuuuucaaaaugccacaauguugguuccauuauuaucccugcuuuucaggugaagaaacuaaggcacagagaaggaaagugacagucugaggucccccaguuaaguagguaguggagccagggaugauaugcucacuuuucccucuagggagggcacccagccaggacucuacaugaaaaaauguauuuugaugcuggcuaaugcccuauugacaacugcacacugauccacguccuaguucaaguuuuguuacuguaaucugggcucugacaacauaugaaguuucuuccuucaguaugagaagaaagauagggagacugagaaacuuugucaagucagucagucaaucaaacaugcaauggcugcagggcuucugcuaccucucagaggcuuccacgugcaggauggcaacuugggagauaaggugugccugcauucagucagcucagaagauucaguccaguaggagagcaccauggccauaaacaguuggcauguacagagcuggguuucugugcucagugacaaagauaaagggcugugaaguuuagagccauucuuccuggagaaaucaaggaaggcuuucugaaggagguaaccucuaaauccuuacuuccuuagcuaccuucugcuguuagagggugagcccaccauuaaagaagcauuuucccccacacacagccucuuugggcucugucuuccuucagccugaaggucucugguuguuuaagaaaacuccgggcaaaaauuucaccccuugcccugagucuuuuccccaccuucccuuucucccaccucuacagcuagucugcuguggauacaggcuugugaaagaaaugacuguuuguuuuauaacaagagcuuaacaugauucauuucagauuccccaaggacuuuuguaaguuuggacugagucauaauauauuuuuuuauuaaacuccaagacccaacaagcaggaagcucuguucgacaacauaauauaacugauguacugcaagcggcuuuuuuaugggugaguccucaagcugcuugagaaauucucuggccucuccuaucaccaccugguucugcacggagauuaaaagggcuuuggagacucgucacaccacacagacacacacacacacacacacauagacacauacagcccugucccuccuaaugccacauccaaaagaugagggucucuggacaagaacaaucccacuuccagacccucucaagaacaaggcccuaacuccuucuucagaacacagaaaggccuaagcagcagcacuggagcaggccgagaacugcucccugcucacccccgguggagccacagucuaguagggcaaugauucuuggaacauuuuccccgagccaggagcauuagccucaccugggacuuuuauaaaaugcaaguucucaggcccauccaacaccuucugagucacaaacucugggggugggacccagcaacuuguguucuaaggggcucuccagggcgauucuguugcuugcuaagguuuaagaaccacugaucguaggacuugcucaaagggcgguccugggaccgggagcaucagcaucacgggagcuuguuggaaaugcacucucaggcuccacccaaggccugcuggaucacagucugcauuuuaacaagacucccaguugaaucucguccacauuaacuuugaggaacacugcuguaggcaccgcgggacaugggccaccucugguccugaguugaguccuugcucugccucucaguugccgccugcucuuggcuggcacaugacuuaucugagccucagcgucuugguuagcgcccugcauuagugcauuggaaauauuugcucuccugguuuaggaaaaugccucccacagucccggcuccacgggaggcucucggcacuguucuuccugccugucccuggugagcgggugaccuucugcccccucugacacuggcccacccuggagacaguggcuguguucuugcagcccucccuccucuuguguuucuguuugauucucaugauucaauauccccugcagcguuuuguugucauuuucuguuuuacucuuggaaagcucacaggguuuccccuuugaaguguuucauuuuuuguuuguuuguuuaaauucagcauugcccucugauuggggcacauccagugacuuuauagcacaaauucagaaagagaguugcuccagugccauucaaaauggaccgcaaaauccacugugccgagauguguccgaguacaacgacaagacagcccaugcacaccguggugccucacaaaaggagaaaacacaauaccuggagucugauaaaugacugaaaagugcuaaaaaugacccccgaaacacagacaccuccuccccuguucccugccuccuaccgugucaugaauuugugauggggacaaggagcacacaaggccccccucagugccccgaugaaagucacugaagccaggaacaaaaguggagccccagacaaggggaggggagcagaaagggggauggaaauccacugacccuuccuggagcucccaaggggcacuagaggaaugaaaacccuuccuagcccccaggccccgaacaaguggcaaucucccuccccaggguacagaguuuaaaaaugcaucagaucaaggccugcauggagggauaccucacacacuguggaaggggcagauuugggaacuaaaguuuggcaauaagacucaagagccucaaaaaagucuacaugccuugacccaguaauucugcuucugggaaucuguccuaagaaaauaauaugaaaugcagacaaaaaugaauccacacggguguucacuauagcuuuauuuaugugagugaaaaauuggaaaccacuaaaugcuccacuuuagggaauugguuagguaaauuaugguucauucauagaguggaauauuuuguagccguuaaaaaugauguuuauagagcuuuuaaugacauggggaaaugcuuaugguaugcuuauggugauuuuauacccugucuuuugcaagauguaaaaucacacacggugugaucucagccauguaaaacaguuacagaaaaauaacaggaaggaaaaacacacacacaaacuguuaacgguaguugucucugagugguaggauugcggaugauuuuucuucuuuucuuuccaccuuucugguuuuuuauuuuuauuuuuuucuauauuuggaaacuauuggucaucgguguuggguauuuauuuaagccucacaggcaaugaaggaaaaaaacaucaccauuagucugaggccuggcgagggauaugacagcuguuuuucccuccugaacaugcauugcuuuugaaaucagagaaaaaauuaaauaaacguuauuuaccaaauuaaaaucaaaucaaaauaaauaaagcaucugagccccugucgaggaaggccucugcuccuaaaagaagcgaucgccugcuuccagcuuaucauuuuucagggaucuuaaaaaaccagccacugugaaauugacuucuaacugaucuuaauugagauggggcccaaaugcaaggaucagaaaugaaauucgggcugguugccuuauggcugggcugccaaagagacucugcacaaucccaggucacagaggagcuaacuggaguuacuucucuguuccggauuccaccugccaccuuccauauaagacuccaggguccugccgcccccuugcuaguuuuuuaccagcucagggaugaguggggguugauuugagacuaucugggcuugaggggauucuuaaggcugguggcugagcauucacuccuuaacccuaccaaccuccgccccccaccauacacaugcacacacacacacacgcucacaugugaacacaucaucauugauucugucccucugcacaaaugcaugcugcguguagugacaggcuacaaugagugggcaccaugcuaagucucuaaagugcuuuaccuuguuuaauucccaugacgacucugugauuuaaguacuaucaagccucacuuuagaguguggcagacucaaacauucuuccuucugcuggcaugugcagcuccuaugauuuugggagugagccugauggucucaucgggguccccuccaacuucagagugacgaauucucuuaauguuaaaagccagccaugcaggccccaacacacaggcuacaggaugcugaggcccucccacucucuccaagucacacugccagcccgucccugcuugccaccuugcugccuggcccuccuucccugucuuccuccuuuuagguuucucccucccacacacaaaaccccucuuccagcagucuacugucagauucauucauugcuuucuuagauagaacaacauaacucuucuuugucuaaacccaggaggccuucccuuucauauccaaacaaacucaucaugguauuuuuccuugaaaaaaaaaagagugcuuuaucaaagauacauucugccuucuuuucaagccacucagcaucacuggggccagcauuuuaaaacuacuuugugugugugcuucuuauugcucuguaugcugcaaaauaaauacagcgcuggaagacuucuaauauuaaaaugaagagaauauaugaaaaaagaaauaaagcaacugaugugauuuaaaauugcaccaauacaaggugcugugguacucuaauacaucugaaaaucucugcaagauaggugauuuuccgggaaaaugaaaauuagucaaacugacucccaaaaaaguagaaaaacuugaaagaaaaaaaauuauaugcaaagggcccguugagaaagguuuuaauggaaucauuuauuuuuaaaagaccccaggcuaagaugauucaaugcugaaacuuuccagguagcaaaaaacauaagauucccaugcuugcauagcagacaagcguuggggucagauggccggacugaaauccugcuuuaccauuuaccaguaaaugguuacuaguaaccugguuacuaaaugguaaaccaguuuaccauuuauuaguugugugaccuuggaugaguuacuuaauuucucugaauuucaaaucccauagaaauucagccaaggaaguagucacaauaagacagcauaguccaggugggcuuucuggaggagguggccuaugauggauuugauuuauuggcaguggcuaccaguagccuuuccacauuauugcucagaccuguuaaaaucaagggauggacuuauaaacuuauaaguuuauaaguuauaacauugcccagccaauguuaggguagaguccaugucauggaagugcugagaauccacaagucccauuguugcuucuugacuuaggcacagcagcauuaaauucuaugggcagcagucauucaguccucauaaugacccugugagguaggugcuguuaucacccuccugagggacaaggaaacuaagcuaaagccagucacagagagugccucacccagggucacacagcuauuaaauagcaaagccaggaucgaaacucaggcagccuggcucuagagcacuuuaccaccauaguuuucugugacgaguaccuugcguuuggaaaggcuuugauaaucagcaguauaaugucacauaugucugcucauuugauugcugcaacaaucgguuguucuuaccuuuugaaggaggaaacaggccuggagaguucugaagugacuuacccaaagucacguggucccuuagcucugcgcguggucuuuccuaucuuuuauaccugagugcccaagccucaguuuucucauuccugggaugggguaaugauguuuagcccacaggucuaggaugagaacaaaacauguagaacacuccgcagagugccccaggaauaguaggugcugaaugaaugucaaugauuagugauuauuaguagcaaacgacuguuaguuucuuuuguucuucuugagcacagggacacaugucuuguauuucucugugaugcaccaucccuaucaaugcaccaucaucccagaguuaaugaaugauggugcacuggacagagcaugggcccuugaguucaugcauccaggucucugccaucuccuaaguuggucccacacucugcaauuaaccuuccugaaccucaguucaucucaucuauaaaaugaggguaacaccugccucacaagauacuugggaagauuaaaugagccaagguauuuuggaagugucugacucagaauauacagcagcaaauaugacucccuuuuccuucugguuguauuuuucguggaugagagacauauuuuugauaaaaagcauauugcuuccugucguguuucuucaguaggacuuuucaagacugguuugaugagaaaguguuaacugagcauaucugaugagcacaaggcucuguggaggugcagaggaaacauaaaauguggccccaccuagagggcccugugauguuucaccugugacuugauggcaucauguccuucugcaaccagagcugucucugcagacagagcucaacugagagcaccuaauucuuuuugcguguuuguuuguuuguuuguuugagacagagucuugcucuguuacugaggcuggaguggaauggcacaauuuuggcucacugcaaccccugccuuccagguuuaagcgauucucaugccucagccuccugaauaccugggauuacaggcaugugccaccacaccuaacuaauuuuuguauuuuuaggagaaacgggguuucaccacgaucgccaagcuggucuugaacuccugaccuauggugauccacccaccucagcgucacaaaguguuagauuacaggugugagccacugugccuggccugcaccuaauucuugaguccuguauuagucuggguucuucagaaaaacagaaccaacaggagagagagagagagagagaaagagauuuauuaugaagguuuggcaauuaugagggcuuggaagacccaugaucugccaccuuccaggaggcccaggaaagccagugguguaguucuggcccaaacccuaaggccugagaaccaggggagccaguguaauaugucccaguuugagucaaaaggcucgagaaccaggaguucucauguccaaaggcaggaggagauggaucucccagcacaagcacagagcaaauucacccucccucugccuuuuuguucuauucagguccucaagggaucggagugcugcccacacacauuguugaggggggucuccaaucucucccagaaacacccucacagacacaaccagaaauaauguuuaaccagauaucugggcauuccucagcccugucaacuugacacaugaaauuaacccucacaggucccaucccccugaguccccaaguccaggacagcuggacaagucaaggaagggcuuccuuacagguaaauagagaaauacaauucagacagcacucccaaaccgugagugcauauuaaucugcggggacaaauaucauaacauaauuaguacagcagugcucccagcuuaauugaaaaugcugcauaugaggggcaguuaaugagaaaugcaagaugugaugauucagaacugcugagauuuagcagcucgguggcuguagcgaggaaguguugggcuuuuuucccuuugcuauucucuuuguacaucuggacaggaagggggcugaaaggaguuacuaacaguguguaugguuagagaacuuugauuaucuggaagucccucagcuauuuggaaugcagcagagagcuagccaagcaggaaacgaaaaagagccucugagccgacaaaacacauuucuauuuggccgugcacugcagucuucagauuuuugugauacgaaauccucucaacccacacucacaacugauuuguuugugcuuacuuuauuuuuuuauuuuuuugagacggagucucgcucuguugcccaggcuggagugcagugguacgaacuuggcucacugcaaccuccaccucccagguucaagugauucuccugccucagccucccaaguagcugggauuauaggugccugccaccacacccagcuaauguuuguauuuuuaguauagacaggguuuuaccauguuggccaggcuggugucaaacuccugaacucaggugauccgccugccucggccucccaaugugcugggauuauaggcaugagccaccaugccaggcccuauguuuacuuuauaccagaguuuaauaagccaggugaucugauuucccaggcauuagcagaacuguagcagggcaucagggcagugguggguggggccuccggaggagcuugucucuccacccugucuuaguccagucauccaguuaauacaggucuuuaaggcgcaauguauguuuggggcauaggggagauaaagacauaaaaaaaucucuucucuuuaaggagcuuacaguuuugggacagacggguguuggcucagucaauguucuuaguuucagacaacagaaucuauucugucuaguuuaaacagaaaaggauuuaauacaggauauuagauggccugcaaaccuuucaggaaugccagggacucaagcuuggcugccagagaaccagagaaguaccuggcauggcauagggcuccuuuaacggaauccccuuugucucacuccuugggacucaacauuccgggaaccagacagcagagccuacgccacagcuguccagauaaacaaacaccuccaccacugugugggugggaagauccagugcacccgagcauagucaccaccuccuguaacaacauccgcccucuacaauccugugggugcauuugcuccauagaacuugggucucgccgcaagggagucaguauauuguuuccagcugucuaggcucguggaaaagaaagcacacuggaaggagguugaaguggguguugagaaagccuguauuugguaucugcugcagauguggccagauaaugagaguccagugagccaaguccugcuguacaguuguguucugaggguucgcucaccauccgacacaagcacaacaaagcgagcacaaagugauacuggagugcugacagucagggagaagaucacagcgcgagaaagagagagcgcagaaacuucaaaagcaugaaaugaugcuggggccauuucauuuaggagcaaauaacccugcagaagguagucacaaagggcaucagcguaauagagcagaguaaaaagaauagcugugcgugauccuuagccaucaaggaaaguuuagauugcauucaggagacuucgacuagaaggcaggaaugucucaaacaggcauccgaaggauuuccacaaauaacgaggugcauuuucccuuuacaauuugugcuacaggacugagacguggaaaucuggggacucauguacucuguguuauuauugauuauauaccuuuuuuccauacgguaucagguaauggagguuucauggcagcaucagaggccucucacuccccaaaugaguaccauauaggccagggaccgugaacccugaguauccuuccuacaggaaucaagucucccgaaaacagaaaugcagacacuuuuggaagaggagcgcauuguuuacagggcagcagcggcuuucuccuaugcauuguaugaaugcacagaaggaagagcuugaaccucaggcaucagggcacgaaagaauccaucuaaacaagcaaaacaaguucagcuaaaaaaaaaaguccucauucuuaccagaguucagauaaaucuaggaaagcucaaagaaaggagggcaagggggccuggagaagggaguguucauuaugaggaaaagagucguuuccauagagccacagaccagugaucaguuuuugaaccugaagagcucaaaauacauuuaugcacuuguauaacuauuuauagucauacguugauguauuuauagcuauguggaggcugacacuaaggccuguuuucuuguccccugguccagcuuuuaguucccauuucucugccuucccaaaccuuccugucuugaguuccauuugaucaaucauuaacaacagucuugccaacaaugcuaacgauuaucauuaguguuauuacagagguccuagggucccuaucuugagcaccuccccugugucaggccgcaugacuagggaagagagcagcaggagcuucauccgucccaggucucaacccugcaucucucacuuuguacucuacaggggggccacccugucucucagaauuugacuggaaugcuugucagggagacuucauuuuuuuuuggagacggagucucaccuugucacccaggcuggagugcaguggcgcgauaucuuggcucacugcaaccucugccucccagguucaagcgauucuccugccucagccucccgaguagcugggauuacaggcacacaccaccacgccuggcuaauuuuuuguauuuuuaguagagacgggguuucaccguguuagccaggauggucucuaucuccugaccucaugauccacccgccucagccucccaaagugcugggauugcaggcaugagucaccgcgccuggccagucagggagacuucugaugggauuuuuagucuucccucuugguauuuuaacaaggcccuguggcuucacugagcccaaugccagauauuugguuucuggaaaguucaaugcuucaguagauauuuucuucuuaccuugccagaccccgcaagccaggugccccgcauccagggaaaaggcucacugcgggccccacuccaaggacacaggcaacguauucauggguacacuguuucuuuuccuaagggaagcacuagcgcugggaaauaaacccaccuccauucccacguagcaauuaugugcacaauuacaguuccagcaggugucacuuaaaaggaugagacccauuaaguguuuaaaugagaaagcagaaaggagccucugagaacucccaggaaagccacucugcagagguggaagaagggagcacaugggaccuucccugagcauuuccuugcccucacccuccacccaccaugcuuucccauaagugaucucaucccagccugagggcagcccuugguacagagguuaacaggccuuugugagcuaauggagaaauugagcucagccccaugcagugaauugcccgaggccucuuagccaguaagaacugacauaagaugcacaugccuauacagggaaugcaugccaauaucauucaucauuucagguccauagagggccaaaccuucccuucgcuuuuucuauagcuuucagggugcccagcacauaucaaauacccaauaaguacuugacaggcuucuuuauagcaauuuucuccccauuguucaaaugaugaaugaagcauucagaggaaaagaaggucaaagggaagaaagugccaggcauaugcaagcuuauuucaauuaacauuuacaguacaaaguggguuuuauugcuuuuacagauagggaaacaagucucagagaaaugaagggacuugcccaagucuacuuggcuguugaguagcaaacgccauauuugaacccaggucugccugaguccaaacucugugcucuuugcacuacauugaacaaccuccguugggauccaucacacugcagagguaacugcaugcuuccccucacacagccaugugggaggugaguucagggaugucacccuucaguacaaccuauugaaagggccucuuccuuuucgcucauuggaaggauccagaccauggcuaagccagaagagccuucuauuugcuggaaucauguaaacucuauuucugagccaucuuaaccaagguuugcccacugaaaguucacaaagggccaccuggaggugggguaggaauacauaccagggcucuacuggcccacaggccugcuucuaccccaacuggcgaucuccucuccccauucacagccccccgccuugccccaccaauaugaaguacuaacaccuggguccgugucucccugucuugccuaagugccucacauucugcuccaucuggaaaccaggggucagccucaggcacagcucucucacccuuucugugccaucacuuaccagguuuuauuaaguucaucuaccauccucacucaaguccccuccuccuucccgucccccugccucuuccacaaucuagaccuuugcagcagccuccucccuggucuucauagcucccuuucugcccccaucuucuguauaauuauagaugagcuuugucaaacauguacuuuaaccauccaaccagccacccaaccuuccaucuguccaauacauguuuacugaauauaugcauauuugcuaugugucagaguucaugcuagacuugggaugcagagcuagauaagaaauagaccagucuguagugguggagagagauauguuaguaaauaacauuguuugggaagggaaacccaaggcauggcgucugacucagucuggcagccucagcggaggcuucuagaggggcuggcauggggucagggcaacugugcauauacaaaggcuugacccugcauugcccauguggggagcuaaaaaugcccaacaagccuagagggaagggugguuccuggcaaggcagagaccaaaccaugaagugcuuugugcugugaaucuggaauuucaccuguuggcaaugguacaccccggacaguuuuaaccaagggagugccaugggcagggagcucuaaaccacuccacucuccugaccucacuuggguguccuggugagcuuuugcccagguuccaaccuccaaccagaucacugauucaccuccuuuucuggcugacugaggaucuauccaaacagcaauuuuauucucccagacacugcucacccacaagaguucggaaucacccuuggagaaauuccuuuauauucucccuguguucuggacacaaugugucuugaauauuagcacaauucacuggacuggugccuguugaguguguggauggcgaauuguuuugggaugcacucagcagcuccugccucaccacaucugcccaucauccuggagugccugguaggagcagauaauaaaugggccagcugccaccuccugcuuuucuaaucaucugucaaagaaauggaaaacucacucgcagucacugcugaaugcagauggggucagugcauguuggguucagaaguaaggaaaaggaggggcacaggcuggggcugcccgugcaggguuucugcgccugaagacucugccccagcaugcucucuuggccuuaaccugcccuuucuucaugcguccugcuagccucuguacuaucugaaacaguccucaccagcuucacuucagggccccuuacacauuacugacuccacagaaagcaugacccagaacccugaagaacuggguuggaacccuuggcucuaugaccuuggaccaguaacuuccccucuuggaguagugggguuuuauuuauuuuuuuguuuguuuuguuuuguuuuguuugcuuuuucuuuuuucuuuuccagacagucucacccugucccucagacuggagugcagugguaugaucuugucucacugcaaucuccaccuccuggguucaagcaauucuccugccucagcuucccaaguagcuggaauuaaaagcaugugcuaccacgccuggcuaauuuuucuauuuuuaguagagacgggguuucaccauguuggccaggcuggucuugaacuccugaccucaagugaucucccugccucagccucccaaagugcugggauuaugaggcaugagccaucacgccuggcccccucuuggaguauucauuuucacauucaguugcacucaggacuaauguucccugccuaacuuaggcuucagagcugggugaaucaaaugaguaagcaggugaagaagauuuauaauugucacaaauugccacaacugcucugaggguggguaucaugaucuguauuugacagauaaggacaucagaagcgcagagauguugaauaacuuggcugaggucacgcagccagaaaguagaugcccuggauguaagcccccugaugcuaaggaucaugucugauuauuuuauccagaaugccugaagucauggcugguacaugauaggugauaaguaaauacucuucaaugacugccuucaaugcacacugaccuuuccccaucaucucagcccuuuaaauuaaaaaaaaaaaaauuacuaauuuagguguaaugguauuuuauuuuugcucuaauuuguauuucuuugauuacuagagaaacugaacauuauuuccaugugugcauucacuuaacauauuucuugaauaacccagccaugucuguuugcaauuuauuugcugugguccugaauuuuuuucccucaucaauuugcaccaaauauuuaucaaaugaauauuaacccucuucuaucuuccaugcuacaaauauuuugccaguuccaugucccuuuuacuuuauuuucuuucuuuuauguuaugcagaauuauaaaauaaaauuaacuuucauuuuuguuaaguuauagaaucagcaugcagaauccccagccaagguuggaaguggguuuccccagguaacacauaccuuuuccccaaccccagugaguccggugggcugacagaaacauccaagguggaugugcagcccucagccuaagggcucuuguuaggcagccagaagacaaagcuauuguaccauaaacaugugguuggcuuauauguguguauuacacacuugauuuugaucuuaguccaaaggcccaguaacuugccuuuaaaacucuaccugguagcucucaucucccugcccacugccugucuccauugucauuggccaaaugucacagggcucagaaaacaugaggccugggauacuugcugcugaugacaguaaaaaaugccuuagaucacacuugacuuuuauaaagugauuugcuauuuguuuuucaguagguccucacaguaagccucuaauagcauuguaaguauuaauguuauuuccauuaucgggugaaggaacuaaggcucagagagguuguccaugguucccaagcuagccacaggcagaggcuggaccccacuccuuggguuucagagcugcugcuguuucugccuuaucaaauuaguuauuggggacgguucuuggagauggcccugaccacccaauaauagagcaggggcaguguucaagaucggaagucuagucuagaaagacaggggccuugccacugcuucgaagcucuuagauucuaaacuucuggagaagaccuugcauaauacaccguaugucucuuccagccacauggagauacuccuccagagaguguggggugauguccugaaagaaggaacaguggcuaaggaugaccagcguguccugaaauggucuucaagguguggcuaaaaugccagcuucuuugucaagccuuccuucauuaaacaggaucuauaucugguccuuccucgagaaguucauagucuaccugaagaaacagauacaugcccaaauaacuguaaaggauguagaaccagccugggaaacauagcaagacgcagucucuacuacaaaaaaaaaaaaaaaaaaaguuagccaaacauggugauaugcagcuguaguugcagcaacuugggaggcuaaggcaggaggaucacuugagcccaggaguuccaggcugcagugagcugugaucacaccacuacacuccagccuggauuaaagagcaaguacuuugucuguuaaaaaaaaaaguguaggaaaugcuccagcaguaucacucauucauucagcaaauauuaauaauugagugccugcugugugucaagcacuguccuuucaauguagcaauaaacaaaacagaccaaugucaugaggcuucuauucuggcagaggagacaaacaauaaacaaguuaaugaacauacaauguccaaugcugaagggugcuagggugguaagcagggugguuaagaauggacaggaaugugcaguguuggcacagagaagacaggguucaauuacauuuggagugguggaucaaagaaggcucccaagaggaggauuuugugcuaggcucugacuucugaggggaguuuuaaguuagccaaggggaagaauggcauuuuuggcagaagaaacagcaaaaguauagacaugaaacuaugaaaggauaugggcauguuuggaaaacugcaagcaaaucugguguggaagauagaaagaaaauucaggacuugaugcuggagaaguagguuguggauagacuaugagggcuuuuuggucuucugaagguggaagcuagcagagacugcguagaugcugccaggauggcagaaccugucuaccaaggcugcucccugagcuuuuggccaggggcccaguaggaguacagucauggcuuuugcaaccaaaaaaugguuaaaaacauaagggacaguucaucccaauaguucacaaccccagucuuaucaugagaagaacauuagacaaauuccaauaguggggcauccuacaaaaaccuuuccaauacucacacuaacagucaaggccaucaaaaacaaagaacaucuaaaaaauugucauagccaagaggagccugaggacacaugaugacuaaauguaauguguccugcaugggauuccagagcagaagacauuagggaaaaacgaaagaaaucugaauaaaucauggacuucauuuaauaauaauguuucaauauugguucauucauuauaacaaaugaaccauacugaugaaagguguuaauauggggaaaacuagguguuagguauagcaggucugugcuaucguggcaauuuuucuauaaucucuaacugguuuaaaauuuuuauuaaaaaacaggagacuuuuuuaaaauuagaaaaaaaugaagugggggaacauauguaaccuccaaauuuucuuguuuuuuuuuucgucuccagaaaggacucuuuguuuuccaacuuggcuucuccccugacaaaugcguucagcuucaccaagguagaaauaagcacgugugucugcgugggugggcacgugaggucugagaagguggguggggauggcgagguggcaagcaagucugcacuggagucucggcauugguuuccucccuggaaccaagagagguuucccgggaggugaggcaugcggcaguucauuaacagcccugcuguucugcaccuggugguccuuucaguuccugugggcgacauuggucugggacacuugggucagucaauaaaaggccaccugugacaagggccugagcagaagcaaaaagcaaauguguccuggcucugggauuccagaguccccuguucugacagugggaagcugaccucugcugggaagcuggcccaccacccgaggggccugcuccauggagagcuugcaagucuuugucccuucauuucuagugggcuuuauuuugcccuugucucuuucucagucccggccugugucggucuguuuauagauacuuuuuuucacauccaaauucuuucucacugacaaaggaugcccugucucucagcagucacuaaaaugucuucucauuguauuccugaccccuucuucucucaauaaagaaugacuuuccccacccacuggguuuagaaggacaaugcuacccucuacaguugcagguagcuacacagacaugacuaaagaaagucacaucccauuaagaugucaguguuucaccaaucuacugacaggugucuuucuuggucugccucaguuucauuagacuccagcuuuccugcagugccucaaacacccuaaccugaccaagcuuucugaagugucacagccaggauccuuggcauucacugacuuacugauggccucucccacauuaguuuaucaaccaacagcaaaaaaagucccaugcaagcugacuggaccuacgggggaaagaagcaaaaaccugcuuuugugucccccauuucuccuucuagggcugccuccccagucucacaguggccccaccuaucacucuucccucuugggcuucagugcagcagucagugcuguaaggggcucuuuaucccagcccaagcacugagagucuuugcauauucacuguccuggaggcuacagagugacgcuccugccugcagagucuuucucagcacguuuaucagucagaguuuaggcaggaaaaaagaaaccccucucgaccuuuccauugagagaauuuaauguaaagaacuggucaaacaguugacaaaacagcuaagaagcuaaacaguacguauuucagcccagaaaucaccaaugacagcaaccaaugacagcaaccaaggcuggagggacaauaagaggaggugauaguuccagaucccagaagcugggauaauccagcaggagcuagaaucauuuuguagggugacugucaggaccugaagccacggggguuauguggccacugccagggauguugucgaagacaaaguaagaggugaagauacccuggcugcugucugcucaucuccaaucuucugucagggacuuucuuuagcccaaccuacccggaagccagucagcaagggaaccugagaaauguagcucccugcagagcacagcagagcaggccaguguggggaguggaucugggagcaaauagacaagugucuggcaaagcguccauucagccugcgcacucccacccacccgcuuuuguucaaagcugaguuggcccccaccuguucuagaaaacucuugcucuuuucuaauuucucugaucagccagcuggcagcuugauaaaaaccaucauguuuuauaaggucuccugaauagaauaaaugaggaaaaaucaagagccuguuuuacuuuggggagggggcgguaaagucuacaacacuguagucaucaaaucuugcucaggaguaucauugcugucccuaguccuucagagaagagcuaggaucuugccuuuuacagaucaucaagguauaaugauucuguucauucauacuaugguggcugucccagaggcucaaauguaccuugaacaaugaucuucugcucugcaagaccaaaccuauaagccauacccuguuauccagccacauucuucccgugagggccuguguucaaugguuauuccaggaggcugguaaauugcuucagggggccuucagcugaagucugagaugguuaaucaguuccagcuugcguucccucagaguaccccucucccccucugcuagcugggagcccuugcugcugauauagcagcucuggacagaggugaaugugggaaggaaaaguccaaggacggagcagaagaaacaaaggguuccuaaguuuguacagccaagaaaauaacauaaaacacgaugagggauuuggcugggcuuucuuguuuuguuuuggagcauuucaaggggccaggcaugcaguuguguuuggauugggaagaaaggcauaacugugcagaagaaaauccuuuucagguuuuauucugacuguuacuagauuaaagaaaacaccaggaggaucaaacugugugaauguaugaaggcuauugcagccagacaggagggaucuugucucugucuucuggggacauguuuggacagcauuuagaagcagugggccuguuuguccaucagcuaccggucuaguccauucaccaguacauggauccauucauauuacucauuuucguaacuuuaaggugaugaucgugaucauuauuaaauauuauaaaaauguucauuaggauucuuggcuugaagucacagaaccaucaucccuccaaaccaucauacucaaaacagaaaggacugagcacgguggcucacgccuguaauccuagcacuuugggagggaggccgagacagguggauugcuugagcucaggaguucgagaccagucugggcaauguggcaagaccucaucucuacuaaaacuacaaaaaaauagccagcauggugguguaugccucuggucuuuaguagagaccucaugucuacuaaaauuacaaaaaaaguagccagcauggugguacacaucagcuacucaggaggcugaggugggagacuugcuugagccucaggaggcagaggcugcaugcagugagcuaagaucauggcaccacacucuagucugggagucaugggagacccagucucaaaaaaaagcaggaggacauaauaccaucucaagaauccaagaagcagaugaacccuccagccagagaaaaggcagagaugcaggagaauuguaauuggaacucuaauucuguuuagauuuuuucugacccuuucugcugcuccagucugcuuuucuuaggcguguaagcuuccuucucucacugcagacgugcuuuccucacucuguggauuuccuagggcugacggaacaaagugcuacaaacugaguggcuuaaacacuggaaacguauugucucauaguucuggaagcuuaaagugugagaucaaggugucagcaggaccgugcuccucugaaggugccagggaagaaucuguccuggacuuuucuuucugcuguuucuuuggcuugggacagcgugaaucccaucuucaccuggcaucuucccuguguguauaucugucucuguguccuaauuuccccccucccccuuuuuuuuuuagacagagucuggcucuuguugcccaggcuggagugcaauggcacaaucuuugcucacugcauccucugccuucuagguucaagugauucuccugucucagccucccgaguagcugagauuacaggcaugcgccaccaugccggacuaauuuuuauauuuucaguagaggcaggguuuugccauguuggccaggcuggucuccaacuucagaccucagaugauccaccugccucggccucccaaaguguugggauuacaggcgugagccauccaccuggccaaguuuccccuuuuuauaaggacacuagucauauuagauuagggccugcccuaaugaccucauuuuaacuugauugccucuauaaagaccuuaucuccaaauaaggccccacucugcaguacuggggguuuggacuccagcauauuuucuuuuuugaggauacaauucaacccauaacacccacauggccaccaacugcucucaguuuuugcaucuuaccauuugcacuacuagauacuacauucuuccuucacuuacugauuucagaaaucccagggaagaauucuaauugguucaucuuugaucagguucuggucuccucaagggaagaaaccgggucuggaacgaugacuaacucggcguuguuaaggugcccagcccugaaccaaucaaugacagccagugaggcaggauuguuuaagaccaugacaaucgucaugggacccaugaaucugucagaucagucaguccaugcuggguacaaaucauccucuaaaucauagagaauugauagcaacaaggaguucauccugucuuacacuccacaucuucuaugggcaauagagauggugagaggagagggguuucugcuuauuguaguccccagggacccagacugacaagccaucccaacugugcugaaagagagcucuggagggucuuguauuggcaguuaaaucuaacaccugaaagugguacacuucugcucacaacucacaccacaguuagugacauggcccuaucaggguggacauucucacaguguaccuggaaaguagagagccagaaauaauugacgcacagcaccuaugacugucacaacccacguggugggagcagugggaaaaaggguucccaggagaggggagaugcuucaccagaauaugauggggugcugcccagggaaacuaguggauaagcacuacaggggcaucugaggccaaaggaagagccauggaagacagugggguguuaaaaacacugugguuuagcuggagcauacaaggucuggggugagaauggccagggacugggcuggaaagguggccaggcuggacagugaaaagaacugcuugcuauaggggagaguuuggauuucuucucccccagugacaauaggggagcaauaagggcuuugagccgggaacaggagggucagguuugcauuuuagaaauagcacugaccucugagcagaggcccagaggucugggacaacuccagugguugagaacuagacuuaguguuaguccugcacuuuuaaaucccagaauuuuugaugaugugcuugaagggguuaaagguggacauugcuuaaauaaaagcaaguuucagaaaauugauaaaauucuccacagauagcauaaacuucaucaggcugcuuuuuagcacuuguggcuauuugagaacaguuuucuccccugccagugcuucuuguuaggccauuuuuacaggcaguucuugcauauccucuaaacacacgaucuuucucagaugagagccuguuauuuuuuuuuucuauauuuaauuuuauuuaaguucugggauacaugugcaggaugugcagguuuguuacacagguagacgugugccauggcggugugcugcaccugucaacccaucaccuaguuauuaauccccacaugcauuagcuauuuauccugaugcucucccuccccaaacccccugacaggccccaauguauguuguuucccucccugcguucauguguucucauuguucagcucccaaucuacccaucugacaaaggccuaauauccagaaccuacaaggaacuucaacaaauuuacaagaaaaaaacaacccuaucaaaaagugugcaaaggacaugaacagacacuucuagaagaagacauuuaugcagccagcaaauguauaaaaaaagcucaacaucacugaucauuagagaaaugcaaaucaaaaucccaaugagauaccaucucacaccagucagacggcaguuauuaaaaugucaagaacaacagauucuggcaaggcuguggagaaauaggaaugcuuuuacauuguuggugggaauguaacuugguucaaccauuguggaagacaguguggcaauucuucaaggaucuagaacaagaaacaccauuugacccaacaaacccauuacugaguauauacccaaaggaauauaaaucauucuauuauaaagauacaugcacacauauguuuauugcagcacuauucacaauagcaaagacacggaaccaacccaaaugcccaucaaugauagacuggaugaaaaaaaauguuguacauauacaccauggaauacuaugcagccauaaaaaaggaacgagauaauguccuuuucaggaacacggauggagcuggaagccauuauccucagcaaacuaacacaggaacagaaaaccaaacgcugcaugcucucacuuaaaagugggaacuguuaucuuuucucuuacacuggugcaucugccccaccuguuccccuugacccucucgcugacagaugucccugccauagcacagauccucagucauuucaaacauaagacugaacauaagguucagauuuucacagcacaccuaugccuaugaaggauucaugaguuugccuugaguuuuccauugugaacacugagaauguugaggaccacucguguguucacagacaaagaaccacaagaaagaacacggaguggaaaccaggccagaagaaggcaagcaggcuccucucagcuucccugcccuggcagaggcaaacacacacagccucaccagggcauguccagagcugguuggcuugacccacagaggacguguaaaaaaagaaaaaaaacaacaaaaccuuuucaagucuucaugaaugaggacucucaguucaaaauucauaggaagauuacauaaaaccaucugcugccuuuauuuccccuugugugcauuaaaaauaugcagcugcucaccgagaaacauuccauuacgcuguguggcucacgagcugcucuuugacguucaggacagagaggaggcaaggugggaggagaggcaggggugagcacgcacagggauuuccacugggcucugagugucuagaacagggcauuccagauuuuuccaccucacugacgugcucucugaaggagaugcucuucuguguaugcagugaaguuucucggugaguuuguguguggguguggauguuuuuuuuucccccuuuuuaaugugaaaauuggucuuugaguccacaagcagcagcugcagcugccauaauuaaagugaaauaaccugcuucauccaguccuuagaaaggcuuaaaaaaaauccauauucuaaauggacucaggaaugugguggaucuucucucccuguuuauuugcaacaaguuuuauuucuuuacuuuucucaggagucaggagaaggguauuaaccuuuacugagcauuuauccugaucccaggcacuaugcuggcuugucccaacugcacagccaggauuugaauccaauuuugaugcuucguuucuucccccgcugccaugccccuucaggaugccuuugaacucuggaucucuccaccuggucugauucuguccagaggccugggaggauuggcauuauuaagauguuauugaaaaugcuggcacauauaaucggcuuggauuagaaaccaaagcucuucgcagaguaacaaggugaaguauuuugugcuaauaauuuacgugauaaugagaugguuuucagaagauuggaugugcuccuaaagguguugcuuaaagucacucuucaaaccaggcugggagcauaaaaaucccagaagaacuacagacucuguaguuuguacagaucucaaaauaagguagcugagguagaaagaacuaugugcugagaauugaagacauaguggucacugucuucaaggagcucccagucugguggaaaagaaaguuguaaagaugaauaauuauaagacacuggacauaagagcuagcugaaggacaggaauagcuugcuguaguuucagcauuuuuucucuaaagauucauuccuucaauugguaaauuugugaggaggaaagcuaccucccugagaaagcaaugcccaugauguugaacauuuaagacuagaagaaauuauucuacauuauuauguauauacuaagggucagguacuuauucucucuaguccauuauuuuuauuccuauuuaauaauaaagaaauguaaaaagcuaagugguuuggccaacgcugcacagcuggugacugggugaguugugauucagccccacucugcuuccaaagcuccaccucuugccacugugccaggcuuccccucagcaaacuggaacccuugauugucaaguacagaacacaccuaucacugugucccauguuuagaaugaggauaucuuuuuauuuuccuuaaacaaaguuuuaauagcaggcgucuugauggaaggucaucuccuccaggcugcaggugcgaugauacaguucugagugcauuaggagcccucugggcugccuucccuaaacagggggucagcccagggcacaggaacgcugaguuucucacugacauucuucagggacccagcagguuccuggguauccagaagauuuucucccggguuucuguauccacugcuccggguaccacggcuuagccgagaagggaaagacaaaaacuaacacuccuugccagagaggagggugguuuccugcuaccuuugcaguucucugcagucaguguuguuguuuuggaaccugacuuaacucaaggcaucaucuuaucuccuugaucuguggucaguuugggggaaauccaacagaagcagaggcacucugcauuuaauuccaccugggccuuccugaaaggcagcccaggaaaugaucaagcuccacauaccgguggacagccaggagaugcacugggagaagaaagacgguugugucagguacauggugucaugcacaggguuacagcuugcuuuaugacuugccuagagaggaaaagaacaggguuuggaucuugucucccuugcuuccucacuaggggauuuggagcaagcagcuuagauuccccagagucuccuuucuucaccugcaagucuggaaggauaaugcuugccuccugcaguuauuuagaaggcuaaauaacaucaaagcaccuaauagccugcccaaugccuggcacacaauuaggagcucccugcccccaggcaacuccacuuccaauucauauugugcaaggcuugccacauucaucuuccuagagcagaucuccaauuaugucacaucucugcucugcucaacagcacucagaggcucccuauuacucacugaacaaugaccacauuccccagccuguugaggcccacaucucuuguugggugugauguccuccacuucccucugcacagcuuacacaugcuggaaagcugagcucgacacuugcucuuugucaugcuuuuaccucccaugccucuccucccuuauguggaguaccugcccugucuccauguccccuaccuuauacaaagucugcugcaaggcagucuuccaugauuugucagccauggcgaucucuccauccucuguccacacauuagguucugucugcaucucucuuacaaaacugccaaacauuauaguucuccguggcuaugucuuguuuuucuugccagccuaugagcuucccaaaagcaggauuugcuucugaaucauuauuguauucuauccagcaacaauccucaguauaugaaugaaugagugaauaugugaaugaaugaauaaugccauaaucccuuccuaacucaauuuccccucaacggaaugcuagcauauaaauacuuuuaaaaacuuuccagcaacaaaugagcauuuuaguuucauuaacugucuuuguuuugucuacuggagguacucugggaaaaaaagggaauuuagggaugggauuugaaaaggaaauaaacagauugaaagauugaagacaaacaguugagguuuucccugaagccuuggcaaggaugagggcagaagaggaguaaaaacuguagcucugcagcuucuucaagaggggagggaccauaaggcacaggugagaagccaagucacaagcuuuggccugaagcugugaggggaagggagagaugauggaguuuuauaacccagacacaaaaaagggagccugagaaagaaauuugaguguuucauccaagcauaaaacguacauaucacuuacaugacuaggaccccagcaggacccuuggggacaaagcuaacagcucuguguccuaaaagccaccagacauuuggcauuuggggagagccccaacaccagagaaaguaccuuuucccuugcccauuuuuguagccaaggcagccaauuuccugcugucuuuggaacuuggggugggguugugugugucgggggugggugggcaggggguaaacuucuaaugaacaaggcaggguaauaaaaauuaaagauguaauagccauuauugccuauuugaaaugcauaaaaugauagucauauccuaauuaguguacugccuauuuuuaaucuuaaugaauauaaugauuuauaaggauuuuucuagguuuacucccaaacucuuguuaacuuuacuugugcccauuaauuuuccuacccuggccaggcaugguggcucacaccuguaaucccagcacuuugggaggcugaggcagguggaucaccugaagucaggaguccaagaccagccuggccaacauggcgaaaccccaucuaaauacaaaaauuagccagccgugguggugggcaccuguaaucccagcuacucaggaggcuguggcuggagaaucacuugaaccugggaggcggagguugcagugagcugagaucaugccacugcacuccagccugggccacaagagcaaaauccucaucucaaaaaaaaaaaaaauucuacccugaagguaguucaagagccagucucuggagaguaccaacaggauacucuguacuuggccagaggcugcugaauguuccugccuaauagaguuacucuuuauuuaaaauaauuugccauaaagaaacauaguaaauguagaugaagacaacaaaauuuuacuauuaaguggauuuuguuuuucaugggaauucccagcaauuccucaccuuauaauaaacagcaauguuuuuuaagcuaggauccuagaucuauuugggaaaaaugaauucagggaacuucucaaauaauggcuuuuuggggguuaaccuccuaugccuaaguguauccuucaugccuuauucuuuagccuaguaggucucuuguauaauaaggcauuuuguaguauuuuuuaugggugaguguggcaguauggggcaggaaaaguacagggaccuugagucuuugagggccuauauucaaauuccuauuccuucucuuggaaugaccugaggcaaaugaccuaaaaccuuagcaccucccccuuacccuucuuuugaguaggguagaauuucuuuucuucauuuggaaaaaccuuuauuuuguacggguaucuccuuugucccagaguccugaaaaucaaauuuauagucauaggauucuagggccagaaaggaccucacgugucccccaguucagaauuuccuucuuucagaugagggaacugaggcuuagaggggggaagucauuagccagagguugcaaucagcagcugggccagaaccaggacucuucugcguaaggaccucugcccaggugacuccaacccucccaugugguauauuacaggaagaucgacccauuccacagaucaagugccuuaguccauuuucugcuacuguaacagaaugccucagacuggguaguuuauaaagaaaagaaauuuauuuagcucacaguucuggaggcugagaaauccaagagcauggugcuggcaucugguaaaggccuccugcugcuucaucccaggggaaaaggcggaagggcaagugaacacaugugaaagagacaagcaugaggggccagccuugcuuuauaacaacccaugauugagauaacucacucacugcuaugagaaugcauuaauccauucaucaaggcagagccaucacaauccaggcaccuccauuaaucccuaccucccaacacuaccacauugaggaauuuagguuccaacacuuuugaggaacacacucagaccauagcagcaagagaguaagauuuagagaaggccagugacuuauuugucuggugaaucugugacagaacuguuaacgggggccacuggccacuaacccuagaccuuagccccauguugcauuccuugucuacucccaucacaguaugcagucaauccuuugugcaaauaacacgcaguuccuacuuugcuccaagcccugugcugggugcuuggguuguauaaagggcagaucuucagucccuguccugcaagcuucaguucacucaaggaaagguguguaaacaauuauuuuaaggcaagaccauuacucccauagcacaagaugagaugggagaacagaagaagguacauuugagccucucaggaaggcugcauagaggaaccaucugugugggauuugcagggugccaggaccccacuuucuucucuucauugcugugggaccaggaacaagccucauuuucccauaguguguguuugcaaugacugcuggagcggagggucugugagaaaggauuggggcaucuugccaccucacucaguuggaucuguguucucugcuucaacagaaaagaucccgcaccauccuccaggauccaauggccuuggagagagggcugcagggcccacggacauugcugacucuucagaacgugcugacauggagccaggucaguccccuugucugcucugauuuucugucauuagcugcaaauuuguggccuugaugagaaaugcaaucucagacucugaacauuugcauguuuuuugguuggaggcuuuuacgacuuggcagcauagaaaguagaggaguucuggccagaguaaagguagccuucuccgggaacagaugcaguaggacugguagguggcaacgguugcuggaaaccaagcuggcagccagcauggugggagggcaaggugggcaaggauggggcaucuagcagguaugugaugggggugcuggcagcaaggaggucacaugucggucuaggaccagagaggcagcaaugccaaucaaggucauucuuggguacaggagaccagggugcagggcccagagucugguggcuauguguugagcugaacuggagugagaucagaggcacaguggggaauaggauacggggaggugaguggaaggcuguccagaaggcagguggucuggaggccaggucuagugccuaagauggcucucuagaagcguuuccucauauugcugugcagaaaagcaaugaaaaaaacagcaggaaacuccuggauucuaugggaaaaguggaagauguuucaagcuagaggaggaacaugguacagagaggagugaaauuguaagugaaaacugguuacauugagggaggcugaggacacaggaaggauccagggaagagggaguauggccuuuauugaaagcccacugugaaccuacuagguaccaagcacuuuuucuuauccuuccagcaaucuuucaagauagaaauaugagucuuuuuaggcuuaguuaugcugcaguaauaaauuaacuccagaauccuaguggcuuaacauagcggaaguuuauuucuuucucaugcuacgcauccaucaaagguugguagaaagcuuugcucuaccuagugacuuagcgaccaggcugaugaaaucucucccauauuuuagggguacgaccuggaugauuggccccuuuggucucuguagcagaggaggaaaucacuggaagguugaacauugacucuuaaauguguugguccugaagugacacaccacccauuggccagaacuagcccugugguccugccugauuucugggauuccaggaggugugggaagacauggauauuuuaggagcaguaacuuccccugccacaguagauaugauuucuauuuuauaggaaaggaauugaggcuuagagaaauugucuugucaaaggucuuccaaauaaaaagugcuggagucuggaccuuacauaacuucugauuaaucauuuauuuaguuauucgacaaagacauauggaagauuuaccaugagugcagcacuauguuaagcucuggggauaucacaaggaauaaaaacaaagguaggcuuuucccucacccugacaaguauauaacuacaaacugagaucaaugcugugcaguagagacauagguucucugaggagcuccauuaauauuuuuugcuuuuuggccaggcuugauggcucaagccuguaaucccagcacuuugggaggccaaggcggguagaucacuugaggucaggaguucgagaccagccugaccaacaugguaaaaccccaucucuacuaaaaguaaaaaaaauauuagccaggcgugguggcagguaccuguagucccagcuacucgggaggcugaggcaggaaaaucacuugaacucuggaggcagaaguugcagugagccaaaauugugccacugcacuccagccugggugacagacagagacuccaccucaaaaaaaaaaaaaauuuauuuuuugcuuucuuuagaaggacagguaaaguggggucacauuuacugaggcacugugccaaguaguugaaugaugcaucucauuugacucccacaaccccauaagguauucuuaugaccccauuuuuuaagguaagaaaaccaaugcucacucagcauaguaagauaaaagcugaacucuucaaccucaccauacucacuuguaauagugacaugaaaguuaaaauuuaaaagucauugaaucuagaccuccaccccaucuaaaucugaaguguggucuccucuuccuccucuucaaccccucucucaccgggggcuuucucucccugguuccccaacgcccagcccaagagacuuggcugcucauccccacaugggggccuuccacguaguuggucccaucaaacucaucuaaauuggaggaggaaagacguuuugcaaaaauacuaggcugcaagaaucugagucuagcaggauggagcaguccucccaggccaguucuuucugggccccucuucugcuuaaaccuuucuccauagcaucugucucuaccugguguguauauuacuagacaaguuuaauugccuauuuucugucuucuucuauuagaacacaagcuccacaagggcagggaccuacuuuguuggccccugcaguguucuucugccaggaaagaugccuggcacauggcaggcacuuuguaaagauucaaaaugggagcauaagaacaaaucauugaacagguuccauauugugacuugcuuacaugcuacuauucaagccauccagccuccacauacacuguuccuuccuccuggaauguccccacugccuuucuccucccaccacuagcucacuuuucaugcacucacucugccugcccaggagggugaggucccuucaccacauggcacagacauuauccauucauccccaugagccuggggauuuccuggaggcaagaauagcuccucauugagcccucagugccugacacacagauaggacccaguuacugucuguugucucgagcccaguggaccagaacagcaucuggcauugcagcccagaggccccuuuccuccucugugaguucccgucucccucggucaggaggcggagacuuguugccaacuuagccuccuccugcuuaacggcugggagaucagggggaggagguaaaugggacacuaaugaaauucagagagaaaacuaaaucgggagguguugcaaacacuguggaggagggagacgugauuuaaaaggauguuuccaggguaggaggaggaaauggggacuguggagagcccuggaguuagcuucacacggccucaccucucacaccugcagugggaugaccccugugagucaccguagcugcaggcccuucacuuuucagucuucaaauuaggggucuuuuagcugacugacucauucauucagucaugccuucccacccccuuuccaaaaaggauuugaguagguuaacaauuuaaaauuaagcaauuaaguccaagaacauuuaauaaaaagcuuaggguagaaaguaggggacaaaaaagggaagaggagaagaaaaagagauucucaggaccacucagaaacagggguuccuggaaagggguugcaaaucagugucuugaggauggcacaggccuuggugacaagaaaaugggugcuaaagaccuuuaaggauggaacagcucuggucaugugguaaucaugauggcccgugccucagagcacuuucagauccaugguccauuuuuucaguuauaagcauugaccaucugcuacaugccagggaacccacaucauguuuuucucucucugucucauuaaaugucacaagaccuugcaagguggucuuuuaaaguucacauuagaguuauggcuaccaaggcacagagagacugagucgucuguuuaggaaacggugcuggggcacuaaauguccacaugcaaaaacauaaaguuggacucuuuccucacaccauauacaaaaauuaacucaaaauggaucccagucaugggcagaaauugcugccugaggaggcugcccaagaacacuaauauaccuuguccuccccugccuuccugccuucuucacagcaugcccuaaagcaccugugcucaaacucucucauuucagcauucuguuuuacucuucaacguuauugaagaccccaaaggguuuucauuuauguggauuauaucugucaaaauuugacauauuauuaauuaauacugaaagauguuaaaauugucauuuaucacuuauuuaaauuaacaauaauaaacccuuacuuuaacauaaauaacauauuuuuaugaauaaugacuuuuccaaaagaaacagaaaugaauggaguggcauuguuuuacauuuuggcaaaucccuucaacguuuggcuauauagagguaucugcuucugcauucaaccucgaaaacuccaccgugaguucauaagaaagccagaaugaaaagggaaaaugauguuguagcauuguuauaaauaguuuugaccucacagacuuccugaaagguuuuagggacccucagggaucccuggcgcacacuuugaaaacuguggguauaaaaggugagauacucccgaguccagcggggagugaggaggaagucaaccgugaaucuaguaaagagaagacgggaagugggaacagucucaguacagaggggacaggaguucuccuggaaugacgccucacugcuguagggagaccuuaggccuuugcacaugguauucucuuggccuagaaugcuuuucccaacuuagucuguuuagcagaaucuucuuggugcuuuaaggucaaguugguguaacugccuucagauugccuuucuuaccaucuuuccaaacccaaggcugaacugcacuccccaccucacccagaacccuggugggugagcauuuaagcagaagagugguugcaggugugguuccagguuggggucggugccuaccggggaaagguuuggaugccaggccaaggagguggggcuuuuugugauuguuguuuaaaaaguaagaagccauugaaaguauuuuuauaagcaacuucuugaugguguacaaauguauguauacagagggcuauggucaccaauaggcagauaaaagucauccacuacuaauucuaauucauuagcaaauaaaguaaugcccguuaucuagaagagagggggaaaugagaaaaaggaggaggaaagaaaccagcagcaaaaugagcacucacuaugugccaggcauucuuccugucaucaucgcagcaguuggcgguguuuuccccauuuucagauggauaagcagauuuuccuccccuccgggcuccccagguuaccuugcuaguaaaagccagagcugggauucaaacugcagacucccaucagccucuuucaaggcccaugaccgcuuuucccacgacuccacgcuugcuuggcacuguuugcuuggccuucaguguuuacugcuauguacugcugcucuuuuaaagauguguuucuguuguaucuuuccagacauauuuuucaguucuuggaaaauugaacagggacaccaauaugcuccuuugguccacccaauuggagucuaucaugacaguucccaugcacacagcagacaauccauaaucccugcuuucguguugcuugcuuuucauggaagacaugacgauuaagaugugaaccccauguugcuauuaaauacagguacuggugacagagauuauuacauggucaggcccuguucauccuggcuggcgaugagaacugggaagucaaaggaguuaggacagugcauuuuuucucagggucagacugaagaaauaauccuaaagaggacaccguacuuccuauguaaauauugaguaaagcagacaaaccuuaugaggcuaagaguauauugucccauauggugccaauuaugucuguuaaguaaggauaaauaaacauuuacugaacucuuacuauggcuugguaucuaugcuaggcauauuguauguuuuaucuucacuauaaaaaccuauauauuuuuggcucuaagagauagaaauguccccauuuccaguaaucaaacugcaaugcagagaaggacauauagcugauaccugguaaagcuggaguuugaagccaggccugccugucuuguccuuuggaaauaccauacuuuccccacacagggagaaaugcuaaggcugguucuagcagggugccaugcacugacuggugagguuggagcgguccuuagcagugcugcaguggccacugguaaccucaugccgguuucagcucuuucuuuccagaccaugucuaucuuccuaggcuucuucugcuucccugugauugcaccuccagucucuacucagagcacucaggaugcccgcggccuccccauaccaccauugucuuccagcacccaguguuagcuucauuacuauuccugguggacuaacugaacacaugaauaggcuuagggaagaagaaggagcagugaaccuaagaugaaauuuaaaaggugccacagauugugcugggaacccaggaguucccgauuugcuuaaaaaaggaauacugugagggaacgccuucuggcccagggcucccaugcuuugggaaggagcagcagacagccacagaagcuaaguguggaauucugcccuuucccaaggccggccggguugggguuagcagagugaacucagccacugcuguggauguugcugcucuuccaaaaccccuuugaugcaauccuucuuuaccuauccugcauccucggaguagggaagcugcacagugcugggugugcagucagaaugauugcagagccauuuacaagccaaaugcuaguuuauuuccaaaugggaaggucagugucauuauccuugguggauucaauuaccaaauccucccaaacauugggcucgcuuccuguugcuaauugcaccugcggcugcacaccucgguggucaguuuauccaaagccacugagguaguggcccgaggguuguuugcaaggcuguggaccucugucgcuguacugccuugacuuacccgcugagaaaugggucuuccaccucccauugccuuugugaaaauuccccugguagaaaggagcaaugagaagcacauaaaccuuugccucuuuggauucuggccauaguggaaaagccaaguaugcagaaaacacuccaggggugagaacagacauuuguugagcgccuauuagaugucagccaccgugcuaggcauuucacaguccauuuaacacucucaacuacccagugagguaagcguuguuauuucugauacacagauggggccacagagccucagagagggucaaugacuuuaagucacacagcuaggaaguaagggagucuggaauuggaucaaggucaucugcuaugaagccgagcuucuucccacuggguugaaaauaaucacaagaacaacaucaagaacuaccaucuguagcauggucaguaucugccugaguaguauuagcucauuuaaucuuuacaacaacccagugauaguagguauucuuaucacccccauuuuacacaugaggaaaccaggguggagagaaguacuuucaagaugaauaauucuccaaaauugggucuucagaaggcaagccucagcaaucugucacuguuuguugcucugucauaaauagcacuuuucuaaaauaggcaaaggccuuacucauagaugugcuuaauacuauguagcaauugaucauuaauuucaugguguucugucugccccacuggaauggguauucugguugcuguuagccucugcuggccauugagaugccgaugacccgugcucugagagacuccugauagagacuccugcucuaggaauucuagagcaagaauuccaggauguuaagaggcaagcauguuagaaggccauaugguacagugacagagagcaggcucuggaauagcauuccugucagaggugggcuugugacucucucuaguuagugauuuucaguggcuucccguugcucuccagaggaagcccagacuuuacacuguaucauaggaggcccuaaauuaucccccacuuuuuuuuuuuuuuuuuuuuuuuuugagacagagucuggcucugucauccaggcuggaguacagugacacaaucucuguucacugcaaccucugcuuccugggcucaagcgauccuccuaccucagccuccugaguagcugggacuacaggugcaugccaccauaccuggcuaauuuuuguauuuuucuguagagacgggguuucaccauguuacucaggcuggucucaaccuccugagcucaagcaauccaccugccucggccucccaaagugcugggauuacaggugugagccaccacaccccgccaccuguauuaucccuuuucccaagaguuuaucacagauggcagggagcucaggcucugguuucaaaucugggcuuuucuacuuccaaaguguguccaucuccuaaagcaaguuaccuagccacacugugcuucuggaacuuuauguguauaauugauauaguaguaauaacaaaauaauguuguuguuagggucaaauaagauaauacacauaaagcacuugggacaccaccuggcacaugguuaacacucucacuccguguuaguugggauauuauuauucuuggcaacagcagcaguaguuguagcuuucauagcagugcuuccuggccuuugcaccuuuacaaagcucuucucucaguaugugcagcccuuuggauaccuugagccuggcaaacuccugcucauucucccaggucccccuggaggugaacuugcaggcagccugccccgaccccacaggcucauugccuugcuucugccccugucccacagccgauagucucuguggccuucccagcauaugucaccauucucugggcacaugggggcauuucuagauguccugacugggagcucuugaggucagggagaugucugagcaccacgaaggcccccaguaaauguuuauaucaugaauuugucacugucccauucuuaguccugcccaggacuaagaaauucauaauugguguuugcagggauuuaggcaaagaagguuaaagcuacauggugaggagcguguauuaguccauuuucacgcugcugauaaagacaccugaaacuggaaacaagaagagauuuaauuguuccacauagcuggggaggccucagaaucauggccggagguggaagguacuucuaacauggcaguggcaagagaaaaugaggaagaagcaaaaguggaaaucccugauaaacccaucagaucucaugagacuuauucaugagaauagcaugggaaagaccagcccccaggauucauuuacuucccccugggucccucccacaacaugugggaauucugggagauacaauucaaguugacauuuggguggggacacagccaaaccauaucagaguguaagaaguacaugggaagccagggcuacaccuguguccccugcaccugagugucacagagaaucagggagggccucauuaucuaccacuggcaacaaaagccccacauagcuuugaccucaaauuagaagaaagcucucaguuccuuccaauaggcagucucuguuccagcacuguucaggcagccacuuuccugcaauucuagaucucucucaaggccuucaggagaugccagauuucauucuguccccuuggcuuuuucuucugccuucucugggaacauaggggcauuucuagauguccugacugggagcucuuuucuucugccuucuuuuugauuuucccacuucagggcagcacacccagauacccaggcaugggaaagagcucuaccauaggggagguucccuaagcacuugcccagaggcuaaaggacuuggacaggcuucauugcucccuauaaggccuagaaacuugaagcaagugggcacccuggccuuguuccugaacaccagaccugccaguggcccauggccuuggccuuagcauucacucugaguucuguacucugagcuacccucuucucagcacgguggcugcauggaguugguucaacauuaguagugccuccuuucucucuuccuucauuucaauuauaaaguguuccuuguaucaaaaaguagaauaaagaauacagugaaaaucuguauaccuaccacccaguccaagaauuaaaacauucuaguuauuauaauagccaaaacuggaauuagccuagauguccuucaacaggugaacagugaacugugguccauucaugcuauggaaugcuacucagcacuaacaaggaaugaacugucuuauguauaacaauuuggaugaaucuccagggaauuacacugagugagaauaaaacuaucucagaaacuuaacuacugucugauuucauugauuuuugaaaugacaaaauuuuagaaaugaggugaguggcugauggaguugaggaccugggcuggggguggaagggaugcggguauggagauaaaaggacacaugaggauccuugccuguggagacguucuguaucucgacuguggugauggacacacaaaccuaugcgagugguaaaauuguauagaacuuaacccauacacacaugaguaccaguaaaaugggacauuugaauaugauugguagacuguaucuauauccauaucuuggcuaugacaguauuuuauacuuuugcaaaauguuaccauuggggaagcugggcagaguguaaaagggaccucucucuuguuucuuaaaacugcaugugaacccuuaauuaucucaauacaaauaucaauuuaaaaaaagaaagauauugcaaguaacuuuaaaagaaacauaauagguacaacugaagauaacggugugccccccaaucucauuccucuccuuccuaagaggcaacaaguaucuggaauuuaguauugcucauucccacacaauucuguacuuuuacuacauauguauguacaguauccacaaacaauagaugcuaucguuugguauaucuucaaacuugauauauauuggguuuuguuggaacuuaccacuguguauaacccguugugugacuguaauagagcucauuuauccuuucacuuguugcuggacuugguuguuuguuuccagucauccagcacgagccguguugccgugaagguuuuugcugauauccucuugugcacauguguaagacucuccccacuauacccuaggagcgcauaggauggcuaggacacagggcaggcacaucugcagcucuacuaaacacugccaaauuuccuuccaaacuauaccuauuuauucucccucaagcaguauaucagccuaucuauggcucugcauuuuugccauugugguaauaucagaaguuaguuuuugccagucuaguggguaugaaaugguauccuacuguuucaauucccuuggcuucuucuaccaugaagcaugguucugugcccacauuguaucuccccaaccagacuggaaacuucuagucacagcucccagagauaggugcccaggccauaguaggggcucaagauuuguugaaugaauaaaaaauaauaauuccagaugcuuuuacuuggaaggauuauaguugcuuuuucuucauuuuuucuuuuuaaauauguaaccaucacuuucuaaaaauagcagcuuuauuuagacauaauugacauauacauacagucauuuaaaguguacaauucagugcuuuuuacuauuugcagagucgagaaaccaucaccagaauccguuuuagaaaauuuucauuauucaccccaaaagaacccauacccauuaacagucaccccagauuucuuccuaaccuaaugccuccacccccugcaccaccuuauucccaucccugcuuuggccaggucuaggcaaccacaaaucucuuuucugcaccuguggauuugucuauucuggaaauguuauuguauaaaugaaaucauacaacauguguuuuuuuguggcuggcuucuuucacuuagcguguuuucaagguuuaucuagguuguaguauguguuaguacuucauuccuuuuucuugccaaauauagcacuuucacuuuccacaauuucauuuucaugugaauacagcacaauaagauauuuugggagagagaugauagucacauaacuuuuauuacaguacagucagcccuuuggacauacagguuuugcaucuaugaauucaaccaacugcagauagaaauccacaauuagagacuguacuaugccacuuuauaugagggaguugaagauucuuggauuuggauaccugcaggggguccuggaaucaaucccccaugauacagaugucugacuguauauuguuauaauuucucuauuuauuauugcuaaucucugauugugccuaauuuauaaauuaaacuuuauuauagauauguauguauagaaaaaagcauaguauauacaggguuugguacuauccuuaauuucaggcauccacuggggaccuuggaauguauccucuguggauaaagggagaaaacuacaauauuccauugugugcacauaucauauucuacuuacccauuucuuagcugauggacauuuggguuguuuucaccuuuaugcuauuaugaauaauguugcuauaaacacuuguccuuguggauauguuuucauuucucuugagcaaauaaauacccagguguugaauugcuggaucauaugguguguuuaacuguuugaagaacuuccagaauguuuucuagaggcuguggcauuucacauuuccaccagcaguguauaaggguuccaguuucuccacaucuucaucaauauuuguuauuauaugucuuuuuguauuauagcucaaucaugggcuuuugaaucaggcaaccuggguuagaaucccaguuuugcuguuuacuagcugcaguaucauaauuaacuuuucccuccauuuucuuccuguguaaaaugagauuauuaauacccacuuuguaggacaauugugaggacaaauuaaaccaagacaaugguaaagccuuuagcacagugugggaugccauuugcauguccugggaacagaguaacagugacaguuugucauuaugggccuccucuaguccauggucuuucugucuagggugcucauaaagccaccuagaacugccaugagcaccuccucucaguugucugggagcuaagcugugugugagugaaaagcccagagcacugcucuucaugaauguccagcacucacaguggaaguuagagcagauccaccaucaccuugacucucagaguccccaggggccaccacuggacugucccaaccuggcagguucuuacaagccacccccaaacaacaagccaccgccaaacaaacaccacagggaacagagggacagagaaccuuugcaggcuccagguuaagaagcuucaaaucgggucugaacuaugugaguuuauuuaaauugguuuucuuuuccuuccuuucuuuggcaggagccaaauuuuucaugccaccauuuuugcaacaaucacaaacaucaucugcacacccagacauuguauaggagggaaaaaaaagaugauuacucgcugauugcuacuguuguucauuuuggagcugccucuggaugagaaaggcacagcugcauguggaagaggcagagaacagcagcucuguaaagccagagcauggguaggguggaaggggaaaagucccucacagcagggaagaccuggcagucagaguggcagugguuuaugggacgagguccuguuccuggcagugcugugaccagugucuacaggaggcagcaaagacaccucaggcucaucaugccccaaacagacucacaucaucuccucccccacccacuuccccaguccuucccaucuuagucaguggaccagaaacuugggugccacccugguucugccuccuucuuugucucacacaccugaccagucacaaagccgugugaauccuauccugcauaucucucaaaugcaucaaguucccuccauucauucacucuuggaucacugcagcagccuccccagugucucccugccucucugccucuagccuagcaccucuugaugacucauuccccagcccacacugaucuucccauaaaacaaaugagauugggucacuuuaccugaaaacccuacagugguuucccuucacccuaaagaugaaaucagagggcuuucagccacuugccccaccccuccuucaugcuucugugagucucuguuacugcacgggacuauaucagugguucauuuaucuucuuccccauucuccccugggcucccuaagggcaggaauucugguugauucaugccaguauccccugcaucuaacagagcuucugacuuaugguagguacccaauaaauguguguuauuugaguaaucuuuaugauuuucagaauuuuuuuuuuuuuugccugguuauuucucuuuugaccuucgccacucugaaguacacaugguaggaguuauuuccauuuaaaaguaggaaacccaagacucagagaugauaagugauggucugaggguccuacacagcaggcauauggcagagcuggacuagccacagcucuuccaaaggaggcaucacuagaaucccaugaggaaagcaaggcagguggcuauuucugugguucucaaagugcagucccuggaccaccagugucaacacuacuguuagaaacacuacuguuagaaacgcaguuuucaggcccuacucacaagaugauggaauagcaugaggccaagcccaaacuucccaacugccuucuuccagccaagaucauauucucuguguugugugauguccuacuucuggaauuacuaauguccaugaguccuaaugaugggccccgcuguaccaguuggaacaaaagauucuuccugcagacccucugcagcacgaacuuuuucaauaaugucagaaagcuguguggggcauaauuauaauaguguucauccuucaagcauacuuucugcugggacugauuaaacaaggucugacaagcaucucuccuggaugacucuggguauuaaggcaaccagaguaugagucacuuguaaugccccagcuagaaguuuuuccagggcauaauaauccccuaguauggacagaaacuacuagugacaggcaaaacguucagaggcugugcuugugccuggagcaacagcuuuguccuccucuccugccccugccuugacuuugaaauguucugucaagaacgaucagccuagaauugaaaggcauccaugugucagcugagccaaagagagaugggaugaaaauagcagcugccucuaguguuuuaauggaugcccgugucccuuaagggcaccaggccuggccacacagugaugaggaguaagccuggaaggcccagccugcauugcucugaugugugacuuuggaugacccuugcccuuccugggccaaguuugcucugggaguaaaucucugaggucccuuccagcacugaugaaggaaccuauggcauguccugggggacacuagauucaaugcggaguaaggugaaguggacuuuuaaaaguggagauauuuagaaggagauaaaccugggugagaagccccagcucuagcucuccccacuaugugaugcccagcaucggacugcugcccugccucuggguccuucugaaggauucugagacuggaggaagagacagcuaggaagcacaacugauugggguucuauuuuugaaagaggccugcguuggcaucccuagagacagagcacggugcauuucccugaauaaccacugcuauuuuuagagggcagaaaugaacggcaccccaggagagaaggcgagaagagugacuggaugcuucuagagaugcugcagguccugagcuggaucucagucaguuuuuuccaaggugucugccugggaaguugcuuaucagccucaccgugaccuugguugguauggugaggccacugcuguccuguaugcugcaagggcagagaaugcugggugccaaccccagggaaccacuuuucacccuuguguggcacacuucuuacagccauugucagcugcuguggaggaggaguugucuggauugaaugucucccaaccacagcaggaaaacaggcagcagaggauuacugucugggacuaaacccuccgggacauguuccugaaaaauuuuagagauggguggaaaucaauagagauuacagaugaguagaauuguggauucuuagacuacaagggcaccacauccagccacccugcuuaagugagcuguccagccccaggacugcauaucuguaauggaagggcauucccugagagagcuccacccauuucuggguauuugauugcuugcaaguuuguuccaaaaagucccauauccucuacucagcacacauaacgauuauggauaaauaaugacaaugaacuuguauugcaggcucaccacguaucagguaauggaaguauuccaccugugccuucucauucaaucuucacauuccgagucagggacauuauuauucuuaucuugcagaugaggcggcugaaacaaugaaugccuagcacauaauaguaacgacagcaaauguuuauacagcuuacuguauuccagccacucuuuuacaugguuuacaugaauuagcaaauuuaaucuucacaaaaacccuuugaaguagguaguauuaucaucaucuccaauuuggagaggaggacagagaggcaagauuugaauccagacacaccggguacagugggcuugcuccuaacugcccuggccauauuauucuaccucuccacgaguauuuguauaaugaacaucugaccucucuacucacaucuugacucauucuucccccucucuuugcuccacccacacuggccaucuuccaguucugcuaacuugcagcgucuaacaucagggacuccuccagacuccaucccuucuucuccuggccaccuccuggucaucccuuagguuucaauucauguugcuuccucagagagggcugcucugauuuccccagaccaggcagaucaggucagcccccucuuuuaaucuuucuccuaguccccgugcuccuucuucaagugccaucaucucccugcucaacacacucagaaggaaagcuccgcaagggcaggacaaugccacuguccucccucugcguccccagcauccugcucagugccugacacagaguagguccccaauacauauuugucaauuaagugcauggaagcagggcuagaaagcaggguuggcaccuguuuuucuugaaggccacggugucucuagaagcaggcugggucuauucccaccaacucaccaguuuccugagagcacauguguggugcugggaauuguuucuucacauaacuucuucucucucauuuuagaggggaggaaauaaagacugugaaggagagagugguggaaggagggggaaggaggaaucaggcagagcuccccaaccuggcugacugcucauuagaaucaccuggcgaguguugaaagcccaggccuggcgccuccccaggccaguggaaucugaacuucuguggguggugccugagcuuggacacuuguuuaguuuauguggccugguccucauagauuguauuugggagaccaggccaucagagagaagacaagagccuuuguuaggaaacccagaccaguccuccccacucagugguucuucacacaguggcggccuaaucaaggaggcuguccucacagaaacuaaagauuagggcagugguugaacaauaauuaucauccucaucauuuaauaauaauaguuacuauuuauuuguugaguaaacaaugugcuaggccucuuaccuaauccugaugaaugccuguuaggugguugaugguguugccaucauacaaaagaggaugcccagguuaaggucacacauggaggagugggagaggccagguaugaacuugggccucuaugcccugagccuguguuccagcaguggccugcacggccugcagguguuugagucuccuuuccuuccaccgggagcacagugugugcagaaaggcuucuaccuucaugacuaacaagacucugaaaaaaaaauucuugauuggaagccugcuacauucugugcuaggguucaggaggagagaaagccagguuuccccccaccacgucccccagcaaaacaaugcauuuuaaauggcuccaaaauugcuaacuuauuucacugcuucagaggagaaauaacuuggggaaagcuauuggcccuuuaugcccugaacaucaaaauaaaaugccaaaugggaacaugaaaucacaggaggauggaaguggaaaggauuaggugggaaguuugcuguugauguguggggagaguguuaaacuggaauucuggguacuugugaacuugggggucagauggaccugguucaauccagccugggacuaaugcucccaugcugacauggcuuuaggauuaacugcaaacaagguaccucuccggcaaaagguccugagcagcuuuugguucugguuccacugagcugggguugggcccaagcaggggcuuuuuaaaaaaaaaaacuuccaggugauucuaaugagcagccaggguugggaagcucagcuuaauuccuccuuucccuucauugucuccccucucauucugaguuuucuccccgcucaaaugggcaugauaccacuugaagaaacaauccccagucccuuccagcaagacgaacugcucucaguaaccuguggugagucagugggaacaucccagccuguuuccagucacaccuuugccuccaagagaaaccagugccagcccuacauucuaguuggcucagguaaaaugaaagcaugggggaaaagggccccagucuggcauggaauauugaggacucagagccuuuuugcuuuuugcugaaaaccucuuaacccugggcaugaccaggcgccaucugcugaacacgcauccauaagccuugcugagggaggcagcuuguuuccuccucaugcugaggcuacugcuacaaggcucugucagugaggcugguuggaaaguucuagaaaugugggucaggugggcucucaggccugucacagcugagagacaagucuccaggccuggaagaggagagaaaaugaggcuuccagccucuagaauguucuguuugaugagcagcacaauggggccagaagccugagaacaagugugacugaggcccuguuaagaagagaaugcacccccuggaaauguccucaggaaacauggggaacagugucugaucugaacacacaccuguacagaccuuguccaugauaggaauggcaaacggcuaccaucaacagcaccagccgggggcugacuccucagacacaggcacuacucuccacaacaccccgauaggucggguuaggaccccaguuucacagacagagacacugaggcuuaaggggacauagaaccagucagugcugaggcugaggcuguggacuuccauaguagcuuucagaccuguuuucccauuugaucuucucaacaagccuacgagaugagccaaggugaagaaacaggcucagagacacacggugacuucuccagugucacacagcuaaggagcagcagggccuggacucagagccaggccuguugggcucagguuggugcuaucuccccucaguccaggcuugcgagaugcccucuugcauuagucuguuuucacgcugccgauaaagacauacccgaaacugggaacaaaaagaaguuuaacaggacuuauaguuccacaugucuggggaugccucagaaucauggugggaggcgaaaggcacuucuaacauggcggcagcaagacaaaaaugaggaagaagcaaaaauggaaaccccugauaaacccaucagaucucgugaggcuuauucacuaucaugagaauaacaugggaaagaccagcccccaugauucaguuaccucccgcuggucucucccacaacacaugggaauucuggaagauacaauucaaguugagauuuguguggggaugcagccaaaccauaaaauuccacuccuggccccuccaaaucucauguccucacauuucaaaaccaaucaugccuucccaacagucccccaaagucuuaauucauuuuagcaucaaccuaaaaguccacaguccaaagucucaucugagacaaggcaagucccuuccaccuaugagccuguaaaaucaaaagcaagcuaguuacuuccuagauacaaugagaguacagauauuugguaaauacagccauuccaagugggagaaauuggccaaaacaaagggguuacagggcccaugaaaguccaaaauccagcggcagucaaauuuugaagcuccaaaaugaucuccuuugacuccagaucucacaucuaggucacacugaugcaagagcuggguucccauggucuugggcaacuccaccucuuuggcuuugcaggguacagccuuccuccuggcugcuuucacgggcuguuguugaauuucugcggcuuuugcaggugcacggugcaagcugucaauggaccuaccauucuggugucuggaggauggugucccucuucucacagcuccaguaguaggcaguaccccaguagggacucucuaugggggcucugaccucacauuucccuucuauacugcccuagcagagguucuccaugaaagccccacuccugcagcagacuuuugccucagcauccagacauuuccauacaucuucugaaaucuaggcagagguucccaaaccucaauuauugacucuguguacccacaggcucaacaccauguggaggcugccaaggcuuggggcuuccagccugugaagccacagccugaacucuauguuggccccuuucaggcauggcuggaguggcugggacacagggcaccaagucccuaggcugcacacagcacagggaccuugggcccagccuacaaaaccacuuuuuccuccugggccuccagggcugugaugggaggggcugcugugaaggucucugacauggccuggagauauuuuucccauggucuuggggauuaauauuaggcuccuuucuacuuaugcaaguuucugcagcuggcuugaauuucuccccagaaaauggaauuuucuuuucugucacauaggcugcagauuucccaaacuuuuaugcucuguuucccuuauaaaacugaaugccuuuaacaguacccaagucaccucuugaaugcuuugcugcuuagaaauuucuuccaccagauacccuaaaucaucucucucaaguucaaauuuccacaaaucucuagggcaggggcaauaugauuccagugucuuugccaaaacauaacaacagucaccuuugcuccaguucccaauauuuccucaucuccacuggagaccaccucagccuggaccuuauugaucauaucacuaucagcauuuuugucaaagccauucaacaagucuccaugagguuccaaacuuucccacauuuuccuaucuucuucugagcucuucaaacuguuccaaucucuuccuguuacauaguuccaaagcugcuuccacauuuucagguaucuuuucagcaaugcccuauucugcuuguacuaauuuacuauauuaguccguuuucaugcuguugauaaagacauauccaaaacugggaacaagaagagguuuaauuggacuuacaguuccacaugucuggggaggccucagaaucauggugggaggcaaaaggcgcuucuaacguggcggcagcaagagaaaaaugaagaaguaaaagcaaaaacccccugauaaacucaucagaucucgugaggcuuauucacugucaugaaaauagcacaggaaagaccggcccccaugauucaauuaccucccccugagucccucccacaacaggugggaauucugggagauacaauucaaacugagauuuggguggagacacagccaaaccauauuaccccugcucuccacucccauggcccugucuggaugucucagcagcugggcugcccccaaccuccaaacacucccauccuucauaccccuccugaaacccaacacaguugccauuuucuagcugugugaccuugggcagguugacuaucaccugaccucugugagcuuucauuuucauuuuauuucccugcaaggugggagagaagaacccaucugcccaccuacugugagaaugagugaggccaccgugucccuggcacugugcuucacucuuugguaagugucagggacccugcuauguggauggacacuuguaggaucagaugugucagucuguggggaguuuccuacagaagccauccagcccaacucgucacucagcaggugaaggacaaaaagagaccaugacuugcagcaacucagaguaugaccggccgggccacaagcuuugucuccugauucucaguccaaugcaccagacagugccguaggaccuagggaaaagcggaauacaagagacuaaagucaaaaaugaucccaccacaugaaaccccuaaaauguaagucauccugaugggaggcagcauuucacauggaaagaacaucaguauucccucacugacaccugaguuccggcugcccugcccaccucacuacuugugaggucuugggcaggucauagccgucugaggcccagguuccaaaucugucaaaugaggaagaggaugaguaaaauucuagaacagggaccuuagugagcugcuccagaaaugguacccaucauuaugaagccuucuuuucaguccucaaauacugaaagaaaauggugagguuggugcuggugggaaagcuugcuguccugggcaucaaucagggccucucacugcucaggcagggguccugggcgcugggaggcuggagaggaaggggaagaaccaagaggaacuugugaggcuccuugagcuacuccuguaucuucugccacauccccugccuacaaccuugcugggaacagagucacaagcaagcagcuuugagcuguuggccagaaaaggcugucaccacacaaucccuguagggaaaauaaucauaucgucuagguuauucuugaaaacuuuuucuaauaugcucaagauacugauacagacucugugcugaaaauauuuuuuuuuuuaauuuuauuuuuuuuuuauugaucauucuuggguguuucucacagagggggauuuggcagggucauaggacacuaguggagggaaggucagcagacaaacaagugaacaaaggucucugguuuuccuaggcagaguguuugugucccuggguacuugagauuagggaguggugaugacucuuaaacgagcaugcugccuucaagcaucuguuuaacaaagcacaucuugcaccgcccuuaauccauuuaacccugaguggacacagcacauguuucagagagcacaggguugggggguaaggucacagaucaacaggaucccaaggcagaagaauuuuucuuaguacagaacaaaaugaaaagucucccgugucuacuucuuucuacacagacacggcaaccauccgauuucucaaucuuuuccccgccuugcccccuuuuguauuccagaaaaccgccaucgucaucauggcccauucucaaugagcuguuggguacaccucccagacggggugguggccgggcagaggggcuccucacuucccaguaggggcggccgggcagaggugccccucagcucccagaccgggcagcuggccgggcagggggcugacccccccaccucccucccggacggggcggcuggccgggcggggggcugacccccccccaccucccucccggacgggacggcuggcugggcagaggggcuccuggcugggcagaggggcuccucacuucccaguaggggcagccgggcagaggcgccccucaccuccccgacggggcggcuggcugggcggggggcugacccccaccucccuccuggauggggggcggagacgcuccucacuucccagacgagguggcagccaggcggaggggcuccucacuucucagacggggcgguugccaggcagagggucuccucacuucucagacggggcggccgggcagagacacuccucaccucccagacggggucgcggccgggacgaggcgcuccucacaucccagauggggcggcggggcagaggcgcuccccacaucucagacgaugggcugccgggcagagacgcuccucacuuccuagaugggauggcggccgggcagagacuguccucacuuuccagacugggcagccaggcagaggggcuccucacaucccagacgaugggcagccaggcagagacgcuccucacuucccagacgggguggcggccgggcagaggcugcaaucuccgcacuuuggggggccaaggcaggcggcugggagguggaggccguagcgagccgagaucacgccacugcacuccagccugggcaccauugagcacugagugaaugagacuccgucugcaaucccggcaccucgggaggccgaggcuggcggaucacucgcggcuaggagcuggagaccaguccggccaacacagcgaaaccccguccccaccaaaaaaacacgaaaaccagucaggcguggcggcgcgcgccugcaaucgcaggcacucggcaggcugaggcaggagaaucaggcagggaggcugcagcgagccgagauggcagcaguacaguccagcuuuggcccggcaugagagggagaccguggaaaggagagggagagggagacgggagagggagagggagagggagacgggagagggagagggagagggagacgggagagggagagggagacgggagagggagagggagacgggagagggagagggagacgggagagggagagggagacgggagagggagagggagacgggagagggagagggagacgggagacgggagagggagagggagacgggagagggagagggagacgggagagggagagggagacgggagagggagagggagacgggagagggagagggagacgggagagggagagggagacgggagagggagagggagaagggagagggagagggagacgggagagggagagggagagggagacgggagagggagagggacgaaaauauuuuuuaaacuguaauuauaaugaaaacugcuuugcaacauuaacaaaaccacacauuucuugacuugcaucaccuauucauauugacuauuuacauuuuuaugugauuccuuccacauuuauucggccagaaccuguaugucuguuugaaugggcugccuguauuagggucuucaugaugcuucuugagggaauaggggauaguguuguauuauuuuugacucucauucauuuauucuaaaaguaaauacugaggaucuguccuuugccaaguccugugccaggucuugaaggucuuaaagaaaaauaagacuuaguccugcccuccaaagagggcagagaggaaaaagaaagacauuugccauuuacaaggugcaaggccacguauuuacacgugugaucucacuuaagccucuuaccaagggugacacaggccuucuuauucccauuuuacuuaugaggaagcugagacuugagacauaaacacagugcccagggcaauuuaacugguagcugacaagaggcagccacgggaguuugugucuaagcgaaaaaugugaccaucuuuuaaaaugccgugguggugaggucuaccaaguaagacaaacaggcaaauaggggaguacccuguaauggggauaaaguuagaggauuucuuuuuuccuuucaagcugcaguaggagcacagagaagggagagauucacguugcuuggacugaagguuccagaaggcucccccuuuaaaaagaaugggagucaucucuaucuaaauccugcuacauguggaaaagcaaccucuaagccuacaggugacugccucugaagcauuucuucuaaccgucaguggcguagagaucccagagugcucugugaucugacaacaggaguggggccaucaacggaggcugcgcaggcaagucugaguuggcaaaaccagcaggacugggcaacuucugauguugcgcucucaggccucucuucuauuauucuugccagcuguggucagucaauauuagcuuugguuccauuucaaaucaaaggaaaauccacuuggcaaauacuuauggaggcccuacaacaccuuacacaggcacuacauauccagagcauaaaaagacgauuaagaccuagcuuuggacuucaaggggcucucguucuaggagagagaguagugcuaaaugacaugggaagagcugucacaggacaucacaagaguguuuaaaaaagguauguuugauucauuugcaguguuugaugaacaccuacuguaugcugacauggugcuaaggccugggaaccagaaaagaacaggacacagucccuacucuuaggaagcauacuccuucacucgagaaacagacauaaaucauauaauuaugauaaaugcuugugugauggaggagcaggagacuguggugggaacacagagagaugguggcuaacugccucugaaaaagggaagggaucuuguauuugccaaauaccuacuaaaugcugaggguuuacauguguuacaucacuucuuaguuccucuuagauuuuuuuaugaaugugggaauugaaacuauuaaaguaccuuauucaagaucauguauuaugacaacaugaaauuuugcauucugugccauaccauaucuguguuuacauucauacaaaauaguauuuuaaaugacuugcuaagccccuacccauguuuuuacguucccuaaaauucaacaagaaaggcaucccaccuaaggaacugugccaguuacaccuguuuuaguaccugugaauuucauacuaauaauuuccaugaggacuaggaauuccuuagguucccucuuucaugauuucagugacauguuuaaauguuuauuaugcaugcuugcagguaacaugugcgaagauuuccccacaucuggucccccaguacugacugccuuucugaggucaagacuuggauuugcaaucaccacacccuauccuuggcuuuagcccugccuggacaaguguggacagaccccagccccuucucauccccuccucccuuuucuacugcuccucgucucccccuucccuccucucucucuuuucuccucuuccccauccccauccucacuucucuucugcuugcuccccuucuccuuuauucuucccuuccuucuucuuugcuuuucuccuccauugacuccucuccucacuccuccauucucccuuccuucuccccucaucucuccucuccuucccuccuucuuccucuccuccucucuuuucccuuuuccucaccuccaucaucuccucucuacuaggacuucacugaaacucucuacucuaggguucauaagcuggggucuaugaauccugcagagucugugagugaguuuccaacugugcauuaacccuugaaauugaagucagcauucuggauucauggccaugaauguguuuugccagggagaaguuuuauagcuuuuaccagauccucagauuucuagacuuggaucucccacuucucuucucaauuccuagucuucgguuucuuguuuccccaaauucccaugacaagugagagucauaguuuaucuacaauugacuuuaaaauuugcagcuguggagaaaguaaguucacagaagcccuucgugaagagagcucacugguuggaaagugcaaaugucccagcaguuguguggauuaaaugaggucucaugagugaguguuuggcaugcaggcaaagcuaaacaacagugaguuuuucucccucccaagcucuacugaaacacuguucuuugcagaugaguagaauuauauauagucugcuaggcugccauaacaaaguagcacagacugggugguuuaaacaacagaaauuaauugcauuccauucuggaggcuggaaguccaaaaucaaggugccugcaggguugguuucuucugaggccuuccuuggcuugcaaauggcugucuucccaccauguccucacauggucuuuccucuguguaucuguguccuaaucucuucuuauaaggacaccaauuguacugggguagggcccaaucauaugaccucauuuuaccuuaauuaacuuuuuuaaggcccugucuccaaauacaaucagauucugagguacuggggguuaggacuucaacauaggaacuagugggaggcaccauucaucucauaacaaauugaguaaaauuccuuuccuuguagagucucacuaguguccugccuagggaggcagucaugggaggagggugagaauaaagccuauccauugaacacuauugcaucuagaacuuggucuuaauucaaaccacuauugacaaaagguuauuuaggaagcacuuucuggcugaguggguccaggauaauuauuaaggacccaugcauggguugagcaggaguuguggacaccauguuagcaaguagccagcccagugguugccucgucuuccugacagauaggaagaaacuguguuuuauuuaugugugcugcuauucuuagucuugcacuuuucccuuuauccccaguggaaaggauuauuguaacuacucuaucuugaacccgucucauagucaaauuaauagaugaggcucaagucguugcccuggaguucaacagcaaaaacauauuaacccaaaagcauuaucauaucauuagagcaguguguguaaaaguuuaacauucagaacaagaaugaaggggaggaaugggaagggguugggcaauggggcuaaggaggauguccaaauaucuuguauaaauuacucuacucuccagugagaguuucuuaacaaaaccuuuucuauaauaucaccugcaauguaaauacaugaucugagaagaaucuuucaccaaagccaauagccagagaaucgggcuccgaggggcuguuucagaugcaguaaauuagagcugugugcauaauaauauacacuggaagcaggugaaucaauaaucucagugcauucaaguauagauucaaagcaguuuauuccaggaacaauaacacacgguauuuauuugcauaggucuagaaaacuuaggcaauuucuuuaaaaaauucaagauggcaagguucucuuugcccucaucauccuacccaaucccccaauauuuaauuccuccagauugccugucucaugggugauagccuaguuuaucaucgcaccacccucugcuuuucuccguaaacuggcucuggguuacugccauuaggcauuacaguaagaagaggaaaguuagccacugacuagcuguuuuguuuugcaugucauuuaccuuucucagccucaucuauaaaaugaggauaacauaccugcuuucuggaauugcuauaaggcuuagagauaaagcacguaaaggcuccgcuguagugccugguacaacaguugcuugauaaacagaugcaauuguugcuacaaggcccuguugauggcuuagaguguuggaagaagugcucagggcgggaggcuguaugguggauuccugucucauuucucuuacugagggcaccuccauucugagccauaacucccagccuggucacuagcuuagccaaugacaagcauaagacauggcaagguggugguauucauccaagauauaggaauauuaguaaagguagcauaguauaaaggaaagaauauaguuuuuggaguuagagagaucuggauuuaaauccuagcuuugccaccuuaccuuggacacauuacuucauuucuuugaaacucaauuuuuucaucuuuaaaagcuagaugaaaaauauuugcuuggaaagguuauugggacaaugaaacuaacccuucuauacauguaaaaugccacacucugucccuggcacagaaauggcacucagacuuggggauaacugcauuaucaucaucauugucguuaugaacauuaccucuuuggcagauguuucuggagauuuuaggaaacuauaucagaaggaauuuugaaaagggaaagacucucugcaggguaaaugauguuuuucuuccuaggccaauguacuuuuucuaaggacugcuaagguuuaugauuucaucagaaugaagaauuuggggguaggcauagacaauugcaccuccaaacuugggcaaugauuuuucagcuuucaugugguccaagcaaugugaaaguuaaaugguauaugccaauacucaugguaaauagcauucuguggaaaauuccacauugauugucuccuccuggcaccaagagucaaauggcaccaugccauucgcuggugauacaauaugaaaauuggcuggugauuuaacugggcccaguuauccuguuggaugcugccucagauaugagacuauaaucuucuagucugucacuuuucaaagucauggacuaagaagcaaaggacuuuuuuucuugcauuuuaaacauuuguggguuuuuguuguugcuguuuuuuguuuuggggguuuuuguuguuguuguuguuguuguaguuuuuugugagacagggacucgcucugucacccaagcuggagagugcagugguacgaucucagcucacugcagccucaacacucagggcucaaacaauccccccaccucagccucucaaguagaugggacugcaggcaugugccaccacauccagcuaauuuuuaaauguuuuuuagaggcaggguuuugccauguugcccaggcuauucucaaacuccugggcucaagcgauccuccccaucagccucccaaagugcugggauuacaggcaugagccacugugcccagcuaaacauuucuuuuuuauguuucaaagaaauguacuuuuuguuuugaucagaauauaagauauaagcuguaucugucauuugcuuaguaugggauauugagagucuuacuuguuuaaauuucuaaaauuguggugaaauacaucuaacauaaaauuuaacauuuugaccauuuuuaaguguacaguucaggggcguuaaauacauucacauuguuguacaaccguccaucuccagaacucuuuucaucuuccaaacugaaacucuaugcccauuaaacaauaacuuucccugcugccuucccuccaggcccuggcaacucccauucuacucucugucucugggaauuugacggcucuagguaccucacauaaguggaaucauacgguauuuguccuuuugugauuggcuucuuucccuuagcauaauguccccuggguuaggaguucccacccccccuaaccuccacccccacaccccuaccccaugccauggaccaguaccaguaagugguuaggaaccuagcugcacagcaggaggugagcagcaggcccagcgagagcaauacugccugagcucugccuccuaucagaucagugggggcauuaaauucucuuaagagugcgaacccuauuguuaacugagcauggagggaucuagguugcacauuccuuaugaggaucuaaugucugaugaucugacaucaagcagguucauccugaaaccauccuccuccgcuaucuguggaaagauugucuuccaugaaaccagucccugguaccaaaaagguugggggcugcugcucuagguccauccauauuauaacaugugucagaauuuccucccuuuauaaggccgaauaauauuacauuguaugcauagaucacauuauccaguuaucugaccauggacucgaggauugauuccucuuuugacuguugucaauaaugcuccugugaacauagauguacaaacaucuguucaagucccugcucucaguucuuuuggguauauauucaaaaauagaauaguuggaucauaagaucauucuuuuauaauuaaauugaggaauuaccaugcauuuuuucacagcagcaacacuauuuuacauucccaccaguaaugcacaaggguuccaauuuuucuacauuuuugccaaugcuuguuauuuucuguuuuuuugauaagccauccuaaugcacaugaagaauagagugagucauucauucauucauuuuauuucucuccuuuugagucauucguucauucauuuuauuucuuucuuuuugaaaauuaagaaacuuuauuuucaagagaagucuuagguucacagcaaaauuaaguggaaaacaagaguccccuugugucuucugugcccacacacacacaaccuugccacaucaauaucccaaaccagagugguacauuuguuaccacugaugaaccuacauugacacaucauuaucacccaaaguccauagcucacauugguguucacucuugguauuguacauucuaugaguuuugacaaauguauauaaugucauguaucugccauuguaguacagaauaguuucacuauucugaaaaauccucuguguucugccuauucauccuuccucccuccaaucccuggcaaccacugaucuuuucacugucuccaaagucuugcuuuuuccagaaugucaaugggaauaaugcaggauguagacuuuucggauugacuuccuucacuuaaugagcauuuaaguuuccuccaugucuuuucauggcuugauagcucauuuacuuuaguguuaaauaauauuccauugucuggauguaccacaguuuauuuauuuauuuaucuacuuaaagacaucuugguugcuuccaaguuuuggcaauuauuaauaaaaguacuauacacauucaugugcugguuuuuuucuggacauaaguuuucaauucauuuggguaaauaccaaggagugcagcugcuggaucauacaauaagaauguguuuaguuucuuaagaaacugccaaacugucuuccaaaguagcuguaccauuaugcauucccaugagcaaugaaugaaaauuccugcugcuccacauccucacuagcauuugaugucagcguuuuggauuuuugccauucuaauagguuaguauuaguauuguuuuaauuugcaguucucuacuggcauaugaugcugaacaucauuuuauauguuuaguugccaucugaauaucuccuuugaugugacaucuguucagaccuuuugcccaauuuuaaaucagguuguuuucuuauuguugaacuuuaagaguuuuuuggauauuuuggcuaacaguccuucacuagauagucuuuugcaaauauuuuucucucagucuauggcuugucuucucauucucaucauaucauuuuccagagagcauaaguuuuuaauuuuaauaucuagcuuaucaauuauuucuuucaagaauugugcuuuuggcauuucaucuaaaaauuaucaccguauccaagaucaccuagauuuuuuccuauguuauuuacuugguguuuuguaguuuugcauuuuacauuucgaguuaauucuugugaagggaaugaggucuaagucuagauaaauuuuuugauauuuggauguccaguugucccuacaccauuuguugaaaauauuauguuugugccauuaaauugccuuugcucuguugucaaaaaucaguugacuguauuuauguagauuuauuucuggguucucuauucuguuccguugauguauuuauguuugcuuuuuccaauaccaugcugucuugauuauuguagcuuuauaguaagucuggaaguucaguaaugucaguccucugucuuuauucuucuccaauguugaguuggcuauuauggaucuuuugcugucuauaucaaguauagacucauuuugucaacaaucacaaaauaacuugcugggauuuugauugggauugcauugagucuauagauaaauuugggaagaacugacaucuugacaauuuugagucuuccuguuuauaaacguggaacaguuuuuuuuuuuuuaguucuuugaucuuucaucagaauuuuuugguuuuccucauauagauauuguacauauuuugucagguuuauaccuaaguauuucauuuggguggugcuaauguaaacgguaauguguuuuuaauuuuaaauucaacuuguucauugcugaugcauaggaaagugauugacuuuuguauguuaacuuuguauccugcaaccuugcuauaauugcuuauuaguuccaggacuuucuuuuuuuuuuuuuaaucaguucuuucaggacuuuuacauaggcaauuauauuauuugugaacaaaguuuuauuucuuucuucccaaucuauauaccuuuuauuuccuuuucuugucuuauuguuuuagcuaggacauccaguaaaauauuaaaaaguaguggugugaagggacagacacccuggcuuucuuccugauuuuuagcagaaaagcuuugaauuucucuccauuaaauguauuaccaguagauuuuuuguagaugcuguuuaugaaguugaggaaguucccuucuauuccucauuuacugagagguuuugucauaaacgaguguugaauuuugucaaaugcuuuuucugcaucuauugauauaauuauuugguuuuucuuuuuuagccuguugaugugguggauuauauuaaucaguuuuugaauguugaaccagccuugcauaccugggauaaaucccauuuagucaugguguguaguuuuuuauguacauuguuggauuuuauuugcuaauauuuaguugaagauuuugguaucugugcuccugagagauaguggccuguaguuuucuuuucuuguaaugucuuugcugguuuugucauuaggguaaugcuggccucauggaaugaguuaggaagaacugacucugcuucugucuccuagaagacauuguagauaauugguauaguuucuuccauacguguuugguagaauucaccaguaaacacaugugggccugguacuuuauuuuuuggaagauuauuaaugauuaauacaauuucuuuuauauauguauauacauauauacacauacauauauauguuuagauauacauauauauauguguguguauauauaugacuauucagauaaucuauuugucuucuuuacuuauuuuugagauguggucucacucuguuguccaggcuggucuugagcucuuaggcucaagggauccuccugccucagcaucccaaguagcugaaauuacaggugcacaccacuaugcccagccagucuuauuuauguuuaacugcauuguuacaaaaauauucagacaacacaaauuacuaaaaacaaauauaaaaauauauauauaaguauaguuaugauuaaccccacgcacaauuacuaaguguuucagaaggucuccaaacuugccaagugcgcgguauuguucucacuguauaaaugagaacgcugaugcuuagagagauuaaaggacuugaccaaggcaacacugcuaguucauaauggagcaaaauccaauucugccugacuacuuggcuguugaacacugcacuaugaugcuucuucaaccuuuggaaucuauagaucguaugugccauaagguuucugugaggaaacccaugucuaauuccaggcuuugacugucuaccucauggccauauaccuaguaugguaguuacagaagcuccacacucagacacuugagaguggagggugaaucauaaauacgggggagguuccagggaucugcucucaccuuggguuuuuuucuuuccuuuuugccaaaaugcauuuuuagaaucuuguuaauaagcuuaagaugcaaagucaauguuuucccuuuccucauugcuuugguuaauuuuaagccuguaccuaaaacauauuuauauaaaauagcaccauuaaaacugcagggcaauuugcaagcccagaccuuagguuuuggagacagagagaucaugauuccauucccaaagcuaccguuuucucacugucccaugguaaggagaucuuuaaucuugcuaagccucaguuucuuaaucuguaaaauggaacagggauauaauaccauuuucaucggaugguuguugauuuaaaugagaaaaaugcuuguaaagcccauagcucugcucuuaaaacaggcuagauauucaguaaauguuaacuaauguuauucuaaacuauuuugagcaccuucuauaugucaaacucuuuauugaaucacucgcuuggucuucaaacuuuuuaucaucuguccuuaacaauaaauguuuuuugaguacacauccucaguauuugcaauuuuauuuauaaauuacauccaugacucauucucaauccauauacuaaauauuagguaaguuuaaugcuuccuuucuuaaaauuaaaaagagagagauguucaaauauuuuaucccaaauuucaauggacuaucuuaaucaucuuguuuugaaggccuccaguuuagcuuaucuaaaacaguuuauuagcaaacuuuuucuguaaagagcuggauagugaagauuucugacuuuguugggacucugucacaacuacucaacucugcuguucugguaugaaagcagauauagacaguaugcaaauaagugguuguggcuguguuccaagaaaacuuuauuuaaaaaacaugugcugggccaucguuugcaguuugcagacuucugaccuaagagaguuugcugugcucuuuaaauacaaaguucccucagcagacuacguaaggccagcagcucuugcaaacguugugagguaguuggcaaggaggagaagugaggugaugcauaugauagcuucuuccaaaauguacaaaauauaguauaucaucaucauuguuguuguugcuaacauuagaacauuuuccaugcauaggcaauuaaagguacugacguccuuguaccagccuuacucugcagaaauaauauggagucuuuuguaaauaagggcagcccucacugacuuucuggaagcaagauacaauuuuuuauuugauuuccucugcuacuuucuucuagccagauacauacacauaugaaaagacuggaucauuucuaugaaauuaguguauccuaugaacagggaaaaauaaaaguuugguggcuucaugggggugauggcucacccacugacggguauuucuuauugccuacugugugccagauacugugacugugcuggacccugugggugggugugggggagacagaagugaaugagagguggccucugcccuugaggaacuccagucaaccuuucuccccgcuauccuuccaacacugcuccugucaagggccccaggaccugcauguugcuauaugcagugguccuugcucaguccucauaugacucaaacuauuuacgugguugaugucacgcuccuucuggagcauuuccuuuuuguuugcugagggucucugcucuccccugguucugccucaccacacuacucacuacuucuuccaccucuuucacugguucuuccuccucaugaauccucugaaugcaggggugccccagggcucuucuuucuguucuacacucccugggagaucuuauacaaccuccagguuuaaacccaucuaucuaucgaugacgcccagauuuauaucucuagucuggaccucugcccuaaacuccaauuuauauaucccucuaaacaggcaacagcucuucucaaaccuaacaugcacaaagccuguucccugauuuuuucccaccugcuugccaaccugcucuuccuguguuaguucuauuccuugcuucacucaagcaaaacaccuuagaguuucuuugucuccccuuucucucacaucccacauccaacccaucagcagauaucuucaguucugccuucaaaaguaugugaaguauaugaucggacuacuuccuuucaccuucacacccucaccuuggccaucucucuccuggguuauuccaggagccuccuaccuguucuuccugcuuccucuuugcucuucuucaaucuguucacaucacuccucugccuaaaaccuucuaaagguuccccaucucagaggaaaagcuaaaauugcugucaugucccauggggcucuacacaucugucacagcagggcccacccugaugcugugcucccaucuccucccucaguccuugggucaccuuugucuagccacaccugccuccuugcugccccuccuacgugccaggcacccuugcaccucuggaccuuuauuguccuagcugccugcagggauagcugccccauucccuucagguuccuaccuaaugccaccuuaucagagagacauucccgcccuaaccauacccuccuuccuccuuaucccacucuacuuuccuccauaauauugaucaucaccuaacaugucagaguuuuguuuguuaucugacuuccaccuuagacucuaacauugaaguaggggcuuugucuguuuauucuugaucccugaauguagagcaauaccuaugggugcucagagaggcuucaaauauggagggggagaagaaagaaaagaaaagaagaggaaagggaaaaggaaaaggaaagaaaagaaaaaaaaagaaaaggagaggaaaggaggggaggggaagggagaggaaaggagaaagaaaagagaaaagagacccagucugguggaggagcacuaaaguaaggaugaugggugcacuagguuugaaaaccaagggggcuccaacccuuugccccugcuuuaaugagaacaguucuucuaucuguuuauauacugaauaccaauauaaauuuuauuuuggaggaaaaguuuccacugcuuugaaaaaaaaaagguuuaaacaauucguuuaaaacaacuguucuaggccacgggucaccauguuagggcuuagaacagauaaguggcacggucaugucugcauauugugaaguuuagucugucagggguaugguuaguggagaaggggugaaaccagagcagagaaucuagcuggacaagagguaaaagcaauguuauccuuucaaucagaaaaccaaaggaaccugcccccacccugaccggucuccuacaggaaccucaguaaauucccauuuauuucucuguucuucagaccgauguuagaugcauucuuuggucugugcuuucucuuccugaauaaaaugauuguauuuacaugugcuaaauaccauauuauuaucacugacuauacacuauauaacauauauuacuauauacuaaauacuguauuaaaaggaacauaucuucucauacacaugaauaugcauacagcuucauguuggcuaauuaguuucacugaguccuuuggaaaaggaggcagacuaaaaaaugaaggaguaaauaauuaggugucaaguaauuaaaaguacuauugagaaagaaugccuuuuaaauaguuuuuuuaauuggguuuuuaauaugacugacuuggaaaguuucucucagaagaugguguugauugacagacaauauaguuauuaauaacauguagucaaucuguuaggaauauauuaaguguucaggagauagaacaucugaaaagaauugcuaaggauucaggcaacagauucaguguggaaugcaucuuuuucuuggcaaggagucaguggccauugagcagaacuggaguaaauggaguguagaagauggcccaaggacccuguuggaucagcaucucacuguuuggaaaugcaaccaccuuuaaugagaccagaagucaucaguugaaugacugacccuaugggcaguacauugaguaaacaguuuguaaucagagauucccaacaaauauuuuaugaacaucugaguagcacaucucuaaaacuugguugggugauuuauuuauuuauuuauuuugaggcagggucuuccucugucacccaggcuggagugcaguggugugaucacggcucaccgcagccucgaccuccugggcucaggugauccucccaccucuuccucccgaguagcugggaccacaggugugugccaccauuagugccacccagcaaauuuuuuaauuuuuugcagagacauggucuccuuguguugcccaggcuggucucaaacuccugggcucaagugaucuuccugccuuggccucccaaaaugcugggauugcagccaccacacccagccugacuauuuuuacaaauauauuuuauugugauauuuccucaucaguaaauuauacuuauuuuuucuugaaaauuuagaaacuauagauaugagaauggaagaaaauuuuaaaaguagcuauuaccauaccacacuaaaauaaauaccguugagcucuguaaauauacacacaaguuugccuuuaauuucuaaaaauaggacugcauuccacauuaaauuuugugaucuucuuuuucauuuaacaacauauagucuaccuuuccaugucauuaaauauucaucucuuaggcuuauuuuguaaggcugcauuguauugcguccuguggaaugccagaguuuauucccauuucucuagcuguuagacauuuagauuguuuccuccuuuuauuuauucuucuauucaauacuacaaugaguacccagcacugauauucaguuggcauugacauauuaauacaaccugccccacuucaacuagugagugcccauaccagucauuaaauguuuuuacuaucacccguggaaaaaauuuuauauaaauccauggcuugcuugggauauuuuuuagaauuauuauaauuucucagcuauaggcauuggacauuuuuacagguuuuugcuauacuuuggcaaauuaaccucuaaaaaaccuguacuaguuaacaccagguuugacgguccaauaugcccugcugaacucaaacuuucuaggguauuuguucaagaagucugauggggacagcaaagaaagaaauagagcucuauuugaagucaaauaaagacagauguauagauagagauauugauauagagauagauaguauauuacuuaggauccuggcaagaaacaguggcauugucauaugggguagcugaggagaguguagugaagggauuauuuuaaaaguaugagcaggauuaaggacaaccacuaagguuggcaaaguacccugaggcuaacaacagcugggagcugucacuccuagaccugaugagcaaggugaaggagaaguuccugcaacuuagagagagguguagcaauaugauagcuguagcaaaaggcugcccaaaggagucgugccuuccuacauagcaacacagcaauuucccagcagggaggucaucuggagaauagaaacccuaaccucauucuucucccaaccuccucacaccuccugccagagucucccauuggcugaacccagcugcaagccagagagagcccaguugacccagugguuaaagagcagccuugcagggcacagaacaggcuggaaaaggagagcaguggaucuggaagagccgaugaaagacaugcacuaggcacagcuguagcuguaagcacaggcaucgauuuuuucauuuuaaaucagucugaagacaaagggaagaauggguugaagaaaaaaaaauuaaagauagugaggaaacaaaaucaaaauuccagcccagucuuucacuugcuguagggguaucugagacauagggagguaugagucaguacaucucucccccgagagcaucauguacaacguuucaccuuugccaccucuugcaaaccccucccagcagaguguugguuuuuagaagcacccgggcaaagaacagacaaagggaggauaagcugugggggcggggagaccaagguagucuuauguaacuuacaucuuuaugaaaacucauuuugcuuuuauuuuaagaagugcuauuuaugaauuccccaggggguuaaaaagcuuaagagauggguuuuuuaugugaugucaauagaaaaaucucuaaacuccuggaauaaaugaugcuuuuguuuuggcuuucuguuuuucaaaaaggccaucuguuuucauaaacauaaaugagacucucuagccaccuuuucccuuauaacccucugucucuuugcacaaaugacaacauucccuucgugauucauuccugaagacauucuucugggcuaaaugcggcugcuaaauuuguacuucaguuuucacugugagucccacaugauccuugcucaggcggcaacugcacuauuacagcuuucacuucucgagucccagauugcuauacccuuggguugccagcagcucugcaccaggcuuuaugcaacuggcuucuccuguuuugcaaggguaucugaggucuuugaggcagcccaauaaguagcaacccuucucuaccuaaguccuaagcguguugagaaauaaauggaagauagcagaugaaagcuaaaauaccauguuuauuauugauaaugaauaauuuagcuuaguguaacagcuaaauaggcuugauaauuggacccagaauuaggcagacugacccaccuggugauaggccacguuggaugaggcagaggauaagccagcuccuggaggaacauaaaaaaaaguugccaacugccaagaagaagaaaauugagacucaaccgagaauaaccauauucuuccucaguuuaccauucauguaacucauaccacuaccugugaccaaaggggcaagauggcucacaagaacacuaauggggcucccuucccauggaaauaacuaucaggaauaaagaugaaguuuuccuuccaacggugacauaagugugacagaagcuaaaaaugugccuugacugagccuggucgauaaaauguacucaauaaauacaugucgacuguguguucauuuauuuaacaaauacuuauugaacaaaguuagggccaaaauaaguuuaguuuuugauucuugguacaguagagagcugcuagaaaauucugagcaaggaaaagauaugaugagauuuacauuuuggaaaaauuacucugauugcuucuugaauaauggauuauaagaaggacaaguaugaaaauggagagacgagggccaggcacgguggcucacgccuguaaucccagcacuuugggaggccgaggcaggcgaaucaguugaggucaggaguugcagaccagccuggccaacacggagaaacuccgucucuacuaaaaauacaaaaaauuuagcugggcgugguggugcacacuuguaaucccagcuacucugaagguugaggcagagguugcagugagccaagaucacaccacaacacuccagccugggugacagauagagacccugacucaaaaaaaaaaaaaaaaggaacagaaaagaugaauuagaacacuccugcuguugucuaagcaagaauugaugaugccuaagucagggaugaaaucagagaaggacacaaaggagaaggccacgugggauauaacuugcagauaggguuagcaggauuugcugauggauuggaguuggggaggaacauggucugugagggaaagcaaagaauugagaaugaccuauguuuuuauuugaguaacugaauggauagggguaaaguagaaggggcugguuugggggauugguugaauaaauggauaagugaaugaauaacggugucccuggucacccagucucuuuaggaggcuguagugggcugaucaugcccccguuugccuaggacagcccugguuuacaucugcugauccaguguaauuauuaacagugcugacuaggugcauugacucaugccugugaucccagcauuuugggaggccgaggcuggaggaucauuugagccagggguuucagaccagccugggaaacguaguaagacccugucucuacaaaaaauaaauaaaaauuagucaggugugguggcacgugccuguagucccagcuacucagaaagcugaggugaaaggaucccuuaaguccaggaauucaaauuuauaaugcgcuaugaucacaucacugcacugcagccuaaguaacggagcaagaccuugucucaaacaagcaaacaacaaucaaagaaugcuuccuuucacccucaaaagugaccugcuuuggauggcaaaguacuugguuaccccagcuuagagaauuuuagcuuguuagagaauuguuggggaagugcuuugaaaugugaaaaacaguaaauggaaaaugucaaucagcauuagcuauguuaaugaagauuuguccaaaagcugacucuucuuugcucauuaacuuacacaauuauuuuaggcuacguucuacagcaagcaauaaauggauaagauaaauucuuauccauuuauucaaccaaucccccugucugauugucuuccaagacauguggcucccaacccuagaauggaacucuguuucccagauccucuuccucucuccuuccccaguuguuaaagauuucuaaaacaccauauuuaaucagucuauggggacucucuauuuaaaggaacccaacgguuaaucguuucauagaucaaagcuuuuguuuaggcacuaaccacuuacuuucuacuccacagcguuuccauggcuggguuucccucuaggaaggcacagucuuggaagauaauccucacucauccuggcucugaaauacuuugugaaaugcaaagauccacuuuccagcugccuuuccuucuuaaggaugucuaaauaugcaguugugcccacagaggcauuagcauuucacacaaauaccauauacugggugaggcaugcugauauuuggagaaggacauuuguagauaccaagguucuaggcccucucuacccuuuccugcugugggacucugacacaaauucuuccccucucugggcuuuuaucuucucacagguaagauaggagaagaugccucucugaccucugugugcuucuaccucugugcuuauguccuucauguaaugggaaaagaugcuucaacaucauacucacggggcugggggaguuauagcacaguccucucuuucucaagucaaauuuaaacugacuugagcuuucacacagagauuggggcauguccagaugguucucuuaugaucccuuucccuaguuccucuuccccaccuuguccuagaaccaaggaaauguauacaauccucucccgcauaaaaaggucucuccggcuccuacuccuguauuaguuugcuagguuccauaagacuguaccaaaaacuggguggcuuaaacaacauagugucccaucuggaggcuagaagucugaaaggcaggugucagcaggguugcuuccuuucaagagcugugagaaagacuuguuccaugccucuccauuagcuucuggggguuugcuggcaaccuugggcauuccuucguauauagaggcaucccccagucucugccuucaucuucacaugacauucucccugugugcaugucugugucacuauuuccacugcuuaggagaacacgagucauauuggauuaggggccugcccuacuucaguauaaccucauccuaacuaaacuaauuacaucugcaaugccccuguuuccaaauaaggucacauucuaagguacuagggguuaggauuucaacauaucaauuuugggcaaugcuguuugaccuauaacaccucucaaguauggaaagucucuguuauuguucaauccacugcugugguuacugccauuuugcaucauaggcagcugcuggcccauggcaagcuguccagugcugggcuccugaugugacagagucuuauguucccaacuucccacccaagccuucaugaacuuggaaggaaaggagucuucucagugcuauauuuugccucugguguuccccauuagaccacugagaccaccagguccccuuaguaccauuauccuccaaaaaccccaaggucccaacauaucacaggguucagagcagcuggacaggaaagagcucaugggaaugucaaaaagcccaaaaagccagccagcucucuuuaggggcaaagaugcccaggcaccagaaagaaaagccccauccuauuugucuuuggaauagggaacaaacuaacauuuuuuccaaauuaaucugucaggguccccugcccuccccaagauggcuagagagauuucuuacucuauccacaaaaaaggaaacacaaguuaaguuccccagggaagacccugcuaagaucucugucugccagcuccuuaugcaugcucaaaaccuguuuggcuuuucaaccugugcaucagaauguucugaacauaucucuuuugcugacugauaaguguuugucuuugcccuagucucuggccacagcagaauuggugguggcuugugguuaaguauuggucucaucauuuuuuggggggagggggucacaucacacagucugacacuggaucuugucaagaaaacugugucaaagagccugagcaugaccagagauuuguucaaucaacagucucugggggagcuugaguuacugcagcacaaaugugcuaguuaaagaggcagcuugggggaagaggaaggauuccaagaccugagucuguucccacugccaauaugcccuggcucugagaucccagacagguugcguagccuccccaaguuccaccgcccucccucuugcgaucacucaacggcaugcucaaggagagggaucuggucaguucccaacugcuacugaggccacaagucugggcuuaauucacagaugugccaggguaucccucaucuauugcuguguaacaaacuacccaaaacuugauguuuuaaaacaacuguguauuauuacuucugaguguguggucagcugggcaauucuguuaaucuagauaaagcuuggcuaggcucauucaugcaucugaagugggucugggugaccagccaucuccauuugccugggacugaagagguuccugggguauuggacuuccaguuuuaaaguuaggaaagguccugggugaaaggggaugagcuggucacccuaggucagcugguggaucagcugaaggcugauuguuaucugagaugaaggacugagauggcguggguggggguagacugggccaugugucucaugucauccaguaaacuagccugggcuuguucaccugggcagcugagcaaaguuccaagagaacaggcagggaugagcaagguuucuugaagccugggcucagaacucacauaucacaacuuugccucguccuauugaucaaagcaagucacaggaugagcccacauuuaacagguggggaaauggacuccaccuccuaugggaggagcuacagagucacauugcaaagggguguggauauaaggggggaagaauuguguucauuuugcggugaaucuacugcaagcacaaagagcuuugcuuucugcagcagucagaugcuguaucaaccagcuaccaagaugccaggagccagagugugaugauguaacagaugcuccucuaugugucuagcuuucucuccucucccuuuaguccauguggucccaguaaauacaguuccacucuuugcccggccaacuuuucacuaugggaaaguagcuugcagucccuuccuccaggaagcccacccugaccuccagacugguuuggcauccccccacaccccuggaucaccaugucauucucccacaacccucucugcuuuccugugucacagcacccaccaccagguacugacauugugaggacugggagcuucuugacuugggagauaaucagauuuguuucuguaccccagcaccccacugaaguucugccacauauaggugcuuaggagauugcugagggauggcuugagguccagcuggaauggaagucccaaaaucuuuguucuauccccuuuacucagacccagagcccaucucaggcuccugccagcagcagacuucagcaucacccugcuccugccugccaggcacaagacaaugaucuaaccauggccccaguucugcaaacuagcugaugcuuuuuccauccuuggcacugucuagggugagagucugcacagggaaccauguuaaugaugugggugucaguguggaugucaaaccagagucaggcugugccugcuacaaggguaugacucauuuuuuuaaaucucuacaugcauccaggguaggugccccagccacaguuuugcaggcccuguggacacagaaggagccugguuuagagaggggagggucagauagaccuggggguguccuccacucgucccucacccucaaccccacaccaagucucucucuguguccugacucuuccccuccuacccugccaccuucaccuccaacugggcuaccaacccugcucaagccccauccccuucaccuggagccuucuggcagucggaguggaccuuucuaaauacacgagaauguggugaucagcagcaagacccaggaggcagacuacccaguuucugcugcuccuggcuaggcagccuugggcaauuuucuuaacuuuucugugucuccuuauuuucuuuauuuguaacuagggauaaugauaguuucuguaucuagguugcucuauggauuaguugaggugauauguauaagugugcacuuagaauauucucuggugcagaguuaguugcucaauauauguuagccauccuuguuaucaucucuguccuaccucagacccuucaacagguccccacuggccauaagauaaagguugaacuccugucacaaagaccaggccauuguucuuuauccuucucccuucuucccacugugaacucagauaugaugcuuggagguguggcagccaccucgcaaccaggcagaaaaugcuaaguauggaagaguucaaaugugaaaggagccugggcuuugguaacucuguagaacugccgugccggccugaaccgccucuccccagacuacucauaugcaacaaauaaacuccacuuguucaaugggugaauaaaauguucuggcuucucugccuggcauucaugagccucuaagaguuccuguucccucugcagccucauuucugaaacuauagcccacccuccacuccccugcuuuauguucuagccauacugaacuccauggaaauucuucugcacaccauaguuuugugccucucaaccauuguucaugcuuuucucauucuucuucuguuuggaacuuccuagugcacugucagcuguuuucugccuggcaaaugccuaugcuucaaaacccugcacugauucugccucucuaugaagcuguaacugaccucuucacccauucugggcaaauuaaucaccgcaugacuacaaaauugagcuagaccgacugaaugcaguucccacuucugccacuuauuaguaauuccauucucucugugccucaguuuccuccugaauuaaaugaagcaaauaacaggguuuuaugaagauuaaauaagguaauaagggucaauaacuuagaauagccaauaguaagcagucaauaaguguuuauuaucauccucaucauggauauucuuaagcuuccagaucuauaauucccacuugugcauaaaccuuucaggggcagggauuguaugauucaucucugaauccccuacccaagcauaguaccuggcaccaaaugggcauugggaaaugauggcugaauuugcugaugaaagccucuuaaaaagagaacaugcucuaugcccuuggcauuuccagaaauggagccagugggguccagaagacgaaauaccuucaucuuucugcuauggaacuuucuuaguacaaucacuagcagagcaugucuugacuuacaucaagucaaaagagauaauacaaguaaaagacccccauggagugucaagugugauucagugcugcccacaacacugcugcuggcggugaugauuaguggcugagacaugcaguagaaccugcucugggucucuucuggaccuuaaggacacucccuauucagaaugaagguaaguauaauguggugucagagaaaaaguuaggcaggccucauauagaccaauggaacagaauagaaaacccagaaauaaagccaaauacuuacagucaagugaucuucaacaaagcaaacaacaacauaaaguggggaaaggacacccuauucaacaaaugguacuuggauaauugucaagccacauguagaagaaugaaacuggauccucaucucucaccuuauacaaaaaucaacacaagauagaucaaagacuucagccuaagaccugaaacaauaaaaauucucgaagauaacauuggaaaaacccuucuagauacuggcuuagacaaagacuuuaugaucaagaaccugaaagcaaaugcaacaaaaacaaagauaaguagaugggaccuaaugauaccaaaagguuuuugcacagcaaaagaaauaacagaauaaacaaacaacccacagaguaggagaaaaucuccucaacuauacauccuacaaaggacuaauacucagaaucuacaaggaauucuaacaaaucagcaagaacaaaacaaacaauuucaucaaaaaguaggcuaagaacaugaauagacaguucucaaaagaagguauauaaagggccaacaaagauaugaaaagcugcucaacaucacuaaugaucagggaaaugcaaaucaaaaccacaacacaauacugucucacuccugcaagaauguccguaaucaaaacaucaaaaaguaauagauauuggcauggauguggugaaaagggaacacuuuuaugcugcuggugggaaaguaaacuaguauaaccacuauggaaaauaguguggagauuccuuaaagaacuaaaaguagaacuaccauuugauccagcaaucccaguccuggguagauacccagagaaaaagaagucauuauaugaaaaagauacuuguacaagcauguuuauaagagcacaauucgcaauuucaaaaauaugaaaccagcucaaaugcucaucagucaaugaguggauaaggaaaauguggugcauguauauauauguauacacacacacacacacacacacacacacacacacacacauauauauauaguauuaguccauuuucauguugcugauaaagucauacccaagacugggaacaaaaagaguuuacuuggacuuaccguuccacauggcuagggaggccucagaaucauggcacgaggugaaaggcacuucuuaccugguggcagcaagagaaaaugaugaagcaaaaacagaaaccccugauaaacccaucagaucuugugagacuuuuugacuaucaugagaauagcaugggaaagaucagcccccaugauucaaauaccucccccugugucccucccauaacacacgggaauucugggagauacaagucaaguugagauuuggguggggacacagccaaaccguacuauauagauauauauauguauauauauaguauauaguauauauaguauauagauauauauaguacuauauaguauauauauaguauguauaguguauauauauacacuauauguauacacuauauauauacacuauauauauacuauauauacuauauaguacauauauaucuauauacuacauacuauauauauucuaguauaucuauauaguauauacacuauauauuauauauaguauauauaguaucuauauaguauaucuauauacuauauauacuaguauaucuauauacuauauauacuaguauaucuauauacuauauauacuaguauaucuauauacuauauauacuauauauacuguauauaguauaguauacuauauacuauacacuauauauaguauauauauacacuauaguaugccauauauacacuauauauacuguauauauacauauauacuauauauacauaguauauauaguguauauauacuauauauacauaguauauauaguguauauauacacuauauauacauaguauuuauaguguauauauacuauauacauacuauauauauacuauauacuauacuauauauacacuauauauacacuauauauagauauauagauauauaguacuauauagauauauaugauauauauggauauauaccuauauacgauauauauccauauauaauauauguacauauauguguauauauguguguauauauguauauauaauauauauguacacauacauguauauauauguguauauauauguguguguauauauauauguauguguguguauauauauacacauaccauggaguauuacucagacauaaaaagaaaugaaauaaugcuauuugcagcaaccuggauggaguuagagaccauuauucuaagugaaguaacucaggaauggaaaaccagacaucauauguucucacucauaaugggagcuaagcuaugagggcgcaaaggcauaagaaugguacaauggacuuuggggacucaggggaaaggguaggaggggugugaggaauaaaagacuacacauuggguauagggugcacugcucgggugaugggugcaccaaaaucuccguuaaaaaacuuauucaucuaaccaagaaccaccuguucccccaaaaaaacuauuaaaaaaaaaguucggcaggccuccaguguuucuuggcuauguggcuuguacaaguguuuucagcuuguugggcuucaguuuccacaccuguuaaaaugaguuuacagcauaggauuuuuaugaauauaacaauuguuauauucauacaaacgugaagcaacuagcauagugccuggccugcaguaaaugcucaacaaaugucccuuccccuuuccuucucucacucucccucucaccccuguccucucagaucgucugugccauugggcagagggaaauucuguccucccaaugaacugguauguggggucaggugucugguaagcaggcugguucucuacauuaaacaugcugccuucacucagggacaaggucuagggaccuuuuaggcagaaggaccauguuuaugcauguaugugcaaccugcuuucccugcagcgcaccuugggccugcagaaauagcucccucagagcugaagagucagccagccuuguaugaacagggacuauggauccucauaugggcccauguccacuugaccaggcugcauggcucagcaugcugugcagcagaugaacagcuggcccagggaguucccaaugggcuccugcacacugccugggagccaggagggagaccuuccaggaccugccaccuggugccagggaggggugagcccgcaaacccaacaacuagaccagaugggugacugggcagccagggaauguggaggaggacucgaaggcuguccagagcuugccauuucaucucucucagaccuaguuuccucaucugcaaaaucaggcuaaagaaaauuaaauaaguuuugggauuccgguggagcuagaaaauaauacuuaucuuccuggccuaaaaucaaaauuaauuaagacauagaggagucagacagauaacaauaauaauaaauaaauaaauaaauaaauaauaacagcaaauacuuuauagcaucaugaccacuaguuaagcauuaauacuuauuuaguauuuccuauuugucaaacucuguucuaagcccuuuaugauguuaacuaauacaacauuucuauaagguagguacuauucuuagccccauuugauggaugaagaaaccaaggcacugaaaguuuaauuaauuuuucccauaucacagaacuaguaacuggaagacuaggauuuaaugccagguggucuggcuuccaaggccaugaucuugaccacugcccuccaccaauuaccauggaaagcccacagggcagcuuuagaucugcacacagggucuugcuaacacuucgaccuauaguuagacagacuuggccaucccgucaaggagaggagaagagcugugcuuuccauaggccacuucauaggccauacaggggguacugggugaggcagguccgguuccuucucccacacccaccaacccaaucauugucacucagauuaccacaaacuugcuaauuuguaacuggggguaaugauaguaccuguguccauguugugcuguggauuagcugaggugguaugucuaagugcgcacuugggucauuuucuggugcagaguuaguacucaacccauguuagccauucuuguuaucaucucuucucuacugcaaacccuucaauggguccccacugaccacaagauaaagguugaacuccuuucacagagaacaaguuguugcugacuuaaaacaacagaaacauaugcuaucacaguuggacaggcuaaaagucugcaguccagguauuggcgaaguggcuccuucuggaggcucugagagaauccacuccaugcuccucuccuagcuauggcggcugucagcacuccacagcacuccuuggccuggggacacacaucacugcagucuccacccccacuucacauggccuuccccucugugucuuuguguguccuuucugucugguaaggagccccucguuggauuuagagcccacccuaauccaguguggucuuauaucaaucuuuuaauuacaucugcaaaaccauguuuccaaauaagauuacauucagagauuuucaguggacaugaauuuugaaggcacacguuucaaccaugaaaaggagaaauuaguaauggaauaagguaaggcaagaguguucccauaagggaaguuuauccucaagaagacguaaugugggcaaagagguuuccuccugggauuaguagacacuggcguggcugcuuuaacagagaucagaacagugguggccaaagcauaaaagaagcuuguuucucuugcacauaaaaucucagccagggggauagagauguucuacuucacaagguucuucagggcuucuuuuaucuuuuucuaacaugcuguucaagaugcccuuaaccccagagacaaagauggcucacuaaaaagggccaugcuuuagccaguaggugguggaagaggaaguggaaggcaaccggcuuuuuucuaaaacugcaagcaaaaaguugcacauaacaccucugcucacacccauuggcccaaacuuagacagucaugccucacugcaagggaauccgggaaaucuagucuuuggcugagaggucauggaaccagcuaaaacucaaaggauuaaauuucuaaaugaaagauggggagauugaucauugagggacaacuagaauaaaguaugagaaauaccugauacaggguaagaggucaguaaauuguaauguugaucuucugccaugauauugcugacaacuuauucucacuggugacaugcugauaagccucuauauucaccccugacccuggcaccugucacuguaguaacccaaguacagacagauuaugacuccacagucuugagaugggccgcuuuuucuucacacuccuuuaccuggcuccccaagucugcugcucuccgagaugcccccaucuccaucucagcccugcaccccagguugcaaaguccuggagaagagaggcucuccccaagucccccgagcucugacugccaggaauacccuguguucuggaaucugaacccccaggcacugcaugccuugcccauucugcacgguugccuuccuggauacuagaggaguuuguggaaagaauuuucuaucauuagagggugaaagucaaaacaguaauuacaagaacaucaguuucugaguggaaagcauauccccugcacaccaggagauaugccugcacagaucaacaagcaggauguuaaaauggaagagaguguucugggagggaggacuaauggccccagccaugauggaggcucugcuuccugggaggaugcugcacuggggaauagggaggaaggagaguagggaaugagugagugagugcauggagaagggagugaaugaaggauagaaagaaugaaaaugguaaaugaaugauuuacuuaaugaaugaauaaaugaagaaauaaauaaguaaaaaaugaauucgugaauaaauaaaucaacaagaaaauaaaugaagaagcuaacaagugaaugagugaacaagugugauuuugaggaaauaaaugagugaaaauugggggaacugaauaugagcuuuggccagcaggugguggaagaggaaguggaaggcaucuguaaaugaaugacugagucaguauuaaguagaaaugaauaaauaauagaauaauugauugagugaacgagugagugaaccaguagucaaaucacucuucuuuucuggacagaugcgaucggcagcaagacugggguuguagggcaggacuggagcucuaucuaccuagaggcucaacaucugggucagccacacauuaggaggccaggagggcgggcaaagcuggaagagucauguaauuauaauuaugagaggugggauaaauguuaaaagcaucugguccagccccaucccccuuuuuacagaugcgaaaacuaaggacaaaaggaaugacaaaaagcuugaaaacaagacauuugaaaacaggcuagccauguuaucuugggcaauuuauucuuuuuauuucauuuuuaaauuuaauccuuagauuucaguuucuguauucgcaaaauaagggugaugcuaccuagugcguaggguaagauuaaaucagauacuacaugccaacuguuauucccugugguguuuauuuggugaucaaucgauaguuugaaccuagacacagcaguccggguagacuaagauaagauauaacagcaaagaacccccaaacccagcgauguugacucaacaaagaugcguuuccugcucauaucacagaugagggccauguagagccccccucuuauagcucugcauucuggaaaucauggcuuugagggucaccaccacagaagaggaacaguacagaggggcucauuguuucuuggccuggaaauuacacaucuccaugccacucacuucaaccucucuauaaggaaaguggauauuggcugcgaagaacaggggcuuuucagugagcacugaccaugucuaccauauacuaggguuauuuggggcuugugauccugguccaauagaggugauggucugaggaggaguacuucuccagcuguagacccaugcuagcagcuuccucaguggcugguggccauugaaacuccagauuuagagucagagaauuggugaauccaucucuccugccuguaugauccugugcaaauuauucaacaucccuaagccucagauaccuucucuauaagaaaaggauaauaucaugcauauaucacauguugauugaggcguaaaugugacaguguguguagaaucaauuucagaaguauaaacuacaaugagaaaugauauucuucucauucuacucaccuuccccauuccuucaugagaguacuaauccuuacugaguacagugucacagucaauaugucaagagucuuaccuccuaauuuaaucuucauugcaccaaugcaaggguugugcuauuaacucugauuuacagguaaggaccuggaggcuucucagggagaagaaauaaguuguugagaccuuguagcuaucaugacagagccaggcucaaccccagccaucuuauuccaaggcagggucuugccugugucuguagucuccuaugccuuggcuaguaugacuacaacuuugcaaggggagaucauucuuucuuccuaaaggaaauuuaccaaaauguucugguguggccagaaaagcuuaagugucuaugaguauuuuuuauuuguggaaauguuacaaaaguagauuuucuuacuuuugauuaugcacauuccccagcaaaucugcagaaaguccuaagcagagauuaggugggacacacaaggaugcaggggcaagcagcccagagugcaggaggagggucccuggguccugggcaagcugggaucgacuucugagagcagagguaagcugcacagcauaauugugcuagcuuugcagguaggacguguaguggaaugaggacgauucugcccucucaccagagguuagaacuccccagacuaguuagaacaugcuggucaggaaguucagccacuucagccaagguuuccugagcauuugcugguucccugcugcuguagauacaaugguaaaaauacacuguccaaggccuucuggaguucacaguagcgggaccaacagacagaauuuaccaauacaguacaguaggauuaugguagaaagcaaggagguauggaacccucaggggagguuuuacagaggaggcagcuuguggacgaggccuuagaagaggaguagaaguguggagaucaguagauaggauguuccaggcagacacacagcaggaacagaauuguggaggaauagaaggacaaugcacagugaagaaacuguagcucugaaaacugccugggugaguacuaggagaguacugaguuacagauggcaagaccugggucuucuuuaccacuguagcuguagcacauagagcacagagccaggcaugcuguagggacucggcacacauucgcugagugcaugaguaagugagugaagguaugaaagaaagagagaaagcaacagaagagaaggaaaagaagucagagauuuacuccacguugcagcacagauuauugaggacagccgcccaggguguuaaagaccuguaugaagggaauagguucacaaagauguauuggaucucuggguguccaggacagaaacugaggcucagagagagccucaguuauggcuugucuuauugcauauccaauaaaugggacuuagaaugaccaacuaaugucguauaguccugggcucuguguccugcacugcuacuaacuggggagcuccugcacugucccaucuccucucugacuacaauuuccucccuugaaauaagugaucuccaaguccccuucagguccuccuucucaacccaucucacucauuccgcaaacauucacugagcauccuugugugucaugcuugguccugcaggagaucagagagaggguccccacuccugcccaaccccucaacuugaucacauugucagccuuugucauauauuuuuaaaaugcuuauguugucugcugucucaccagacucaaaguuacuugggggcauauuugauccuugugcuuccuuaaauuauuuuuggagcaaggcagagaguaaauacauagauuaauuaguguauugauuauuuuuucuuugucccagagcaccuuagacugguaggcauucacaggagacauuuaucggagacagucaaauaagcagagcauugcacaaaggggacaauugcaccagcaggggagaaagaaaaggagggugcuggaagcucaggauggaccucugaucuagacagagggugaggaaggcuuucaggaggagguaaccuuccacugagucuucaaggacaaggaguuacucagggaaagaugagggugacugagacuaaggaaacagcauguagaaagugcuggaggccugagaaagccuugcccauuucaggaucuacaaguaauuucuggugaugccagaaucucgcccuucaccucuucccuccaagacucccuggugggguaugcguuacacacaacgugaacagggaccagagaggaaucaaucuauccaugcugacaagcaccucgcacaucacucuuccaugcaggacuuauugauuggugcugggcugccaacuugggcaggagcuacaauggucugugcaggacagacucuacagucacuuccucaggcugccaaguggccggagccacagugcaagcccagaccugucccucuggaguuuccuggauaccuuuaacaccacccagucuucccucuaggcaggagaacacagugugccuucacuucugcugggagaggccaguccuaaccguugacauuuucuauguaacugaagcucaccucucuuagggaauaacuuaaacacuuuauuuaaaguuuaaauauuuuugaaguuaaauuaguucuauaguagacaacauguaggaaggaugggauggcuggcaggugggaaggguggggggauaaaaggaagaaaugagggucaaggaacccagucaggaggcuucagaauuccagacaugacccagauacacaucuucauguuuauaucccagaucucagggagaaagccuaggccaggauacucuuagagugggaaugaggaagaagagaaaggaggcagggaggaagagaaggaagagaaggaagggacggagggagggagggaggaaaggaggaaaggaggggagggggagagggagggaaagaaggaagguaaaaaggaagggagggagggaaggaaggauggaagggagggagggagggagggaaaggcggaccauuaaacuacuuggaaacaaacaucaacuauuauuuaaacaucaaauauuauuaaagaacaaaaacagcagguuuccggagcacucuggagucuaucuugauagguugacguugcucugggguuaauaugaggaaauggcauucuuaaaaacccauauuaaccugucuguuguucuauggacugugacagcugcauuuuacaucauaauggcuaaccauuuauuucaagccaaaaaaaaaaaaaagagagagagagacauauuuuagcccaugaagcaaaagcucaaggcuggaagcuuugcccuagaaacagguugugaagcagaaguucagaguaggucaaauguggguuccacaggagccccuacugugugccccaccuccauuggcccagauacuccggaucugucccucuucugggucccgcuaggguuugccucucuaggccuuccuuggggcuguuguggucucaggggagacaagcuacucacuuggauaauggugagguccugguagcaaacaguacaggaaagggcccugagugcaggggaaaggaagggagagcuuguggagagcagagaagggagggucgagcugacccagcuucagauuugaacugcauggaaaugcacucauucaacaaguauuuuuugaguaccuacuaugugcccugcccugguccagagcagugaacaaaauagguaagggucuacugcaugcuuggcccccugaggacaccccgguggacaacauacaggugggccugcuucagagggcuuauauucuagcuggggagauaggcauuaaucagaucaucacucugguaagugugaucacaagggcucugagaauguagaguagaggaaacuccuuccucugaggggccaaggagcucuccugcaagugaguaaggcuaagcugagagcugaaggggaagaggggacucccagccuuggggacggcacuuacuccuugagcauaauuaccugaaagaugccugguuuggauggagcugggggaacaaggggcccugaugggaacauaacaucagcagggggucaggggacaaaguagacauguaauguuuauuuaagagugguaugguuuggauguuuuguucccuccaaaucucauguugaaaugugaccuccaguguuggaggugggccuagugggagguguuugggacauggggacagaucugucaugaaugguuuggugcucucuucaugguaaugagugaguucucacucuaugaguuuaugugagaucugguuguuuagaagaacauggcaccuccucucucucucucacucccucucuugccaugugaugugcuggcucccuuucuccuuccccgaugauuggaagcuuccugaggcccucaccagaagcagaugccaacacuaugcuuccuguacagccugcagaaccaugagccaauuaaaccucuuuuuuuuuaauuacccaacaucagguauuccuuuauagcaacacaaaagccaacuagcacaagcagcaagaggaagcucuugaggagcuugaacaaggggugacauaagccuucagguuuuugcacuguuuuuaaaacuuuucacacccaguguuuuugagucugaaagcaaucugguaaggcagugaguuugggguucuuguccuaaccugacagaucagaaaacugaaguccuuccaaaauggaugacuuaccuuaccuaagaucacuaagaauugaacgagugagaggaugagggucuaagucuuccugcucaggggcugguugaagaaucagagagaagaaagggggccucguagacccacacacagcaugagcaaugguauaacauggugucaggggaaccuugcaugguuuggagaagagccccagugugaaaggacccagcacugugccucguacauggcagaugcucagaaaacuacccuuccccuucuuucagccgcaagaaccacugcuucgguuucccacacugccuggccaccaucaugccaccuucuagguuaagggguguuugggcagauacuugguuuugguaggggugugagagaagggagacagguugucuugugcuccuuacccaagucgggauccaucuuuccuagcucugauuguucugcugggugacuugccucugcccagacaccgugcaaggaaacaugagaagaaaauuucccaggauuucugcugcucugccccuggcccuugcugcaauguucuacagugcuuuggucagaaaaaguccucaucagaaugaucugcuuuggacauguauucacacaagaagaaucaucuaauauucauuuacaaaauccuuuucauacauuuuucucauuuaauccccauaacaaucuugugagguaguuacucauuacugacauuuuauaaaaggguuuugaauugguuguuauucauggcacacauaacaaaccaaaaccugagcacagguccucucugaccccagucuagucaucuucuagcuucgugacaagugucuaucuugguaucauccuuuaguacugccuauucagagacaucacaacaaacuuuccccgcaguaaggcaagugauggaaagccauucuaaaaaugugcccagaaucuuuagaagaacaaacauccauguaauuagucuuugguauguuuuguucaguguauaccuuucuucugcaucaguuuaagguuggcagcucuucuguccucuugaugaaugccguuggguuuuccugugcauugaaaaggugaguuuggacaucuuccugcucacuaaaaggaugaacauugaccauuuugggaggcuauguccaggaagucaugcuucagggagcccagagcucagaauugcaguuccuucucuuugcauauccauuggacaucaguagagggcugccagccagcacaaacacuguggcauuggaagggguuggaggaaugcagcuggcucccagccccuuguuuucccguuccacuggaagguuguguucauucgagcuuuuaaaccaaaaauaaauuguuguaauccauuugcuaauuauaccaugcuaaaguucuagacgcuguaaauuacagccaugauauaucuagaugaaguuucugggaguuuauuuuuagccauccagaaagcacucaguuuccuagaggcuucauuugcaagucuaggagggaacagggaaaaugcaucugcacaaccuuucuuggccuaugaccuggagacgaugaaccucuccgguucuccucuguaaaagaaagugguuguagccguucacuuugaaggucuugucuaucuucaaagcucuaacucucauuuucugacuaagcaaaguagaauguagccaaacauggguuuucaguuccugguugaucauggagaauaucaaaagccaccacaccaacauauuaauauuugugaaccauggaacacagaucuucagaaaccucaggcucaauggacacauugcguuucuuuucuaguccucaauuuugaggaguggagagaggauggaaggauuuuauguuuauuuagcacguacucuuugcauaauacacugcuuggugcuugcauuugagugauauuuggauggccuucuccauucaaggacaaugucaucuaauuuuaaucaaucagucacucauugacaucugugugccagccacugggguugguucugaaaauaucuaggguaaauuagaugcaucucuuaccuccaaggagacaggagguggagauaaagcaugcaaugaaaauguugaagugcuuuuugaaaugcacuauuaucuacaaaugauuaaauaccaagugccagcagagagaacacagagagauacauugugagggguagggggagugucuagguucaucugugccuguugggggaggagaaucagggaagacuucagggauaaugagguauuugagccagggaugauauguaaauaugauuuuaaaauguggggauuggguaagggaaauuggacagaucuaguuuaguaaccucggaaagcgccccggccaggucccauggaugacuguccuugaccagucauuaacacaugacacacagagcacaucucuuccccaaacaccacaacuucuagcaaguuuucuucaauuuugaccauaguaugauuauuuuuucaaagagucaacauaaaaaauccuuuggaacaauuccuuugucuggaugcuucuuguguuuagacuucuagauaagcaaucuucuacuauacuuguguaauucuuggguggagagauggaugcauggucagauggaugaauggaugguuucauaucauuguagagcugccacagcaaagagauggaagcagugaaacugguuuggcucgcuaauagcuuugugggaagagcugagcuuuaaacaauaaacagaauuuucucagcacacaguauggauaaaggccuucccuucagagggaagcaaaaugagagcaugaaauccaugacaucguggaagaauggugagucacagaagccaugguauaggaaggcaggaugaguuaauguaguggcugagagcacaggcuaugauuggauggacugcgguuugaaucccuguucugccacauaguagcugagugauccugggcaaauuaggucacuuuuccaagcuucuauuuucucaucuguaaaauaggaauauuaauaaugucuaccucgugugguuauugugaagauuaaguagaauaaaauaauguuuagcacagugauugguaugcccuuaauaaaguguaguuuaugguuauuauuuuauaaaaaaacacuucuaauuaaauuaugaaaaugcccauucaaaccacagaauuugugaaggagucagagaaaguccuuggggggaaagaagaaccaggagaaacugguguugcugauauggaggcaggaauuucuagagggaaggggucccugcuagcaaaugacccagagaggccacugcagauugagaagaagugucuggaauaugcagugacaacaucccuaugaucuuaaagaaagaggcugaaagccacaaggcaacgauuugugaagagugugggaguggaggaagugguggucuagaugacucuuucaggaaaucucucugaaaaggagaaaaggaacuugggggcaggacaggggacaaggucaugggaagggcuguuugcuagaugaagaaauuugaacucaacacaguguuuuuugaccuuucuaaacucaugccugcuuugauagacauaaacaucacucuccccugcaagacugauguucuggcacccaagaccuaacaccaggcuuauuugagagccacaucugccaggaggauuuugucaggauuuacuuucugugcuguauuuuuaaaacaguaggaauuuaaugaucugugagaaccaagcagguaagaaaugauggaggcauuguaggucauaacaaggauggauuugaaagaugauaagaaggcugaaccgagcaggagugaggagugaggggcagaggcgagucagagggauccugggguucuggcauugaggacugaauaaaucacugcaccaacugguguguguccuuuuucuuuguggguucccaccucuaccugccuaggugacauuauacagguuuaagaccaaauaacagacguggucauuguuuagaaacuuuuaaguacuuuaucaguguagggcauuguuagugauacuguuauaaagaaaaaagagcauaccuugaucuuuccuugugcacugugucuuugucagugaguauaauuuuaaauggugugagggaacuaauguguauugcucacauaccuuauuacaggugaggaaauggagaugcagaaacauuuaaagaaagccagcccaagaucaacccgacagccagagaaugcacacucuuucuaagcacauauaaaacacucacgaaaguggacuguauccuaggccguaaaauacaauccaguaaauuucaaggagucaguauccuacagaccauauucaccuaccacagugcaauuaaguuagaacucaguaacagaaagaugagauguuuuuuaaaaaccuauauugagauauauuuauaaaaauacuuccaacuaacucucagaucaaaaagaaaugauaacagaaauuauaaaaugauuauaaaugaaugaccaaagaaauauuaaauaucaaaaguuguggaauauagccaagacagcacuuagagagaaauuuaucaccuuaaaugcuuauauuaaaaaagaagagcugaaaauuaaugaauggguuaaguauccaauuuaggaacaacagcaaauauaaguaaauaaaccagcccagaguugugcagucagaagugguggggccaggauuugggcauagcuauggcuggcucaaaucccucacucucuuuacuccacugguaccuuucucugugcugcuuuccauuauaugcccaguaccuggagauucucucucccuaagaguugaagagaugaggcuacaaaguaacucccugcaugaaagcuugaugauaaaucccacucauuuucucagccauccuuuuacuuguccaucaacuacuuaaugagcauuugccaugugccaggcacugugcuaguagcuacuuuaguugcaucuuuccucugagcguucaaacacuagacuucagcuugggaccaaagcucauacugcugcuacuaaugcccaugcccacgucucacccccaccucccaagcugccagaaucuucucuacugcuuaucagaacagcauccucaucaaaaaugacugauuugucucuugucucuuucaacagguagacugaaauuaccauguguccaaauuaaaauugcauacuucaaggauuauuugaaggacuauucuuagacccuuuuaagaagauuuaaagaaaagugaguugauuuuuuuuacacuucagagaguauucaugauuuaaguuaauguuauggguucuuuuuuucucuaccucuuaaauaugcauuaauagguagacuuuaucuucauuuauuuuacaauaaagauuuuuuuuucccuaagaacaaugaacaaagagugcaggauuacugcuugccuucccugcaagauuuuuauauguuucaaaggcuuguggaaucuuagagauaaaaggguuuuagagguacggaccauucccuccuggaugcugggaaacccacaacagcaucucuauagaucccuggccuguucuuggaaacuugcagggacugguuuggagguugguaucuccccacacuuaggauuuuuguagagcucucccauaaucuggacuugaaauucacuccacgucuugccaagucucuuucuucucuacuagacauccuaaaauaggugaauguaaacagcaugucccuccucaagaucuuuucuuguuauuuguuccuccaaucauuucucauaaguugguuucaagagcagcucccacccuggucacuuggaauacagacagagcaccuccagugaucuuugcccaguauauggaugagaaucaaagcaggguaaacccaaagagcaggccuggguucagccccaguucuacucuuguuguguuuucaggaaagucacuucaucauucugagcuuggugaaaacaaggaagguaggaagagauagucacuaccaugccucugaccuccacuuggaucguuuugcugacucagaguaaagaaguugcugcuucuuaccaucucaggcacuggaaugggccaggucuugggaauccauggaaucuggguccaauccaagcccuaucacuugcugacuauguggccauagacugccauuucucaucucugaucaucuguuuccucauuuguuaaaugaggaugccaauaaauguugcaaaggguugcgugaggauguacugagauaauguacauaaagcaccuaguaccugguacauagaaaguguucaaaacauggcaguugcuaguaugauuauaaguaauggcagaacuacuuaccuuuagccagaggagaagauaggaggugcuagagacucucauaaggagagaaaagaacgggcauacucauuagggauacaguaguguucacaucucauaaacucucaugcaaacauaagcccaaccucagaaaauucaugagguuaaaacucuacuucucagagucagacaaggaugauggguugcuauggaaauauacaguuaaaagggaaauuuuagaguggguccgagaagcugcacaaauccugccaaucucucacugaugccauagccccgguccuagaugguaaggauuagagccccccagaaugaagguccuuaaacacacagacugggaggccugcaaaucaucaaauauuuauauauguucagaaggcugguggugaguguuggaugagagauugaguguuuuguaaacuguaaaguuuccuacaaauauaugugccuuugugugauucauguauuauggacuguaucaauacuuugcaaaucagaagaaaggggggaacucagaugagcugacuguguaaugaaccuguagaguccagccccacugauuucugagugaaauagcauauacguaugcaugcauguacauaucuguauacacacgucuaugcaugugugugcaugcacacguguguguuugugcauaugugugugaaucuuugacccuuuggagguagucaccacucuuuauccagugacuggcugccucuaaggaguauaacagaggaaugaaaacacaggcuauggugucagucagccuagcucuauaacuuacaaguuauguggccuuggucacauuauuugauaagagugguacaguuuucgccuuccuggagcugaaagucuguggauagggcugcucucaggagcugggaggaugcagcauaggauguaucucucacaccaagaaagugcuuaggauaugggagagucuuucucccuugguuaguggcuuuuuucuguuuguuuuucucagaguuuagggaauguuguguuaacucguuagauaaaaggaaccucugaagguaucuuugguuccauaagaccaugccccugaagaccuagguaccucgguggcuagagagacuguguaggaaaacguacccucuaguaccuguugaaagggcuaauuucagagguguuuccacaccuuggccauccuucugagucucuucccucagucugggccauggggcuggcaauuauuaaauucagaagaauuggaaacugguaucacucaagguauaggacaaaguauuuucuuuaaauuuggaaauuaaauauagcuaacauccuuguucuccagacaguggcucacaguagauacagagguguugauccaggccaauguugguguggaugccacaggcuagaaaugccccuuucugggcuauucugacccaggaaagacugcauaauuguguaucacagggugcuucaaauuguggguuguaguccaguaacaggucaugaaauuaauuugguggcucaagaucagcauuuauuaaaguaaaaacagaguaaccuaguaacccacagaguggguaaagauguuguauauuugcacuccauauacucaacaaaggucucauauccaaauauauaugguagaaaaaaaagaagaaacuccuauaaaucaguaagaaaagacagacagccuaauagaaaaaugggcaaaagacucagauacuucauaaaagaagauguccaaauagccaaaaaagcacauaacauuuuuacucuucagggaaugacaaauuaaaaccauaaugaaauacuacuauguacucaucagaauggcugaaauaaaaaauauagacucuaucuaguguuggcaaagaugugaaacaaccgaaacuuacacacuguuagcugaaauguaauugguuugaugacacuggaaaacuguuuggcaauaucagcuaaagcugaacauauacauaccagcacuuucacuccuuggaauauaccccugagauauguacacagauauccaccaaaacacauggccaucagcccuggaauggaucaaggguagcauauucacauaguggaauauugcacauagcaauauugaugaaccucagaagcaugaaggugaaagaaagaagcaggcacaaagaaacuuuaugacugcacuuuaaaaaaguacaaagccagguaaaacuacucuguguuuucagaagucuggauggugguugcccccgagggaggaguugguaaaugggaaggagugcaaaggggcucucuagucacauucugccuuuuaauucagagguaggagggcagguuaaauggguguugucaauuuguagaaaugcaucaaucuauucauuuaugauauguacccucuacuguacuuaagucauacuucaauaaaaguuuauaaaaugagcauaacagaggagaaaauauagcaggucauaaggacaaacaucauuaagugaaacuucaguuacaugucccucuaaauauguguguauagaccaaguugagguaugaaauguauuucuuuuuuaaauuuuuuuuaauuuuuaguuuuuauggguucauaguagguauauauauuuauggggcacgugagauauuuugauacaggcauacaaugcaugcugaucauaucagguuaaaugggguauccaucaccucaagcauuuaucauuuauuuguguuauaaauauugaaauuauacaguuuguuauuuuuaaauguacaauaaauuauuguugacuguaaucaaccuguuaugcuaucaaauacuaaauuuuauuuauucuaacuauauuuuuuguacccauuagccauccccacuuccccaugcucacuacccuucccaaccucugguaaucauccuuacauucuuuaucuccaugaguucaauuguuuuaauuuuuaguucccacagaugagugagaacaugcaaaguuugucuuucugugccuggcuuauuuugcuuaacauaauauccuccaguuccauccauguuguugcaaaugacaggaucucuuuauuuuuuauggcugaauauuacuccauugugaauauguuccauauuuucuuuauccauucaucuguugauggacacuuagacugcuuccaaauuuugccuauuguaaguagugccacgauacacauggaagugcagauaucucuucaauauacugauuuccuuucuuugggguauguaccuaguaauagaauugccagaucauaugguaguuuuauuuuuaguuuuuugaggaaccuccaaacuguucuccauagcgguuguacuaauuuucacucccuuuucuccaccuccucgccagcauucauuauugccugcuuuuuggauaaaagccauuuuaaaugggaugaaaugaugucucauguaguuuugauuugcuuuucucugauaaucaaugauguugagcacuuuuucaucuaccuguuugccauccguaugucuucuuuugacauucuucuauucagaucuuuuguuuacuuuuuaaucaaauuauuauauuuuuuuccugccgaguugccuuagguccuuauauauucugauuauuaaugcgucgucagaugaauaguugguaaacauuuucucccauucuguggguugucucuuuacuuuguugauauuguuuuucuuugcugugcagaggcuuuucaacuugaugugauccaauuuaucuauuuuuccuuugguugucugugcuugugaguuuuacuuggaaaaucuuugccuaguccaguguccuggagaguuucucuaauguuuucuuuuaguaguuuccuaguuucaggucuuacauuuaagucauuaauccacuuugauugauguuuuuacauggugagagguagggaucuaguuucauucuucugcauauggauaccuuguuuucccagcaccauuuauuuauuuauuuuuauuuuuuauuuuauuuauuuauuuuuauuauacuuuaaguucuaggauacaugugcacaacaugcagguuuguuacauauguauacaugugccauguugcugugcugcacccauuagcucgucauuuacauuagguuauuuauccuaaugcuaucccuccccacucccuccaccccacaacaggcuccauugugugauguuccccacccuauguccaaguguucucauuguuaaauuccgaccuaugagugagaacaugcaguguuugguuuucuguccuugcgauaguuugcucagaaugaugguuuccagcuucauccaugucccuacaaaggacaugaacucaucauuuuuuauggcugcauaguauuccaugguguauaugugccacauuuucuuaauccagucuaucauugaugggcauuuggguugguuccaagucuuugcuauugugaauagugccacaauaaacauacgugugcaugugucuuuauaguagcaugauuuauaauccuuuggguauauagccaguaaugggaucgcugggucaaaugguauuucuaguucuagauccuugaggaaucaccgcacugucuuccacaaugguugaacuaguuuacacucccaccaacagcguaaaaguguuccuauuucuccacauccucuccagcacauguuguuuccugacuuuuuaaugaucaccauucuaacuggugugagaugguaucucauugugguuuugauuugcauuucucugauggccagugaugaugagcauuuuuuucaugucccagcaccauuuacugaagagaguguccuuuccccaguguguguucuugguaccuuuguuguaaaugaguucacuguagguaugcagauuuguuucugaguucucuauucuguuccauuggucuaugugucuguuuuuauaccaguaccaugcuguuuugguuacuauagcucuguaguauaauuugaagucagguaaugugauuccucuagauguguucuuuuugcuuuggauagcuuugccuauuccaggucuuuuguggcuccaucuaaaauuuaggauuguuuuuucuauugcugugaagaaugucuuugguauuuuaauaggaauugcauucaaucuguggauuccuuuugguagcaugaguauuuuaacaauauugauucuuccaauccauaaacaagaaauaucuuucuauuuuuugguguccucuucaauuucuugucaauguuuuacaguuuucauuguagagaucuuuuauuucuuugguaaauuuuauuccuagguauuuaacaacuuuauuuauagcuguuauaaaugggauuacauucuuaauuuuuuuuucugauuguuugcuguuggcauauagaaauccuacugauauuuuuacauugauuuuguacccugcaacuuuacugaauuuguuuaucaguucuaaaaauuuuuugauggagucuuuagcuuuuuccaaauguaaggucacaucaucugcaaacaaggauaauuugacuucuuccuuuccaauuuggaugcccuuuauuucuuucucuugucugauugcucuagcuccaguacuauguuaaauaacaguggcaagagugggcaucauuguuacguuccacaucuuagaggaaaggcuuuuaguuuuuccccacucaauaugauuccagcugugaaucuguuacauauggcuuuuauuguguugagguauguucuuucuauaccaaguuuuuuagaauuuuuaucauaaaagaauuuugucaaaugccuuuucagcaucaauugaaaugauuauaugauuuucauucuucauucuauuaauaugauauaucacauugauugauuuuuguauguugaaccauccuugcaucugggaauaaauuccacuugguuaugaugagugaucuuuuuaaugaguuguugaauucaguuuucuaguguuuuguuccauugauguucaucaaucauauuggccuaguuuuguuuguuugguuuuguuuauuuguuugaugcaucuuugucuggcuuggguaucaggguaauauuggccuuguagaaugaguuuggaaguauuccuccuccucuauuuuucaggauaguuugaguaggauugguauuaguucuuuuuaaaauauuuggugaaauucagcagugaagccaucaggucccaggcuuuucuuugcugagagacuuuuuauuauggcuucagucucauuacuugucauuagucuguucagguuuuggauuucuucaugguuuaauauuuguaggauguguaugucuaggaauuuauccacuucuucuagguuuuccaauuuauuggcauacaguugcucauaguagucucuaauguuccuuugaauuuaugcagugucaguuguaaugucuccuuuuucaucucugauuuuauuugggucuucucuguuucuuagucuucaaauguauuucuuaauguugagucacagucagaaaauaagagccgcugauuuaaucuaauccuuccauuuucaggugaggaaucugaggcccagagaagaagggaauuaggagcagagguaggaggaagacagagcuaggaagaagucucuaggucuccugcugcugaugauucuguguuaagccuguuuucacugccuugaaugguauauucacauuaauaggcuccgucuagcaccuuaaucucagggaggcaaccugguacuuuugguccaaggggaaagauuguuuuuccacccacagacgguagagucagaggcccagcuaccucugcagggaccuggcuccagguccacagauccccucccucuuccuuccugccucuucugucuaaaucagcuucccucagagcagcagaaacgccacugcacuaaauccuguuuucauuuguggaagacgacugucaugccaaagcuguuugaugguuuuagaaguuagaaaacugugaagaaaauacauuuggagaauaagaucugacaacgaaggcuucuauucuggcuuggugcuuuuauuuuauuacaaaaaugugaguccauuaagcagacuucuucugugguggucaaacagugcuaccaggcuuccagaguacaagaacaagauguagcccuguuucugccaggcagagcagcccagaaaagggaaauguggggauuuuaaaggcucagucugagccucacacaagacuuggaagcgucuuaaacaggaggguaaauaagaucaguggauugcugacuauuuugacuaugacccacagcacaaaacacaugggauaucuacuuaggacacauccccacccacucagguaaauaggugaggcuuaggacugaccaguccagaccaucaaaguaagggcauuuagcccaaccuuggggguagggagcccggagggaaggggaugguaugucuucaaagaagguuucaaaucucaagaggcuugagcaaaggauuaaagaaagggaaaccacacagcagagguugcugaggacuggcuagcaggugggaaccuggucuaaaggaagccauguugcacgccggaacugccuaugauucuggggaguugaaguugaggaggcauauagggagagaugggagacgauccagaagacauuggcaggggcagaugugaagggcucugugcccugacaaggaguguccagagugaauaagagaccaugccugagagucaucuaggcaagaaaugccugucaccuaggagacagaauaaaagauguaagcggacauaaggaauguugguuccaucuucaaauuuuguauuauagcacucacuuaugccaucuguauuacucagcguucucuagagggacagaacuaauggaaaauacauauauauuacauaaucuauguauuauauauaaauauaaaauauauauuauauauuuauauaaauauaauauauauuauauauuuauauaaauauaauauauauuauauauuuauauaaauauaauauauauuuuauauacuuauauaaauauuauauauauuuuauauacuuauauaaaauauauauauuuuauauacuuauauaaauauaauauauauuuuauauacuuauauaaauauaauauauauuuuauauauuucuagaaauauaauauauauuuuauauauuucuauaaauauaauauauauuuuauauauuucuagaaauauaauauauauuuuauauauuucuagaaauauaauauauauuuuauauauuucuagaaauauaauauauauuuuauauauuucuagaaauauaauauauauuuuauauauuucuagaaauauaauauauauuuuauauauuuauagaaauauaauauauauuuuauauauuuauagaaauauaauauauauuuuauauauuuauagaaauauaauauauauuuuauauauuuauagaaauauaauauauauuuuauauauuuauagaaauauaauauauauuuuauauauuuauagaaauauaauauauauuuuauauauuuauagaaauauaauauauauuuuauauauuuauagaaauauaauauauauuuuauauauuuauagaaauauaauauauauuuauagaaauauaauauauauuuuauauauuuauagaaauauaauauauauuuauagaaauauaauauauauuuuauauauuuauagaaauauaauauauauuuauagaaauauaauauauauuuuauauauuuauagaaauauaauauauauuuuauauauuuauggaaauauaauauauauuuuauauauuuauggaaauguaauauauauuuauagaaauauaauauauauuuuauauauuuauauaaauauaagguauauuuuguauauuuauauaaauauaauguauguuuuguauauuuauauaaauauguauguuuuauguauuuauauaaauauaauguauguuuuauguauuuauauaaauauaauguauguuuuauguauuuauauaaauauaauguauguuuuauguauuuauauaaauauaauguauguuuuauguauuuauauaaauauaauauauguuuuauguauuuauauaaauauaauauauguuuuauguauuuauauaaauauaauauauguuuuauguauuuauauaaauauauguuuuauguauuuauauaaauauaauauauuuuaauauauuauguauaaauauaauauauuuuaauauauuauguauaaauauauauuauuuguauauaauauauuaaaauauauuauauauaaauauaauauauauuuauauauaauauaauauauauuuuauuuauauauaacuauauuauauaauauauauuauauuuauauuauauauuauauauuuuuauauauuauauauauaauauauauauauauauauaaaggggaguuuauuaaguauuaacucacaccaucacaaggucccacaauaggccaucugcaggcugaagagcaaagcgagccaguccaaguuccaaaacugaagaauuuggaguccgauauuugagggcaggaagcauccagcaugagagaaagauguaggcugggagacuaggccagucucucuuuuuacauuuuucugccggcuuauauucuagccaugcuggcaacugauuagauugugcccacccagauuaagugugggucugcuuuucccagcccacugacucaaauauuaaccuccuuuggcaacacccucacacacacacccaggaucaguacuuuguauccuucaauccaaucaaguugacacucaguauuaacaaucacaaguccaccccuugucaaccugaacccaugcacaucucuugagaucauacauaaucuucaaauaaagacaauaauaaggucauaauuaugccuaacauaaaacaacaauccuucauacaacuggagacgcaccaauccccaacccaaaugcuauuacauaaaguuaacaacacuuaaauguugacgugaaguuaauaaaucuuaugucacaugauaaaggagaaaggaaauaaaaugaaaguauuuucuuaguacaagcguauauaugcgcagacguguuuuuaacaaaagaaagaggaaauacuuacaacaauuacaguccucauuucggcagcuggucacgcgguuguaacugguauuaaugacaaccuucuucuacuacacauucuguauucccuuugccuucagcaagcaccuuguggguuuuuuugccugguggcaugauccaaaccuucauuccugaggggucugguucauuuguagucugccuggauuggucugucguaguuuuccauugaccuuaaucacagggcagaguaauacuaagagaugcccuaauggaucuccuguauuccaugcauacucuuccuuaccuccguuguggaguagcagacugauuucaucuugauaauccaggucagucaccccagccaacacuguaacucccuucuuagccuguugacuuaaagguggaaggagcucaaaauguccagguggcaaucuuaacuuccacuuuaauggaaucguugugucuuuugauagcagugcuccucccucuggaacuaaaaccucuaggccagcagaacauaaugucacaggaacaggaaguaaaauuuuugccaguggaucaccagggguaauggugaguggugccacuuccacccccugauuccuggaaacaugaauccuggcuaugggagaaacagugccauagauuggaugcugauucagagcauacacggccuucugcagaacuuugccccagcccugcaaaguauugucaccuaguuggcuuuguaacugugacuucaaaaggccauuccaccauucuaucaauccagcugcuuuaggaugauagggagcaugguaagaccagugaauuccaugagcaugagcccacugucacacuucuuuagccauaaagugagugccuuggucagaggcaaugcugaguggaauaccaugacaguggauaaggcauucugugaguccauggaugguagucuuggcagaagcauugcgugaaggauaggcaaacccauauccggagcaaguaucuguuccagugagaacaaaccucugccuuuuccaugauggaagagguccaguauaaucaacccgccacuagguagcuggcuaauaauccugaggaauggugccauauugagagcucaguguuguucucugcugcugggaaauugggcacucagcaguggcuguagccacucuuggugaguguaaguacauguugcugagcucaugcauaaccuccaucccugccaccauggccacauuguucaugggcccacugggcgaugacagggguggcuagagaaagaggcugagugguguucauagaauggaucauccuauccacuugauuauuaaaauccuccucugcugaggucacccauuggugagcacuuacaugggaugcagauaucuucacagcuuuugaucacucaaagagguccaucacauaccucuuccccaaauuuguuuuuauuauuauuauauuucaauaaguuauugggguacagcuaguauuugguuacaugaauaaguucuuuaguggugauuugugagauuuuggugcacucaucacccaagcaguauauacugcaccauauuuguagccuuuuaucccuugcccccaacccacucuuccccauaaguucccaaaauccauuguaucauuguuaugccuuugaauccucauagcuuagcucccucauaccagugagaacauacaauguuugguuuuccauuccugaguuucuucacuuagaauaauagucuccaaucucauccagauuucugcaaaugcuguuaauucauuuuuuuaaugcugaguuguauuccaucauauauaugauauauaugauggaauauauauaucauacauauauaaugauauauaucauauauauguauauaugauauauacauauauguauauaugauguauauaucauauauguaugaucauauauguaugauguaucauauauaucauacauauaugauauaucauauauguguguguauauauaugauauguauaucacaguuacuuuauccacugguugauugaugggcauuugggcugguucuacaauuuugcaauugugaauugugcugcuauaaacaugcaugugcaaguaucuuuuuuguauaaugacuuauuuuccucuggguagauacccacuagugggauucauuggucaaaugguaguucuacuuuuaguucuuuaaggaaucuccacacuguuuuccauaguggcuguacuaguuuacauucccaccagcaguguagaaguguucccugaucaccacauccacaccaauaucuacuggguuuuuuuuuuauuuuuugauuauggccauucuugcaggaguaaggugguaucacauugugguuuugauuugcauuucccugaucacuagcgauauugagcauuuuuucauauguuuguuggcccuucauauaucuucuuuugagaauugccuguucguguccuuagcccacuuuuugauaggauuauuuguuuuuugcuuacugauuuguuuaaguucauuguagauucuggauauuaguccuuugucagguguacagauggugaagauuuucucccacucugugaguugucuguuuacucugcugacuguuccuuuugcugugcaaaagcuguuuaguuuaauuaggucccagcuauuuaucuuuguuuuuacuguauuugcuuuuggguucuuggucaugaaauccuugccuaagccaauuucuagaaggguuuuuccaauguuaucuucuagaauuuuuauaguuuuaggucuuagauuuaaguccuuaauccaucuugaguugauuuuuguauaagugagagaugaggacccaguuucauucuccuacaugucgcuagccaauuaucccagcaccauguguugaauagguuguccuuucuccacuuuauauuuguuugcuuugucgaagaucaguuagcuguaaguauuuggguuuauuucuggguucucuauucuguuccguuggucuaugugccuauuuuuauaccaguuccacacuguuuuggugacuauggccuuauaauauaguuugaaaucaggcagugugaugccuccagauuuguucuuuuugcuuagucuugcuuuggcuaugcaggcucuuuuucuguuccauaugaauuuuagaauuguuuuuucuaguucugugaagaaugaugguaguauuuugaugggaauuggguugaauuuuuagauugcuuuuggcaguaugaucauuuucacaauauugauuuuccccauucaugagcauggaauguguuuccauuuauuugugucaucuaugauuucuuucagcaguguuguguaguuuuccuuguagagaucuuuugacuccuugguuaggcagauuccuaaguauguuauuuuuuugcagcuauuguaaaaggaguugaguuccugauuuuauucuccacuuggucgcuguugguguauagaagagcuacuaauuuguauauauuaaucuucuaucuggaaacuuugcugaauucuuuuaucaguucuaggagcuuucuggaggagucuuuagggcuuucaagguaaacaaucauaucuucagcaaacagugacaguuuggcuuucucuuuacugauuuggaagcccuuuauuucucucucuugacugauugcucuggcuaggaauuccaguguuguguugaagaagagugaugagagugggcuuccuugucuuauuccaguucucagaaggaaugcuuucaacuuuucccuauucaauauuauguugucuguggguuugucauagauggcuuuuauuacauugagguaucucccuuguaugcugauuuugcugaguguuuuaaucauaaagggaugcugaauuuugucaaaugcuuuuucugcaucuauugaaaugaucaugugauuuuuaauucuguuuacgugguguagcacauuuauugacuugcuuauguuaaaccaucccugcaucccuggugugaaacccacuugaucaggugaauuauuuuuuuuucauauguuguuggauuugguuagcuaguauuuuauuaaggauuuuagcaucuauguucauuaagauuauugguccauaguuuucuuuuuugguuauguccuuuccugauuuuggguuaggguggugcuggcuucauagaaugaauuagggaggguuccuucuuucucgaucuuguggaauagugucaaaaggauugguaccuauucuucuuugacugucugguagaauucugcugugaauccaucuggugcuggacuucuuuguuguugguaauuuuuuaauuaucauugcaguuucgcuacuuguuauuggucuguucaggauagccaguucuuucugacuuaagcugggaggguugcauuuuuccaggaauuuauuuaucucuucuagguuuucuaguuuaagugcauaaagcuguucacaauagccuuggaugaucuuuuguauuucaguggugucaguuguaauaucuccuguuuuguuucuuagugagguuauuuggauuuucucucuucuuuucuugguuaaucuuguuagaggucuaucaguuuucuuuaucuuuucaaaaauaagcuuuuuguuucauuuaucuuuuguauuuuuuguuucuuuguuucaauuucauuuaguucuguucugaucuugguuauuuccuuacuuaugcuggguuuggguuugauuuguucuuguuucucuaguuccuugagguaugaccuuagaaugucaguuugugcucuuucaguguuuuuugauguagguguuuagggcuaugaacuuuccucuuagcaccaccuuugucauaucccagagguguugauagguugugucauuauugucguuaaguucgaagaauuuuuaaauuuccaucuugauuucauuuuugacucagugcucauucagaggcagguuauuuaauuuccauguuuuuuucaugguuuuaaaguuuccuuuuggaguugauuuccaauuuuauuccacugcagucugagacagagcucgauauaauuuaaauuuucuuaaauuuauugaggcucauuuuauggccuaucauguggcuuaucuuggagaaaguuccaugugcuguugaauagaauguguauucugugguuguuggaugaaauguucuguauauaacuauuaaguccauuuguuccaagguauaguuuaaauccauugcuucuuugcugacuuucugucuugaugaccugucuagugcugucaguggaguacugaagucccccacuauuauuguguugcugucuaucucauuucucuuuuuuuuuuuuuuuuugaguuggagucuugcucuuucucccaggccagacugcaguggcgcuaucucagcucacugcaagcuccgccucccagguucacgcuauucuccugccucagccuccugaguagcugggacuacaggcacccaccaccgcgcccggcucauuuuuuuuuuguauuuuuaguagagacaggguuucacuguguuagccaggguggucucgaucuccugaccucgugauccgcccaccuuggccucccaaagugcugagauuccaggcaggagccaccaugccuagccuuauuucguaggucuauuaguaauuguuuuaauuugggagccccagugcuaggugcauauauguuuaggauugugauauuuuccuguuggacaaggccuuuuaccauuauauaaugucccucugucucuuuuaacuucuguugcuuuaaaguuuguuuugucugauauaagaauagcuaccccugcuggcuuuugguguccauuuguaugaaaugccuuuucccaccccuuuacuuuaaauuuaugugaguccuuacugcuagguaaggacugaaggcagcagaugguuggugaguuuuuauccacccugcgguucuguaucuuuuaaguggagcauuuaggccauuuacauucaauguuaguauugagaugugagacagcauugcauucaucgugcuauuuguugccaguguacuuuguuuuuuguuuuugcuuuuuaacuuguauuuuuguuuuauagguucugugugauuuaugcuuuaaagaaguucuguuuugauguguuuccaggaguuguuucaagauuuagagcucccuuuaguaguucuuguagugguagcuggguagcggcaaauucucuuaguauuuguuugucugaaaaagacuguaccuuuccuucauauaugaugcuuaguuuugcuggauacaaaauucuuggcugauaauuguuuuguuugaggaggcugaagauagagccccagucccuucuggcuuguaugguuucugcugagaaaucuccuguuacucugauagauuuucccuuauagguuaccucguguuucugucucacagcucuuaagauucuuuccuucgucuuaacuuuggauaacccgaugacaaugugccgaggcaaucuuuuugcgaugaauucuccagguguuuuuuguauuucuuguauuuggauggcucaguucucuagcaaggccagggaaguuuuccucaauuauucccccaaauauguuuuccaagcuuuuaguuuucuuuucuuucucaggaacgcugauuauucuuagguuucaucauuuaacauaauccuagacuucuuggagacuuuguucauauuuucuuauuauuuuuucuuugucuuuguuggauuagguuaauucuaagaccuugucuucaugcucugaauuucuuucuucuacuuguucaauuccauuguugagacuuuccagagcauuuugcauuuugauaaguguguccaauguuuccugaaauuugauuguuuuuucuuuucugagauggagucucacucuguugcccaggcuggagugcaguggugcaaucucggcucacugcaagcuccgccccccgaguucacaccauucuccugccucagccucccaaguagcuaggaccacaggcaccugucaccacgcccagcuaauuuuuuguauuuuuaguagagaugguguuucaccauguuagccaggauggucucgaucuccugaucucgugauccacccgccuuggccucccaaagugcugggauuacaggcaugagccacugcaccuggacuguuuuucuuuuaagcugucuguuuccuugaauauuucucccuucacuucuuguauuuuuuuuuuccuuugcauugggcuuugccuuucucuggucccucccugauuagcuuaaugacuaaccuccugacuucuuuuucagguacaucagggauuucuucuugguuuagauccauugcuagugaacucgugugauuuuugggggguguuaaagaucauuguuuugucauauuaucagaguugguuuucuguuuucuucucauuuggguagccucugucagagggaagaucuugggcuggaggcuguuguucagauucuuuugucccacaggguguucccuugauguaguacucucccccuuuuccuauggaugugcgcuccuguaagccgaacugcaaugauuguugucucucuucugggucuagccacccagcaagucuacccagcuccaggcugguacugggaguugucugcaaagagucuugugauaugaacuaucuaugggucucucagugguguauaccagugccuguuccaguggagguggcaggggguugcaauggacucugugaggguucuuagcuuugguaguuuaaugcuguauuuuggugguuuuuggccuccugccaggaggugacacuuuccagagagccucagcugugguaguaugaugaggaaccagcgguggguggggcucuagaacucccacgauuaaaugcucuuugucuuccacuaccaggguggguacgaaaggaccaucaggucgggggcagggcuaggcaugucugagcucagacucuccuugggugggucuugcuguggcugcuguaggggaugggggugagauucccaagucacuggaguuguguaccugggcggacuauggcugccccugcugagccaugcaaguugucagggaagcuggggaaagccagcaaucacaggccucacccagcucccaugcaaacccaagggccagucucacucccaccaugcucucccuaccccccaacaaacagcaccgagucuguuuccagguggugggcgagcugggcuugaaaacuugccccaggcuacccacuucccagcugcaaaagaaaagggcuugguucuuccuccgccuguggagucugcacaccagauuugugcccucccccaaguucuggccaggagccuucucaccccguucaaauuguuacagaguucagcuggagauuuccuucucccuguggaguucccccaacccaccccgccaccucuggccacccucccaauggaucccucuggugccaggcaggaauggccugcuugggcucccagcaagcucccagggccuuucugcugcuuccucuaccccuguauuuugcucagcucucuaaauuggcuuaguuccagguaaggucagaaacuucucccacaaacagaacuucaguuucuccaguggggguauguguucaggagaggaggcucucccuuucccccuucugcaguuggggcacucacaguauuugggguaucucccagguccugcaggagcugucugcuuccuucagaggguuuguggauccucucaggauugcugguuuguucuuguagucaaucuggagcuaaaguucacagugcaagccucugcauacugcucuguccauuugagucccucaaauuuuuuugucaccaauuuuccaaucaugcuucuuccaagucccugaccauccagccagaccauuugcuacaccccaugaaucauauauaaucacacaucuggucauuucuccuuccaugcaaagugcacacuguuuaggugcacugcucaaaguucugcccacugggaagauuucccuucacugcuguccuucagagauauccuuucaaaaggggcuguagugcugcagcuguccacuuccagguggugcaugcauaucaugcagaaucaucagugaaccaggcccuagucuucucuucuucugucaacugaucauagggaacuaacuccccaugaggccacuggugcaggcucggggagagaaggcaggguggcuggaguggagaccgugggcauuugagccacuuccucauguaacuuauuugugccuucaggaccugcucaagcccaaucacguauauaccauuuccuuuugaugauggaaugcugcugugcaugagccacuuuauggauagaugggucugaaagcacccaguucaugauagacaguacagguuucauggugacuugaugacccauagucaaauguucaguuuccaccaaagcccaguaacaggccaagagcugucucucaaaaggagaguaguuaucugcagaagaugccagggcuuugcucuaaaauccuagaggccucugcugugauuuacuuaugagggccugccaaaggcuccaaacaucaucccuaucugccacugacaccucaagcaccauuggaucugcugggucaucuggcccagcuugcacagcagccuggaccuguugcagacccuucuuuucuggaccccacucaaaacuggcagccuuuugggucacucaauaaaugggcuggaguaacacacccagaugaggaaugucuugccuccaaaauccaaauaggcccacuaggcauugugccucuuucuugguuguaggaggggucaaaugcagcaacuuauccuucaccuugaaggaauaucuugacaggccccauaccacuggacuccuagaaauuuuacugauguagaaggucacugaauuuuaguuggauuuauuucccauucucuggcaugcaaaugucucaccaauaaguccagcauguuuccuacuucuugcccacuggauccgaucagcauaaggucaucaauguaauggaccagugugauauccugcugaagcaaaaagugaucaaggucuccccgaauaagauuaugaaacaaagcuggagaguugauauaccccugagguaggacaguaaaagcauauugcuggccuugccagcugaaggcaaauugcuucuguuggggcuuauggacaggaauggaaaaaaaaguauuugccaagucaauggcugcauaccagguaccaggagaugugugaauuuacucaagcaacaaaaccacaucuggugcagcagcugcaauuggagucacuacuugguuaaguuuacaauaauccacuauuauucuccaagauccaucugucuucugcacaggccaaaugagagaguugaacaggaauguggugggaaucaccaccccugcaucuuucaaguccuugauggugucacuaaucucugcaaucccugcagggauggauauuauuuuggauuuacuguuuuucuagguagagacagcucuaauggcuuccauuuggccuuuccuaccauaauagcccucacacuaccagucagggagccaaugugggaguucugcuagcuacuaaguuugucuaugccaauuaugcauucuagcacuggggaaauggcaacaggaugagugggggaacccacuggacccacuauaagucagaucugagcuaaaacuccauuaauuaucugaccuccauaagcgccuacuuuaacuggaggaucacaaugauguuuuggguccccuggagucagcaucagcucagagccaguguccaguaguccccaaaaugucugaucauuucccuuucuccagugcacaauuacuguaguaaaaggccagaugucuccuuggggaaggaugggagaaagauucacuggauaaauuguugauaauguaguaggguccuuccucaagcagagcuggccucccccuucauucaaggggucagggucuguaaacuggcacaagucuggaaauugauugaggggccaugauucucuguuuuuuuauuauucaaauuagucuuuuguccauucgaccuagaauuuuucuacuuguauaaauuacauaggaaugcaguaggcuuccuaucaguuucacuucuaguaacaccaugauaaauuagccaaugccagagcucuacacaaaucagacuauucugauuuccacuuugccucugcuguccauuaagguagcaaugcccaccuugccuuugacaguugagugccgccacuuggccccugccaccuugggauccaauuauucccacuauauuuaaauuuuguaguugagugacugugguucccacuguuagaucugacauacagagaugagcaauuacagggcucuuuaaagaugcaggugcugcccucacaaaucuauuucacaagcauuggucaaggguauaucuuuugaacccucccaacugggaugaguaggucuaaagugacuaauucacuccaccaucccaaucucccuaagccuuuggaucccuuccucuacauuaaaccaagggagaucaagcauuuccagcuaacucacagugggccaucuuuuaauccauauuucagcuaaccaagcaaauaaacuauuagaaccuuuuuuaauucuccaagcugcaacauuaaaugcagauucccuacuuagugggcccaaaucaauaaauucagccugauuaaacucuguuucuucuaccauuauccuacacccuuaauauccguucccaugccuguucuccagauuucuguuuauauaaauuagaaaacucaagcaguucuuuuugaguguagcgcacuuccucaugggucacacucucauccucaccucuaggggcucgcugggacuuuaguuauaggucuagaagcaaacagggguguuggggguggcuccugaagagagucaacauuaucuugccuggcaacugccucaggggaggccaucacuguugccucaggcagcucaggguuuauguccucagacaaagauggaaaggcugauggggcagcaugggucagggagggaauguugccacuacuggggauggggaagcuguuucuucuggcaaaaaaguucaucagaguuuacaaacucagaauccccagcuucaucagggucgucccacacaccccccauuccaaguugcagggucccauucuuuuucaaucaaugccuucacuuuaaccguagacaccuggugaggcugugcaugcaucuuuuguugcaggucagccacucacaugauaagagcuugugucuguuuuuccacaauuucagcucuuucccugcaggagauaagacucucauucagggcagucuuaacagauuugaggcucacuaucugcuucugaagccaggagauggaaucccugaguucauuacuuucuuucaucacuuugucuacugaacuuaagagcaaccaaccagcuucauuauguuccuuagcucuccacauauguucaaaaguauuagguauagagucacuaaaccccuugcuucucacgagcaaugaaucaggagugucaaauggauuuauuuugcauaagucuguaaacaguucacaccaaggacuaucaguguucuccacaggauuagaaguagaguccuuagcauuuuggggucuaaucauauuaagcaaccaauuccagaaacccugaaaccaccaaaauacuccauccuuaauauucuauuucucuagaaccacuccuggucccaaaaucuguauuaggguuuucuagagggacagaacuaaucaaauauauauauauacauacacacacacacacacacacacacacacauauacauauacauauauacacauacauauacauauauauacauauguguauauauauacacacacauacauauacauauauauacacauacauauacauauauauacacauauauauguguauauauauauauauauuugauuaguucugucccucuagagaacccuaauacagauuuugguaccaggagugguucuagauauauauauguauguauacacacacacacacacacacacacacacacauauauauauauacgugcauauguauguauauauacacacacacacauauauauaugauaaggguagucuauuaaguauuaacucacacugucacaagaucccacaauaggcugucugcaggcugaggagcaaagagagccaguccagcuuccaaaacugaagaacguggaguccgauuuuugaggccaggaagcauccagcacaggagaaagauguaggcugggaggcuaggccagucccuccuuucacauuuuucugccugcuuauauucuagccaggaagcugauuagauuuugccaauccauauuaagggugggucugccuuucccagcccacugacucaaauguuaaucuccuuuggcaacacccucacacacacacccaggaauaauacuuuguauccuucaauccaaucaaguuggcacucaauauuaaccaucacaccauuguggaagaaaacuugcagagaacucuucugauuuaggccuggcugaaggcaggagcuuggcagagaugcaggacaaaguacccagccucagaguccugccaacggacccacagucaaaacccaauaugaauuugacauaguagguauuauuguaggacaaaauaucccaggcucccaagcuguguucugugauacaucagcccuauaaaauggguuuaaaaaaagaagaagaagaaaaagaaaguuuucccuguugagugaucugagaagcccuguacacugacuccucuugguugaucucagggccacuagcacacuaaaggcucugagaaggccugcaguaagggugcuagccucauguuucccaaacuuauuugccccagaaucccuuuugcguguuuauucaaaccccucuguucuucaguucauccuagagaauggccugaaggcuagguuagagcucuaaggaaggagagaggauggggcuuccccgaaaagggacauuuugugugcauugcacaaggcccaguccaagccuagcacagucucugucccccagugagugcucaguaaauucuuaauaaaaaaaaaaaaaaaaggggcuacugcguuugucuggagagaagaguccagaguucucaacagaggcuggagacagagaggaugcauauagcagggugucguccaaguguacuuuuggcaguuuaauguagggccuuuuuccucugacuugacccccucucuugacuacuggcaacaaggggcagccaaagcaaagugguuuagggcauauaccuuggggccagacuaccuggguugaaccccagcuccaucacuuccuagcuaguuccuugggaaaguugucguaacuuuucaauaucucaguauuuucagcuguaaaaugggccuaaaaauagugcuauaacuauuuaguguccagcucaauaacgcccaggauuaaauguguuaauauagguuugguccuggcccauaguaagcacuauguaagcauaagauacaugagacaguccucaucuauugucuuauuccaguguuuaccucccagggucugaguucccuuucccaacguuucccagcagacugaagauucucauauuccugagugaggcacucugcaaauuuguuuucugcccccacuggcaucaggaagagccaggaugacguugcuucauuuccaguagucagggcuguuugagguaaggcucagguucccuucccgguuauuggugcuuaaccaugcaggcuggguaaauauuucugagggaguccagcacaucuauuauuaauuuacugcaagcaguugcuguacuuuccagaaauaccucugccuacagauguuuucuagacuguguagaguucuccugaccuuaaugcuuuucacaggguguggugggaaucaguuccuuuagugggggaaggauggacaguugugugggcaguggacaagggguaccaguuggaucuuguuggaucugaucauggaggcaguggacucuuguucuuuuuaugcccuacuuucagcuucaaaccuggcuuacaggccagaaaccuggguaucguuuuuugguagcacccuuuacugucaugaccccauauccagucagucaccaaggccuagagaugcuaucuccaaaaggucaugaauccaguccccucucuguaccgccauugcuaagcuagucccagcggacaucucucaucuuccaagucucagcuuccuugauugcuaaacucaaucagacccccugcuuuguguucccauagaaccccacuuuuuaaaaaucaccuuuuaaucuuuaaaugggcuguccaggcuccaacuucucuaguggacgauuagcuccauucucuucuuaguaacagugcccgacaaauauaaaucucccagugauaaaagaaaagagugcuuucccuuccuccuuucuuucccuccuuccuuccuuauuuccuugcauuauuuuuauuaauuaacauuaaaaggggacuagcaaucaccuggucaaauugcauucccuagaggaaccucaaggcccacuguaggaagaaaggagacacauuuuuaagcagaacccugaaccccacaaaccccucaccaaccagcagcaauccugaaucucuguuagacauugaaauuuuaccuuaguauuuuucuugagcgguggggaaacaaaaagugguuauccuaugauaaaagguuuggacaacaucaaucuauucuuauauucucauuuuucagagcaaaacugugccaggugcuuugcauauguucacucauaaacaagaaagguauuauccucauuuuauagauucagaaacugguccuagaauagugaggaaacuuguccauggucagacagccagugugcaguggguccagaauuccuauccaguauuguuaaacuccaaacucuuuccaccaccaccugcugccucccuaagaccuguccuccagcaaacgauggguuccugagccaacugugcagucuggcauggcugcaguggccacagacagaucacugggauguaauuggacacuacuugcucagaggaacagggcccucauuccuagggcuuccuggcugugcaacugugagaugcuaauuagagagaaaugaagucuugugugggccagggaagagcugggcuacuccgccgcaugguccuuuaugccuaaaauaaagcuacuuggcugggaacccagagucuuuucaguacagccugagucuuccuucccaugugucagggguuucucccaaggaaauccuagacaaagcaacaacccaggaaaagaaaaccguguuccagauuauacaaaaagacagcauuuguuuuaccuugaacuuucuggucucucuugccuuuccuuuguccucaagcccagauuauuuugacuuccacuuuggggugaagucuggccuauguaaacaagaaaacuagaauggaagacaggaaagcuccuagaaagccuauguaaacaagaaagccuauguaaacaagaaaacuagaauggaagacaggaaagcccuagcuccuccagagcucauuguguggcuuugggcaugucacauggccucucuaagucucugucuccccaucuaagaguguuuuggacaauaugaucacaacuaccauuacaaagauaguuaaaagcaaucgcucuggagcugaguuuaaauccaagcucucccauuacuaaugugugacuuugggcaaguuauauaagcucccgaggccucaguuuuaucaucugcaaaaugggauaacaguaaugucuaucucauagauuugcuguggggguuaacaaguaaagcaguuagaauaaugcccaacaaauaguaaguuauuuauuuguugucauauaauaguaaguuauuaugguagugguuuugguugugaucaucuccauucaugaaaccauacuuugugauucugcacuuuuaucugccuagagcauguccaaaaucucccaguauuuaguauuuauauuuuucacuuuuauuguugggaaaauauguaaugacaacaagcugcuguggauucagcaauguuuuaacugaaugaguauucaucauaacagcuccuacauauguugcauaagacauggacucaguuauagacaaugcuuggugagaccucagcauuguuacugcccaaauccuaccaguaacaaugugucccuaguuagaaacgucugauuuugauuauuguuguuccuuccagccuaguucaugcccauggugggcacuaaguuaguguuuuauugaacaaaacaauuaacuggacagacagacagauggguggauggauggaucuguuuuacauuugccucuugauuuaauuucagcagaauaagugaguacagguguuacuguguguuuuucuaugagcauuugcagagaaagccucagcuaucucuaucuuagggaaguagaugguccuaguuacauauuuugcauauucccucaucuguugguuuauaaggucauuuuucacugaaguccuuucagcuguccugcguugacaauagacaagcacucccucuucuacucccaugccuucuucauccaacaaugagggcuuugugcugggaagaugccuguggaugcuuccuucccaaggcuucaaagccucgucuggcuucuaucaaggguauugaugggggaggggacccagacaguuggauucagggagcagugccuguggccuggugccaacggaauaugucaggcugggguagauaauucaaugucuauucugggauauagacagccugguuaccugagcugguuaucgagcuauuugcagccacugcccugcaagucaucaagcucuaguuuaccagagccuuuugcuccaggaucaggagaggauggacaucuggagaggacagaugggagagaguagaggggcgggcugccagucucagggugugaagagucuuaccccauuggagcaagaggcuguuguggcuacuuccucuuagggcuucaguucacuaaugagauuaaaaugccaacagccugccucugcgcacacuuacuuaggaacacauugguuugaacugcuuaaugagcguuaggaaucuaagaaaggucugggcaggcgccuggcugaugccuugaugauuagaauacuaaaugugucccccuuugaaagccagcaguugcuggagagcaaagccaguucugagacuuucuuuccuugauuauccuugcauucccacuguuuucagauaguuauaaaucaaugaccugaaguggguauggaauuguuaugacaaugauuuuuauaacaacaaggacaauaaugauaaugauuaucacaauaauaaugauuaucaaaccuagaugcucaccagaaauacccagacauuuguugguuguuuagcuuauuuuuuguuguuguuuugaaaauacagacuacuaggccccaucccuaguaauucuauuucucuagaccuggauggaggcccaggaauuuauuugcuuaacaggugugcuggaugauucuaauguacuuggcugagcccuggcuuugggaacugcuauuuagugagggcacccaggaccuagaaugaugucugacuaccacuuccuaaaugugugaucucauaccuauugcuuagccucugaaccucaauuuuauuaucuuuaaaaauggauuagguaaaauguuguagcuacagugaaaaacaguauggcaauuccucaaaaaguuaaaaaugaaauuacuauagauccagcaauuguacuucugaguggaacccaaaagaauuaaaagcagggucucaaagagaggucuauauguccauggacauagcagcauuauuugcaauagccaaaaaaggugcaaaccaccuggguauccauuggcagaugaauggaucaauaagauguagcauauauauaugcaacgaaguauuauucagccuugaaaaagaaagggaauucugacacaugcuacaacguggaucaaccugaagaauauuauguaagugaaauaagccagucacaacaagacauaugauguaugauuccacuuuuaagagguaccuagaguagucaaauucauggagacagaaaguagaagggugguugccagggucuggagggaagggggaauagggcuuuauugucuaauggguauggaguuucaauuuugaaagaugaagaguucuguacagggaugauggugauggcagcacaguagugugaauguacucaaugccauugaaguauagacuugaaaaggguuaaaaugguaaauuuuauauuauguguauuuuaccucaauguuuuaaaaggggauuagguaauaucuucuuuccagaguaauucugagaaugacauaaaaugucaucucuaaagagccuaauacagugccugacaguguuucuuucucuucucuuuaucauuugccaaguccuuucauaaccauauucuuauuacuacucagugauggcacacaggacucagaaugaugucugacugccacuuacugccacuuccuaaauguguggucucaugccuauugcuuagccucugaaccucaauuuuaucauuuuuaaaaauggauucagcaaaaugauguagcugcuaugaaaaacaauguggcauaaaauaucaucuguaaagcauccaacuagcacagugccugacacacagugaaugccccaaaagcauuucuuucuuuucccuuugccauuugccaagccuuuucauaaccauucucuucccugggucuucuuauguguguucccugcgcagguaugucugaagggaagggggaaagggaacuaguguguguugauggcuaauuaggaguuauuccauucaaccuucauuuaccuguggaaaguggguauucucauuuuacugaugaagagacugauguguagaaagguuaaaugacuugccugagaucacaaaacuaagacaaggaagagcaagguucagcuggccuuaccacacccugucaagcagguuugccuacagaugguuguggacaguggcugcugcucuccagggagaaugugccaggagcuacacuuggaacuggcuugaacaucauuugaggcaaugagaaguuuguugaagaguauuccccagaauccuuaggggaaguggaggcuugaugaagccaaggucauguuuggcccccgccccaucaccuggcaggugcucagagcccagccccugauagcccuuccagucccagcuacuauuaggcaaggcucugucaugaucacaacauuuaaaggacagccucuucuagagacugggauuguuugacaugagaugggcuucaaaucaggcuugaaaauagccuccugccuauguaggccaaccaagaaagaugcaugccccuugaauacaaaaagaauuccgauuucccuccuagcacggccauuaugugccugucucugacguaaagagagcugaugaaggggaaaaucacaugggcacagugugaucagggcccaguggggugguuacugcuaaagucaacaucaggguuaggcguuuauuacaaaugugugaguugaauuggacagcauauugaauaggugcauuaucaauaccaucaucacagugaauugaacagcuacauuggguagcugaauaaaaaugauaauaaugaugaugaugauggugauaguagcugugguaagaaugacacaggcaacuugaauaacugaacuggagaguaaauuggauuacccugaaaaauaaaaaguaaaacuugugcuuacccugugcaggauccaugcuaagcauguuauacaccuuuccccccauuucucuuuaaaaagcccugugggguagacaguaucaucuguuuugcaaauaaggaagacugagcagaugacucauguguccaaggcaacauggcugauguugauccagaauuggaaucugaggucuaccuggccccaggcgauauauuucggacucccacagauuugcuaaacaguaaguaaaucaggguugaugauucauuuucagaaacaaaaucauuuacuugcuguauaggaagaguccuuuaaaaaguaacuaucaccuaguguguucaacauaaaacccugauuauaaagauucauuugggggagagcauuuucaacaauaauccuucccaucuguaaggcuacaauacuauuuuacuauuucacagcaccgucacggguauuauguucaacgucaacuugacuuagacaaaaacuuaucacuauuuuucucuguggcaacagcaugcauuuggcaucugucagugguuaaacaagcaggcuguggugccgaaguccugaauuugaaccccagcuuuacuccuuacuagcugugaguuugagcaagcuacuuagcauuucugagacucauuuucuucaucugugaagugggcagaauaacuuuacauaaugaauguuaaguucuguuccaaagugucaccgaauaagugagaaaugccauuuaugauuuacuaugcccacccaacaacauucugaggauaauguggcuuauucuuuguagaaaccuacgguaagaccaauguggacaauuuuguuucucagugucaauuaauauauuguuauucugcuuugugcuucagucucacaggaacuuuucaagugucuucagguccuauugccauuggggugcugauaaauuuggguuucugaaagggccaaguuauuguccugacuccaaggcagagaaaauucccccagauucugccucuccugucugcccaucuggggccucaucagaguagagaaaccuagacucuucgagucagagcagaccuuggagauuacauagaaggacauaucuuggccugugagggauaggugaggugccuggcagauaugauaggaagagcagaauuugcuacugaaggcccuugggcagcccucuucacucaucugugccucaguuuccucaccuugcuugcaggguucugaugucuuggacaagcacuuuggaaugcccaaauagggacagcaucugaggccagcauggaacauuaagaagccucacccucauucagaugcucagaauccacaggaauaaagacaguuggauacucacgucuggagcucaagaaagaggucaggcuagaggauaagauucagggugaaaacccaggaggagaugugaucacucaggggaggguagagcaucagaagaaaagaacaaacugacuuuauuguagugauucuggggaaaugaagaccugagcuaguccaugguagugggaauggaaagagaauuacuaagguauagucaguagaauaugguuucugcugauuugagaguuggcgaaaagagauaaaaagagauaauuugacauggauuaaauccaagguccuccccagcccucuccucugcccaccccaggcugggcagguugcuucuuauuuauggucccaccaagugucugcauggcaaaccccaccguguauaguaauugucuguguacauguugacauuuuccaaguuuccgucauccaagugcuuauucacuuccuuacagguccuaacucaaauaguuugccucccauaccagcccucacuaucucccuuuccuacuuuauuuuucuucauagcccuccauacauagauaauuguuuaguuauuauuaucaaucucccugacuagcccuuaagcucaguauagcagggacagacuugaucugcuuuauucacagcuauauuccuagagccuagaagagugcucaagaugcuuaauaaacaugugcuaaauauccccugccucuucgcauccccagacugaauaccccuuauucucucugacucugcacauauggcaggguuuccuaucuauccuggccaaugccuuggagauccuuacccagacacaacaauccagagggcuucuauguugcucuguccuguauaauuggauaauuauuucucugcaugaagacagucugaugaacuggaucaguuacauaaauuauguaacauaaaaauguggagccccuuguucaaaaauaaagaauuucaagacagucauggcagagcauucaaccaagcauggcugcuucugaguguuggcccucugugacugcacaggucacacacccaugaagcccuucugauggggaccagaucuuagcaggcuguaaauaccaggcuccagauuuauauuuugucauguagaaaauaaaaaacuacagaaggauuuugaagagaggggacuuuuacaguuucacuguuuccugacuguaagucguacuuauugaagaaaauuugcacaagggcagaaagguauauaauuauaagguauaagauauuaaucuccucccuuuccuaccucuugccuugcagacaccaaaugcaaaaguagccaguggacacuuggcugauuuccuucugucuuuccaaguuuauuuuuuuucuauguaacauaguuaagauuguacuucagcuacaacuuuguauccugcuuuauucacaagacauugagagaggagggaggggcuuuaaaauacauguugagggagauuggccugaacacgagcucauagagugaauuggugguacaggguuggcagcaaggcguugagauagaggcagaguuagggcccuggaacagagaacagaggagguccuggacuaagggguuagaagugggaguggagagaucguuugggagcugaaaccacucugaugggagaaugaucacaacccccacccuucaugaauucccuuaacucaugggaaagagucucaaggucuggucaugucuuucaggaguugugcaggcaacaacaagcauugagagucauuucucaaacacaagucuuggucuccuuccuucuaagguuaggccuguccuucuccacuccuauaagggucagacaguaaaugcugggccccaggacagccucugagggcagcaaauaggaauccagagacagagcaggcauggcagggccaggguucccaauguccaccacacacaccucaggauugagaauugccauuuuguugguuaauccccagugccuaggcuggcaaaggggagaguuaacauugucauuggauccuuaauugugcguuucaugaauuuucauguuuccgcuugcaagcuuaauguugcuuucucggugaguuuuuuuguccuugagaguaagagacuuguaauuacagaguguuguggauugcagagggugauuaaaauggauuuugugaaaucugaagcacccccucucuuucucucucucugucacacacacaacacacacacacacacacacacacacaccaauccaauaggcgggggaguaacucagacagaaucccaugaaguucagagauucaggauaugaaggauaugaauuuucuucaugcuuucccuccgugggucuuggauccacuccaagacagccuuccccuucccucucuugcuucuccuccuccucccuuuccugaaugaaguccagcuuauaucccugacccucagcugacucugacccccagggcuggcugcuuucucacuugaagggaugauaaaacaaagaguagauuuucaucuuugcuuuugugcagcugucaaguguguuucauuaccaucucagccagccuauucucccaucugagaggguccuucacuuugaauagaggccugaaaauugcugaaaccagcaaggguguaagaauucccauuuuggugucucuuccuccuaggacaaguuagugcuugauggaagugagaacugaucuuuucugccuuugucaauaugaacggcuuguuggugcagagaggacauuugaaguauaagugaccaggaagugaaggguggggagaggaugggaggaagacuuccuggaggagguggggcucugccuugaagaaagaggaagaccauagugggauccuuggagaaggaaaguggaacagcagggaguccagccuggcuagaugggaacaauccccuaggaaugaugcuccuugaccaaugaggaaaccagggcaaccuacuugaguguauggguguguucgugcuguaaaggacuugggaagucacugaagccagagcuucuauuuaaaagaagggucucuaccgcaccacagccagccugacccuggccugaccugaacugaccagugguuccccucagacaaccucccuguccaucucccacccaccuaccucucacccuaacuccaccccagcccccuucccauaaacacaguccugaaucaccccgcucagcugugugcuugagcagugaacaaccugcccaaccauaugcagcagcccugagcagggcuuacaaccaggucucucuuuuucucaguuuacacucucugugcccccaaccaugccauaugcuccaccacacugaauucuaucuggauuucugagaaucuuuacaucucagagcuuaacaucccacauucuagaauuugguugugcauauuacuuaugcacaagcauauauaaauuuacagacacggguauaugcaugugugugugcgcacacgugcaucucuuucaaguguccaaagauggcacugcugauggcggaacguguucauggcugggcagagaagaccacuuccucugcacccuacacgaccaaugaggcagcuuccagcugacuucugcagccucuucaucacccuuccucucucugcccccaccuugcccuccugcagugaauguagaguuccccacacagauuuuuuuuuguaacuccauaucuuuguguugaucccucugccugaagugcuuuucucacacugcucuucaucuaauaaauucuuucaagccaggauucacccacgucuccucucugagacucuucuugaccaccccccucccaccuccuuucucuguaugacccauguucuucuguggugugugugcugccacaucauauuugaguuuccauggcagccucucuuacuagcaugugggcucccgagggcaggcccauggccucaccugucucuguccccugugcccagcacagguucugguccauuaaggaguauaucaguuuguuuucacacuucugacaaagacauacccgagacuggguaauuuauaaagaaaaagagggguuuuguuuuuguuuuuuugucguuguuguuguuguuguuguugagacagagucuagcucuguugcccagacuggagugcagcagcgccaucucggcucacugcaagcuccaccucccggguucacaccauucuccugccucagccucccaaguagcugagacuacaggugcccgccaucaugcccagcucaucuuuuguauuuuuaguagagaugcgguuucaccguguuagccaggauggucucaaucuccugaccuuguaaucuacccaccucggccucccaaaguucugggauuacaggugugagccacggcgccuggccagaaaaagagguuugauggacucacaguuuuacauggcuggggaggccucacaauuaugguggaaggcgaaaggcacaucuuaccuggcagcaggcaagagagaaugggagcaagcgaaagggguuuccccuuauaaaaccauuagaucuuguuagacuuacucacugccaugagaacaguaugggggaauccacccccaugauucaauugucucccaccggcucccucccacaacucauggaaauuaugagagguacaauucaagaugagauuuggguggggacacagccaaaccauaucaaggagguuccaggaauggcuguuguugaguggagcuguugauacucuuuuagugaaugaguuagcccugaaagaggaacaaagaucuugcauagugcagagcccaggaaaguguccaaguuagccggggagagcagggucgggugcuuuaccggcaaagggccuaucucucagauaccaugucccaggugccagugucccccuuuccaaagcagacccaugccauccauccucccaggugggagccugugccacaaacugaccucuuuuuugaccugagcuuuggaacuuaccugacaugcacguuucuauggaccuggcuggucuaugggcucugcuucaacuuacagauccaggaacuccagagacuucuuucccuccuaggccagcacugucaccugucaaaaauguuggcagggagaggaggcagcuggugagaaaauccucaugacccaucuuuccuucaccagcaugcauuccucuccaccuccggggcuauggacucuagguaccaggcugcagcuguccaccugcagugcccagggcgcugugaguccccagggugcugugagugccauuacaggggagcacagcucucaaccccuucugcuucaggguggcuagggagggggcugcagugugagacaaacagcaccagauucucugugugcugugagcuguuaaggguugggcuguauaguaggcuuauggcaauggauaaaaccugguccuacccuaaaggggaugcaggagcaaggguccccuuauaaucaggugggcggcagucuguguuaugaugaugauggaguugcacaaaguuuccuggcaacagagagggaggaggguauuguuucuacgaaaagggugagggaagacuuuauagaagggaugauauuuaaacuagguuucggugaauaaguaggaaugugccagcaggaauugucauuugggaucagaccauggaagaagguggauagaaaguaaaggaaggaguaacgaaagcaacaauagcugcauuagcauucacagugugccagguguggauuaucucaguuaaugcuuacuacaacccuguggguagccccauuucacagccaagagaacugaagcacagagagguucagaauugcccagagucacauggcuagugagugacagagguaggauucaaaaccaaacuguucuuguuccauuguccacugucuuuauaaacacuaggcuaaagauaucugagugucugugauuuggaaggcagcggguucagaacuuuccaaacauguacucguuaccuacucggcaacccuuugacacuucauagcuauuuuacaugcaggaacauaagcuuagagggguucuccagcuugccuggcucgcuugcgugggcugggauuugaaccucggccugccugccuggcuccaaaacccucuccccugcauggcaaccgcagaaccagccucucacuucuaucugucuccugcaccuuggccugcuugcuagaaggccuccuuggcuuguccccugggcaccucacaaggagaaucacugcuucaaaggcacacacaaaaaagacugguucauguucaggcugaaggaagcuccccucaccuggcugccucugcccucacagcuaucaggccuugucacaccaagcccuccaagggugcuucacgagugcuuguacuuggcuagauuuauuggugagcuauauuaaucauauuuuaaaaauaagaagugaaauaaauaauaaauagcaauauucugcuuccauuaaaaaccaccugcagcuuggaaagguagcuggcaccuugcuuccuugaagugucgcaugucccugcucacggccguaaauguuaacaucccucuguaggcagacaaccagcucugaggggaauccacagaugugugcaaagugacucacugcauacucuggcuucauaaaaucgaggagauggaauuaucccaggccuucugggcggcagagagaaaauuucaagcgguggguguuugugagucgguguguguuuguguggggaauggggaaggggagagaguggaagggaaggaggaaaggggcuaagagaagggaaagcagacagggaacugggcaggagcccaggagauccuuggcuaaauuuuccaccguuuccaggucaggggcacccaggaucacuagguccaguggccacuacuauugcuggccugugagccauggagggaggaggauagcucuuuuucauuaauauuuuuaucuuuuuucaauuacaaauguuaauacuaccugaaugauguugucuccuucucaggguacaacaucuggagguacauuaugcucaucggugaugcuaauuuuggugaguugguuaagauggcauauuagucagccaccuccaggauaauagagcuaauggaauauuauguauaccuacauauauauguucuacauauauauauauacacacacacacaguauacauauguguaaucucuuaauauauacauacauauuauuuuaaggaauuggcucacgugauuguggggcuggcaagucugaaaugugucagcuaggccagcagccuggaaauucaggcgggaguugaugcugcagucuugaaguagaacaucuuucuuucugagaaaccucaguuuuugcucuuaaggccuuucaacucauuggaugaggccacucguauuaucaagucaucuccuuuaccuaaagucaauugacuguagauauuaaccacaucugcaaaguaucuucacagcaacaccuagaguugcauuggacuaaauaacugggcacuaaggccuggccacauugacacaaaacuaagcaucccagauggucuccaguuccucccauuaucauuuuccuuuuuguaauacgaauuuuggagggagacaacuucaagacuauguaaguaguccaaccuuuuccccaugaauuaagcaucuauugcuaguucuugccaggaucaauuuuuacugugacaguuacauaaauagcuuucucuuggagaagggauuugggaaccuggcuucagaucccagugcuaucacuuagcuggcuguguggccucagacaaguuaucugauuuucccaauccaggguccuucuugcucaaauaggguugacaguacuugccucaaagcuuggaauguucauuaaaugcaauaacgugugaaaaugccaggugcaaagaagcuaucccauaaaugcguguggcaucaagggcauuagacacauccaugccucagugaagugacuaugaucuuacuccugggcaucauugaugagcggagugaucugagaccacugggaagguucuuugaggaaagucauuaucuuuuuuagccauucucaucauggacacaaggucaaacccugcugaaucagggaacauugacccucugugauugagacacuguuggaaaggcuuucccaaagcuagugauauccuagcugagucuugaaggauaagacuggaagucagacaaggaaggaaaauauuuccaggugaggggaaugggaugugccacagagguggguggagagauggggaaggagaauuuuggaaacuuggggagguaccauuaaguuuccaaagaaacucacagaggggaucgucuguuuguauuuuuuccuauuaaugccacuaugauuaugauuaugauuaugauuaguauucucaaguaaugugcagucuuguauacaguaaaaauaaauucauuauuccuugugagaagcagcaugccauagugauuaugauauggacccuguagccaugcugccuggauucagaucccagcucugcccauuuacuagaaauagaaccgugagcaaguuaaccucucugugccaccuguuccucauccauaaaauggggaugauagaaagaguaacuuccuccuaggauuguacugaugaugaagcaagcucauguuugugaaggccuuagaacaguuccgggcaggugcagaguaagugcugcauacuuauuugauaaauaagaaaguauauucuagacaauuacucuuuggucaaauaguuauuguuuuccuuucacuaacccaucaaaauauucaugcuguucuucaucucuaaucuacuuacauuauagcucacuuggcagcugccaugaagagguaaaguuaccaacaggcuguuguagaaaaagcagaagaugcgggucagcagaugaguucuugucccaucucugccauugcccugcacugugaucuuggacaaguugccauuccuuucugaaccucgguuuucccaucuguaaagugggagaguugagccagcugacaucaaagagcacauccaacccuaagcccugaguguuggugacuugcucaguggcuucccuucagggacaggcaagaggaccgacgucugucaagcaccuacuauguggcaggcacugcuuagcucuuuccucacaugcuucuuccuguaguccucccagcaacacaacaggaagauagcauaucuuugcauuacacuuggagacacugaagcccugagagguuaagcagccagcuggucacucugcugguagggggaacacaaggaccccagccugggacugccugucccuaagcagccuuuuuccacuaggcugggcuuccucccagaggguauucugcaaaggugugauccaugaauaaaagcaucauuacccagcuaugcuggggagauuccugcccuccuucccucaucuagguagcuaugcucuggcgcuagacuugaguuaggauccugccuuugccacuucuucacucugugacuuggagcaaauaauguuacuuucugggcuucaguuuccuggucuauaaaaaggagauaaugauuuccacuucauaugauuaucuugaggcuugaagagagcaugugugagacauuagcguggugacuagaaucuagguaauuuguuaaaaauaauauaacuucuuguuugugguuguaugaaucagugguucugauuuuaagauuucauggaaaagcaaaaugucaaaauaaaaguuuccaacauuuuguuuuacuuagguaagccuuuagaacauaauuagcaucuccuagcaccauuaauucauaauacuaaguagaguucacccggcauaagcugguucucucaaccagccagcaacacuguuaccuugcucuugcaaacugcugcucagagucagcccuuuagucaucugguuuagggcaauagcugccaaauugaaguuuggggacuucuuuacuucaaaccauggggcugaaaccagcuuggggaagggggaaagacauaggcacugaccagccugccucauuuggcaggccccuaccagcuccaccuuucccugaccugagccucaucugcaaagugagcccuuguuuucucagccaaccuucccagcaucaggagcaacaaagguggaacuuauauuauagcuugugaugugcuguuuuuauaugaaggaucagcaucacucugcuaucugaccucaaugaaggcaggcagggcagagcugggagggcuggggagaauuggauuugaauuaugugaacucuagaggaugagaagucaguguuuccacacauccuuuguuccuguguuuccaaacuguaguucuucacccagugucagacuggauuugcuugagcacacaggugaugggaaguuguuguauuuaauagauuucagcucaacuagaauugcaaggaagcaauaacagaaaagggaauuccaaaugaagccaaauuauauucauuuguuuuacaacaacuauuaaauauguugagagggugaaaauaaugauuucacccuuucgaacugaaauugggguucguugguggcucacaccugugcuauauugaguuguggguuuggucaggugugauuauagaacuuaauuguaaauugcaucuuucuggcacaugcaugaauguauuuauguauucuaaaaccuuuuaaaaucauuuuuguaaaaauaaugucuaugacuaaaaccucuaauggcuaagucacuagcuccaagcagccguucaguugaggcuuagaaacuucacaagggugcuggacaguauuugcccaagggauggagaugagcccaccuccuaucuccuucucaacccccuuggagccuuguaaagugcuuuguguacaguaggaucgcucaccugugaaauggccccauucucacuacuuagccaaagccuaguaauaucacauacucuuugacccacuaauaacguuuuaauggaaauaagcagaacaucaugcaaaggcauuugcagcaagaugcucauuggcagcauugcuuaucauaaugggaagaccuggagcaaccuaaguguccaccugcaggguccgguuaaaucaaugaggguuacuccauauggggaaauagcaugccuccuuuaaaaccagugaggcccagcugugauauggaugugaaagauacucaugguauaguaagugagguggggaagcagauuagaaagcagucuaaauagaaaggucacaucucuaauguuaaaaacgugaucguaugagcauacguagaugcagaaaaugucuagaaggauagcuaugcgcuaagauguuaauugugauucugaguagugaggacacagggaguccuuauuauuuucuuuauucuuuucuguacuuucaguuacucacaaaaauuucuugaauaccuaugagacaaaauccuugcuuuucagaagcuuacuaucuugcuggggaaagacaaggaauaaauaauuagacaauuaauuccaaaugcugauaagugcugggaagaaaaugagaugguuaauuugagaaaaacugacagagcagggggaggugagaccaauuucagcuaggaagggaagaccacucuuuagaggggcauuuaauugagaaaaauagggaagagagacccaaaugaaaucugggauagggguguucuaagaagaagaaacagcuaacacaaacgcccuggaugaaagagaauuaggugccauuacaacguauuauuucuaugauccagaaaaauuuuuauucuaauauucauuugguccauucaaaaaaccauaggacccaucugaauccuuccauuccggaggcccaaucagauagcaguucgccuaagacagcgaguggggagcagaggaaggugcccuucaagugcccacugcagaaugagucucuagaaggggcaucucccaagaggccagcucacaguuugccucacuuuccuugauuuucagcaauuuuuuucuuuacauuuugacauuuaugaaaucggaaaguaucuuacaauccauguguacauuaagguagugcuuuguuuguuuucuugucucagaaagccuauuacugaaucgauggugcaucuugcaauugcuggcaucuuaggauugaugaaaugcaguaauguaugcgagugaugcuaagaggacggaccuugggaaguggaagggccuugguggaaguccaugauuccaccuaaaggggaugcacugugggcccacaacaguggacugagucuucuagaccucuaugcaccccagagcaccagccacagaaaugcuuacaacauggcccuggucauccuucagggagcaaucagaauuaugugcaauaacaauguguuauuucuauaaucauacaacauuauuuuauucuaauaugcauuugauccaugcuggguaaaucccaggggaggggggaguccuggagguugggggagccauccaagggggcauccccacccuccuuggauuguggggagagccuaagaaagcuuccugaagagguuaccaggcagacaaggcagaaagggcauuggaagcagagggacagcggcaccgccaguguauucagggagcagugagcuguuccaucuggcuucaaggcaggaugagcacagggaacaccccucaucuggagguuguacugggucuuggaugcauaucaaagggacuagagacuuggaaagacucgacaccaagaagugacauggcuauguuuuggcuuuagaacuaugcugucuaaugugguagccacaagccacaggcggcuauuuaaauuaauuaaaagugaccuuaaaaaaaauccauaagaacaucuggaaaaaaaaguuaaaugaaaaacucaauuccucagucacacuagucacaucucaagugcucaacagccacagguggcuagcuggccacauggacagugcagauacagaauguguguauugugacagaaaguccuuuuuggacagaguugcuuuggaaagaucacuugaggauggguggauagauggauggacagacaaaagcgauagcaaugaccauggugcuuacggugugcaaggcaccaugccaagggcuucacaugugcuguuccuugaacccucauaacaucucacagauguccaccagguaccaggagcuuugggagcagggacaaggcugugggucauuuuucagcauuucccgauuauuuaccuagcucagcgcuggcuucuccaggagccagaguauauucuuauauuuuucgaaggguggcugaggaguguuggagcuucagcuuuaccauugcaccagcccaugguugaacaagagggagcucccuggggaucccccaaauuucaugaugagcacugugcgaccuucucaggaaguucuuccaagugucuaacccagcuuuccaauguaugacugcaacagaugccuauuccuucuguuuauuuuucccucagaaaauggagccuauauuguacuaacauugauaacugcuguacuugacggacgcuuccuccuugucagacacuguccugaucacuguacauaccaacucauuuaauucucagaagagcucuaugcucuagcuaccauuguuuugcccauguuauacaucaggagacuggggcauggagaaguuaagaaauuucccaaggucauacuuugcccaagccaguagaaaguguugcuaggacucaaacucacacgaucuggcccuggagccugguuccuagcccuggcacuauccagucucucaucauaaaucuucuggagcuagaagacagcugccaagugcacuuuccaccuguuuuggcuggagugguaugaaaacuugauucuguuccaggaaaccuuggcugaaaguuaugcccaguuauaacauaaaugccucacauuuggggggcacuuuaugucauuuucagaguacuuuucugccagcagugcuuaugguaauagucgucccacaguuacagcauguuuucugguuuauaaagcacccucauuugcauguucucauuaaauccucacaccagcccugagaggaaagugaggcgcagagcaucauuuacccacguaacacaaggaacccagagaaguaaagcacugugcaggauuacucagcccuccaggacgcaacgguuucuuaauucugcuucuaucaaucaagagccucuccgccaugucaauccauuucaaagucaagccaaaguaagggcuguaaagccaggacccuguguguuaguccuggagcaugccaaggucaagacauggcccaacaaucagaaauaacaucagaauaacucagacuuccaccuaauauuucucagaaguuaucaagaaccaccaaauccacagaaaaacugcuuaaaauccgccuuuucucucugcccucuacugcauuuacugacaucagcuucuccuauaucucuuuuaaaauauuuuuuaugaaaauuuuuuauauucuacagagaguguuuauaacaaauauguucaguguaaacaauaaugagaaacucucauggccccaccagcuagcuuaagaaacagaacaugaugccaccuuugaaacccuggggauggcccccaauacccuccccucuucccagguagcugcccuccuacacuuauucucuugcuuuucuuuauaauccuggaugcuuugcaacccucccccagagaagcacucuccccaguccagcccacacgccucugcagcuuccauuuuugcuucuuucccuaccccagucuggugugaccuuuucugggggaugggaaagggccuggagaaaauggacagaggacacaggcagacuccuuuccagauaaggggaguggaagguuaagaacaccccugcuaaauaccuuuuguccacuugaaaacacauugggaggagagagggaggggcuuccuuguaaguuuauuccuggagcagguugccacuugucacuuggagcaagucccuucaccauauggacuucuaaacuggagggggacuggcacagauugggguuuccuaaaauugucauugcuucuacagauauuuacugagcacuuacugugugccaagcagcgccauagguacagggaugaugucgugggaaaugagacagacaaauucccugaccucaaggaauuuaccaucgagggcaggccucaguccugccccacaacuagcuaugauccucccuuugucauuguaagcuauucaccauuaaagguugagguggggaugaaauuagaugauaaauauggaagugccuggaaaaucagaggcaggucuuggcuaacacuacuuagaagacaccccacaaucccugaaacgagguccacugggcacggaagaggcuggagcuuuggguacucacaccuguaguuacccagaucugccacuggaugucagugauguguaggagggggcggggaccuaagggugaugagcuuuuuaaguugagaaaagugcgaaauaacugcuuacagugugcuauaugcuguucuccauguauuuguuauagcauuugauguuuacggaaacccuaugauuugcauauccuuauacccauuuuacagacagggaaacgugcucaggggagggauauaagugguugucuccccuccuccaccugagaguaccaggcaaagauugcuaaagaugcuaaaaacggcccuggcgugaaagugcucaaccagacagcccuuuacugcugcuaaacugcuaugaacagcaucuccccauacuuggggcagcaaauggcugcacaaaugcaugagaaacaaaaagcuccacagcuguuaaaacccccaugggcacccaugaagguuacaguacaaguguuugcuaggcagauagauggguacagauuaacaagagccacguggugacagcagagcuugcugugcucucugucaaucuagaagcaaucauggcuauggccaacuuuuauguuccuuguggugaggauuacaaaaaggucucuggggaucuugccuuaaagagcauacagauguauagggugucagcauugaagagcuguagucccaguccuuccuaaacaaucccugagaagcucuacugaaaaauuaaaggggaaagugggggaguauucaaggucaaauucauuuugggaaaaucugcaugaaauaguuuugaugaucauugcaauuaguagaccugaugaugauaucauccaccucuuugauauagacccaggggagcaagugcuuugggaggggaaaugacuaguucaggaccacagaggcaaagaggacaccaugacucugaccucuccccaugggaccuuaaauucacaccaugagaacgacagggaaaaggacaugaacaaugggaugggauguuccacagaagacuauauggggggccugcaaaggagagagggucuggagcaaaggcacuggggcuagauccccacagaaggaaaucccagcagcacucccucagaugcaccccuggcaggaggggaauccagguggugcccaaggcaaaccagagacccccaggaaugacuaaggaacggagcuccuccaacaggaggagggaaggcucagagguccuuguggcaggaacaucucuguguaccaaaguucccaggugaguuaccguaagucagguuuuagcucagcagaaaaaaaugcguauauuuauuccaauuaaacaguuugcaaagccauuuuuacaugugucaucuuauucaaucuagacagucacccuuugagggagaccuuucuaucccuacuuuauagauggggaaagugaaggucagagaaguugacucauuuccccaaguucuggagcugggauuccaauucaggucuuacuagcugcaauaccacguuccuuucacacugaaauuguccagggaugaugaugaugauguuccugaugucguugauggcuaugagguaggacucauuagccucauuuuccagacggaaggucugagccccagagaagacccaucgcuugcccaguauggcacagcugguagcugggagagauggguuuggauguacacuuuucgucugcaagccuuguccucugucugcuuuucuuccguacaggugugcaugagcucccgguuacucgagucaugggagcaaauucugauggacucagccagcuuaccuuuagggugaguccuccucaggagagagguugggaguagaugguagcuaaguguccuguuuucuacuuggacucucucagacucgugcugaguggaggccagugcacaggcaggucccuugcuuaaagcaaauuccugggaagugaugagcagggguuggggaguaggcugucaggagccaggggucaggagaagggcccugggggcagagcuagcuguuuggcuuugagaagggaagccaggagagauaagcagagcugggagugaugugaucaaacugugaaagaugauucucacugagcugggagaugggggggggugggggagacacaagagacccgcaugcaggguuuugaaggcagcagauacaggggccugggaagcccagaccaggaucgcagacaauccugggaauggaugaucuggugaguugagaauaauccauguacuuuuacgauuauacuuaguucuuugcagucuucauuaguuaugggauaaauacuucccuuccuuccuuggcuucaaccuuuaugcugcaaguuuaauuuaucuugggccacuaucguuuuuuguuuuacuaaguuaucuguauaguuucauguuuuauuugcugguggucagugugcugacucugaauuuuaauccagguggugguaauuuaucaaggcuucuuaccuuuuucagaaucuuuuuucuuuuuuuuuaaaaaaaaaaagcaaaauguuaauauaaacucagugaggaguuugugggugagaaauaucaucuacuguauccccaaaguugccaaaugguguugagacggauucacauguucgcuguuucguaacauccuggaaauggcacccugcauguugauuuuucuauucucagcuuacagggcaaaauggucuugacuuuuucuacuuauuuuuggagaaaguucaagggguaggaaaaauuccuuuggcauauuuugaagagaacaaaaauacaaccuggcuuuuguguggugaaaaugugggaaauuucaauuuccaaaugugcgugcuggaggaagcaagcugaacuuugaggcuggguuccugggcccucagcccaaaggagggaggggacgcuggcaggggcugagcugccuuggaaaauuagcaggcgauccauguuggaaagugcaacuucugguuccuuccucagccuccagggacacagacucuggcgaugaaaaagaaccccacuuugucaaacuuacccaaagaauagaaaacauaaccaaggaaagaaaaccucuccgacaagguuaacuccuuaagcacagguggaggaggcaaauccgggaaagggaguggauuccuuguaccagaguucuuagaccugggcuccgacgccagccccagcauggcuagcagcuuguucugugaaaggcagcccaccucuguguccucaucugugaaauguggauagagccccugucucaaugcuuguugugaggacuauaugagaugaugacuauaguagcuacuuuuauuacuuagcauauacuaaauauuagugguugcuauuaucagguuuguguacuucuacacaagaccacaugaagggugugugugugugugugugugugugugugugugugcgcgcgcgcgcgcaugugcgugcaugcccacgcaaggauuggucuuccaaauaaguagauugaaaugugugagaauggagcaaauuguucccuuagcgguuaggauuuccugggaaaaugucuauaaguugcugagacuaugucuucucauugccagaauauuccaaggagcagaagaaaagucaggcaguggcccagcuguugccuauccugggccacggguccauauguuuggcuggguuuguccuucugucaucccagccuugccgggggugggucaggggacaugucccaaggaauggcuucccugggugccuuccagacagcugcguuccuguccuaaagaaacagaccaccggggaaggcacaccaggggaaggggagaauugcugcuguccugguuuggguggggcuuacagagugggggugggguggggugggggaggcuuucuaggaaccugaguuuauuggauuggcaggccauccugaggagcuccaucuggaaaucuuccccccagcaaaggcaccagcaguuuucccaaggcuuugucaguacaucauccuaauguaucuccuugcagagucuccuuguuucuucauugacuguguacucgaugucagccuggugccgagcaccagaggaagcagggccauugugacagugaacauuugucaguggcuugccaggacccagcauggugcuaggugcuuccugggaaugauccucagcacagcaggucccuggggcaaguagacaguacccccauuuugcagaacaggaaacagagacccagagauguugcauuacuuguggaaagucacacagcuguuaagaagcagcauuggaauccaggcucugacucuaguauccacacuuguaacuucugugugcauuguugccuggaagucagacaccgucugggcagaggaacaaagagauagcaaucggauggcacaugagagacccucaauggguucucccggccuggccugcuguuagaggccaggugcugccaugggaacacagggugugggaaguaaaugaagccaggcugaccccuaacucugcuacuuacuaucugugaggcauuaacuccuauaagcuucugcaaaucacauuuaaaauacuuugccagguuacugaaagaaauacugaugacugagugacccagcaccucuugggcaugugucuuuaaauggaaacuaguacuacaauggcuaagaacugagaacuuuauggcuucagugagcacuggggagucugcuuccuuccugguaggaggaccagguuagucaccagaggggccucaaacuggaagggccucuggaggucaccgggucccugggucuccuggcagguugccggccuggaugucagccuugguaagggaguccaucccguuuuauaaacuucccagggcagauaaugcaguguccucucaucacucauuagggcuauggaagagcuuggaagaguacaaaggaauauauacuugcuauuaaugauauggcuuguaaguuuugucuuuggaguugguagagaaagacucgcuaagugugggguacugugcaaggaggcagagggcaagaagcagagauuucagugucagaacuggguucaaauccugcccugcugcuuaccaccugggcgaggcaccugcccucucagagcuuccauuuccucauaugaaaaagggagaguccucccucccugaaaggguugccaugaggagugaaggcuggcucuagggcuauuucugugggcagagcuuccugacugcagccuggaccccauuuccaagaggggccugcuccugccccuucaccccccucuccccaccccuaucaggcagagccaaaaaugcccaggcugaugcaagaucuuggacauggacacaucuccugccaggcauggcugacuccaagccuccuugcaggggagaagggacagaucugccccuguccugggucuggccucagauccuuugacacaucucuagacuaaugcagaguuuaaggaugaugcaggcauugaucugggacagccuggagccacaggcagccucguaaaucaggccccagccuuugaaucuuccgcaaacucccugggagagcccuagcaccuugaucuucuugcaguaggagcuccucccccacuggucuggagucuccaggggugacuggggccugauuuacggaggccucuaauagcaacagcccagccugggagaggaggcccaggaaagaaugauuuugcccugugaccuagccuccuaggcuggggagacagucagagcugaagggaggacuaccucucucugggccuguguggacaauaucccccaccccccaaugccuacuggaauuugacacuucucacugauucaccccuuucuuucacaagggagugaggggaggaaacaccuccaaaccugacauccuggaaaagaggcaugguagacgaauaugggcucggagucagaucucgauccauaucccagcccuacuguuuccuaggcauggggucuuggacaacucuuuucacaccccugagcuccgugucuucaucagucacauggaauuuaaaaauggcacuugcacagagcugcugugagggauaaaugggccagcacauauaaagcauacugcacagugauuggcccaucacaggcacucaggaaguguucucuccccuccuuuuuccuuacuccauccaaauacucaggcugucuggccccaaaacccaugcuugcugugcaguccugugcucucuaggcagggaucugugaguuauuuucugauuaucucaagcuucugaaccagcucuguccaguggaaccuuccgccaugauggagaugggcuaugucuacagucucuaaugcaguagccacuagccacauguggcuauuguacuuuugaaauguaccuaguaugacuaaggaacucaauuuguaacuuugauuuuaauuagaaacuuaaauucagcuaccugugccuggcugguggcugccauauuggacagcauaagccuaaaccguaaagaugggaugugaagacuuggcuuggcauuggcucaagguacauggccuugggcaagucuuauuuaguguuuauugaguugagagcaauggaggcuccaggaggagaagacguaagcccuggaauuguccuguugcauggaugagauuugcaccuaugagacagagacaaggggaugcauuccaacuccucccccagcauuucugaccucuaagccauccccacucuggauugggccucccccuccuuuguucccacugugucuagugcuuucuuugccccaaggacuucccacacuggaccauaaauacuguuuucaggaucagcaucuccucccacuuugccaucacagugaaucaucauacagcagaugaucagaggcuguagccuccacccaggagaggauggugccuugaguggggcccuaggaaugggggaaguagaaagggaaaguugcucuacuccaccguccuuaaagguggcucguaguccucaugccugucacuuuccaaucccaagauggccagcagagcuuaccuuuauggcaagaagaacaaguggcaucagcaaaagcccucccaagcucccucugccaguccagugaacuuccuuuuuucaucuuacuggccagaagugggucacaugauuaccacuagcugcaagggaggcugggaaguugaguaucuggcaaagaggaaacagacuugucuugauugccuuagccaaauuaugagucauugccccagggcuaaguguguugcuuucuccagcaaaauuuggcuuguguuagccuggaaaaugggguagagaaugauucuuggguuaagucacuaacaccaccugucucaguaaccauugcacaauuaguauagcauugugcaacuuaccaaguacucuugacauguaauucuguuugagccucucaaguuugugagacagcucagugguuacaauccucauacugcagauaaggaaaacaaggcucugagaauuagaguaacuuaccucaggaaacaagggauccagggcuagcagccagcucuccagauucuagagccuccuccuacgaaccaggagaaaagccucagcugggagcagcaaccagaagccauuuaucuuuguauucuaaacaucugccucuguggccuggcacaaaauagguguucaguaaauguuugauggaucuauuaauuaaugcauuacuuuauuaauguacuaacuugacucauugagcaggggauaagaaugaagagaacuggccgccuacucuuuaguuaaaauaagcagcaugaacccuuuccaggccuggcuggcugugagcauuucauuuccuaccaauugugcacacucugcuagccaugugagaagauagaggccacacuuagaagguccacugauggccaggaugugaugggggacaaagcuggguccaugcgaaugacgcagucucccgagaacuuggccuaggagucaggaggucuccaucaggggagaauggaagaucuacugggaaaggugcaugaggaggggagucagugaucauucacuuggcucccucagccuugaaaaugguucagcucaguaaacaucucacgcauugccacaaaccugugucaagaacauguacguacacucauuacuuugaaagucagucugccccaccagacugggcgcuccccaaggcaggcucuaaaucccaucugcauccccagugccuggcagcagagauggaguuggaauggagggauguaaagaaaaaaaggccugccccuugccuccagggcucaccauauuuugaaugagaccaacacccaccuaaauaauagacaaauugcagagcacugagcucuccaacagaauccaggagcacuggguuggggaagugagggaugaugaggcgaugaagucagggggcaugugggagggcaucuaaggaagcuccuggaggauuuaagcgugacucccaaguuaggaaggaauuacagcuggcagccaugaggggaagguuauucuaggggagggcagcaugcguacaaagguuuggaugcaggagaugacaggugugcaggccagaguggcacuaaguauauuugaaaaaagaggguggagaugaaauaggagaggucacaucaggugugaggaugugaaggucuguguuggcauccugcagucccauguuuuucagaccucagugucauaggagucaccuggggaucuaauugcagauucugauugaguaggucuuggggagagccugugauucuguauuuuuaacaagcauaguaaugcugaugcuacuagucuaugugucaccccuugaguagcaagacuuuaggcaguagagaaccauuuaagguucugagcagggacaggauuguggucugauuugcuuuuuagaaaaauuacgcugaagacugcaaagaagcuuccuccgcaggguagaggaaugcaggcaggaugagagauuuauuuuuuuuuauaucuccaacaccuagaauggugucuggcucauaacagauaaucaauagauauauguaaaaggaauaaauuagccauuuaugacggacuucuuaaaugagaaaacaggaagaaugaaugaaucaaguuaucccaggcugacaagcugauacuuuauaaaucauucauucaggccaguccaaauagagaauaggucuuaaggcagugguuuuucuagcuuguuuuuagacaaagaucugauugcuuaaaugaaacucgaaauggaagcccaauaugugaaucacauaaaaaauaaguaagcgccuaggcuggaccgggaguaagagcucugaaaccuaacaaccuacuccuuccccuuucuccugacugccagcgucugacauuucccacuguaccuccagacucucacaaguaucagccaccccaaaaagccagccugacucccccacaaccccagaaugggugagggaggcagcccuucagcaggaucugggauggggauuaucuguuucuggcucaguuucucccacuaaacagugaagucccacaagauaggaccauaaaagacccaucuuggcagccucaugcccaacacagggacgucgguugaauagggaacuuaggaaaggaugaugggcagagauggaguggugagccaccaagucccaaggccagggcuugaguucccaaaaccccaaacauguuaccucuuaccucuuaagugccaaaaguaguaugggaggcagaggcgcacaggggauggaguucgggguucaaaucccagcccaggcacuuacugacuauacaacuuuggcuaaguccugagcgucucugugccuuggcuucucaucaguaacaggaguguaacaacucucccuucaguggaaugcaaugcagaacgaaugaguugccagaugcaagccaugccuucucaacagugcagcccucuucacuugcugccauaggcagcucgccaccugccuuucuucugcacgggugucugcauguugcauuuaagcaggaagcaucagucacgcugacaaauaucugugcccucaggugguguuuguaaccaauuagagguuuggcauuuauucucaacugccuguuguuauauuuuucaaauagccaaguauuuaaauaacaucagccugauugcuccugcagauucauagcccuuguccugcaccagggaaauccucuugcagacggcagcugcagccuuguggaagggacauugggcaucagaacacuguaguagaguccgagcucugcuccuugccagcuaggugaccuuggacaagucacuucuccuggugcaggcuuaauuuccucaacaagaaaaacauauauuuguauagugcuucacagcuucaaagccacaucugccugccccugugacauuuccaucuaaauguagcugaccuuuaucaccuccaugauauagcuaaaaaaauggaggcucucuguguggggcuuugaaucucagcucccuuaagaagugcugugauguagagcaaauccuugcccucugugauucucaguuucuauaaaauggcaacacaacagcacacaaauaucaccagacaccuagugggagcccagcaaaugagaaccacuguguguacuuguuauugguguauuagugucauucgucuagcaucacaaagccaggucucaaagucagcucucuugagccagaccccacacucuugccugcggccauuggaaugcuacuagucugugggccaaacauuaaguagcaaggauacuacuugcuauucgcucacugaaccauugggaugaggauaugaaaccugcuucuuuggguuagcuggggcagugugauuggcagugcuguguacaucaugaagugccagguccagguaaggacugggcacuucccucuggugagguagauccaauuacuugcuauagaccaaauuauaagcccagacucuuucuuuuagauuaugcuaaaaaucauucucugggcccuuccuguuuccuguuuagcaccaggcucugacuugaacacccuuuccuugcgcucguggaaugggaggagaaggaagcuagcaggccaaagcaggcacaacuugggaaggucgaggcaaaaagggccaguuuccagccaucuagccuguuguggggccuggcccucuugggggcuaauccccuuugugaugcucccuuggagcaggcacagagucuaagccaauuaaaacccucccuuugaaggugguucagguuucccagagagcacaggccugcacagugacccaagguaauuguuucaaggauugcucuccucuccucccugcuggccagagcuggaggaagaccagggcuuugucugggaaggcuccaucacauuuucccgcuccagacccccagaugaccaugugggucugcaggagaggcaggauggcagggauauaaacaacugaccaucuuacagaugaggaaagugaggccugggauggcuaugcagggcugagauucaaacugcaacauaccugcucaaaacuggugccugcucugucuuucuaggacaagaaccaaacccuugucaccuucaaucccagcacagauggggccuauaguagguuucuaguacauauuuguucagugaugacugaauaaacaaauaaugcugaacaggaacauucgucuuaaugcaauagugugaaugggccggagaaauccagaacugcaucugggccggagugaaguauuaaauacuugauaauacuuagcaauaguagucauaauaaacagccaagugcgaagccuguucuaagcuccuucuaacucacucaguccccccaacaacccuauuggguaggucaauuaucuccacuucaaagaugauauagaggaauaaagagguuaagugaauugugccuggcacacagcuggggcgcacagagcugggagucgaaccuuggcuuccugacugcagagccaaugucugggcugcuaugcaccccuuucuuucuaacaggaaugucuuccucugugagguucagauggugaugaccuucacccucccugucuccccgcaauacagggucucagugacaugagaugugaaggagcuuuccauuagaaacaccauacuagacaaucuggaccauugccggccagcagaggccaggcugggcccuagauaccaucacccucuggguuucagcccuggagagagcaagcagccccacuccagcuggaggagccuccaagacugguacauuucacaacugagauuaaagacccauaaaagcagaaccgauggagugacaggcagagugucuuaaugaaaacaaauuuagaacuacaaucaagagaacaaagugaggaucgggcccugggaagccagacuccagugacccagguguaacauuagccagcugcggggccaagggccagagcuuccccacggaaagaacagccuggggcccuccuggaagguagagaggcagccacaguugcugagggaggcucugcucagcccacaagagcccacuguagugcgugugcagccuggaggcuguagaggagcacagcauuuguccuguauacccuggugacugcuaggaaggcaaacagggccuccucagcuagagucaggggccccuccuucacccccagugcagagugauuaaggacauucugagaaugucaccucuguacagugagcugcaggaaggaccuuguaaagggaagggggcaucugaaacaggagaaugcagagcucagagcuaacaucccucgaucccucacuaaggaacaugcgacugggcccagggccgaggacagaucuuuucagcgcuucuguguuuguuagaugguuuuuuguuugauuuggaagccuuguagggauuugaggcuggaugguacaaguucaugcaggacuugugcuaacagcgaucucugaucccaagcaauaggauucccaugcagcauguuucugcuccagcggggagcuugguuugaucagaauccucucagcauggggacuggcauuccucaaacauauggaauucauccaacgacauucccuucuaacugggggguaguuaaucauuuccuugucugucucacccucggaaugcauggaaaauuuaaggacauaccucugcacucagagucaaaagaauugggcuuuaucugaguccugguuccugcuuuuugcuagcugugugacuuggaaacaaggcacuuugccucucuaagcuucaguucuuuauuuaauacaggaucauagcuacucagaaacauuuguucauuuguucaauuagccauuauuuauuaagugccuacauuugcaaggacagaagcuuggguuuuaugccgaacaagagagacacaguucccaacucuguagagcuuagagcauauaauuaagcaacuacuuaaauauaauuuugguaaguuaucaaaaaaagguacagaaugguagauuaaaucacauuaaaauguguuagaaauguauaaguucuaaaguacuauuuaaacacuaggcagcauuauccuuauuacccucguaauauuuccuuuuuuuuuuuuuuuuuugcgagacagagucuugcucugucacccaggcuggagugcaauggaaugauccuggcucacugcaaccuccgccuuucagguucaagcgaucccacugccucagcuucccaagcagcugggacuacaggcauaagccaccacacccagcuaauuuuucuauuuuuaguagagaugagguuucaccauguuggccaggcuggucuuaaacuccugaccucaagugaucugcccgccucagccucccaaagugcugggauuacaggcaugagccaccagaccugacccaguuccucuuauuuuuaaaauaccuuaaugaucugauccucaguuuccuccccaguaauaugggaauuauaaaaauaccuaugucagccagccuuugcuauauaacauaucacccuaaaaugcaguggcuuaaaaugacugcauguugguuccuguuuccaagagucaguuauuugggcugggcaaagcuaggugguucagcuagucuccccuggguucaccuguguggcuauaaucuaccggguguugguuggcucagcccuguggcuccagcaacaaguaggcuagccugggccucuuuauaugacagcuguuuuccaaaagcagggggagaaggcaaucccaaaggcucaaguguuuuucaugccucugauucaaguuugcuaauauccgcuuggcccacuggccaaugcaagucauguggccaaccccagaguuagugugggggacuacacaagaguuuggaaacagggagguaugauuccuugggagccauuaguauggcagucuaccaucaugccucacuuccagagucguucuggugacuuaguaauaaauacaggaugcugugcuugugguguuuguaugaauauuggugacuguacauaguagauguuuaagaauuggucggucaauaugaaucugagcagcuugcuaccuuauuaaggaaaagugacauuacacaggaaauaaguggcaagcaauuggccaaaacagcauguaaagugugggguuauggguauaugcagagcaguuucagguaauaagacugcaucugacuucaauuuucaaccuugguguuuuacauuagccaaaagaaacuuuuucagagaagaauggccaggauggagacaacgugagugaggacugaaucaggggaaggcaaauaaauacuucuccuggauaacaaggcaacauuuacaccuauugacugagucuuuauuaagugccaagcauaggauugagccuuucuaugcaucaccucauuugagccucaagacaacccuguaaggugguauauacuauccccauuuuacagauaaggaaauugaggcuuagagaguuuaucauccaaaguuguacgagaaguauguaagagauucaggguucaaaucaaggucugccugacucaaaaaagccugacccaaaaaaaaaaccccccuuuuuuuuuuuugagacagagucucgcucuuucgcccaggcuggagugcaguggcgcgaucucagcuuacugcaagcuccgccucccggguucacgccauucuccugccucagccuccugaguagcuggaacuacaggugcccgccaccacaccccgcuaauuuuuuuuuuuguauuuuuaguaaagaggggguuucaccauguuagccaggauggucucgaucuccugaccucgugauccacccgccuuggccucccaaagugcugggauuacaggcaugagccacuacacccggccaaaaaaaacccuuuucucuacauugaaauuuuugggaacauuauaguucacaugcaauuauaagaaauaacaagagauagccuguguacccuuuacucagucucuccuaauaguaacauuuuacaaaacuauagcaaaagaacagauaacacaagcaggauguugacguugauacaauccacucaucuuauucagauuccccauuuuacuugcauuuaucugaaugagugugugugcaugcaugugcguguuuacuucuauacuauuuuaucacauguguaggugaguauaugcagucaagacaacgaacauuuccaucaccauaaguuuccuucgcaguccucuuuuauagccacacccaccucccucccaccccuaccccaucccuaacccccuaacuaccaccaaucuguucuccauugcuaaaguuuuaucauuuuucuuuuaaacauguuauauaaauggaauaauguaggaugaaagcuuuggcgauuggcuauguguugacucagcauaauucccuggugauuuauugguagcauuaguucauuguuuuuuaucacggagucauauuccauggcauucugucauugauuuaacugcuuaccuguugaaggauaucuggguuguuuccauuucucggcuauuaugaauaaagcuuuuaugaacaucauuguacggcuuuuugcaugaacauaagcuuuuauuucugagggauaaaugcccaagaauacaagcgcuagguuguacaguaauugcauauuuaguguucuaagaaacugccaaccugcuuuccagaggggcuguacacuuuuauauuccuaccagcaauguauggguaauccaguuucucugcauccuugccagcauuuaauguugucacuauuuuuuauuucagucauucugauagguguauggugauagcucacugugguuuaauuugaauuucucugauggcuaacgauggugaauaucuuuucaugugcuuauuugccauguguauauauccuuuuuggugaaauauuggaucacgucuucuggccauuuucuaauuggauuguuuguuucucacuguugcauuuugaaaguuucauauauauauguguauacacacacacacacauauauauauauucuagauacuaggccuuccuuuguuaguaugugguuugcaaaaauuuucuccuaccuguagcuugccuuuuccuccuuuuaaggguauuuucagagcacaaguuuucaauuuugguuagguuccauuuaucaaauuuuccuuuuuugaucaugccuuugauguaaagccuguguuuuuaaccauggugcuccacugcuucccagagccuggagaagagaggucuugguuugggaggaggucuuuggcuugcuugugagguucuaaggcauauggaguuagggccgccaggaaggcucucacaggagguaaguuucagcucacuaucagaaugaauuguccaaggccaaguuuagagaaugaaauguguuaggaguaagcucccugucacgggagcucaaacaagggcuggcugcuauccacguggacucacagaaggaauucaagcaucagauggggcuugggcaacuguaucccucauguucccuuuuaacuaagaauuugggagugugguuuuugaauuagcccugccugaaugggaguuuuuaacaaauauaucccccggguugagaaacguauaaaggcuuuggaugacaaaaccgaaccagucucaagaggagguggccagcugaagccacccagucugccauuaucuugucuagggacagaaugcacggaggccgaaggcuugcgauggcacaggcugugaggcuggggccuauuccuggaucccuguccccaucuuggaggcagcugcacacugccugccccaccuccaccccagcagccucuucuccauucagacugcccuggagaaucccuuucuuuacggcacuuauaagacuuaauuaccaacggcaaaguccuuugaggccuuggaugaaaggaaugggagcagcacaaggcuugauuaggcguguagaacucugggcacaauuagcuccaugagagacuggcccugccuuuaucugucuccaguucugugugacuuacagcggcuaauuauugaaauaaaaguugccuggccacccagcugcuggaaagagggccuuaauaucuauuaagucugccuuuaauuauuagagauggaggcagcuucaggcaguuaggguuuuccuaucauuaugggccuuuuccuccaccccuuugaggcuuggauacccagagaugucagugaaauucugccaaagcuacaucucucccuugcuuucuacauagcuuccuuuccaagaugccuuuacuaauccaccuuuccugcugugaggacccauagucacaccuccccaagggccuuugcaaucacugcaucucacagaacuuggagcccuagauggagcauuuuaaauuccugugugugugugugcacacaugggugcacacauaugugcauuuuucugggguaucagggcaguucucaggcauagauuaaaugugacaccccacaccaacccauuuugcagaagagaaaacugaggccguggaaggaagcaggauggagcugacagcuucuggcuuuucacuugcugggaugcggcugacugccagucacaaccccccaagccuuagcucccgccucucuaaaaacaaaauuucaagcagcaucaggagggcacaaucaguugcccccuucacaaaccuggggagcuuguguggggccgagggaguggauuugugcuaccgaaaaagagccacuuagaggaugccaagggagaggguuggcucgcaaagguuuccagcuuuggggcuuucauuaggcaaagagaaagucagagagcuuugcaccuagaaggaccauggagguggcauauggagaguuguauauuuuuauucacuuugguucaacccagcaaacccuggaugcaccucuaagcuguucuuagcauuggggaagaaucgagauguuauaaguaccaaugaaguuaaugauccaggugugugggcauuuuccuaacagaugaugaaauugaggcacagagcaaugcagggacuuucccaaggacaacccaccugcucuaagagcccaugugagcaccagcugagggagggaaggacuguuccgaggucacuuucaaaccgcuauugugugggcuucagucaucacgaguugagggacggccugagucauaguaacugaggaggaaauauaagggcuggggggauaaaaacagaaauuuucuuccucuaggcccgcccugccccugccccaccagcaaaauugaaaccugugucagccacgagcacuccgagcccacauccauugggcagcaguucugagcuugauccaguuccauccccagggcucaauagcaaaaggccuggugaacagaguuacaauagagccuuugguuucugaacaaucacagcagugggccagcagccauuaagcaugugugcaugcacacacacacacacacacacacacaccaccucugacaggaaggacagccuggguaaucccugcuguccucccagcugugaucagaggcugauggugaccucuagauuucuauccuuucagcuuagcaucagugucagguaugcccagggcauagacuacaugugucuggaccuggaguuuuauaagacaagaagcuauugugcacacaagguaucuugauggcacccggagaagccauugugauauuccuucccugcucaacagagcaucuucucugggccuaaagagcagaaaggaugucucuaaauccucccuuagccacagacccaaagcuguaugaacucaggcccagcgucuggcugagaagacagaggaaaagagggacuaaccccuuccuccagcuguuguguucaaccaagaacuuccuucaggcugaggaggccuuuguguuaaaacuaaguuucaccauuuccagaauccuucaacugaugccugccuuucugggauguugguuucccuucugucucucuccucucucaccucacagaguggaggccuaauagggcacccagguaauuacagguuaagauuggacgcaguaggggacgugugauuaaucagccucucucccucuucccucugcuuccuaguguggucccagaauaagcccagagaaagucaggaaaaaaauguuuuuacagagaauuggcaauccaauaaacuggguuucaggccugacccuugaagggguuuucuaggaaaaggguuuuucuagggagaaggaaggaaguauuuuucccuggggccugaaguacagaagagacuggcaauuucccaaagugcugcuuacaaggaaacucagaguccuaacagccagcuguacuuggggccccagugggucuggcuuccaagaaagccacaugggacugagugccccaaggcaacaugugucagauacaggagaaaggggugcaggggggacauucaggcugcaccaagaggcuuccaguggauuccagucaacacaaugggagaggcaggccagcaaacgggaucaucuuccucucccugcccuguuaaccccugcucggcuuuucagacccggcccagggauuccuccuucaggcagccucugcugcccaccccaccugaugcagugccccccuaccccgggugucugugucaguugcucuuuugcauccuuugugcuggaaucaccuguagacguguuuguccuucugacauuccugugggcucuucgaggaucaagacugcauccgcuccaaccccuuguccccgggucuacccuaggaucucauaaagccuuguuggaugggaaagagggaacgagguuggacaaacccaaggaaaaggucaccagaaaggugagggcuugaaaacugugggagauauguuaaaucugaagagaggaugcagacacccagaccagcccggucuucagucuggaagagcuauugcugaggcaaaggcauuaggcuuauuuccugagaccccaaggaguagagcugaggccuguggaaggaagcuaaaaggaggcagguuucagcccccugagguaguaaaguccccagcucuggagcuggugugaccacucaguagggaugggacugaggaggguuugggcaccugauggggcuugaaucagcugaccuuugauguuguuuucaauccgaacacauuuucuuucuucuuuuuuuuuuuuuuuuuugaaacaaagugucacuguguugcucagacuggagugcagcggcucgaugucagcucacugcaaccuccuccaacucucagauucaagcaauucucaugccucagccuccugaguaacugggacuacagguguggaccaccacacccagcuaauucuuguauauuucguagagauggguuucaccacauuggccaggcuggucacaaacucccggccucaagugaucugcccuccuuggccucccaaagugcugggauuacaggcgugagccaccgugcccagccuaacacauuuucugacucuaagaugccaccauuugucaaagggaaucauuggcuccuacgugacuuugggggcaggaaggauguagaccaaaggaaucuggaagacacagcuaccauaauaccaucuguugauggaaggccuguuguguccuaggcccugcacaugcccagcccucuagggggucaggcagcucuggggggagcccucccagcuccgcagcucaggaucagagaagcagugcccauacagcagcugucugcccuuugauaccuggccucugacaagcucucuaacagaagggcaagauggcuucuguagacagcggcaccaucugucaccugccugccagccgcugauuagggaugucccuguagccaggcugggcacacagccacacuccaccacgcucccaggaaagcccugucucugucccgacaguucucuuucuguacagggcacguaucaagcagcagcuguaaaagcgcuucucccaggaguccaggccaggugcugacucaguucaacagaagaauuaauaauguuuuuuaaaaaaggugaaagaacaaauagaacauuuaagccaauuagaauauagaaugacguaugcaggaagcaguguagguuaugauuaaaagcuugaaccuuggggucagacagacacagguuugaauccuagcucugucacuuuuuuguuguggccuuccaggcaggauacuuaaccucccuaaauccugguuucuuugucgauaaaauggggaugguuuugggaguggugagaacucagugagguaaugcauauaaagaccuugcuuuuagccaccauuauuauaaucacugucucacuguugaaaaaggccagggauuccccaaagugacagugccagagaaauaugcucugggugcuacaacagagaguacagaccucagaagcagagcucccggauuccaguccugguguguugugugaacuugagcaucacuuugcuacucucaguuucuaaaucaguaaaguggggauaggagugccuccuucucugguuugcacaaagcccaacacaauacuugguacaagaacagguaccaccacaagccauccuccccacccccacuuuaaaauaaaggacucaaagaccacacuuugaaggaauaagaaaaguaaaauucacgauuuuacacauacacacacacacacagaugcuacccaggacuuauauuuuguggaacacauuuuagcucugaaauauuuaugggcccuuuuugacacacaaagaacuaaaaauaucacccugugcuuauguuaaggaaaacuuauaaaacuuuaguccaguaggaauucagucaauuuccuggcucguuucuggcuguaucugaggcugcgagguaacccggggugauaacagcccccauuucccugcggguuuuggcaggggcagagguuuuuucgagcacuguacugucuguggaagucucucugcgaaugcuccaggcuccugccccuucauaaauauugcuggaacccaugugaaggggccagguuuguuucuugaauuucuccucaaacaccaaaagcuuuauuucccauaucuccccuucucccgggccccacacucuugccauucuuccagaccagcuccagccucccaaggcagcagggccucugaaaacuagcugcagggcacgcucccuaccagguccuccgagggcaggcucucucugccacaugcauuuugcauuuuacuguccacuuacauuuaccauguagggauguuacuuuauuucuucuaccaggcugcucccuccucacuucucaagcuuucucuccaaccucuuucccuccccagagucugaacucucggaauauaacugggccuuugucugugccagguucauuuuuccaugcugugaucuaggacaguguuuuucagacuguagauuggcaucucauucauaauucuaguuaaguagagaauaaaauaucagauuucacccuugcaguaagguucagcaucuuuucaugaaauuuuuguuuuaguuaaaaaaauuguagauguguguauccuggauugcaauauaagcguauuuuuacuguaggcaagagaaauuugaaagccacagaucuaaacuuuuuucucuccuuaccucaaaaccgucuuuuacuugacauucuuugguuuucauuuagaugucacuguuucuggggaguggucccugauggucucuccaccuuugacccaccuuggccuggguguggggcaggccccugugguguccuucccugccucucccucugucugacuugcccaguguauagaagcaucuaggagucagaagcacaucugucuuguccucugaugccuccaacaaggcuuggcacaggaggguaggaacugggaguucggggaggagagaagaagggagucuccuaugacgccuccuuggaucuuuugcagcacuuaggacagaaaagggacuuagcaaugauuaccaaaugaaugagccuauggaacuagguuuuugauccuuuucuugagguucaaacauuuucuucaguuucaaaucuagacccugacacuuggaagccacgugaucuagagcaagccaguuaaucucugggcuuguuaucucauugauaaaauaagaguaaauaagagaaaauaaagaauaaaagaauaauaccuaacuuaccaaguuauuauagggauuugaaauaauuuacacaguaccaagcacaugaggagguguucaauuaacaguaguuaucuuaccauuacuagcccuuucuuuuccugucuucagugauccccugaucaccaucaccaccagggggcucccaggccuccccacauucacgucccuauugaaaccuuccagauccauccaagcccagcuucacauaaaggaaaaagacaaaaacaaaaaaaauacugauaugguuuggcuguguccccacccauaucucaucuugaauucccacguguugugggagguaauugaaucaugggggccgguuuuucccaugcuguucucgugguaaugaauaagucucacaagaucugaugguucuauaagggggaguuucccugcacaagcucucucuucuguugucugccaccaugugagaugugccuuucaccuucugccaugacugugaggccuccccagccacguggaacuguaaguccauuaaaucccuuuuccuguauaaaguacccagucucagguaugucuuuaucaguagcgugaaaacaaacucauacaaccacccaaacauggauuuuaaauucagaaggucuggguucaggucucagcccuguccuuuacuggcugugugaacuugaucagauaacuggaucuuuuagccuggccucaaaaacgagaaauaauuauggcuuucauggggguaugugaaaagcacugugcucaacacauaugucuucuucccuccucuccucugggccuacucuccuucuccacagacacaccaaaaccaagacccacguuagcauaagaacaagcuuauaaaacugcaguuuauacuuuaucaaagcauuugucacugauggugauggucccuagggcugacaccccagagagauggugagcugucacuggagggcuugugacccgcuccucucuggaaccuccagugcccagcacuagacuggucugcaacaguuugugaaaaugaauucuucucuaaggcaccuuugugguacucagguuuugcuuggagaagaguuucagaacacugcgccaugucuggagcagacugacaggccgagucccugccagggucuuacacaucucacagauggcgucaguggcaaugugcucaccugggggccacaugcucuucgucuugauuggagccucuuuguuuagccugaggccuacaaugacugagcuacuaguuugguccuuaguuauauauuugcuacuugagcuucccaaaacauucucaccugccuaauuuggucuagguuuaaaguaguuacauaauuuguuguuuagaaauaacaacacaauaaugaugauggcauugacaguaaugauuuuccaaucccuuauaccaauuuaguacauuacaguuuacaaaacaucuaacaaacucagccucuuggaguaaguuaaauguccugugcccagggccacacagcuaggagguggccaggacaggccuuacuccuagccuggagcucauucuaucacugucaggauagaggguucuggaaagaagguuugcaguuggacacuuccagcucuugagucucuuccugugugacugcaagccaguuauuuuacuucucuaagccgcaggcucuucaucaauaaaaugggaccgauucacagagguagaaaugaugagaacuaaaugaaaucaucucaagcacuugaccggugccuggccuauggcaaacccugaguaagugguggcugguguuauuauuaguucaaugacgaugaugauugcugaaagccaacagaaaguaaggggugaagcuguaucauuggucaggauccuaacaggaaacaguucacucuagauggcuuagaggagcagacuuuaaugaagagacggaggugcagcagggucugagagccagcccugauggugagacgccugggcuguagcaacagcaagaaacuggcacaucccugguccugcacagaugaggguaggggaagauguuagcagagcccaguaugaagcggaggccuggaggaggggcuaccugucagagaaggcauggacagaggacuagagagcuagugggggcagggaagacacacucuggccucucaccuaaugugacccugcccccaucuccuccuggugccgcccuuaggugaguccacccaacaccacuuguagaggcucagcaauguuaaagaguaugggaugucuggcaaauggcaggcaguucugcaugacugaaauggagcauaugagucugcgagagacagguugcucuguggcagccagaggaagcagagagagacaaggaaaguucagaucuccagaagccuuggaugucacgcucauggguuuuauggggaacccagagguugguggguaaggagggagcgaacacguuuaggcauggauaugugccaugugcuucugucccugaaccuguggcuggggguugcagggucugaggugggccccuuccccagcauuccuucuguccuucugccggggggcuccaggucacuguacugaagucccuugcuccagagggagcauuucuccacugucacuccucuuucaccccaaccucuucuuucucgcucuguuaaaugccaauuugagugugaaccauaacugaccucccaucuguucaaaaacaguaaauauuugcugaauuacuauauuaagccuaaaaugugaaaaaaaaauuuuaaggaaaugagaaccaggcgaauguucucccugccucagcuuugugacagggaagcugugcguuagguguguauguucuuaauaauuugugauuacugagccuuugccuugaugccaaugucuucagucaacaggcacacacugauaagaggaaauagucacccaccaauuuaacagccuaaaacguuucucagccuuauuuacauaugcuucugaggggaugccccuuccccaguuauaacugacacuuacccguagcuuucuacauuaugccuuuuaaacagaaaauguguuuguuuuuucugaugauaauaauagcuaacaucuaugagcacucauuguguaucaggggcuguauaugcuaggggcacaucuuaacucauuuaauccucaaaacaacccuaagagguuuuacagaugagaaagcugaagcacagagagguuaaauaacuugcccaaggucauucagccggucagugggggaugcauaccgcaagccugggcuaccuuugaaauuuaaaaaaagaauacaugugagcaacgccucuaauucagccuuagauuuacguaauacuuuacuuaauugguagugaacuacuaauauuuuauguuauugaggcuuaauaagaagacaugaaguagcugccaaguaguuucauucaugcaugcacuuaacaggcauuuugugagcaccggauaccaagccuaccuacccucaaggaaccguagucaaggggagaggcagacaugaaaaaaagaucaucuagugggcugcaugugcagugaugaaacaucaugcacaaagucagagaggccacagaauucacauccaggaaagugugaguggcucagcaagauggaagcgaggugagccagacugacaagagccuucauuuugaccaggaagccagaauugaccccaaaggcucagcagggcugcuagagggcauaagcaggacaauagcaugaccugggccucaaaaauuccccuggcacagcccauacagcaguuauacccauuugcugaguucaaccucaggaucacaauuuuuucuccaccaugccagggccauguaaccuugggcagcauacuuaaccucacaauuucucaucugcaguuugcagagaaucauaauaccuauaucacaggguuggggugaggauuaaagauguuauauauaaucauaguaaaagcaagcaauaauuaaauauuagcuacuaagagucuauuagcuauauuguucaaaccauuauuaauauuaugaguuauuaauaugaguuauuagugagucauauuaauaauggcuaacauuauggaguacuuaugcuuauuauuaucaucaucauuauugucacucagggguuagaaguaaacaggcagaggcagcaguugccauaaauccucauucaaauuauaccagaauagugcuuugcguugaaagccaguauuggguugugauaucaauuuagaguuauaaucagucauuuuuuaaaaaugaaagagaaugagauagaacauaucagagugcauuucucaucaugcaauaacuuuugugaaucuuuuguuucucuuuuauacauguaaacacacacauucgcauacaucaauguguguagugggucauuauguaagauauuguaauuuuuuuuuuuuuuuugagacagggucucacucuugcccagcggggaguacagugguaccaucacagcucacuauagccuugaccuccugggcccaagcuauccucccguuucagccuccugaguagcugagacuauaggcaugugccaccaugccuggcuaaauuuuuguuuguuugucuguagaaacagggccuugcugugcccaggcuggucucggacuccuggccuguagugauccuuccacuucgccuccuaaaaugcugggaugacagaugugagccaccccaugccuggccauaauauguuuuucuaauuauggacugcagucaagaaaguuuuuaaaacccuggaguagaagguacuaucacugaucuucccuugugguccugcuucucagacacucagaggacuaucaucuugccagcuauugggaacacugagcaucaggauggcagagcucagagcucuggguuugagccucaguaauauaauuugauuucugugugucucgaguuacaccccuugccccagcauuaauuuccagggauauuuugagaaucgggaaccaaaacagugucaacuauucaucuuaauuggaucuagguauaaucccgaggcauugcagucuauguaguuagugccagcuuugcaacuaacucaccauguggccuuaggcaggagacuauauggcccugggucacuguagcuucaucuauaauauggggaugaaaauaauuguaaucucuacuucacaguuauugugaggcaccaauaaaaucacaaauguuugcacucuuggaaaaacgggccaaagagcuaccucugauguccauggucaaaggcagaauuuggaaacuacgagccucagagcaaauucaacucagaagucucuuuuguuuggccugcaaaguauuaaaauuaaauaauaauaauggaucaacauuuuaaagucauagcuuuuauaucuaacuccaaauuuccagcuugucuuaaaaauucacaagacacccccaccccccagacacucccacccacacucccacuuugcagcacaggcaagcacuuggacagacccacccucccagcugucaaggccccacccuggacacugagaucugauguuggcagcauuuaucacagcucuugcucuguugucucucuaauuggauagugaagcaggggaaugucuuguguacccaugcugcucugaaagauggagcaacagaaagccagaacugagcagguuguguuucauaaaaacuaagugaugcccuaugucucugcggaggauauucugcuuuccuucuguauugagcuccuggcccuguaugguuguguuugcuaccccagagcucaaagaagacauuuggagggagaaagagggugcuaucacaacucaaaaauccaggggugucaguguagggcagaagggucaagauggggaaaagaggagaaagggcuauuaggagcuucccaccagucagaccuucuagcaacacccagauggauggggcagacacugugcugcccagugcugacgguggcacugaggagaugggcaagucuggaggugagggacauucucugaguaacuggaagggcacuuuuguguacuaagaguaggagggagacgucucagggaggcagaauggaauaggaaaaaugcaggcuuuagagccaaacagaucagaguuccaauccuggcuuuuuuacuugacaccuaagugaccuugaaggggguuccgagucucaguuuucucaucugucagauggggaugguuagcugguuaauuaaacacaucuuuauuaugcgccuacuguguaccagcccuuguucgaggugcuagagaccaggagugagcaguacagguaaaguuucugcucucauagagcuuacagacuagcagaaggagaugggcaaaaagcaaauaauuauauaaucaucugguagugguaaguguggguugguuguuuauaccuuagcucguuuccaaaagagguuggagagaguaauaacaucucagaagauaucaagauuuacuaagauaauauaugcaaagugcuuaccccaguguuugcaugcaaucauucaucucacagauuuuuaaggagcccugggccagagcugggucaggcccugcuccaugugggaugugaugggaaccaaacaggcuugguuccuaccuaggaauauuacuaaccaccagugcccuuuggccuuugcugucagcuuccucggugcccaucacuggaggaggccuccucaaggugaauaggcuaaguagcaaaaagggccaggauuuguaauuagagguccugggugcgacuuuccuuugccacuuaugggcugcguagugguggagcgguacccucuccuccacugccugggguucucuguccacagggcugcaagggugaauccaggaccaggaugaacccgggaauguucucugccucucacgcccuaucuuugguuucccuggcucuagaccacucggcccugagugcggcgaggacccuguuuguggauguggaggagcgcgggccggaggccauggacgugaaggagaggaagccuuaccgcucgcugacccggcgccgcgacgccgagcgccgcuacaccagcucguccgcggacagcgaggagggcaaagccccgcagaaaucguacagcuccagcgagacccugaaggccuacgaccaggacgcccgccuagccuauggcagccgcgucaaggacauugugccgcaggaggccgaggaauucugccgcacagguaaggacaaggccgagggggcgggccucaggcgcaggugagcuuggcucagguaggcaugggcucgggugggcguggcgcaggugggcguggcacaggugagcuggaacaccaguuggggugccauaucaacagcaaguuucugccauuugggcacuuggaccugguaaaaagccugcccuguaguucauucuuaguucauuuauuuucucgcucacccacuucccuggcauagugaggugguuaggagcugggcuccaguguuugucuaccugccuagaguugaguuaggcuccccucuaagccucaguccucaacuguuacauggccgugagaagccucccuagugcacugaauuguccugaggacuuaaugagauggccuuuaagugguaagccugauaauaccaaguaagcgcugaauaaauguuaguuccuaguuuugcuguucauucaacaaacauauuuagcaguuucuuugugucaagcccugugugaccuugagaggaagaccuucccgagaugguuagacaugaaaacuuaguaauuuguaggauauucuggugccuggcucccucuccugcacuuucuaccuacaguaguccccaaagccuauccauccugccccaguauucaaauccauucuucuuagccauucccucugauacuucccagugcaaaccauuaucauuuuucuuggaggauuaaccacaaccaccccccuucacccagagcugcccgccucuagccauucucuguacugcagccagaugaagcuugggggugacucccuguugcccuuaaacugagcucccccuagcauagaacucuuuccccaaaucuguuucuguuuuucuagacuuuuuuuguccccuaacucuccacacuccaccacucaugggccagcccugcugaacugcucaaguuuccagaccugccaugauauuucuuuccuacccuggugccucggugauuccuguuuuucugccugcagaggcuugagcccucuuugaugccuguugggucaugaccaaugccugacaauuugugcagcccacccugauuugcucugcccuucucccccuucacagacagggucagcugagcacugugcuauguaauguauaugcauuuugacaguguuauuuaauucucauaacaaccccagggugaaucauuugcccaagaucacagagguaagaggagcuggccacacacacacacagagcacaccuaugaccucuucauuuccauucucucccacaggccuguauccaugugaaagcugaccuguucugccugugaggcuugaaaaaugagcagucccuuucccagcuuaugguuaaggcuccaacucuggcaucaaacagaccuagauuugaacuguggcucugccauuuuuaguauucucagcuacuuuaccugugcaaagggauaaacaguaccuaauagguggugaggauugaugagaacuauaaaugaaacacuugacaccaguaccuggcacagaacagaugcuucagaaaugcugccuguuauucauugucaucucuggaucucacugaagagaagagacaaaauggucucugaaagcuuuucuuuugcuccguccuguccguaagugacagagcucagugagccccgguuggcuuggaccuagcacaugaggcucagggaaggggcggcuccuugucuuuguaaauaacaaauaagcauucucaucucauaggcaggcaugugcguagcaguuuacaaaauacucuccuucaaauuaucacccuggauccucaaaaauccuuugaagguagcaggucauagauuaucaucccauuuuaaagacaagaacauugaagcucaggugaucacaagcccaagauugcacagcuagauguugagugagaugggaugucaacucaugccccgggccucagaaaagaggccaaaaaggacauaaagcaaguaaaccaugaggacuucuuaaauuggaugaaguaaaucuuccaaacucacacaucagaggagcugacuggcucaacaggaucauggaacccuuagagugagcccuuaccuugcauuuuccuaggaguuaaguuccuaagacauccuagucccgagaugucuuaacucacuuguauugaugcugagucuggcugcuuaaaagggcaugcaggacaagccagauggaaaucaaugcagcccaggcuguuuguugcaaauaaauuugauuuuucacuuaauguaagagucauucuucauaacacgugaguggcuucucuuugagagggccggccgaacagagcacagauagaacuguggauggggacagggggcgagagcaggacaggagagaggaguguagaucagagagcggccagggagugugauacgcagggagagcaggaagccgacugaggaauuuaggcucuaauuuggcauuuucuuuuucuuugaaggagagcaaaaucggagggcagauuggaguagggcacggaggagugguaugcaaaauacuuaacaucugguuggcccagccucuaaccaaucagaaugucugccuggccacugagcagagcccacgggcuucuuuuaugccugguccgcggacauuaacccuuuguuuaguaacuggaucaugaggagauuggggguauugggaaggggcuggaacagccagagcagaggcugaaaggcacuggguguggaaggaggcacugagguggcuuggcacaaguuauuuaccaagcuguguggaaguacuucaugacuguaaccuggcaucaaggcugucccagccugagccagcugaguaggaggccugagauacaccuccacccaccaccacagccuagcauagcagcuugcauuucagcagcaccccagcuggucucuccuccccgcuuccuuguccccuuaucuguuguccagaguacugccagaguaugugcuugugugugugugcgugcuugugcgugcgugugugcaugugcgugcgcgugugugcucgagugugcaugcgugugugugcucgagugugcaugcgugcgugugugugcaugugcauguuugcacgugugugugcacuuguguguucaugugugugcgcacgugugugugcacgcgcgugugugcuugugugcaugugugugugcgcgugcacgucugugugugucugcaugugugugguuaccuaacuuuuacagggcaccuacucugcagcaggugugauagguguuggauucagauaauuaggacacaccaggggagcacaaguuuaucuguaagagugagacacaccauuauaauaagauggcgucucugcuggcucgccuccuaccccuccggcaguucuuucuugcuuuccuuugcaggcuuguccuauucaguccuggccgaggaggccuuuaaagcuuggccauccaccucuucugccuucuaacuugucauucuccacauucacucucaucgcaaaccucuccucuaagcuccucaccccaauaucccaccuucugcuccugcgcucccagagcacucuguggaucuccccauuuugaacuugcacacuuaaucauguguuugguugugucucuccuacccgccagagaguucuguaaaguugggcacuguauccuauucacugcuguaucucaguacaggcccagggccggcaugaauugguuuaaauguggguucugccugauuauaacuccaguucuccagaucgucacguuaagugggaucugacccuuacugacuuuguauacucccucuuccuuuucccugcaacacauuccugggaauacuagaaguacaggagaagcugucccugaauagacauugaauucacaugcaggagugacagggaggcuaguuuuccaugaagucagcauucucuuugucacucagguacuacuccuaggugaccuucucuuacccagccucuguccuaggcauugccaggccugcccaagcccucaagagaccugucucugccaguuccccaucacagacccacuugggauaaggaagcagcaggcagagccuuuuuccuggugugaggcugacuuuucucugccaguccccaucuucuucacucucaagcuucaggcuuucuugaccuggccagaaaggaacuucuggccccaagggagacauuuagaucucaucgacugggcuucugcccugcucaggacuugcugaaaaguccucccuggaaaaggagaccugaagcccucaauucauuuuaacaagcauuuauugagccccuucugaguacugcauuuuuguucuagggaaagagauuuaagaauaagcauaagcaaaacauggugccugcccuugcugaggucaccuccagcagagggguagacccuuaaacaacucuacugugcaguaugaccaggcccaaggacucuggaaggagcuuggagaaagugaaaaugaauucugcacagguguugguauugggguagacuucacagagcaggugccauuugaguugaggcuuaagggaaauggaggguucaggcugaugaagagggggcagaaaaagcccuccaggcagaggcaaucacuugaacaaaggcaugggcauagaaugccacagcaaguucaaagaacgacagugagcccugggguaagaaggccaggcuucaggcagaggcagacgcagaccucaucucagugcccuaaccaaguucaccuguguuuccucccaggugccaacuucacccugcgggagcuggggcuggaagaaguaacgcccccucacgggacccuguaccggacagacauuggccucccccacugcggcuacuccaugggggcuggcucugaugccgacauggaggcugacacggugcuguccccugagcaccccgugcgucuguggggccggagcacacggucagggcgcagcuccugccuguccagccgggccaauuccaaucucacacucaccgacaccgagcaugaaaacacugagacuggugaguggcugguuuggucugugccgggugccugggugguggggcugggguuuuauuuauaauauugauuuccugcuccacugccggggcucuggugaaguuggugaaaaauugcuuuacucucaggggucaaaugucagagucucuuggagagucacgugaaaugcccacccaugagugacaugccagagauugggucgcugcucuuugcuuccggauuagggaggcgccuaagucucugggucauugcucauaaggugccugugugcaggggagcagagagggcauggggcagugguaacagauuccccauaguuuauccuccaucaaaucagcaaggccugguccugccugaauccugcucaugccaucucuagcuccaggugcucagcuguccugggcaaccucuaggaacgcugucccacaucagcaucuuauguuguucagaggauggcuuccaaacaaaaacugucauuuggggauaacuugagguuuagggaagauguugucaaaggguacagcguuucaguuaggaggaguaaguuuuugaaauccauugcacagcauggugacuauaguuaauaauaauacauuauauauuucagaguugcuaaaagaguagauuuuuaaauauucucaccacaaaaaaauaaguaugugagaugagagauauguuaauuaacuugauuuaaucguuccacaggguauuuagguaucaaaacaucauauugugcccuauaaauauauacaauuauuaucugucuauuaaaaauaaaaagaaaguaaaaagacaaaaaaaaauaaacuuuaaugauuaaaacuugaggcuuugcugcagcuucccccugaucccaggacgugccagcugcacacucauuauuccacucuccucccugaggcucguucccaaggccugagagaggcugugggaggaaaagaugacaccugguucacacaccuccuuuucaugguggaggaaagggggcccaguuucagcgucuuccucuuucucccuugggaccuugcuggcagaauucugaggggcucugagucgaacgugguccugcguggagacuauugccuggggggaaucuccccuucuauauauuucaugcccuaccagcccuugggcagcuuugcugagccaggucagcaccgagguggguccugcuggguucuggcagcaaaggaaagaguggcagagcccaggaacagccccagcaccuggagggcuguuucugggaagcccagugaagaggaggccugcuggugcuuccgcacgacagccagcaaaaggguaaggggagggcagucugaauuauuaauagaauaggaagcaccuagccuggugccagugcccccugcuggcuucuagcuucaaauguagauccucgugauuccugcccgggauuccccuggaucagggcagggaccaggucagagaugaggcuuagagggguuagucucugaagaggaggcuccaacugaguggugcaaaaccaagauugauccccagauuggggaugggcaggagaccacgcacggucagggucaggugggggaaauguauccccuuaggguccagagucccauguggcagaguuccaaaggugcauccugccaccccucccagaggacuaacauguucgccuagggagccuguguacuugucuaggggugggaggguggcaauugcuuggguacuggguaguggcuuagcacugucacucuccguugguccccagccagcccugugaaggggccgaugaccucaguaccagaggaguuucccucucucuggugggaaaccacccacacucccucacccaccuucccaaggccauacccagccagcaacccugcuucuccccaccccgaccacgcacugaacuugagcauuaaauugaagggcagugcagggccuggcacaaagagaauagggucugugccaucacaccacagcaggcagggagccucaguucuauuacuggucuaggguguggcaugggguaaauugcauccuuucuugggaccucaguuuccucaucuauaaaauaaauaguuuaaaugaaauuagcauccccugaucugagaauguuaguucuuagaugggguaaggggcuguucuguggucaaauaauguaggaaacacugaaucaaacaaacuuaaaccacuuucuuuacugcagggcuucuuagaguuuuuaagauguuaaugugcaugcuaauggauaaauuaccaagggaggauguaugcagcauuccccaaaucaauuugaccacagaacucuuuuauucucagagcaucuggugggaccaguauucuaauaaacgcuuuuugggucuagcugagcuaaaugaaaugaccuguaggcccuuccagauguagaauucuuggauccuaauugcaugcacaagaugaaggugugcaagaggaaaaugauaauaauaacagcauuaauacuuaauaguuguauggcugggcauggugguucaggccuguaauccuagcacuuucagaggcugggguggauggauugcuugaggccagaguccaagaccagccugggcaacauggcaaaaccccaucucuauuaaaaauacaaaaauuagccaggcaugguggugcacacuuguaaucccagcuacucaggaggcugaggcaggagaaucacuggaaccccagaggcagagguugccaugagccaagauugcaccacugcacuccagccugggcaacagagcuagacucugucaaaaaaaaaaaaaaaauaguugccaccgauuaucucaaccuaagcacagugcuaacugcuuuagcuauauuaucucauuuacucccccuacaacccuuuaaagaagguuuuauuauccccauugcacacaguaaggaaaccgcagcccagagaaguuaagaaaucugcauaggucacacagcaagcaaaaugagauuggaacucaagccuacaugacucuaaaaucuuuacucuuacagcccuaguuacagugaguucccucuguagcaaaauacuuggguuauuuguucuuuugaaggcuucuugccauggugacaaaugaucacuuaacauaaagucaugacagaaagaggugcacacuugcgcacauuauuguauauucccugagagcugaauuacagcugaauuaagccucuguugggugauaaugacauauuaaucaagccugaagaguuucagccuuugauagugggacagagaaauggcugccugcuccccuggccauguugucauuucuuugugaucguccauuuccccacuggccacagaacucaaagccucacuguacucaggguagacgggugggcagaggagguaggcagaugaaucuaauaaagggcuucuguuucccacaucccuuccaagacuggacucccuaaaccuagacuccccauaggugcccaaaggcugucuacuugcuccugguuaggaaguuacauuaacagcuucguuaugcgguacucagaucuaaauaaugacagcaaucaugggaauggcucccuuuuauucacugauuagguucagguuccucuuacacuauuaucuccccaacuuauagcggaggaaacugaggcacagagagauuaaaggcugugcacagggccacauaucuaguugagcuggagccaggcucuaugacaaaagucuugguuccuuuuacccugucucucccuuuucuuuuaccuuccccuucucccaucuuucucuaguucccacugaccucaacaaaccccugggccccagccagaccucuccuuuucuugugaugagaacucggaucucaccaucagaacagggcucaguuccacuggaccugucagugaacacaucacaguguggucacuucucagggguagagcaaaggcagcaaccucaugcuaugggccuaccacuguacaugugcaauugccuuuaaucucccuggcaacucaguggcauucccauuugccaaaugggaaaccugaggcuccaaacugagacacaauagccugcgagucagcaaguuggcagagcuuauauuugaagucugguuucucugaguccuuugccugccuccauuugagucugcaggcguccucagcucucaguugaggccaccaaaaaugugcaaccaaguucucagagauccuuaccagauaaauguaaaaugugaagcauaacccccagcaaccuccagccacaggaacauuuacucugccuccacacccugccuugcauuagucaauaguaauugucaacaguauugauagcgguagaggcuuuugcagaggucacacugaugcugcaugcagcugccaucaauaauaacuuuuaugggguccauuaaagacaauuucugccccugaagguuaaugucagcagcuuuuaugucacugcuuaauaucuaaaauaaauacagaauugacuggguaauguaaacacaaaucuuccuacucggggccuucaggcagagccagcccucaggccucuccuccccugccgugagaggccaacaggcugggggucgggaggcagugagaagcuggccugucaggaacagucggcaugcaauagauguuuuuuagaaagcagagguugcaauucaagcuucgcucccaagcacugggucaagcugacacagugucuuuuguggguucauucuguaauuugucccacagcuaugcugagcuccuucagugugcagcaugauucuaggauguggacucuagaugaccggugagggaggcagggcugugaccaccuugcagcucuuuaauagaggugcagcaggcaguguugcagaguggaaaaagaaugcuaguuucagaguccaauguggagaccuggccucaaguccugguugccccagucuaagcucugagaucuugggcaaggcauuucaccucuuggagccacaguuuugucauuuuaaaaagagcacaucagugguuagcaggaacuaagaagaggcuguuggggaguuauuguuuaauggguacagauuuucaguuugggauaaugaaaaaguucagagauaagaguaauggaugcacaaccaugugacuacacuaaugccacugagcucuauuccucaaaaugauuaaaaagauuaacuguuauguauuuuucacaugauaaaaaauuacaaaaacagcaugccaucuuccuuccuugaaguguugccgugagccuguacuacagcauuugugaagcgucaggucuguguugggccuuaauucacgggagcuauuaauauuaauuuuuuaagaagcuggaugaugacaauaaaggagcaguucauuuugcccugagggugcagaggcucauuccuucauuccacucauguuaugcauggggcuugaaagccuaguaggauuucacugagugugagggaucugagagaggcauucccaauagagacaauugcaugacccaaggcuuggaggcacgcagaagcaugaugggucuggggaacaguaagaauguacaugauuuaaucccagaggcaaauuaagaaaccuacuuugaaaggaaacaaugaaacagaaucacaguuaccccugccccaaauugucaagcagccuggugucaaaagggaaauuauugguuaaccuaauuaggcagccaaauugcucauucagagucaguagauuaggugagcaucuccaaagcacagugagaaaggaacucauuaccaauuaacuccauuuauccucugcucuccuuggccccauacccaagagacuugguuuuaaaaaucuauaagaauaucuaucauuaagucccaaaguggucaaaauacugcagcaacccaacucauuguacaaugggacaccaucuucuagaaugggaaguuaggucccauccacuaggguagggauugggccccacauuugauuacucugcugcuugcccccaggcucccaagaggacugaggagagccugguagagccagagccucugagccucucggaaucugugagcuagaaagaaccuuggagacaacaagcccaccaacucuuaaccuucccucauuuucuagccaaggacacagagauuuggagcaguuagguuaucucauugaagggugcauagcuaguaaaugucagagccagggugugaauccagauccauccuacuacaguguccauuauccuuuuuuuuguuuuuuuuuuuuugagauggagucucacucugucguccaggcuggagugcaguggcacgaucucagcucacugcaacuccgccuccaggguucaugccauucuccugccucagccuccccaguagcugggacuacaggcgcccaccaccacaccuggcuaauuuuuuuuguauuuuuaguagagacaggguuucacuguguuagccaggauggucucgaucuccugaccuuaugaucugcccgucucagccucccaaagugcugggauuacaggcgugagccaccgcaccuggcccauuauccuucuugaccaccguguucuacagucuuuuuuguuuuauagagacacguucauguuagcucaacccaaaaaauauagaugcuagagaugcuucuagcuauauccagaauauaaacuucuuugucaauauuagaaacuuccagaaaagaaauugaacccauaaccuauuagaaaugaucaggacccagagaucauacugggccacucucaaauuaugacaugcuagaaaaaugacauuugaaguacauguuuuagaggauuaagagaaauaucccaucagaagguaucugagaaagcuuuauggaagaagugcuggccccuagguuuugagggcuggaaaggacuguaacaggcaaagagggguaagaggggacauucuaugugggcaaagcuuggggguaaaccaagagaagguuugucauaugaggcuaggacauaagcgcgugcaacugggaauaggguggcagaguguacuaggagguaagguuugcaaguuagcuggauugucugucauuccacaacuauuuguugagcaccuacuauguaccaggcacuguuuuaaauacugggguuccagcaaugaccaaagcagacaaaacugcccccucucauggagauacauucuagugggaaaauugaugaugaacaagguaaaaaauaaauaacauaggauguuucucuauaauaguuguuauggaaagggggacaguaaguccccagggugagucugggcagugucauggggaggugcaguuguaaagaugguagccagagaaggcuucacagagaaggugacauuugaacauagccuugcgguaggugagggagcaggcugugaggaugucuggaaguaaaacaaucuugggagagggaagggcaggugcuagggccuuaaggcaggaguguguguguggcuaguuugaaaagcagcaaggaggccagaguggcuagaugguagaggaggccaaagaggggagggaguaggggugugugcaggccagugcaggggagccacggaggguucugaguggagaagugaugaggucugacuaauacuugaacaggaugauucuggaagcuguguugagaguagacuaacaggcaaaggcugaaguaggcagcuauugcagucauccaggagagagacaacaggugcucaggucagagugagccauaggugaggaaugggcaaggguuguaguucacugagguguggcagugaggguaguaccuguaccuguggauggggauagaacuuucucuucccugcuccuccccaccaucuuguuagcauugaggaugacuucaagacucuuaaauucugugaccaaaauggcuugccaguacuguaaggacggggggcuugccccugauccuucucccagccucacagcuaccuuggcccaguuccggguccuuuagccauggccugucccaugccauacccugugcuuucuuguucuuaguccacagcuuuggugaugagccauaucccuugcccacuccucccaccacgcuccauccugcugcagaucaucuugguuucugaccuuggugccugacucccucacccagccuugccuuaucuuccacaugagacucuuggaaccaucauuuuuugauacaaucucagcuucccuuuaagccauaauuuuagccuuuccuucugcuugguugccucaagcugccuuagugaaguuugaccuggggccuccuccgcauagcacgaaauuggcuggaauugccugugaucugggagccaacacugacggcuacuagcuuuguuguucuuaggagucccuuuaagaaguccuggcccagauuaaaugcaccccauaaccgcuuccugcuggcaagcucugugacucucccugguggcagcacauacuaacacaacagcaccuugcuucugaaagggaaagggaggaaaaggaaggcucagagccaugguaaauuaagacagauugcauucccgaaacuggguugagaccugcugagugugcagagagguacagcaaaugagaguuuuguuuuuaauuugagacaacacgauuuucaauuccaguggaggcaacaacaugcaugaugacaaacuuccuaccgaaagauguuucagaagcauuuuucccugucaguaagcucagcuuuguccaagaagagugguuucugaggcugcuugaacuucaucugacccaggaugacuucaaggaagaaagaguauaaccaacauugggaaaggagcuuccugccuaugggagccuaguuccagugccagauguguggaguccagggaugaaucugguuucaauuuuaggcugugucacuaguccuagugugacuuugaccuagucacuucucucugagcauuaucauaguuuccccaucagccgaaaaaggucaguggaaucucagacagugagauaacuuggaaggaggauaggcuuuggagucaaacuuggaaucccaacucagcuacuuaggaauugagugacuuugugcgaauuacuagaucucacugagaugaagaaacggagaaacucaguuucuucaucugcaaccugggaaugaauaacugucuaccuccuaaaguuguaauaaggauggaaggugaucaugcaugugaaagagcaggacaguguuuucaaaacuaugggucaaccaaucaugaaauaaauuuuauagcucagcaacaucauuuaaaauaauaauaaauagucugggcacaguggcucacgcccauaaucccagcacuuugggaggccgagacaggcagaucacuugaggucaggaguucaagaccagccuggccaacauggugaaaccccuacucuacuaaaaauacaaaaauuagcugggugugguggugugugccuguagucccagcuacucaggaagcugaggugggaggaucacuugaaucuggaaggcagaaguugcugugagccaagaucaugccaccgcacaccagccuagacaacagagugagacugcaucucaaaauaaauaaauuaguaauaauaauaauauaauagauagaauagagagaagcagaauaaaguguauggcacauagaagauaaguauuauuuuguaaacuuuuuauuccaguuacagguuuuuuuuuuuuuugagauggaguuucacucuuguuuuccaggcuggagugcaguggcgcgaucuuggcucacugcaaccucugcauccuggguucaagcaauucuccugccucagccucccaaguaccugggauuacagguucugccaccacgccuggcuaauuguuuguuuaguagagaugagcuuucaccagauuggccaggcuggucuugaacuccugaccucagaugauccacccaccucagccucccaaagugcugguguuagaggcaugagucacugcacccagccagucaguuacacuuuacacacaauacaugcagucaacugucauguaaaauauauuuauuauuauagguuuuaguaaaaacaagcuuaaaagaugguaacugggggccaagcaccaugacucaugccuguaaucucagcacuuugggaggccaaggcgggaggaucgcuugaacuaaaaauaacaacaacaaaaaauagccaaggaugauggugugcuucugaaaucccagauacucagaagacugagguaggggccugggugaucgaggcugcagugagcuaugauuacaccacugaacucuagccugggcagcagaacaagacccugucucaaaaaaaaaaaaaagaugguaccuggaauaugccuggaccuugugaauguuaauucccuuccuucaaggaccccuuagcucaaaaacuccaugauucaugauguaaaagucuuggucaaaaacuguuggccuaguauuucuaggauccccuuucugagaaugacuaaguaucugggcaggggcucaugauucagcugaaagaagauugacuccgggaucagaggcuuaaucaaggucacacagcuuguacagugauaaagcuggaaucccuaauuuguagaaccuguacaucucuccucucuccucucccaguucccuccuauguaaauggucauugggaugauuaauaagccguagaguaacuaugggcuguggggacagcaggaaaagcauccccgaacagggagagcugacuuaggaagauacaggggcuagaugaggcauaagcuggguucacgcacccaccuggaucucuccacugagcacaaaggcaacuggagaggaacccagagcagauagcaaugggcacaacaugaaacuagcaugucaagagaaaucuggcuucuuccaacccauagauccuuaccacaaauuuaauuucacacuaaucaacccaggcagauggacagagcacuguauaguaauugguugcuuuccuuugacuucagucuggaagggagcauaggaagcaaaggaugaagagggacuccaggaguuuauauggguuugauacaugaagcccaggaggcagcaauuacccauaccccacaaaauaucucuuucaggaagagcccuuagggaugaccagaccuucccaaaacucuccccaaagugacaagccuggcuuccucugauggugggaagcagcagcaaucaggaaaaggggcauuggacugcagacagagaacaugggucugacuucuggcugguggagacuauuuaggaaacagcaaagaucuauuauggcuaaagccugugagauuaagaaaagaugaggccagagaggagagcuggguugcaucauagcaggagaugguucugaauugcuggcucaaggguucagccuuuguccugaaggugauaggaaccacagggaaauuuuaagcagggagaaguuaaaggugacaaaugccuucucugauucagguaagaacagacaugacaucuagagugaucuuguucuugagaagacuacaauugccuuuagcuuugaauuacuagcaguuuaaauaaauaaagcugcaggucaggcuggaacccacauucauaaugcauuugcccugaauaacuaacuaaccaugaacuugucaagaaccucaagucccgccucugccaaauuuugacuuuaagaauccuuuagagggugcccaacugguuaucagauuuuguuuauaaagaguuuguuuguauauauaauuacuaucuucuugucuuaauaaaccugauuuagucugaguuuccuagaaagcagagcugaggcaaagauuaaaagcugaugcuuuauuuaggagaagucaacucaggaacaugaaacaaagaaagaugagaagcaaagaacggugauguguuaccaugcuugccagugccucacaacaagcugcaaggagacauaucuggucucuaagcaggaaugccuccugagaaggcucucaggcaggcuguacauagcagucuacucuccagaauagucugugggaggaaggcaagacaagcaguuaaugggugcuaggcagcagaauucaauggaccgacuggccacaguggcagcugaagugcugccauuggcugagaggccagcagauggcgaccccaagagacugaaagggugcauaagcugugauggaugcugcuguuaacugcuucuuccucccucccucccucgccacauccccccugcuccuuucuuuauuucuuuuuacucauaaacucuaccugucaauaauuacaggaguaaugcucacuauuuauuauauacuuacagugaaccagauagugcacaugcauuacuucauuucauuaccaugaucagcccauaaaacaaggguuguuccccauuuaaaagugggcaaaggacaugaacagauacuucucaaaagaagauauacaugcggccaacaaacauacgaaagaaagcucaccaucacugaucaucagagaaaugcaaaucaaaaccacaaugagauaucaucucucaccagucagaauggcuauuacuaaaaagucaaaaaacaacagaugcuggcaaguuuacagagaaaaaggaaugcuuuugcacuguugguggaaguguaaauuaguugaaccauuuuggaagacagcguggcaauuccucaaagaccuagaggcagaaauaucauuugacccagcaaucccauuacuggguauauacccaaaggaauauaaaucacucuguuauaaagauacaugcacaccuauguucauugcaguacuauuuacaauagcaaaaacauggaaucaaccuaaauguccaucaauguuagacuggauaaagaaaaugugguacauauacaccauggaauacugugcagccauaaaaaggaacaagaucauguccuuugcagggacauggauggagcuggaagccaucauccuuagcaaacuaacgcagaaauggaaaaucagacacugcauguucucacuuauaagugggagcugaaugcugagaacacauggacacauugugggcaacaacacauacuggggucuguuggagguuggugcaauggggagggagagcaucaggaagaauagcuaaccaugacacacguuuauuuaugugacaaaccugcacaucuggcacauauaccccugaacuuaaaaguugaagaagaaaaacagggguuguuauucccauuuuagagcugaugaaauucaagccucgaaagcauaaguaacuugccagcuagccaguuaaaaagcugauagcuaacccagggcuauccaaauccaaagcucuuacccuagucauauuaccugauggagacaggaauauagaacuacuugagugaaugacugccaguaauuuuacagguuaaaaagguguugauguaucagacuagccccugcaaacacacacuuggugacuccaacuuauaagcacauacucuggagccaggcugccuggguuggaacccuagcacuuccacuuauuagcuguguuaccuuguguuaaacaaggcaggucucuucaucucuccaugccucggucuucucacccguaaaauggggauaauucugguaucucucucacagugugguuguaaggauuaaaugagguaagaaaguuaaagcacuuagaaucgugucuggcacacaggaagugcuauuuaaguguauguuguuaaaugcauugcacuucgugauuuacaaaguguuuucauauuuuguuuaacauuugugacaagcuuugagguagauaucggccucauucucauuuggaagugcucuugagaucaugcagcuggcccauggaggagaugggauucaaccccaggucuaucugacuccacacgcaugcacagcuguucauaacucucucuggcagcuggucagccuggcucuaacugccagagaugauucccuagguaccaggaccaagugugaaaaggcuccagucagccugauuuucuucaggccacuuucucccaguuugcucugugagaaggauccuucuucuggaagaaacucucccucaaauaaauagccaaauccuuuuggucccaaacaccgaagagggauuuucuuucugccauugcucagcagccuggcuucuaaaugaguuugcuguacuuaguuuguguaguaccuaaacuacaaaacaaauugcuuuccugaaugugccuccaaaaaggaaauaaguguauggaacaaaccagguucaaagcaugguauaaacaaagggaaauuguuugcaauuccagcugcuuguaaagaugcaagagggaggagagaagagcccucaugggugugaagugggcuaugaaagugcaaaagaaggugcuucaaaugggaaccaaaugggcuaagucagaaguuagacagcaauuagaagugaggugccuccaggcgucucucucucacucuacaugcggccucaccugguagcaaaaagagggaaaccgcuuaagcccaaaggauuugcccuucucucuaccugcauccacagccuucaauaauuuauaaccccagcacuagagcuagugcuaaaagauggauuuuauuuugaaaaaagaucgugucacuuuuuuccccagauuucaaaagcucuucaagagucugcucuggcagccuggccauuauuauucacauuuagggagugcauaauagcucacaaugcccuuuaauaccugacauuucauaagucaugacaucaucuccccaguccagggcaccugagcccauacccuggcuuuaaaugcugacaguggcccuuuggccuuggagccuggguccggaugugcccaagguucaauaagucacuaaaagcauuuacaggacacaacauggaguggggcucacaauauuuguuacagcaaaagggaaaaaaaagcaaaucagcaaagggaaaagguucaugggacaaaguucggaggaagccgggcaaaagcuuccaagaguuuuucucucagcagagucaugcgggaagugcucuguuccuacagccaggagcugugaugacaccuacaaagugcuguuuaccauggaagcucaagacucagggccccaaguguugaucaggugcuagucacauaggugcccucugccuagcaugcaccaaauuccaaucucccggaaggaaauaagguguuuaacauacacucauuauugguacaaucuaggcauaauacaaucuaggcacagauagccccuccuaucauuuaggaccuaggcaacuguuuaccagccagguucucaggcaccagcccaaggccagcuuugcaagcagagcuuucuaaggaugcaggcuucggccugcuauguuaacuccuuucugcccccugccucuuggacugcccuccuguuugauuagugagcggcccuagcagaucccccuaguguauacuucucaggacggccuuguaguucuuucucuagucauccuccuucaugcaauaacucuuagagagugauuauaaacuuugugagaaauucuguuagagcgcacugcuagugcugauaaugaaaguggagagaaaaaugaaaugaugcguccugaguaggggggaagagccguguccaaaugacucucacagugggccagugcuacuugguccauaguuguauugaugaacuggggacugggggagggaauugugcugcccagugacugucugugugcugcucccauucagcaaucugugccaggcaaggugcuagugcugccuggcugcaggaaggcuaacuggaccugacguggucucuaccucaggggcucaugguauacagaagacagacaccuacguaggcauacaucagugcugaggacucuucuggguaaccaucagccagagaauccgcagaagaaauccagcucugcuugagcaacuggauaaaaugaugccuaagguccccugagguucuaagcaccgaccaagggagaucugggaugggaccacagacagaagaaugcccaccagaauggccccugcccauccuguaacaugguuuucaggaguuccaguggcaaaagaggcaacuuaaagguuguggagucaggauccccguuugauagagaaaguaggcuagggagaaagcuuuaccugguauccggguacagaaaaggcccagagguguugcuaccccgaaucagucuuccugcuaggucaggguaacacugaaaccucuguuaauacaaucuggccaaagacuaccagaaacucacauacaguugguugaaccaagacacgaucacagacucuuugcagcacagaagcaccacaccaugcagagccauuagggucucgguagaggguguuagaaaggaugugcaggauuggcccuugugucacaugauuugggggugggguccaggaucagggcuuugcucuagacugccuacugucagggaaugggcaaucuucugccgggguaucuucauaaaucuuauguagaaggcaggaagaauggugugaaguugaaguggucacuggaaaaaagguggcagucacucauguuaggcaggauagggaguguuuggucauuguguggcuugaacaauguucuuguguuuuuugucugaguucagacaugacuguagagugaccuuauuuuugucuugauccauuacagucagaguugccuugucugagguugguaugugaaacuguugauauucaacaggugaaugccgucaccucacugugagugccaggccagcuccuggcugucagggacuaauuuuuccuuuuuuaucccaaaucaaaagacaaaugaaaagaaaaauuguaccagguaugacagggcuucaagagccuucagugaccuguggccaugauaaaucugugucugggaaaaauaauaaugaaaauaacuuaauagguguuauuauauuaauuaagugcucuucaauaauuauuuauuuaauaauuaucauuuaguacuuauuacaggucagauauuacauaagccuauucaaauacacuaucucauuucauucuccucuuaaaaucgcuauaaaauugguauuuucuuuuuuugcagcuacagaaauaggggcucaaacaaauuaagugccagcugucaggccaccugccuaauaaggcugaauucaaacacagauacccgccugacuccgaaccugcauccucccacuacccuaggcccccuugacacaugggcacugaaggagaagugcugccgagcuguuagcugagacuggucuuaguccaaggagccuaagagcucugagacaaauccgaaguguguucacagacagagcacuuccaggaccacagacugugacagcccgcagaagcccagucccuggcagaguguggugguucccgggagcugcugucauugcaccagcaaagugagcauccccagagagcacgagugagcuugauguauuuuuuauuccugcacagcuggcuaauuaauaugaaaaagagcugcccacuauugauuagcuuuguauuccaccacaacagugucuucaugaaacucaauaucuagagcucaaaagcuggggugaaaccuuuuaaguagaucugaugggugaccucgucaucccugucagagguccagcauuguuuuguggagggagggggaauucaaaguccuuuuuaagucugucucuuggucagagguauuauuuuucuucagugguccacuuuacauuagguuggcgcaaaguaauugcggguuuugccguuacuuuuaauuaaguauuauuucaagguaaugccgugaaaccuuuucacagaucugugucaaucuuggcaaagccaugguuuaucuaucucuguguaaucagggccuggcacauaaaauuccauaaauauguauagauuagaauggguucucaucgcgucuugaugaaucaucaagccuauguuucugaaugcuagauggaggcccagaaagaagaaacaagggaauagaacucauauuuauuggguguuguauucauuuccuagggugcugucacgaaguaccacaaaccaagugccucaaaacaacugaaauucauugucucgugguucugggugguauagacagggccaugcucucucugaacccuguaggugaaucuuucucugccucuuccuagcuccaguggguugccaccaucucugguauucccuggcuugcagcugcaucacuccagucucugccuggauugugacacgguuucauucucccugcauggugcugccuucacauggcugcugucuuauaagaauacaagucauauuggaguagguucccacccuacucggcuaugaccucaucuuaacuaauuacaucugcaacaacucuauuuccaaauaaggucacaucuggaaguucuaggggucagcacuucaacuugucguuuuuuugggggggagaguucaucccauaacagaugccaagcacaccccauuaguugccaggcacuaugacaggcucuuuuaacuccccaccccucagaagccugggucuuaaauuugcagcuuuuuggugcuccaugaacuguaacagaagaaaccguuuuguucugaacaauggagcaguugccacucuccaugcugggccccugaggccuggcugcaacucccuccccaucucccuggcucacagcaucucacagcugaccaggcugggccaggacacacaaucuuaagccccuucuaagugagucagccccuucaccggaggcaugaugccacagggaagauuccugccugagaccauguguguaccuguggccuugccuagaacagcaggagauguggcugugugggaaugcacguguaagagugacugcaagugcaaagugcagaugcucucgacaccauaugagugggagugugugacaaugucagugcaguuacauuagcacaggaacaaaugugugacuggggaacacgugagcaagaauguguggguuugacuccacaugaggguguguuuugcgugucugcacaggagugaaggaguggguggggauuucugccaaauaccuguuguauuuuagaauuaaccagcaggcaaaggugaagucuuucuucccacuaagauaaggaaaaagggcuuugggggcuuuuucuaauuuaaaaaaaaaaaaaaggcgucauccaguuagugguuguuaauuaggaacaggucccagagaagcugcuucugcagcagcaccaauaaaucacucauuaacuguccguggcugccugccuccaagccgggcuccucugcagccugagcuccaguagcagccaggccagggcccuccacugcagaccugucaguaaggggguggggugcaugucucuuugucucucuccuccuaaaagcauccucaaaccacacuagguaggagaggaaagggcugagccucuagucaucgacucauggacuuaaaucccaaucuuacugcaccaagccccuuccugauccaaccccuucugaccccacugaccccgucucucaccacucucccuuaauucagcuuccaacuccacugugcuucuucacauuccuggaacacaaccuccuucauaguguugcacaugcccaguggagcugugaccgugcaucuaccugugccucccacagagaggagcacgcaguggacacucaggaaaucaauucuugccugaccagcuccugccaacuuucucaccaacgcaauauccuccagccauguuuuaaaguauugauuuuagcuaaaaucgucauagacuuggggauguggaaagagaauaacugcuuaauggguauggggguuucucuggggagugaagaaaauguucuagaaccagguagucacgaggguugcacaacauuggauguauacuaaaugccacugaauuacaugcuuuuaaaugguuaaaaugaugaguuuuauguauacuuuucuauaauaaacauacuuuaaaaaaacaacccagggcaccuuauucgcuuuauucacuucagcauccauuuauugagugcauccguaggaucaggccccggggauacaaauguguuugggguuaggggaugcagacuaauaugcugcugaaauguguuuuccguuuuaacccaaguagucugcguaauccucaaaucacugagauguuguuauauucaccccuacuuuauacaugggaaaccuaaaaaucacaaaaacaggagacuuauccaaagccacacagcucuuaaggaauguaauaggauaugaacccacccugcguuuaguacgauguguuuccuccauaauaguuucaggcccagcacucacaagcuaacugaagcauagcacagcuagagguugcagaaaccauguauuacugacauauuagcaaaacagaccuuggcuaaggacaguuccucugcauccuuuggcugaaggcucuaccaucuucccuacccaguccugccgccuccuaugcgccccacccuauucccuugucagcacugcugcacagggaucccucugaccugauuagcuagauuuggccugcuagauguuuuuauuagugcccugaccuucuugccaagcaguaauuucacaaaccugugacuuuggaaugacauucuuuauguuuguguuuguuuuugaaaauauguagaauucauccaaaauucacagcccugcuuuuguguuuaacugaaacguguugaaagauuuaaggauaauuauugaauauuuuccccacauguaaacauauauuuggucuaaugaggccauucuuuaaucugaugggguugggagagcuguuagaauuagcagccuuugguucagggagcucaggaauccccauccuugggaccgaguccagauguaacccuggaagcaugaaguucaaagucagugggauuauggcuuagugcaaaaccggcaaaauaugucaccaguucaccuccucuagacagugagccauaagccauggucugcaugcaguuuggguuggcaucaguacagagauacuucagagagcagaaucaacagguuaaauccugccucugaggccaaauggagauaagaauagcacuguggggcaagagaugggggugguuauuauaagcuauuuucuuuugacuccggaucucauguucauuuuucuaggcuuauuuguucauucagccauucauucauucaucagauguuuauagagaaccugauauuuccauguccuguuuuagugauuauagacaaaaauaagguuucuguauuugucagcauagguuaacagcuaaauuaacaacagaggguuaauuuauggugcagugacaaacaacccuaauauaugaguggcuuaacagaguuuauuucucauguuauguacccaacaugcuuuggggcuggggggagacuuuguuccacacagucucucauggacccagggugacagaagcuccaccaucuuguggagcuacccacucuggagcaaauagccuuuuuggcugcuucucacagcccauaggccugaauuacucauauggccccacuuaacuacaaaggagcagggaaacgugcaccuuccaugcaccagaagcagaagagaaccagacacaaugaguacccaaagucucuacacaacauagaauaaaaagaucugagguaugaacacaauagaacauuauccucugagguguuuccaucuagcagaagagacaagugaacagacuuaaguaacagcugagggaauccaacaauguguuggagagggggaagaggaauugugcuguuagcucugagaggagggagccauuuacuggaauaucccagaguggggugggauugcuggcagucuagccaggaaaugucauggcaugcucauacaugcauguacuguaugacugagggagcucagcgcagguggcuuuuguggcaagacgugcuugggcaccacauguagguguuggaaccuuauucuguagguagggaaagcuacuaaaaagcuuucuaggaaaggauaugauccuauauauuuuaggaagaucacccugguucuaccugacagaggagagauagagacagauuguggcccccggaaucugaauaguaaucaugcagacagauucaagagguacuuagcagaaagaagugauuaaaauuugguaacuaaauagauguggguugggggaaaggaaauggacaggucuguggccugaauuuugacuggggcaugucuuaaucccuucaggcugcuauaacaaaauauccuagacuggguaaauuacaagccacagaaauuuauugcucacaguucuggaggcugggaaguccaagaucaaggcaccaacagauucaguuucuggugagggcuugcccucugcuucucagauggugcuuucuguguccucccgugguagaaggagcaaacaagcucccuuaagccucuuuuauaaggucacuaaucccauucauaagggaagagcccucuuggccuaaucaucucccaaaggccccaccuccuuaauaccaucacauuugggguuuagguauuagcauaugaauuugugggggacacagaaauucagaccauagcaggguaacuguguggaugcagcaaggaaaugcuggagcaugauuguagagagaaguaauaagcugagugcuagacauuguugagucuguauaccuguggaaccucuaaauccaggugucuuaaagcacuuggauauuagggccugaaagcuuagaagagagucagccuacccuucccaagugucuaagaaauuaaagguguagggguaaccucuggggaaaguaguucuuuccuccagggauuuuaaguuacgcaucuauugguaccaggucuauuguguauaaaucugggugcuuucaaaauggagucauuuccugcugaucaccuuccuaaggcccagacccuccggcuaagggaagucacugcucccugggcuucuguagcccccguuguggucagaaccaaguuacuaucauuguucagacccugagcccugcgagggcuggcacccagguguucaguaaauguuucuuaaacaaaaugagugaauuaacuacaaacuauucaaaacuguugggucccuugugacaacauaaauaguacuuucauuuuccaaaaggcuuuaauaaauuauaacucaccaaauuaaauauuuguuuuaacuuccaccaaccaagacuggaggauuugacaccuuuucaucuucaaagugauuucaaaacaagagccugcuuccccaaaggccacucuuuggauguuguaaauuguaaacagauacaaaaauguauucacauucaugagcaaagaugccuugggccaguuuuaaaaagaaucuucuccaggaaagaaaaguaaauuguuucuucgauuuuuuuuuuuuuugagugccuccaaugugccaagaguuguguuaagggauuucaauaucuguuauucucucaaugguccugugagguagguauucucauuccugcuauagagauaagaaaucuggggcuucaagagacaaaugaggccgggcaugauggcucaugccuauaaucccagcacuuuggaaggcugaggcuggcggaucaucugaggucaggaauucaagaccagccuggccaacauagcgaaaccccaucucuacuaaaaauacaaaaauuagccaggugcaguggcagaugccuguagucccagcuacucaggaggcuaaggcaggagaaucacuugaacccgggaggcggagguugcauugagcuaagauugugccacugcacgccagccaaggugacagagugagacucugucucaaaaaaaaaaaagaggagaauggcaaaugauuuguccaagaaccaaucuuaaauucuucuaacucccgaguuacugcacugcccuucccuuuguauuuucauuucuuaacccuuggucuguggauuaccugcauugggcacaagcaggaugcaaguucugggguugugccuggacuuauuggaugaaacucuggagggagaagcuugggaaucugcauuuuaaauaaacuucccaggugcuucuuaugcacauugagauuugaucaccuauaguuuauacccacaguggguuucuaaaacuuaaauuuuugucuaauuagaugagagaauaaacaaagggggaguaaagaggccugaacaccaugugacuugccuugagcuuggcaaguggggcagcagcaucauccucccucuuugccuccucuccaggcugugcuggccaagauggaaaacuuccucuguuccccugcuuuucauggcaagcuuggguugauguuuucucuccacuccauauggauuuugcaauuaacucacuagaaaaguaaaucacagggugccuggaauaguaagugcagcaaacaccagacuucagccaagcagacugggacugaauccagagugugacucagguugcugggcuggcacagaaaggaggcaggaggccggaggcuggcugcuccuggaggcuggcugcuccuggaggcuggacaaaggcagucagugaggaagaaggagaggggaauagugguugaaacugagcugagcgagcaccuuuuguagguucacagacuauguuuugcauucuuugucucuucaauugcacacaacucuuuuaggucaauguuaugacucccauguuacaaaaaaagaaacugaagcucagagacaaaguuacuucccaacauccuugcaccgggucugcacucaguccucaggaaagacuuccaggguuaggagggagaaaaaagggaauagagacacgaagagguucuguucugguugcucuagcuggcugguggcuuuuuauagaagucuuuuuuuuuuuuuuaaucauuuugccucuuuuauuuagccgagaauauaguagugguccccaaaagauucagugaauaggugaauuuucauuugcuaauaugauucaucagaauaauauaagcuagcauuagcaagcacugaguacaugucugacacuguguugaaugcuuuagauacguuuccaucucauuucauucuuucacaguuuauaggagguacuauuuuguuuguuuguugauuuauuuuauuuuacuuuaaguucugagauacaugugcugaacgugcagguuuguuacauagguauacacgugccauggugauuugcugcaccuuucaacccaucaucuagguuuuaagccccacauguauuagguauuuguccuaaugcucucccuccccuuauuauagaugucuuaagugaaggcuugagugucuaccucucccucugagggguuccugcccaucugcugauaaaaggguucuuuucuguagaggaguucuacuggggaccaugugcaggaccaacacacucaguccuaugacaacauccacaucugaggaucugcaguuuauaagucaaaagguaucuucuugcccacagagccuaaaacuggcuucuuucugcgucucacagcuuccugaaagauccugaaaugugagccaggcugacagcugugcugacguacagcaaguguggggcugggauuuguccucuguugguggcauucacuuugccaucaccacaacaccaaaaacccuuugaggcuguaaggcaagugggcaugacucagcagagcaccaggcacagaugcugcaaaucacaaaaucauuuuugcucuggauagggcuuaaggguuguuucuucaccuagcuagaaaauugggcaaaggggacagggcuuaaaaagcagguaacagcuauuuaagcuggaagaauggggccccaaguuccaagagaacuuucugcauucucuuuagaaugcuccaacacaagccccuaccaccaccaagugccugaggccccccugggguacauucucccuugcuucagcaugcuaaauacauuuauuuaucacucuagauguaauccugguggucuuugggcagucaguggacuucaucagaaguuucaaaccuuacuuuuccauugugacaccugaaagcagaaccaucaguaugaaagcucuuucccuucccuggcucuuucucuucuaugaggcuaggcuucuugcaaccuaccugccaaguuaaacucuugcauaguuuuaagaugguuuuuucccaagccaggauuugaacuucugcaguuagugcccagaggucuuggcuuucucuguuucccccaaauaggguucuguccuauugcagcuagaaaagcaacagagagaaaugaaacggaagagaaaaaaaggaguuucugcccuucagagagagcucaacugccuguguguugcucagccucccuucccuguucacaaaaagucaaagucaucaccucaaacucaaaucuauuuuuaaauaagaaagaaggccagugaagaggggcaggcaagauguggccaaggaaggcauuggggaaaagguaacauuuguacugggaguuugguagaugaagaagguaagaaggagaaguacagacaguuaaagauggcauugaaauuccagagucccagaggaggaguuugcagggacagcagguggcacuugaugaguuagaauuucagaugugaugaguuugaagcaccugggaggcaucuaaguagacaugauuaccagacaccuggagcugaauaagagguccuggagauauugauuuagaggugauuguucucucauccauguauccauucauucacccaggcaagggaaauguguacaguaccuacucuaggcaggcccuaugcuggauauugggaauacaaugaugaacaaaacagaugucucaggcgaugguugucuccggcuuccuuuguccagcuuugacuuugcaggaccucuggguaggauggucuggccaaaugucccuauuaugcuuucccuggagauguuucauaaaaagaaggcaucuuagagcagaggcugacugucaagcauugguucugagugcaagcccuucucucuguuccacaauaggaaucauuuucuaguacuugauucugauuugauuagggaaggagucuuuaugaugauucucaugcaggucaaauucaugaaaguuuauuagaaauacauauauuuaguucccuugaccguuacauucuuagcuauggauauccugauggauuugaaugaaaacugugcaaauaaguguccacuggcuuucuugggcagguuucaguuauuugggagaaaagguauuaauagacaaaucauggagaaaagucucuuacacaucagcaaagaaaauuugagacauggugguugauuagggaaggauuucucccaaaguguauggacuuaagcucuaguaaccaacagcuuaaaaaaaugaagccaaaugaaauaugaugugcuuaacugugaaaauuguaaggaauuuguuuucuaggcucucauuauuugaucacuaaccaaucagaaauccuggcucuuucauucucggaauauagcaguagaaggagauucucauuagacccuccagaugcauaagaaaucuggccaucggauuaacuccuaaggcucugcccccagcaccucaacccaaggccagggucacuaugaagugccaaagggcugugguuuaagaacugugcuggaugaaacuugccauguaguugagggcugccucauaggugcagcagcugacagcaagagagccuccuaaagggaccacauuugagguuagaggagcaggcagcuggcccaugugcauagcaccacuccacgcugucccuccuguccuggaugauguuguaauacaaucgccccuuuccuaccugcccucauccucaccccagauguccuuugucagaauacaucuugaguguauuuucuuuuuuuucuuuuuuuuuuuuuuuuuuuuuuuuuuuuuugagauggagucuuguucuguugcccaggcuggagugcaguggcacaaugcaaucuccgcucacugcaagcucugccuuccagguucacgccauucuccugccucagccuccugaguagcugggaauacaggugaccgccaccaugcccagcuaauuuuuuguauuuuuaguagagacaggguuucaccacguuagccaggauggucuugaucuccugaccuugugauccuccugccuuggccucccaaagugcugggacuacaggcgugagccacugcgccuggccgaguguauauucuuucucugacucacccaucuccacuucucaggcuccaccuacaacaucaacucaguugccaacaaguacuugaccacuuuggcuaaacuugggugucugcaucuugcugugcuucuuugggcuuuuuuccccacuuagggcuaaagccccucacuacugcucccuuggcugucuuuugguccaguaccaugccacacucucaggagugugguacacuggucaugaugucugcugcuccucuggauguuugccccaugcagaagaugccugaacaccgaguucccuuuuauuugggaauccagaacuccagggauccccauaccaccagcuaucccaaaucuugagggagacuugugcauugggcuuaagucuggccaaucaaagauagcuggugaugcaggugccugcgauacacaggaacaacacucaucguggaguuuauauaagcaaaggagaaggaugccugccuuggguggacgaguguccuggagccuugcuccucaaagugcuccagggaaccuacagcauaagcugaugagaaaugcagaaucucagccccacuccagaccccacugacucagauucugcuuuuuaacaaguucuccaagcaccucauacauccugaagucgagcagcgaugcccuagacuuugaagaaaguuaucucagggaaaauacuagguuuaguuuuaaggccagacacacuaaaaagaugauucaagaggcuugggaaauaaaacaguagaucuaagaucaucuuuuauguuuuuaagcaucaagacugacuauaauaugaaaauaaauaggaaaaugucuguaaauacaacauuuaacagugguuuccuugggagaugagugggaugggugagguggaaggagggaaggaggauuuauauuuguguucagcuuguucuguauuguuggaauucaaaugugaauaugcuagaauuauuuuugaaccaaaaaguaggaaagauaaaaguaaagaagaagaaugggagauuuggguaaauguaaguuuaacaacacagcauagaauaaacccaggaagcuucacaggcauuucugagaugagcuuaaauugaaaaggaauauguuuuuguguuaacaagauagcuccaagugguggaauuaugggcgauuuugucuugcuuuguuuuccuucuuuuuuuuuuuucuugucugaauuuuuuuaaaucuucuacaaggaauguauaucccuugugugaugagaaaaauagaccaaaacuguuuuaaggaggaaugacaaaggcaggaugaagagacauaaguuaccacaggcacagcagagugacacagagcuguagggugcaaauggcuucacugauggugagcugagaauuuuaaaauaaaauaaaaaauaaaagcaacaagguaauguuugggauacaggggguguuauuucuugagccucugcugagugccagccguguccccuguggauucugcaagaugagcaccauggccauugcacagccgagcagcagaggcuggggaggucaaggaacuugcccaagguuaagggaggagugaacccggauucagaccucaucuugugacuguccucugcacugcuuggcucagaacagcagaggcaauauuauggucugaagauuaacaauaagguuuaggccaacucaaaggccucauguccuugcauguucuagagcaguacuuuuucaaguguuuaggggaugugcucugcaagggaugaggggaccuuagccccagcccucuguagcuccucagacccccuccaguagccucugggauccuguugagcacagugugaaagccaguuuugagcagagguucugaaaguucuaugaaaacuaguuccccagauguccugaggaauaaagguuuccagguaaguuugagacccuucgcucaccaugucugcucuuagagguccgugcauaucaucaugguccacguaugccagucccacagccaugugcucaccuuguuauccaggcauuuuccaggcccgucugaccacagacagcuuucuauggagcacccguuagcaucuuacagauagaguguuccaaaagacaguuuugagaugcuuuuuaggccccauagauaccuaauuuaaaaaaaaauuuuuuuuaauuaaacuuccacaauauuuucuacauggugguuucagauuucuucagaacauuuuguucuuuaaaaaaaauuccuagaaagcuaaaaaugucuguaauuauccucacaacaagagcaggaucuccagcgugugccucugagugcuggagguuaauaaggauugcgccuucauaaggcagcagaauagcauuugugguuacacuaguuaaggaugcuacaaauuacaaggcccucucagccccagcaugcagugggaaaggaaagacagugaacucagaaacugacaugcagaagugguccaaccacuguacacacuucagggugguaguuuuuaacuuuuuccauauacaugaugaaagcuucuuugaaauugagccuucauaagugggcauaaaaugcugaaauuucuacaacuguaaaaaugcuuguaugucgcucugcaguuugcaaaaaugcuuucaccuccauguccucaaaauagaccugagugagcugcauguuauuacucccauuuuacagauaaggaaacugagaaucagcuccuaaaaggcagcauggugacccaacccugcucuuuucacgcuccauccuguauuguuuccauuacgcuaaaugccuccuaugauuaaugauugugguaagcccuagauuuuuugaaauagagcugauuucagggaauuuaaacacgaaagucaguucauuaagugcuuagcaaaauguaguuuauuuguaucuuuuuaggacccuccaaauaaaucacuucauaaauuuuaaguucacaaaucaaaucaagucuauuuauuuauuuauauuugcuuagaaaauagauuucuagugcucugauagcaaaaccagcuacuuuuacuaguguccauguuaaauaugagaacauccauggacugaagcucuuaugggacaaauucccaccuguccaaguaggcaucaucagguuuuauugacccacuggaaagagacuguuuauggugcaagacacagcuugguggauggaccaggaaaacuugugcuuuggcaccauguaaucccagcucucuaguagccauuucauuaucagugaaccagggaccauaauacuuuguucaccgcauuguugggaggacuaacccugugaguguaagugccuugugcagaguaggagaucaggaaauauuaguauccuuccuucuuggguacaagcaggacaggaaaacagaacuuaauucuuccuucccagcacacauaccccauuucuccucuggugugcacauuuuccccuaggaacuugaccuccaggaaccugguuuugacaaaucaacaaauacuuauugggcaccugcuguauggcugucccugugccaagcacuagggauggaucucgcagucuagaggagaagaagggugacccaauaaacaaauucauuacauauuggggucuuugcauagauaucuaguaggucaucaagugguacagauuuaguucuucccugaggaguggggauaaaaaugccuuagaggguagaugcugcaggaacagucuccagguggagggagguugaggagcagagggaauuuuacugcucugugacuuguuagaugaccccacuucucuggcugagccuguggucuuuaauuuccacuccaaauaagccagucaccagcauguucucccuggacaagugaauaacaacuuuuugucgugaaaauaauucucaggggccugaggaauggggaaaaaaauaucagucccuauuuguggugcucaucuuuucauuuauuaguaucgccuuuccuugggacauuaggggagaaguauucuaacucuuuuaaagucauguuguucuuuggaucuuagggggaucccccaugaaugcuuaaauacaguaucuucaagcaauuaucuuucuguugaaggugaaugagccacagacucccaccagaaccuucuaguaggcucuggcucccuaagcaguggucagucuaaggggaacggcgccugauuaccuggacauuugaaaggcuuucacgucauucaugccuaucacacacuucucacugcaggaggcgccuuuuagaaacuuauaucaccagaggcucuuucucauagaaaaagcacuaggcuggcaguccggagaucugugcuuccaggccuguacuugcccugugacccuggacagccauuuucuucucagacuucagcugcuucaccuguaagauaaagcagggggacaagaggcuccuauggacccuucgaggucuacauccaggguuacaaauuccagaaggcuaaagggaaguccccggccuggugccccccgccucagggugauuacugcugugaucucacaucuccagcuggacuguacaauggauuguguucccauuggccuucucugaaucccaaaccccugucaucaguuuuaaggaacaaaaguacaagaugguaguuaucugcuuauaugugucaguacucaauaaaucuuuacugaugguaguaaucuuaauuauggugacuaaaauacaucuaagugaggccugagauucaggaucaagggagcagugguacucccauaggcuacagaaaagggcuuuucaacccucacauuuggagccagacaacgcuuuguuguggagucugucuugugcauuguaggauguuuaguggcaucccuggcucuggcccauuagaugccaguaacccuuuccccaaguuguggcaguccaaaaugucuccaaacauugcucuaugacccccuggauagcaaaauugcucauguuaagaaccaaugcccuagcaugaaaguagaagcaacguucacucacguuugcccagaggcaccaagucuuaagggagggcauguccaacccagcaugccccuuuaagccucugugcccgccucacaagucccacuguccuuccacagguacaguccuaaaccccucaccuugaccuucuuaucccacaauucuguacucauucacuaauuaagcaaacuucugcugcaugccuguugcaugccuggaucggugcuggauucugagacagcagcggugagcucucuacccuaccacugauugcccuucuccuucucugauccugagguugaaggugugcuucuggcuuccuggugccuaugagaaagcuccuuucccugcugacuccccacccuggcuuuaaauucccagguucagacccuagccuggaccaucuguugggugcagcuguugccuaugagccuucaucucucauuacuucuuuucccuauugaaucuacuugggcuccuguccugaaaauuggguaucuccccugccccaaauacauuaucuguauguaggcauuuugucagucagcgagccuuugcugagcuccucuaaugugccaggauuugugcugucuguauccuuacaucucuuuaucugugacaucauuugcuaaguacuucugagccccuccuccaugucaggcacugugcugggugcuacggauacaagauuaagcaaaacaagacguggucccuacaaugcagugggagggacaggcuuucgucaaauaaucgaucacccacauauaugucccuuuauccaccuucgugucuccuuucucuguccuucucugccuuccccccacuuucucucugucucgcuccucuuuuugccucugucuccugggucucucuggugcuuuccauccuacgccccaucuauauccagcagggccuuggcgggggccugcugagaggcuucucaggggcgcuggaucuuggucagaaaucugucacccuggcuuccuccugguaggagaauuacugucguuuaaggaggucugccgaggcuguuugacaggagucggcugggcugggcaguaaguaagaaggaucacuccuuccuggggauuguggaaggauacggggcccauaaaucauccaccaagaguccugccugagcagcacacggcuucacucugcuuggcaugcagcucgaggaaauuucuaaaauuggagaggacugacacccugagaaggacaggcugccagauauccaguggggagcugucucuccucccugccugcugccgaguuucauuggugguauguccagccgaaaugacucuagcuuuuugauagcagcacagccuucccauagaaucaagcuaggguggcucccaaccuagcaucucagccaaggcagugagagagggcuucugaaacuuccugauuucaagugaggacuugggaacccaaccugggcuccccuuacccaccagguaaaccugagcuggucccuucacuucuucgaggcucaauuucccuuuauauauaugaggauaauaucaaagcuacauccucccaucagugugaggaaucaaauaauccauguaaguggcuuagcacaguaccugguacaugaaaagcucagucaacaccagcucuggccccaaguuccucucagcuuccuagucucuuccucugauuacaugccugauugccgaaugaaaaguagacaggaaucuugcuuuuaauccagggcggauuccgauugccucccauugaacugggugggguucugccuauuaccuuucccuagauccuuucaaggcccuaaaccucccuuucccugggcuagagcaaugcagcuguuuaacagcuguuaacuuacccuguucagcagaucaaguucauugucaggugauaugauuucuccccauaaaggacccggggauuucucaaaauaaaagcuguuaccgaagugaauauguuauuaauagggcuuccuggagaagagcccaccuggauagagaaagcuacuugucacaaauaccaagucacucuugucccguuuuaugcccuccccguguuucuuuugccuuccaacuuggaaggcacuuucugaauuaagauuccaacugcgaaggccccucugggaaugagacugagaaauguugaggccugguuuugaggaguucuaaaucacucaguucucuugggccuuccacucccccaggggcucuuggguuuccaagacagccaagcuucuaagaugaaauagauugcuguauuuggacgagaaugauuuaaugauucagaaaguagagaacauggacacaggagaaacuaaaccagccauacacugcccucagacacaaagaaauugauugaggguggggagguggcaguccugggaaaaacaaauuugcuaacuccauaagagcauugguuauucggcucccagaaaacaaauuugaaagcaggugaaucuagcaggcggaggaggccaggggaaagauugcaguucuggaagaugccuuguguauuagcucuccgcuagacuuugagcuccuuaagagcagaggcuggaucuuacuuuguuugcauccccagcagauaguaaagauagucaaaaagaggcagccagccuucucaaacugcgaugagaguauucucuggccugugcagagauugacagagagguaacgauggccuguauuucugaagaugcgaggggaaaaauauuuuuguauuaaaaaauauauuuugaaaggaugcaaaaugugaguaaauucuuaagaugagaauuuauugaaaugaccacuuauggccaauuucucaagacucuuuagggcacugguucucaaucuuaaugguguacacauaccacuuagugugcuuguuaaacucagaguccugagccuucuacccagagauuaugacuaacaauacuucuaaaauugaacucaaaaaauugcauguuaacuagugccccacacaauaucuuugcaacuauacuaacaccaaccuugccuuggagagcggguaauaccuacccuucugcuauucaggauuauaguggaugcugugguguaucacccagauucuacccaagaccagcaguucacagcccacagcuacuucauucucugagaauugucuuccccugaaaggagcugccuugcccagcccaagguuaagacccaucccuggaggcagcuugucaccagugaguccuccaugugaaaggugggaguaggagugaggauuacaaagacccaaccuucuugacccaauuugagacaacucugaaaggccagcccagcuccagagcucuugaaaagauuggcugaggccuguguugcagccgcauuguagcucaaguucucccucugcccaguucugcuuuucucccucccuuacagggguugcucaugagagcaagaagccuccugccagcaaaucuccauuucagaguuuauuucccagggaagcugaccuaggacaagcauacuucagauggguuugagcagcauuaaacaguggaaaauacauagucuugagauaauauaauaauaauggcaacucauauuuauugggcucuuacaguguuuucagugcuuuauauuuaucuucucccuaaaucuuuacaacugcucuguuacuuauccccacuucacaagugaggaaacugagguacaggaaacuuaagcaacuugccaagggucacauagucacacaguggcagaguuggguuucaaauccauacugucuggccuaacagaccuuuaaccacuacaaucuauggcuucucaggguuuauuugagguucuuccaugugcuagcuuuaugaccuuccugugagugaacccaacugagcuucaguuuccuaaccuguaaaaugggcuucauaguaccuacauugcaagcguguuagggggcugaauugaggcucagucgguguuaagaaucuaacacaugccuguagcccaacaggcaccagcugaacagauaggucuagcuauuguggagucuugacaggucucuggugaacacuuuucagggaaugccugaaugaaauaugucuccuauggaaagcccuaagcuggcugguguucacagaaggccagagaagaaauguccaaggaaaugagagauauggauucgagaggaggugacuguguugaacaagacugagcaaaggaaaaaaucauuugcaccaaugcacaaaucucagcugcucagagcuuuugggaaggcaggaaacuaaggaugcagcugagaaugccaguuucuggcacagugacaaaggauggucugcuagggucuaggcccuguggccaccuaaccuacaucgcucucagccaaaaacuacuagacuuugacucaaagagcaucuuauccuggcucugccacagaagaguugugugauccagggaaaguccacauuccccaauuucagccucauuuagaaauauagaugggaaucaggacuuaggaucucuaagacucuaccaggucagaaacuuggugacugcgugaaucuuugggcucuaauuuggguugaagugcuagcccucugugguuucagaagggaagccacaaaccacaaaccuacuguuagaagcauuuucugcccuauccucuuccccuaaauuuuacagcauuccuuuuuagaacuuuuaagucuggauaauuccaaguuuaagucucuuguucaacccacauuuacuucuucucugccuccacgcucagcacuuaaccccuuaaauuacacaugggaguguguaggaacucaguaggaaguauuagaacacccaggauacugauucacagaucucacugccucccuagcccacucacuuacucacaugaacucucucucucucucuguuagaaucuauauagaguggccagcuuugcacaggguuguuuggauggaaggaucccaggaaauuuauuuguuuugcccuuuuaccagaguccaagaagcuggcuuuucugcugcgugaucaucuugauuaauucauuuugugaaggaagccacucuguaagguuuggggaucagaccacccaguacuucauucaaccuaacaaggagugauugaaucccuucucugcgaagcuggacuaauaauacccuuucuugguugcugugagaaguagcugaaguaauucauagaaaggacccaacagugccugacccaaaguagauauucaaaaaagcacuaaaaguacuacuucuaacaccacugauuagguucuaggacgucugaucucuccaaaguuugacuuugaagggcuggaagauguccucccugcucaauuccuuuuccuaccagaugccuuugguagaaaauaguccuaugcacuguguccauggcgcucuuguuaagccuuccuuccacucgcuuccuugggcaauuguuaguucccugcuaccugaucacugucagaaagagcucugccuugaauuccaucugcacacguuugcuuuuguuucucccugagauaacagugccugguugaacaacccuuucaaguugguuuuacuguaaucacuguuacauuuuuaacuauuucuggccucacacccagggucauguaggacugguagaauacccuuaaugaauguuauacauaacaaaaucgacuguaccaccuguaauuccuuucagaacugggacauuugcccucguguucacaccuggccaggcacugcccugaauccugcucacacaugcugugaucacugacaucguugcccucguuggagcacagagaaucgaaggcuuacagcaucuagaaauauuuaagaaaagagaacuggaugggucuguuguauuuuuuuccucagggaagacaaguagacaugcauacacaacacucccccacauacacucacaagcagagugcaugugucccggagccagccccguagcacacacacagauucacauucauuguaaucgagagagaucggguuuguuccuguuguuccuguaaaauucccaauuagccuccauucagcagagaguugucagccugacagcaccucauuaggacaucccacuccaagcuucaggaauguugauucaggcagauuagccguaaagagcaaaugcccacacuggggagccagauccuuuuggcuuuacauaaaaugacugcccaugggaccuuacacaggcuacuuucugcaaccucaguuuccucauccagagaauagagauaauaauaauaccuaccacagaguaucuauccuugccaaaggcuaaaugagcuauuaccaggaagcucauuaaaugauagcuacuuaugcugucuccauggccuugggcaaaucucccaaacugagaugauaauccuuguccuacagaaguguuuacaaaacuucacggagcuagggggaugucuauuauuauuaauuauuauuaaaaagcgcagaaccguccuuagggccuguuaggccacaccuaugugaaagccucuagauguccccuucuggcagacugaaucacucauucauucauucauucauucauucauucauucauuccaguguuaugccaagucuuccuggaugugauagggguaggggaaauagacaugaauaugaccccuacccugucucagggaauucucaggcuagugugagagacagagggguacuuagccaaaucuuauggcaagaaguggggguucuuugaacuggaagagucuccccaucccuuuccuuccuccccuggcauccuccagggguucccaaaggagcaugccaauucucaaaaugcugccuccggcagguuuuucaagggauguugcugucuucaagagaggcauauccuaacaucuucccccuucuucugagggaggaauuggucucucucuaagaugcuggugacaagagccccggguaagaaucaagaggccuagacccauugcuuucugguguguggcccuuggccaaacuguuuggcuccucugagcccucauuuccuucuguagaaaaugaggauaguauucucaguauugcucaaggugaacucugcaguaauacauaaaggcaccauacacacgagcugaaacauuacucuuuguaauaauucaagcaacaaugugugucaaucccuuuccaugcccagggguaugcuagagucuauggaggaugcaaaagaagcaauacucucaauccacucaccuucuuauugaggagaaaaaaauguacacagaugaucuaggcagggaaugagagaguacaaggccauauaucugauuuuaugguguaaaccaauuuucuauauauuaaaucugacuuuuccauugaguuacaugcuuacuccagagauguguuuucuuggaugugaauagcuuuagaauaucauaaguccuuccauguaaaguacauaaacaacccaugcugcccccccucucugcuagaguaguucucaugaucagauguguuaaagaauaguugagcaaacuguaaaccagggucuuggaagucuagggaggcuggaauggaacugagacagaccacaggccaaucacuuuucauucuagguaaagauccugaggcacagccaacagagguguuacaggcagguggacauucuaagucagugguggaacugggccagguacccuggccaccagaccuuuuccaaacuuucuccaagucguucauugucuucguccuucccacuacacaggggaugggaaggauaucucuauuuauggcaacucuaagggaaaacuuacaaaccucauagaucagguugaaucuuaauuccccuacuuucuaacugaaugaccuuaaagaaguuauuuaacuucucugaacugugaaauaguucuagcaaugcuuaauguuucuuucgugguaggugccaucguaucugguaguggcacuuaguaaaugccaaagaaugaggcccaccccugccuaucaagccacaucagggaauagccagguagugaguacugcccaacuguccagccauguuuguuccccaguauuggcccagcacuaagagccuucaggagcucuuccugguauccacccacccugguccacugggcccucugccuagagcacacgcuucucuuuaucaaccaauuacuauguagcuuuuuacugccacauuaauuaacagugaagcagauaauugucauuagcuuauaggagcugaaaaauaauugauagcucuuuucacacuaguuguagaaagagucaucaugauuuuuuuuuuuuuuuugagacagagccuuucucugucacccaggcuggagugcaguggcaugaucuuggcucaccacaaccuccaccucccagguucaagcgauucuccugccucagccuccugaguaguugggauuacaggugcacaccacugcgcccggcuaauuuuuguauuuuuuuaguagagacgggguuuugccaugauggccaggcuggucuugaacuccugaccucaggugauccucccaccucagccucccaaagugcugggauuacaggcaugagccaccacgccaggcugauaaaccuugauuugaauauaauucacccucauuuucauuuaucccuaaugugagggugguggcauuuucuugacaaauggggauuaggaaggucuagcagguaucauagguauaucugagaccaaguaaacauucauucaauagaugaauaaauuuuuuaaauaaaugaaggaguaaacaaaugaagugguuauguuagugguuagaggcacaggauuuggaguaauaauucaagcaguaaucucugucaauccuuuuucaugccuaagguugugaccucaggcagguuacuucacuucucugagcuucaguuucucauguguuaaauggaggugcuaaacuuugucuuacaggguuauuguaauaauuagagauaaugucuauagaguagccaacauagugaguggcacauuuaugugcucagaaaauggugguugcugcuaccaucaucaucaccaucuucaucuucaucaucuucaccuucucaauauauucaucaugcuuaucaccacaaucuucauccaucaucaucaucaccaucucuucauugucuucaucaucuucauuuuuuacaaaguuaauuuuuguccuuauuugguauaucaguuucugaaaaccaaaaaugcuaucgugugugucuuuuaaaaaccuuuuauuuggaaauaauugcauuuccagacaggacccuuuauucugcaguuggcagagugauugccacagccacugccacacugaaagguuuccagggccaugugaauugaggaaugcaugagagugcggacugcucuccccugguccugggacucauuaucuuguuugccuuuaaucacaaaucugcacaaagauccuuugccgggacuguuuacugcauagcugagacugguggcacauccuuugaaggucuguggaugaacagcuguagagaagggcaccacagggucacggaaugaaaaacagauucacauucccaccuugguuuugugucgacuauugggccucucugaaccucaguuucaucaucugcaaaaugguaucuuuauaacaucuuccaagguugcugugaagauuaaauaauacaaauucauauaugugaagagugaaacacagugccugaugugaaauagguggucgguaaagcaucagauuauuugguggaggccagcaaggugauuggaccucccuaacgcuuauguuaggacuuaagccauccaucucuccaugacuauggguuaucucaccaucaaugucccuugguuucucuagagacagcacgauugagccaaauugucugcguauccucugccacccucaugccacacacacaccucucccugggucuuuuacuugcucaacccaaagacaaagggauuuucuucugaaggugauuuguacuuuaaaagccaguaugcugaagucauggcauucuagaauguuaguacuguaaggaaucucugauguccucuuaucuaaccuccagaccuaugagugucucacuuucccuuugaauguucuggaggcaucccacaucaucaugugaucacaauuacucaccugcagcuguggcagugggcaccccauuuauacccuaugaccauuucaguacagccagcccaacuuccaagucuacuuucuucuccugaagcucuuucuggccucuaaaggcagcuuugcccauacauggagcagaucagaagugaaaagguaugaacacccccuggaagcagcccccaacaaauaacugaugggcaggcauauaaauaccccagcucccccgcccaccaucugauggcacaauucugcaacacacccauucuuaggggccuucccuucccuaucucacauccccacuccuuugccuauaaguaguuuacucucagaugcuacuugcauuugaauccuuuuuuuaggguuagcuccugagggaacccaaacaguaggaaacuaguccuagauagaagaggaaccacugaaaaagacauggccauucauccaacaaaaguuuccugagaacccgugaaugaaugguaaauggcuccugcuuucagaugcuuauauucuugagaagagacuuagaaacccucaaguuuaguugugaugagggcuggguagaauaaagagucacuuucugguuggcugugaggacucaguaagguauauaaaauuucaggcaauucguuaaaauccaccaaacauuuguugagugucuauuguaugcuaggcucugagcuggcccagcagggaugcaaagaugaauaaggcacauccucuaucccugaagcacucaggaaagggcauuucaacacugugcauucuauuaggugugcagcugcagaggguacuguggggacuccaaagaguaaggcauguguucagcaacaguuguuuuucuuucccuauggaauucucuuuagggccuuaggucuaggucugggcuugacauagaguaggugcucagcgauguugguugaauugaacugagcaguucaggggaagaggaagaagccucugaccccaugauuccuuugcccaacuaggaaacaccuuuccccauagaucacugaucucagacaagaaauaaggcccaagugguuugaacauugucagcaacaguagacaacagagucaaaaauacaauuuuuucauguuuuuuuuaaugccaggaaaaaaaaaauugcauuuacauuccaggguuuaaaggcuuucagaggugggaugggaaggaggaauuagagcugcaagcuauuguucaugcuuggcugauauuuaaucaguuuguugggucauaauagagaauacagcuccaaugacacauaaauuugaaugaucaagucaaagccagugagucuuccucauuauuuaucuuacaguagagauaaccuuuucauuauugaaauagaauugccaaaugagauaguuaauauuaaaacagaauuagcgacaugagcucaacauuuggaaauaaauuucuaauagugcuuuuugugucugcaaaauuaguguucgguguugaucuugcaguaguguuaauugauggcuaaggcuggucccagcugcccugcucuccagcaagggggcucucuugauuucucuggaucaguaacacacacuaacaucaucugugccagaagacaagaagcuuuguuuuacccugagcgagagccauuguugaucuguucuauuuaacaaagaagugaugaguuuugggaaagggcaagggauuguggggauaagaaaaugaaugagccguggcagucuccacaaagcuaacaggcuggcaggguggugggauauugagaaaaguaauagcaacagaauaccagguacucaggugccugaaggccuuggcaccugucuuucacuuucaccuuuauuccccacccccaggcuccaggcuuaccuuucaagaugcaauucaagucuuguuucuccuaggaaucuugcuuggaggggauguucccuuaacucccaaugcugccuucuaauuucacugucuaaugucauagugucugugucuccacuuccucaaccccccucucacaagacugcaaacuugaagauaaugauggcaucuuauuugccuuuguagccucaacuucuagcacagagccuguacaugguauagaacacagugcauagugggugaugaauaaauauucacugaaauaauaaauuagaaugugggaaaaguacuuagagagcaaaguaaaggaagaacuagcuuuuagagggcuuucuggaagauaugacauucaaauagaaaccugaaagauagggacaaugauucugccuuuucagcagagucagcuauuauggcuaguugaggggaaauggcacccugggugguuauagagguagaagaguugggcuuuggagaggaugggcucuucuacucugugaccuccacuguagccauuuuuccuucccccauucccaaagaaguaagagaaugaaggucuagugggaugcucagguuagugaccaugcugcugcacuaacuuccaucuuuucuucugccuugcugccguccucuaccuagaucugguccaggcuccaggaaacuaguaauagguccaggcccuggaggaauuaacugucuucaguacaaacaggcaaugucauuucaugugaaggaguggcuuucacagaggcauggaaguguggaggagaaguuaguuguccagaagugccucuggguauuuuuuguagagucuuugcuucgcuuccccaugaguggacauucaaaccacuaccauggaauagggagucccccagaagaaacccaagagauggaggguggguggaggggcugggagccaaggcuccaagcuguaagacuguggagcaagccuccucuccucucugguccucagcuuuccccucugugaaaugaauaaguuguacuagcucaucucuaaaauaaucuuaauaaucuuugccagcccuaucauucuaagacugcucauuuaaaagucuggcuaaaaaaaugucagugaauaacauguagaucagcauggccagagugaaucacuuccauuucucccucccugccuggcucaaaucacaaugcacauauuaaacccauucugaaaauaagcgugggggagaggucuccgggaaguaaguaaaccucuucugaguaaucucucucugaccacucuuuccuaccgagacagagauaagcacacauuguuucaaucaggcccaaguuccauuucuuuaucuuaaaacuaucuucugccacauuauaaauaaucagcuuacuggugagcuaggccaggcaugugggguagggauguguguggggggaugugugugugugugugcaugugugugagaguggagguucuggagauaguggacaggagccaggaagcaaccuugauccuuaagcagcccagagaaaugagauuaccccuggccuaucagaccaaggagccagcugcuggcaagagaaccucagguuaggguagccagauaauauguuguucaaaccaggacauggcucagaaugaaugggaucgcugcuaauaauuacacuggaagaacaggcacaaaccaguaucauccugggccaacuggaacauguggucaucccagccucaggguuccaggguaacaaacaucuaggauuaagagguccuugcauucaguugggcaacaagauuuuauuucagauggagaaguggcuucaucccccagcccucaucccccagcccuccuccccagcuugagacuaucccacagcaggcagccaaaugguuuuccagccccagcuuacauccccaagugggaggaccaccuuuccucuccagcaggaccuguuaacaucauuuguggaacccaguguaaaaugaaaaugcaggacuccacauucaaagacuuaagaauuucaagacagugacaguagagcauuagaaucaaggaugaggcccuucugagccugagcccuguacacagggccugugcccaugaggcuggaccugcucccuaagcagccugugccgcauuucaagagcacagacucagaauguacuuuccuuccugccugccuucugccugcuugcuugcagguuugccucaauuauauuuuuaauuuaauaucuugaauguguaauaugcucacuuggcuuaaaaguuaaacaacauaaagugcuauguaguuacaaaguauuaguuccacuucuccccccaccauucccaacaucccuuauccccuucccauagauaaccacuuuuuguuuuuuuguguauccucucaggguuucuuucugcaaauagaagucuauauuuuugccuuuuucccuuuuuuaaaauucagagguugcauacuaaacaggucuucugugcccugcaucagaacuugcuuccugguauccaggacaguagccacccacucuucucaccaccuuuggaacaaggccauuucuucccuggaaaagcccugcagaaauguaaaagcagagacuaaacucccaccuaccccacuuccuccagccuccgccucuuuuaucuagacuauuccuucagccauuccucacagagugugaugucuaaacugauccuguuugcaacuuucugaaugugugaggcccagagcuggccaauugacccaccaaaggugggcugcucugcucacagcagaaaaaaauugaucuccuccaucauucucgucaccugaccucaaugcagcccacuuaaugauaauuauaguuccacuggaaauugacucugugccaggaaccaugcuauguaucuauaaacaucacauugagccucaugacaacucugggagauaggucuuauagucccuccuuuacagaugaggcaucucaaggucagagagguaaaguaacauacaaaaagucacccagcaaguaaguguugaaaggauucaaaccaagguuugucuaacuccaaaccaugcucuuaacaagaccacagucucaccuccccucucaaucucuuuggggucuuuugaugaaccaaauaaugggacugaaagcugaaugcuucccccaaagacuuccucacacacaugcuauuaacuaugaacuuucauuuggguaguuuuucuugggcaugaugaaugcuguuucuuuuauuaccuguuauguuauuuaagaguuuccaccuugacuuucaagauaaucucguuuccaugcuuuaaauaucaaccgaauguguaucuuuagccuagacuccuccuccaaauuauaaacuucuguuuccaaccauuuguugauaucucugcuugaaaguguagccucucaaacguaacauaacuaaaacaaaacucauaaucaugaccccaaauccauuaucuuuccaaagucuuccccaucucaguaaauggagugaucuacccacucgcccaaguuagaaacuagugucaucuuugauucucgccuuuucuucaucuucugugucuaaaucaccaacaaguccuguugguuccaccuccaaaaaugucucccagguucacuuuucucucuacucauaaccuuaagucaaguccccagcaucuccccucugagcugcugggauacccaguuuacauuucuccuuguugccacucuugcccccuauacaauagaucuuugagagcaucauuguguuccacuuaaaaccuucuuuuuauuccuaaaauaaaauccagagcuuugaccaugccuacaauacucccuugucugggauccacucuagcucacuuccuacccuucuacucaccaugccccagccacacucucaguaccuuggucucaucaggcucgcccuugccuuuggcuuuuacacauaugcucuuccccuuccuggaaugcucuuccacccacuuuugacaucuuuagguccaaucuaacucacucuccugaggggccuuuucugaccaccuuaucagaauucaugccuugguauccucucucaaggcguccuacuuauuuauaccugacagagcacuuaugaccauuccuuuuugguuguuuuguuuguguuuauugucuaucucuucaccaaacuagaagcuccaucagagcagaaaccaugucuuuuucaugcauugugguaccuccagcaguaagcguagugccagacacauagugcagcagacucucaaguacuguggaauuaguuuuucgccuuucucugguucuuccauguaauaggcuuuacuagaaagcugcaauauaauuuuuauuaccuguuguuuuaauugaauagguuuugcacugugggagaguugaacaauaaaaauguuucuuagaauacauacacacacacacacacacacacacacacacacuaaaugacuuuuuuucucaugaaaucagcaguguaguuuuucucuauagguuagugauccacaguaugaaauggaaagagguggccucuagcauuccucguaccuaaggaggcaguagagcaucauuggagaauaauuccugcgucacucagugcagcaaagguguuugagauugcaguggcuuagaccaugaacuuggagccagacugccuggguuccaaucccagcucugauucaauucuucaucccuacaaugaguugauaaaaagcaaugcccaccuucuaugguuguugugaggauuccauguguuaacacacagggccuggcaggcaguaaguccuuagugaucacuagcaucauuacugugcugcacuucuuacagagacuuuuuuucccaauggccuaaugagauauuuauguuucaguuuaguucaacuaacacuuccugugccccucugccagggccuggagauacagggaugaguggauccuaaaggggcucccaaauucuuaggaacacuuuacaacuguguagagugaaacaaugaaguuagugcaggggcagaggcauguccaggcaggagagcauuaaucccauggagaccuaucugcaaauccacuucacuuagccuuccugguuauaaaagucaccgccccuggccaaggcuacaggugugguagauuaaggcacucuugcccacuuuugcccaucuucuugucucccagaaccggcuuucucugugguuauaacuugauuugcaaacggcaagugaaaggcaguucucccugaaaagaauccuguucaugcaucacccaggauccuggaacagcugccuccucucuaagcagaagagcccugguggccucugugcaugaagaccauuuggggccuaaugaagugcaaagguauuuugugcucuggacccaggagugcaacaguuacuggcugcugaaggcagacauuaaggagaaccauuuuaauugauuagaaugugcauaugcuguauugguuucgucugagggcauuuuggaacaaauagcacugucauugugagccuuaauuagauaauaaauuaauagauaaauggauuccaaaguuccgguggccucuccuaccccugugccagcauuagcauuaagaaagaggcuuccucucuaucaccagggagguguggggaggaagagggaacuggcugugccugggccaugguuccuaagguucucuuggcucaagcaucaugaugacaacaucuaaguuagaugcugaggaaaagggcagcuuuuuguuauagucgaaauggcacaggacaugagucccaggcucacucacuucuuuuguuaucuauucuuuuaaugaauauuuguggacugccuacugugugccacagacugugccgggcucugaggauacagauaacaagaguuccugcccagagaaaacaaaucaauaagaaugucauagacuuuguuagguagucaaaaagugacuauagagaaaaaauuaaguaagaagaggggcaaaucgggaauauaagauggggagugagcagggagggagggugcaauuuuaaagagugguuagaaaagugacucagcuggaucucugagggccuugagggccacugcgggggccugggcucuggcugggaugcaguugaagagccuuuggagggugcccagcagaggaguuguuauacuuccucuaggacuuccuggucuguaauuuuaguauguguuggaucuggaauggcugacucauggcaggcaaggagcugcugcuuucuccugcacccuugggugaucauaaccaucuuucccaugagccugauuuggccuuggaaucuuguucauccagccuuccaggagcucuaccagucccucccuguuggcgcuccagaggaagugugagauuccagucacuuccccaccccaugauugggcugcugggcugcgccaggccugcacccaugaggcagauggaaaggcagugggccuggugccugcccagagaacacagugaaggggguugggggaaggagcuucaaaauauaacaacaggacaagucugauaagcagcauagaaagacuuaaggggauuaauucugccugggagaggggcacacagagcuucccagagggggcaaauuggaggguaucuggaaagauagguaagauauuaacaaggaagagccugagaagacguugcaaggaaugcgggagguggaaauggguggaggauagucugguggcugguguuggugaaggaucuaagucaggaaauaccaggaagcacuuaaccagcucucgugcccccugaauguugccauuucccgaaugucugaaagaggcaccauaauaucagccacauugaguauauuaggauaaugccaguuauuaguaggaaagccauuuccaaggacugcauaaaucuuguucguguaucagucugguguaguguuccugauagcagacauuucuuuauguuggggaucacugaaaaaccuggacuccucucuuuggucuuccauccccuggagccucagugucaucugcaaaagagggaucaagggugaaggcuacuuuuuagccaucuuggaugagaacaaucacaccuucugguaguucugugagauggagugcacuggugccauggagcugccaggggagcugggaaaggucguccucgcugagcagccacuuucagccccaggucagugucuggagggaagagcauaccugugguggccagugagcaccuaccccuggugaauaugcuguaaacucaguaaacaucauccuguaccuccuccuauaucucguucagcacagcaaacuaccuugauaauaagaauuauaauccuucauguuuucagaaaacuuuaucauuucucaagaacuuggagauaaguucagauugagcauuuauuaagcacccacuuugugucagacagugagaaaacugccucaauuuucuccuuuggaaacaaggguacucuccugggcucaggguuauuacaaagaucaaaugagggaacugccuggcacaugguagguacucaguaagcaccaacacccaucuucccaucuuucaagcuuuuccaggcaagauccuaagagcagauaggauggucuggcaaccuccuguuuucuucaggaccuuggcuuuggaaaaccuugcccuaccacaaggcgaagaaucuaauugcagacaugaggccgucggggaaaagccaaauacacacggcuuaaaaauagaggccacucucauggugacuuuucugagucuuucuaacucaaauaucuggaaauugugcugaucaaauucaacuuugcgucccccaggacagaggagccggucucauuuuucuggagacaugugcuuugggcauuuguuccuccuugauccucccagggcuggcaacguggauugcaguuugucccaaggguucuagcaggccacuuggcugcugcccaccaacuuuuacauaaagaugcguggaggugggaaauaggcugggggcuacauccagggaaaaggggguuucaucuaaagaaaggaacugagaaggaacuguaucgguauuuagucugaaucagaaugacagagucauuggauuuuugaaaaguaagaagagaugggcaggcuccccuaaugaggaaauuucacacucuucuuuaugcuugaugacugugcuagugauuccaguuguaauauuccucuaaauuacauuauuucaggccauaaguuucucccagcagguggggcaguggggaaaagauggcagcaggcauaagccaacuccaugaagcuggauaggggcugccaagccagcgggggugcagaccccuguugggguuccaaccagcagccaguuccuggagaggaggaagaguguaggcagaggaucuggccccacaucccacacucaggaaccugggcaucuaagccaagaaccucagggaggucagucuuggaagagggucuuacagaagcaaggcaauacucgcuuaggagagucuugggcaggcaacuagaaaacgcacccagaaacaggaccaaggccaagacaggucugggaacugggacuccaaaauucccauguaagagccuuggaaaaaugcagauaccugaaaggacacagucccugcugugauucugacucagagaauaacucagaggcccagacaucaacuuaaaagggagcuagaaucagaacagugcccagccaauaagggagcaagcagaaagcugagcgagcacccucuugggaggguggggcagagcccaugcgugggcccaucuguucuggauucacggaagguuuuuuguuuuuccuuuucuaaagcauacauucaggguagguuucaaaaagaaaauauucuaacagggcuuaauaaggaugacuagagaagggaacacaccuacuacacaucaaacauucuacuauguguuuuguuuauuucucacauauaacccaguggcccauucuaaagaucagaaaacuaaggcccagagaauaaaguaacuugcuccaggacccacagcuaguaaggggcagagucugacucuaaagccugucuucuuucuccuaaacauuguggacaggugcuaaagaggggcuuucugcugggaccuuugcucuggccuucccuugguuuccuguccccuagaacccugacaugguuuggcuguguccccacccaaaucucaucuugaauucccacauguuguuggagggacauggugggagguaauugaaucaugggggcaggucuuucuccugcuguucccgugauaguaagucucacaagaucugaagguuuaauaagggggaguuucccugcacagcucuucuuugccugcuaccauccauguaagaugugacuugcuccuccuugcuuuccaccauaauugugaggccuccccagccauguggaacugugaguccauuaaaccucuuuuucuuuauaaguuacccagucuugggugugucuuuauuagcagcaugauaacagacuaauacccuaaggaaaacucccccagagcaauggaagcccagugaagacuuccggccucccuggccuccccaagucuccucugagccccaguggcccaaaguacuuacucuguauuccucagaguacuuacacugcccccuucacagcccuucuccccgcaaacagugaguuccuuugcagcagaaaccguauuuuuaauuccauguccuagugcuuggcacaugaaaaguaucauguaaagguagccagguagguaaggagaaggacaggaaagacugggucuauuagucuguucucacaccgcuaauaaagacauacccaaaacuggguaauuuauaaaggaaagagguuuaauugacucacaguuccauauggcuggggaguccucacaaucauggaggaaggugaaugaggaaaaagucgggucuuacagggcagcaggcaagagggcaugugcaggggaacucuccuauauaaaacugucagaucucaugagacuuaucacuaucacaagaacagcaugagaaaaacccacccccaugacugaauuaccucccacagggucccucccaugacauguggggaucauuacaauucaaggugagauuuggguggggacacagagccaaaccauaucacuggaauauaaagaaauugaaguguucggggaaagcuuacacugggaagcaggaggcuuggaugccagacuagcccugccacuaacuuuccccaagacguuggucaagucccugcccucucugagccucaguuuccucauccgcaaaauggagauguucagcaaaugauugcuaggauccucucaacaacacuaagugauccuauggccuaaaaaucagggucccaggauccaaaaacuguccauaaugcucuguagaauuaaagaaccugaaucucagguguugggccaaaccccucacaaauggcauuuauuaccccauuccuuggacucuagucgcagguguacuuguuuuauuuccagguaggcugcaagcucauaaagggucugugccuuucucaucuccacauccccagguucugggcacauggggugaggcucauaagaacaauaaaauacuugcuugagugucugaagcugaauuugggcccagucuguguaccccacauaccuaaccaaagguuaaacaccaaaccuccaaaagcugggaccugagauaaccuugggguaagcauuguacaacuaaacaugaguaacuaaaaacccacguguguccagcuugguuaggguaaggguuaguguucggguugggcuugaaaaguuuuccaggaauaacaaauugguaaaaauauuuuuguaacaaauauggcagacagcccuuuguauaguaaacaggaaagcacuaagacuccaauagaacagaagaaaugcagacagaugauacacaaaugagcaaaauguucaccuuugcuauuaauccaaaaaugcaaacuaaaacacuaagagauggcauuuuuuacuuagcaaauuacauagaagauauguuuauauuaaagauuucaguguuggcaagggcguggugauauagacacucucauggaggguggauggaaaugugaacugaucaccuuuauggaaagcaacuuggcaauauauaacaggacacuuuaaaauauguccaucccuuggccccauuauuguguuucuagaaaucuauuccaaggaucucauucgaaauaggaccaaagcuuuauguuaccagauguucaugaugucauuauuuauaaucacaaaaaaaaaucagaaaccagcuccauaucccacaguauggaaaauaguacuaccacuuuauggcauaccaagcuaauguaauauuauaaaguuacuuaaaaugaguccuacaaagaggcuuucauggcuucaaaguguuuaucauaaaauguuaagcaaaagguauaaaacuguaucauagcuaugucaaaacuaugucaaaaauauguguauauauaacaaaauguuaauaguguugugugaaugaugucacuacaguucauuuuccuuuuuuucuaaauuuuuauuauucuauguuuaaaauacauguuucuaaagaagggaaguaaaaguuugcuggcagccagaacgaguaggacccauuugucuuugcaaucaccagggaccgccugcuaaggaagcccguuaaacccgggguggcagagcccuugugcugaaaucgcucugucucuggagcauauuuuuucuuugcuaaggaaauugcuuuccauaaaaccagcucucugacaccucugaguaccagggaaccaugcaagcccacuuuccuggggacauucucuaauggguaacuccaucacguuccagcuuggcgcuuccaacgaaucccagccagccauaaaaauuuuuagcacccugcaugcaagacugauuccagcggccucauaaaaaucccauucacugaccaagagcugcggguuugaaacucucaaguccccugcuguuuuaaacccaguggcuuggcgcauugcuaagugaugccugguagaacuccaggcaucaagucaagacagggauccagggcagaacuggugggaaaaaaaggaagaaaugggccugugccgagugugcagugcauagucaugauaaagagccaacuucccacuguucuuucaggaagguacacggauuuggccaagcaagggagaggauuuaggaaagauggcuauccuucaagaagaaaaagggguugugaaggguguuggaggaggagcuacuuuggcuggagugcucuuuuccugucugccccuagacagguggggaggaggccccagcuaguggacacccacagcccucuggaaggagccugccuuacuccuugucucaggaaagggucuccgcagccucuuagcaacgaccagaccuaaggaugggucaggaguccauugccugcauaccgcuugcagugccccaguggaugccugacacagccacugcuuuccacacuaaacgggcuccaagaggccuguguucuacacccugcuuagcccccagucagcuuugucacccaagggaaaucacucacauagucucucucucagcucugguuuucucauucggagagugaggauaauaaacucccaucuuccccuacuacugcuccccgcuccagcccccacucuuucuacccauuuuauuaaaauauuaucacagaauauuuccauacuccagucaaguaaaaccauucaaauagcauuuaggcacaguauuaggguucuccggagaaauacuaccaacaggaugucuguauauauagaaagaggcuuauuuuaaagaauuggcucacaugauuaugaaagcccaaaaucugcaggguaggcuggcaagcuugugaccugggaagagccaacguugccguccaaguccaaaggccaucugcugcaggguuuccucuucuuugggggagguucagucuucuguuuuauucaggccuucaacugagugaaugaaggccaccuacaugaaggagggcaaucugcugugcucgaaguccaccaauuuaaauguuauucuuguucaaaaacaccuucacagaaacauccagaauaauguuugaccaaauaucugugcucugugguccagccaaguugacacauaaaaauuaaccaucacaagaacucaucuuuuaagcuucuaagaaaauucaauguucuaugugcuuuuucacauucagaguuuucugcaacucuauucuuuguaacaaaagauagcaaaguuucuaauguaggccuuaaggccugugccuguauaucuaaauuugguggauauauaucccaggccugaugcacccuauguggcuuuggguggugauugacuuaaccuaucugagccucaguuaucuaguguguuaaauaagagaaucacgucuacaccucauagaguuuuggugaagauucacaggaaucagauauuaaaaugccuugugugauaccugaccaagguucugaacucaguaaaugagccugcccuguacuuuccugccuucuuaguauugcuagagcaucacauuuagaucugcguauaucauagcuauccuauuauguguuuggggucaugaaaaugaauacuccaucuuuauaguuucugacacugaccaucaaccaacuugaagguaucccaauagguaaggugccacccauuuucuugggguugcaauuucuaacugaagguagaaagggagguacugaguaggggguagaaagggagguacugauuagggaggggaaaagagaaguggugaggaaaacauuaugacugccucaaaaagcaaguauuccccucccaggagagggauagcuucccaucaccuggcuacuguaggccauguuuugcugaaccagaaagcagguagaguuccuacauuucuuuuuguuggugauuucuaauauaauucuguuguggugaaaaaaauacuuugugugauuucagacuuuuucuugacuuagcucucagcuuaggcauuguuaguguauagaaaugcuacugauuuuuguacacugauuuuguauccugaaacucggcugaaguuauuuaucagaucuaggagcuuuuggguagaaacuguggaguuuucuagguauagaaucauauuaucugaaaacaaggauaguuugacuugcugucuuccucuuuguaugccuuuuauuuauuucuuuuucuugauugcuuuggcuaggacuucaagaacuguguuggauaggaguggugagagugggcauccuuuucuuuuucuugcucucaggggaaaugcuucaaguuuuugcccauucaguguaauggguuugucauagauggcuguuauuauuuugagguauauauuccuucaaugccuaguuuguugaggguuuuuaacaugaagcaauguugaauuuuauugaaagccuuuucugccucuuugagaugaucaugugguuuuuguuuugaguuuuguuuaugugaugaaucacauuuauugacuugcguauauugaacaaaccuugcauuccagggauaagccuaauugaucgugguggauuaccuuuuugaugugcuccuggauuugacuugcuaauacguuguugaggauuuuugcaacuauauugaucaaggauauugccuaaaguuuucucuuuuucucugccagguuuugguaucaggauaaugcuggccucauagaaugaguuagggaggaguaccuccuccuaaauuuuuuggaauaguuucaguaggaauggaucaacucuucuuuauacaucugguagaauucagcugugaauccaucugguccugguuuuucucugguggguaggcuuuucauuacugauucaauuucaggauucauuauugguacguucagggauucaauuucuuccugguucaaucuggggacauuguauguuuugaggaauuuaucaauuccuacuuaguuuucuaguuuguguacauagagguauucauaguagucagaguuguuuuuuuuuuuuuuuuuuuugguauuucuaugggaucauuaauaaugucaccuuugucauuucugauuguguuuauuuguaucuucucucuuuuuuucuuuauuagccuagcuagcagcuugucagucuuacuuguaucaaaaaaccaacuccuggauucauugaucuuucuuaugguuuuuugcaucucaauuuccuuccauucagcucugauguugguuauuucuugucuucuacuagcuuuggaguugguuugcucuuguuucucuaguuaguguaggugugauguucgguuguuaauuugagaucuuucuaacuuuuugaugugacuguuuagcgcuauagucuuucaucuuaacaaugcuuuagagauccugauauguuguaucuuuguucucauuaauuucaaagaauuucuugauuucugccuuaguuucauacuuuacacaaaagguuguuuaauuuccauuuaauuccauguaauuguaugguuuugugcaauuuucucaguauugauuucuauuuuuauugugcugugguccaagagcgugguugguaucucuuaauuugccgaugauuguguagucgauuuaaagugugugccuugugcagaugguaagaauuuauauucuguugguuugggguggagaguucuguagauaucuguuagguccauuuggucaagcauugaauucagauccugaaucucuuugcuaguuuucuaccuuggugaucuaucuccuaccgucagugggacauugacagcucccacuauuauuaucugguuacccaacucucuuucuagaucucuaagaacuugcuuuaugaaucugaguucuccgguguuggaugaauacauauuuaggauagcuagaucuucuuguuggauugaacccuuuaccauuaaguaaugcccuucuuugucuuuuuugaucuuuguugguuuaaagucuguuuuuuuuuuuuucugaaauuagaauagcaaccccuguguuuuucuguuugcuuucugcuugcuagauuuuucuccauuccuuuauuuuaagccugugggugccauagcaugugagauggucucuugaagacaacauacaguugggucuugcuucuuuauccgaguugauaugugcagauuugauccugucauuauguuguuagcugguuauuaugcagacuuuauuguguugucacuuuauagugucaauggucuauauacuuauguguguacauagaccuuuggggauggucaucuuguacaauaucuagcaguuacugaagaccaguaaccaucuugucuuuccauauuuagcacucccuugcagaccuuuuguaaggcaggucucaugguagcaaauucccuuaccauuugcuuaucugaaaaguauuuuauuucuucuuugcuuaugaagcuuaguuuggcuggauaugaaauucuugguugaaauuuguuuucuuaaagaaugcugaauauaggcccccaauuucaggcuugugggauuucugcugaaaguucugcuguuagccugauggaguuauuuuuguaggagaccuuccccuucccuuuagcugccauuaacuuuuuuuuuuuucauuuugaccuuggagaauaugaagacugugugucuuggggauggccaucuuguacaguaucucacaaggguugucuacauuuucugaguuuaaauguuggccucucuagcaagguuggggaaauuuuccugggugauauccucaaauaugaaguugcuugcuuucucuuccucucuuugagggaugccagugacuuacagauuuggccucuuuacacaauuccauauuucuuaaaggcuuuguucauucuucuuucuucuuuuuucuuuauuuuugucugacugaguuauuuuggggaacuggucuucaagcucuguuuucucagcuugguuaauucuacuguuaauacuuacaauuguauuaugaaauucuuaaagugaauuuaucagcuguaucagaucagcucuaucagaucaguuugguucuuucuuaaaauggccauuuuaucuuucaucuccuguauuguucuguuguauuccuuagaauccuuggauuagguuucuucugaauccugaugaucuuugcuccuaugcauauugugaauucuguuucuuuaguuuuggacauuucagccugguuaagaaucauugcuggggaacuagugcagucaauuggagaugagaagaccccuuggcuuuuugaaaucucaaaguuauugcacuaguucuuucucaucugugugggcugauguuccuucagucuuucaaguugcuauccuuccaauggguuuuuuugauuuuaucuuguuugaugcgcuuggggguuugauuuugguauaagguggauucacucaacuagccuuguuucuugaagauuuuagagggccaagacucagcuuggcacuuuugggcugugugcuguaacucuuggaaacuaguacugggccccugccuuuguucuagagguuaggaaccugcugcauuggaggggcugagguguucccaguucacuggccacaacacuccaauggguggugccagccagagcaccucaucagggaaggggcagcaggauccauuucacuugcacaugucaguagcuguagcagcauggcaggguacccauguguuggcuggggcagaguacucacaggagugaaccccaacauuccugugugcauuugcacuggcaggagugaggugcuggcaggcacaaagcugcuggcuucugugcacacguuuacagaaggggaggugcagggccacuaguguuuguaugugcuuucaugccagcaagggcagcacaaccagguacccauguaucaguggggggguggggauggcagggugugcucaugccagcuagugcagugggguaugcuugcacacaugugcugguggggguggggaagccaggugcacccuggaugcaccagaaaagcaggggagauggggagcuaugggcaaaugcaugacagcaaaacaguggagggaggcugcaggcauugggggaagaauacaggugaguuggugcacauuggcaggggauguucugcuggagcucuccaauggucaggcaugguuugcugacaaaggagcuauggugagagcccccaggaugcacccugguugggcauccaaggcugcauugcaaguaggcauggccaaacucgggucccaggagaggccaacauacaggggggcaauuaguucagacuggcuguaucucacaaguaagaccacccugcucuguccagcuucaguagucccccucaaggcuaaaaucuccuaaaggagaauaguaagccauggagaauggccaucccuggccgugcucuacugcagauguuccugcaccaaacccuuugggcucugcgcaggcuggagcccugcuccuacaaccucuauaagcaucucuccuugacagcucaaguguucaugggauuuggggggggucuccugcugccaggauucuggaaguucauggcaagagcaugccauuccuugccuguucaacccaacccuuccccaggaguugcugagggccaggcuggugcucaguagccccaugcaggguucccagcuuccccccgccuucagcccagcaucugcauccucccuucauccacuaucaaugucuucccucugaagauccacuuagaauguaucagucuuccugaugucccagccucucaguggcagacauuucuccuggcuccauucuuuuacuuugaagcuguuugugucuuacaaucuaaaguauguuuccuauagacaauauaucauuggaucuugcuuuuuuaucugcugucacaauaucagccuuuugauugggucauuuaggccauauuuacugucauuauuuauaugauuggauuuacauuugcuacuuuccuuuuuuugagauggagucucaauuugucacccaggcugaagugcaguggugcaaucucagcucacugcaaccuccaccuccuggguucaagugauucuccugccucagccucccaaguagcugggacuacaggcauaugccaccaggccuggcuaauuauuguauuuuuaguagagacaagguuuuaccauguuggccaggcuggucuagaacuccugaccucaggugauccaccugccucagccucccaaagugcugggauuacaggcaugagccgcugcacccggcccuuccuauuugcuuuugauaacuucccugucuuuuuuauuucucuguuucuauuuuacuaccuuuuguauguuaaauaaaguuuuuauguagcauuguaauaccuuuguugauuuuuuuaacuauaucuugaggauuuuuuuuagugguugcucuagggaauacaaaaugcauuuuaauuugucacaaucuauuuugucacuaccaauuucacuaaaaccugaaaacuaugcuccaagaugacuguauuccuuucuucuuucuuuugcuauuuuuugucacacauauauauauauacauauuauaaaccuaacuauacaguguuauaauuauuguuucacucaaucuuauauuuuuuaaagauauuaagagaagaaaugagaaaauuuauauugauagguuuauuuuuauuaauguguguauuuuccauuucugaugcuuuucacuucuuucuguggauuugaguauaucucaauauuauucccuuucagcuuaaaagacuugauuuagacaugugaggcaggucuccuagcaguaaauucucucagucuuuguuuaucugagaaugucuuuguuuuaccuucacuuuuuaaggauaguuuugcuggauauaaaauuguucauugacaguuauuucucuaacagcucugauaugcccuccauuguuuaagaugaggagucagccauuaauuguauugaugcuuuccuguaaacaaucagucauuuuucucuuaccaauuuucaaaauuuucucugugucuuuggcuuucaacaguuuaugaugugucucuguauggaucucuucucauuuaucuugcuagggguucauuuugcuucuuggauauauagauuaauguuuuucaucaaauaaggggaaguuuaauaauuauuucuucaaauaauuuccucugcaccucucucuucucuuucucugguuucucucuuucuccucuccuggagccuuuauuauauguuuguuguugggcuuaauguugucccacucucagucaguuucuauugacugcuuuccuuccuaaguaugggucacacuuuccuguuucuuuguaugcaugucuuguaauuuugauuuuguuguugaaaacuggacacuucaguuacuauauuguaacaacucuggauucuaauuuucacuuaugaagauuguuguuacuguucucuuuuuauuuauuguuuaucuuuggugguuuuuuuguuuuguuuuguuuuguuuuuugagauggagucccgcucugucucccaggcugaagugcgguggugugaucucggcucacuacaagcuccgucucccggguucaugccauucuccugccucagccucccgaguagcugggacuacaggcgcacaccaccacgccuggcuaauuucuauuguauuuuuuaguagagacaggguuucaccauguuagccaggauggucucaaucuccugaccucgugauccacccaccucagccucccaaagugcuaggauuacgggcgugagccaccccgcccagcccauuguuuaucuuuguuuagaacaugucugggcuaaaucugugaaauguuucucucccgcggugugaccacuggugucccuaaucacuugauuuuuuucuugucacuuuucagcuucugacuacauagcuuagugaucaaccaauggacagauggacagagacugugcucaaaacacuuccauguguuugagccagauguucugccaauggagaugugagaugaagggaaauacauucaaagcuuaggucuuuuuaaaaccugucuggcuuuugauuuccacuggguccuuuuacaucuccuguauguaugcaugccuucauuuaugcauccucaggguuggccagaaguaugagaauggucuggaaccucucuggacuccacuauucauucacaucucagccaagaauaugcuugccccacuaugaccucaugcuaccagaaccauuggcccuccccacuuaccugcugccaagagucacuacuuuuacgacaaugccaccagccaugggcaucagcugcugcucccacugaccuuguaagccaaguugccaauccucauagcaacuucacccuggcagaacugugcuggccaaggcgugguggacagaacaagcccaggaugauaacaccacugagucccacuguucuuaccuaaaauauagcaguuuuucaagcauaaucacuucggagaucauuauaugccuuuugucaauuuccagaaaauuaaaauaguuauuuuugucaauuuugucaaacuuuacauuuccuuuugagaagagaugauuugucaaccuccucauuuggccauaggccaaaauccccccuauaauuucuaaaguccucuuaaaucucuuuugauucuaacaacgucuaggugagacugacagagcaauguuguuagugccauuucaaagauaaagaaagugaagcucagagaggcuaagugacuugcccaguguccuccagcuugaaacugacugagccagguuuucagccuggauuucugucuuucagugcuuuucuacuguaccaugaagccugggugugguuccauugaccacugagcaaauaagcuaccuuagucagcuuggggugcuauaacaaaauaccauagacuaguggcuugaacaacagacaguuaugucucacauuucuugaagcugggaaguccaagaucaaggugccagcagauuugguuuuuggugagggcauacguucuggcuaauagacagcagccuuuucacuguguguucacauggccuuuccucgguguauauacaccaaggaaagagagaagagagagagaagacuucucuuuuccuccucuuauaagggcacugauccugucaucacggucccaccuucauuacuucaucuaaaccuaauuaccuccuaaaaaggcucuaccuuccaaugccaucacaucauggguagggcuucaacauguaaauucuaaagggacacauacauucaacccauaauagacgccaguccagaacuuagcuuucucuugcugacuugaggccuguagaguuucacugggucuucauauucaucaaagccaaacuucagggggaaagaaacaauggauaaauuccagcuguggaugcugaagcucagggccuuucuucuuuuccccauuaagcuaagaggugauggugggacguccuuucuccugcagccauccuacugagaggcacugugcuuugcauguggguagcuccugaauuauaacuauggcacguauuuuaaccagucuuaaaguuguaacagucauuuuauuuuuuccaacuuucuuuguugaaugguuuagcaaagaaagguaacauuugcuuuaagauucagagucauaaacccucaaaucagaguauuaucuucugugccaaaacaaggacauauguaaacuuuggagacugaugggauuugccugagucuccagagaauagugugagcucuuugcagaggucacagucucauggagagaacacgcuggacugcucugaauuuuagggccacuuuccuaaugaugaagucugucacuuauugagcauuuaccauguaccaaacacuaucuuaggagcuuuauacacaaaacaugaauguuccugggccucagcagccuguggucacuuugauggaaauaauccaaauuuccuguauuccuacacccacccuacccccgccccaacaacuugcacaggaccuacagcuuacuugaagguccccccuuggggcuuucuggaagccuccagaggccucccauguguuugagaagaacucuucuuuggcaccuucacaucgcaccccuuguuaauauucucucugacuacaagccacugggaagguggaaccaugccccggcccuuacagcuggagcccuccacaagaccaccauucuucugccccagggucaucccaaagcugcaaacccuuaaucacugcacugucuacaguguaccauaaacaugcuguuuccuagagaagggaagagaaggagccucaccuugacuccaugcuaaccuugauuccuaggccccaaagcagcacugcuuggguccacuauuuaauagcuucuucagcuucccaauaaggcucagagcugacccugggcccaggcaggagagcaaaccuuccuaucccuucuggguauccuuugcuguguaacaaacuauccuaaaacuuaaaggcuuaaaauaacaaccauguguuauuuuucauaauucuguggguugacugggcagcucuguaaguucugcucagggucucuuaugaggcuuuagucgcaugguggcuggagcucuuggcuggggcuaaaacaucgaagauggcuuuacucauguguucugugccuucacagggucaguuggaaggcuggcaccgcugucucuccaugugguuuuuccacuuaacuagcuuagacuucuuuucaugauaguuggaucucaagaguguuccaauagggaggaagcauagguuacuaguucucuuagggugugggcccagagcuagcaucugcugcauucaauuaguuaaaguagucacagggccagccaggauucaaggggaaagaaaauaagcccuagcucaugaugagguuagugacaaagaauuugcagccaucuuuaaaauccacugccauucccccuaguuuuugaggcuguuccuaaggaaacaguccuccuugcggcuuucuucucuccacguaaaucagcugagcaaaggagcagcuaaggagcugaugaccuuacauaagcgaucucaguuuaggcucaaugggaaccacuccacugaucucuuaugagucuuacugcaauucagccagguagguuuucuuaucccccauugugcaggugaagaaccuaaaauucagagagcuuaagugaucgaugcaagguuucagcuaguaaaauggucaauccaggauucaaacucaggucagccuaacuccaaagccuuucuugccacccucacucugcaucucaucucucugaaucuuaguugccuccaaugucauauauuaagaaaaaaaaaaaaaagcagugauguucaaggcccauucuaacuuuaaaauuuuauaauucuuuuccacccaccacuuaccugaagaagcacaucuccuccugcugcauuugcuacuuuucuguaucucuguugacaagauuuugacccauagcauuuguuuguaagugucuuauacuauuuuuuuagaaauccaaauggcucuuaugaaaggguccuucaaauuccugguagaagguaauugacuucuaagcccucuccagucccauaaauccccuuuugaguacucaguacuuucccugccagcugggagaugucaaggacaggaguuuucaggacgucacuccucugcuucaaagcuuuccauggcucccccauugcccucaggacaaaaucuaaacucuugacauggcaugcaaaccccuuuaagagcugaucugccucuccagucuuaucucauccuaucacacugagaugcuuacaguuuucagccgguacggugugucucugugcuuuugauuaucuuguugcuauuuucuagagggccucacucuauuccuuccacuccugguuaacucuuacucauucuaggaaauauagugcauauaucauagaggaggcuagacuuccaaguccaucucccuuacccgauagcacucuuggcauaacuuugucaccucacucacuacuuuauguugaaacucuuuauuuaucucuuaguucauaucucccaaaagacaugaaaucccugaagaccagaauugcguuuuauucuucuuuguaauaccaacuucuugcacaccccaguguuuugcacagaauaggcauccggggaaugguggaaaugaacacagaucagaacaagcuauaaacuccauuaggacaagucucuguuugucuuauucaccacaaaauccccugugccuaacacaaaacagagauugauacucuuucugagaggugucucuucauuuauugccuuaugucuguaucuucccuagucuucaaacaacucuuccgauucuccauuucccacccuuccacucuggccauaauagaauaacuggaauuggacuagccauccuaccguaagcgauuguaaaaaugaacacaguguaugaaauuacuauuuucugauuuuagauaaaaggcagcacaaagcuauggcuuccaagagguagaaaacuacacaaguuacauggucguuccagcuuucagcuuagaggaacuuuauaaaacucccaaguaguagaguucagauagaacacaaccauccuacuaguuuagggccauugacaaaucuggaauuuguaggauaggguacuagagagaaaaggcuacagaaaucugcauugagguccucaugagccuuugauuaaaugccaagcuucacauaugcaaggaaaaacuucauguggcuggucaaagaacaucuacuggggaaaaaacaacugccaggaaauaaaacaacuaccaagcagcugcaugcugacauucacaccaggcugagagauguuuccguuccaacuacccagaagggaaggaccuuguugaacuuccuaggcuuccacuacacacuggagaaaggccaugcuuuaggaauaggguuaaucuaguuauagagucaaggcuacuuuaggccuaaucuaauggugauuaaaauaagccuugaaaugaucauacuaaucugcaaguaaauuaacugccuaccuaagcaaaaacucaacauuuuuuuagggaagacaacaaaauccagaccccaaacaucuuaauauccauaaugugcaguauacaauaaaaaauuaugugugcauagaagaaggauagggaacucauaaccaagagaaagauuacucaguagaaacauagauuacaggaauuauggaauuagcaaauaaggacuuugaaaauagauacuauaaaucuguucaaggaauuagagaaaaauaugaauauaaugagugagcaaacagaacaucuucauagagaaauggaaccaaauugaaauucuugaauugaaaaauguaguaucugaaauaaaaaguucacuguuggguuuaacagcagauuguacacuguggaauaaaaaguuucaugaauuugaauacagggcaauaaaaacuauccaaacugaagcagaaagagagaagaauaaaggcugaaaaaaaugaacagaacuucagugaccugagggacaaugucaaguggucuaacauguaauuagagucccacaaggagaagagagagaugaaaacaguaaaaauaauagcugagauuuuuucaaauuugauguaaauuaagcccacaaauccaggaaacucaacaagucacaggaauaaacacaaaaccguaauaaaauugcugaaaaucaauuauaaagagaaaaucuuaaaaagcaaccagaaaaagacauaaauuccccuuuuucauaaaugaauuucuccuucuaguaaugcccccucuuccuccaggcucccuuagcaccuuuuccucaacuccccuuugacucugucuugaucauagcuuugggucuaugcuucaugccccuugaaagauuuugagcuuuuuaauggcugggaauucaucuugcauugaggcuaucacggcauaucacaacauguugccaauaguagcuguucaacaaucaauuaaaugggugaauuaaguaccugaaugaauaaagguaauagcacagguugguuauuaaauccuggacuucuaagcaaacaacaccaagaagcaguggaacccaggucaucccacaagagaauuaugccuccccuuucagaauaauaauauuuaaaaccacaauuuauugagugcccacugaaugccuggugcugugguaagccauuuauauacaccuaauuaaagucuuauaaugagaaaagcaaagggcaaagagcuaaguaaauugccuccggucacgcagauaguaagugagauuguagguuauccccacaagauugauuucaaaagcuggacaaaacaccuucucuacuuccuacucacaaccuauuucuuaaucauauauucccauggcucuacgcuuucuuuuguccaugcuauuucuucugccuuucucucacccaccuggugaagucccguucuuucucaagauccacaucaaaacuaucuucggcaggaaaaaugaguucacauaccaccacaaauccagaaggcaagucugagugcccgugcucuuuuaagccauggaauccugagaugaaugagcuaugucuucuaaccuaaagcaaugcacaguguaaucagagaaagaguccuuggucaaaugagaucaguacaagagagaaggcaauacuagggguuugggagucccugagccaacuagacuacucagugaggacuucccggaagaggucaugccugacaugagucuuaaggauaugagaacuggacaaaguauaaaauacaaaugcaacaaaaaguccaugugccugcauuagaggacacagugagagaagccaaggucagugggauggcaggaaguccucuuagaagcugcucguucuccuuugcugugcaccagcaggugcucucaggucugaacuccuuuuccuaacagaagucugccucugcaguaacucugacuccuccuuagugcuuguuacagggaauuaaauuucuuuugaauagaucuaccuucagagugggaaguuaaugagucacuauuuuucaaauuuagggaaaauccauaguugucccagccuuauagcuugguauuauuggauaaucaaacacaacuauuuucucaaaauagaaugggguuuccugccaccccuccuguucccaucccagccaccuccaccagcagcagcacagggugaggaagccaguguuuugccugggucugggcccacauuucuuuuuuaauccuagacuguauaauuggcccuugcagacagagguuaauuuccuacugugaauucccuaccaaaguagcauggguccauggggaaaaccaagggagaaauugcuuccaggugccaccuggucucccugcauggcugugagagaggccacauggggaaaugugacgagcaagggcuuuagaaaccuccuacagacccagguuugagcugagccacuuacuagccaagugcccuagggcugguggucuaauacaaggcuucaguuuacucaccuguaaaauagggagaauaccacccuauuaacugugguaagggaugucacaguugugguacaguauuuauaugcacaagcauucaacaagugcucuugccucuugguugcucgguacaaucuugcuaccauccugccuuucuuucucagagaaagcucccuuucugagaccuucgaguaaccuaccucucagauguuuccuuccuaucaacaagaggcaauaaugaauccuuuuuuuuuaaccucaaaagggaugugaaguucaaauaagggacuagauagagacauuguaaaacuuuuauuuuaaauauucuaccaguguuucucaggagggcuacccugggauuuugggcaggacagucuuagcauucucagcuucaguguauucagugccgguagcagccaucuuagucauugugacuaccaaaaacaagcugcacacagcuccacauacacaggcacacacgcagacaccccaugcgccaucugagaaaucacugccagguuacagucugaucucaccuaugcagcauuuaucaucucucugggcccuguguccuaacagcacugcuauaaaacaaguauucagaugcagaacauuauugcucauguguauuucuuuuuaauauccuuuuucuaauuaugcaaguuaacacaugguaguugaaaaagucaaagaacagagaagcaugacaaguaaaacaaacugaaaauccccggcaugaacauuuuaaauauuuauaugauuuuuauuauaaaaguaauaaaaucacaugguuaaaaauucaagcgcugcuaaaggguguaaaaugaaaaguaaaggucuuuagcaucaacacccauccugucguucacaguuuuauauguaucuuucuaggaauuucuauacagacuccuaucuguguguuuguguacuccuuucaaacacacauggaaucguauacuuuauuugcugcucugcaaguuguuuuuuuccacugaacaguauaucucguggauuacucccucgcaguauauuuagaucauccucauucuuuuuaacagcuucagaauaguccauggcauagggugccccgggguuuucugucuucccuguuucaaacagcgcugccauggagauuguccucugugccagcggcagggugcuccgguccuauuguucucagugggaauuugaggacagacauucagagcaggugggaggccacagccaggcgaccccaagcugagcagaagagacuggagacucaugaugcgaagucagaacaccuggguuccaaauacagcucagccacucugucugaguaaccuugagcugucuucuuugacccaugcuucuucagcuauaaaauuauggguuagaacaaagugacuccuguaccucuaacauaucugugagucuaaaacuuaaaauaaguucuaaagugacccugggacccaauaaaggaggccaaaaugccaaaucaucuuuuuuuuuuuuuuuaaacaaagccucacuccugucacccaggcuggaguaugguggugcaaucaugcucacagcagccucgacuuccccgggcucaggugacucucccaccuuagccuccugaguaacugggacuacaauuauaugccaccacacucggcuaauuuuuuguauuuuuuuuucuuuuaguagagaugggguuucguuauguuguccaggcuggucucaaacuccugggcucaagugaucugccugccucagccucccaaagugcuaggauuacaggcgugagccauggugcccagccuaaaccaucauuuuuauacuccacgcuaggccauugcugcauucauuaagcacugcugcuccgaagagagggagcauccagggacggcucuaccugggacgaaaggaauggaaaaacccccaugaguuagcgcagaggaacuagagcuguuuaacuugaagaugagauggcugaacugugauuuaauuaaucucugugaaucuaugaaggauuucucuaaagagaguucuuaacacuuguucuucauguucucagaagaugaagcagaagaaaaggaacugaaaugaaagcaguagaaauuugugugaaauggagaagacauuuauuugauuacugggauuaaacaaaaaguaaacagcagaaguugccaccaaaaaauauuauguggcucucuaacucuggauuguauuugaacauaguuaaaacaucugccucagacagaaggacuggaccaaaaauauuucuagaugcuuucccacauccugugacucuuucagucuuuaauuucuaaguucugaccaaaacguaaccucugguuaauguuaauagaacauaauaauaauaacguguaaggaggagaguugauaacaaacacagcugaacuguuuuuggccuucaauaggacuaacuuauuaauaaacaaguugcaaauuuuuauuucuucucuguaagauuugacauuauucaggccuauaggauuagaguugugaggacccagcuaaagugugcaguggcugaggucuggaccuuagcuguguggacagagcacaaaaauaaaaauauaaagggaaucguggccucaugcaguggcucaagccagcaauccuagcacuuuggaaagccaaggcaggaggaucacuugagcucaggagugugagaccagccuaggcaacauagugggacccugucuccacaaaaaaguaaaacaaauuagccggguaugguggcacaugccuguagucccagcuacucagggggcugaggugagaggauugcuugagccuggaagguggaggcuguagugagcugugauuaugccacugcagucuagccuaggugacaggacagaauaagauccugucuuuacaaaaagggaguggggggauugugaaaaccaaggaacaauuuaaaacccaggcuacacauugagaaacagcuaccugcaucugagcucugagguggggcacagauuauuggucuugugauuucuuuuuguguguaugugugacuucuuuaagauauaagcucaucagugagagcugcuuaccauugaauucaaauaggccuuaugcauuaguuuucaauugcuacauaacaaauugccccaaaauguagcugcuuagcacaacaacauuuauuauuuuacacaguuucugagagucaggaauccacaggcagccacaggcagugaucugacuuuuugugucagccaggguuacagccaucugaagaccugaccagggcuggaccauuggucacuaagguagcucacucacacaguugacaaacugauacuggcuguuggcaggaggccucaguuucuuacacauggaccccuccauagcuacuugaguauccucacaacauggcagcugguuucuuccagagcaaguuaucugagcaaaccuagggaguaaaccacaauaucuucuaugugcuagccuuggaagucaaacucucuauuuccacaauauccuauugguaucacagguccgcucuacugagcugaauuauacaagggcgugaauaucagaaagugaagcucagcagcauccaucuucaaccuggcuacaccuuacaugagagucccuuguguugucaagagguaauagcaccagccuagacagagccagcccugaguccuggcccugugugggugaauggccugggggaaaaaacguaaccugccuuaccgucaguuucuucaucuaucaaauagaaauaagaguaguaccuacuucucugaguuguaaugaagauuagaugagauagaauaaauaagguccuccacagugccuacaagauagaaaguggcuauaaugguaacuacuauuuuuauuauuugaauguagcaccuucacauuuaucauuuuuuagauuuacauuuuauuugcccucccuuaagaauuucaaggaauaacaugcaugcauuacaguguguaaaguacacuuacauguacaaugauauuuugcaauguauccuucccugcagccauagcccaaaucaagauauaaaacauuuuuagcaaacguauaagauuccuucaugcacucaccuacccugagacaacuacuauucucacuucuguaaguauugcuuaguuuucaaauuaaguuguauagaaacagaaucaugugguguggacucuugcaucuggcuucuuucacucaacaugaaugaaucugugaaaaagaaucugugagaugcauccaugcuguugcauuuaucaauaguuuuuuuuuaauugcugugaagcuucucauuguaugaauauacuacaauuuauguaucaguucaccuguugauagacauuuggaaaguuuccagacuauuaugaauaaagcugcuaugaacaucacuguuauuauaucaucagcaccaccaaguagacugagaauacgaaaguacccagcuggaaaacuaugauugauagagaaauaauaugauggggaggaagcaauaaaauaguuguugcugcugcuguucuuauuauuauaccuaaaauguauuaagccuuuccugugggccagacauuagacuauguguuuauauauuccuuuuccuauuuaacccucauggaaucuguauaagggaauauaauuaucuucauuugacaguugagggaacuggacucacagagguuaagugauuugcuuacgaugaaaaugacaaugaccagccgaguggggucacucacgccugcaaucccagcacuuugggaggccaagguggauggaucaccugaggucaggaguucaagaccagccuggccaauauggcaaaaccccaucucuacuaaaaauacaaaaauuagucaggcaucauggcagaugccuguauucccagcuacucaggaggcugaggcaggagaauagcuugaacucgggagguggagggaggcggagguugcagugagccgagaucacaccacugcgcucuaggcggacgacagagcgagacucugucucaaaaaacaaacaacaacaaaaaccaaacuggcagucacccaaagaaccaagauaaaauuugcccauuuggcuccuacagccuuuaacuacuaugccaggggucagagaaccugggcaaaagccaccucauccacuuacaauaugacagguucccauguaaucuccccaagcuacaguucccucaucugaaagcggggaggauuguacugaaaaccacagaaggggaaaagauuuuaugaaaauaagauauaaaaucacuuagcucagugucuggaauacaguauguguuugauuaauauccauuuucuuccuucugccaaauuaaaaauucuuaauuucagagauguuucuuugaguuauagaacuuucagaaaucucacuucacuccuucagccaacacccaaguuagaauuuccuuggaaacugcaaauuuguaucacauuuuaucuaccccagcaucccugcuucuccauucuaggaguaagaggagcccaguagaaaaaaagggaauugcuccuaguauauucuaaaugaaaaucaauguucuaaagacauugugcuucaucucuugauacaccuuggagggacaccagggauuugaaaggaagaaaaggcuccauuagaugcauagggccuccugaaugcacacgggagggcauggaguggcaccucuauucugucucugagcuucugugcugccuguagacccagagggggagccugggcaaagcugauggcaggaaguagcucgguaacuuggcugaccuucauugaacccagcagccguaaagaaaaugacugagacagacagguuaagcauuucugcauggcaauaaaaaaaaaauuuaaaaagaacaaaaaacaaagcuaugucaaaggaaacaaggaaaauauuugcauuuuauaagauagguuaacuucuuuaacguacagaaagcccuaccaaucaauaaauagauaaaauaaacaacacaaaaaauguacaaagauaaguauggcaauucuugaaugaguaaauauuauaauaucugguaaacauagaaaaaugcucaaacucaguaauaguuaaaguaaugaauaucaaaauggcuuuaaacuauuuuacgccuaucaggucaguaaggauuuaaaaaguuaagacuacccaggguugcuuagguuguggagaagcacacauuauuaguaagaguauaaaaucuauacauucucuuuuggaaaguaauuuggcauuaucuuuuaaauuuuuuaaauauuaauuuuuuuggcccagcaauuugucuuuuagcuugcaaagauacucauuccaguaugaucaaaaaaaaaaaucuguauggcauguguacaucaaauaauacauaggacauggcacggaguagguaccaaacugguggugguuuuuaugaauaagugagcauuguaaagccaccacagucuuaagcacuuggcauguauuaacucauuuaauucucacaaacagccuugugaggcagauaccauuuuuauccccauuuuacagaugaggaaacugaaguacagagaaguuaagugacuugaauaagaucacaccuuaagugguagggccaggauuccgcccuugacaugcuagcacuacagcagcacucuccaguagaacucacugcuguaacagaaauggucuagaacuuguacuguccaauacgguagccacuagcugcguggaaccacugaucgcuugaaauguugcuguuaugccugaggagcugagacuuguucuuauaauauuaaauauuuaaauaaauaauauuaaauauuaaaauuuauaguuaaaaucgcuaccauauuggacagcacagcucuagaauccgugcuuaaucacuaugccauauuggcugugguuaccgguaguagagguagcguagcagcagcagcaguaaugacaguauuuuggugcauuagaaggaagaacauuauggcaaucagagcucaaugcaacugaaauagauugccucuggagugaguagugagucccuugucaugucagcagcaaccacauuguagaugggauucaggcacuggauuugggcagaguaacagggcggauaacaguaagagguuggagaguuaccgauuuucaaaguuuaguucaccagugggacucugaucccaaauggcgaaugcaauccacacucaucucacugacaccucggaggggaaacuaugucaccaaaacuuuuccuuucaagaacucucgaggguaucuagcccuucagagaagggggaauuaacauuuacuggauauuugcucugugccaaauacuuuacuaggcuucauuuaggauacucuaagccuuacaugaguguaacaaggcagagguuguaaauccccauuuugcuuuuggaggaaucuaaggcucagagagauuaagucaccuauuacagauuacaaaguaagacgcagagaugggguuugaacuuaaaccuuccugagucucuagccugcuucccucauuuuucagagaagaaacugguggcccagagaaagccagaguccgaagagcccagggcuuuuuccugccugccucccacuccuccucacuccuggaauccucuccacaugacccuugacagacagaugaccauccauuuucucuagaacauucccugaguccuccauuuuauagcugagaaaaugaaguccuguuuggguuagugauuugcucaaggucacaaagaaagugagacccagaggccaaaagccagggcuccugccucccucucaugagcugccaccccacugagcccacccagccccacccccacaggauaggacagcacucaggagagaggcuuggccucaaaggccucuagaggagggugacaggcccugccgugucuucugauuccucuccacaguugguaggcaugcccugggggcagcguguccccacugccaggcuuggcacaugccaggcaaggccucucccugccuucaggaagccgcuagucuccaguauguaccacacugugcaaaagccagucgguuuuucaucagaacccccauagagccaugacccaugcaucugugucccuagagcccaaggcaggacaccaugagcaucaggaaugugucgucgaauggaugacaaacaaaagcacagacuagggcacaguuuagcugacuugugacaauagcaguaguuuucaucaucugcaaacagauauuaaaauaucuaacagguuuguuuuaaaauaaggcacuaagaguguuugacauagagugggcaacccacucuuugguaaguuuccugagggcagcaucacuggucuaucaccaguuccugacccaaggccugacacaagcauggcuuucuauaaauacuuguugaaugagugagugaaugcaugaaugacuaacaaaugugaauagacugugagauuuugagaacauuuuauacacuaggugcucaaaaagugugaauuauuuuuccuccuccuaugaauguggcauuugaacugagccuucaagaaaagauaccggcaaggguauugaaggucaaagaaauagucaagcaaaggccagaggccaggaaagugccaagugccucgggaaaggucacagggagcuaacuccucagacccaggccacuguguggucaguaacugcgagagcugcccuggagacccuugcaggggaccagcaaggacaaugcucagggcugcuuuaaaaaggcugagcucagagacuuugccagagcaucucagagaauaacaaguuuccaaagggcaggagaaacagggauuuagcacuaaugggcacugcagggucugggacaucucagcugggcaucaggaaauaauuuuugacguggagagccaucuguugcgcuuuguauaagcccuucugagggaugugcauaaguacaggccuggcuggauuguuggauguugcagcuggguggaaaauuggcagcaagaagaggaacaacuuuccagugagugugaaugcaucccugggccacagggccuauugggggugugaggagagccagaggggcagggcccagcaugaccacuugagaugcugugauucccggacucacugcaggggacccucugagacuugcgcccagggugucagccaguugucaaucacuuaagcagacaggaaacaggagcccagggugaguccauggacucuggccucaucccugaggaagaggacaacuccugauuacugguuuucagaggaggccacagccgcgaguggaccuggagcuaaugugggacaaggccuccaagcauguauuguaucugccuuguuagacaaggagugucacaagaacagggguggcucugcucacucaccacugggucccagugccuggcacaugguacuugccaaccagaagaugcaaggauuauuacugauuaaggcaaguggcauuuccuuggagggagacugaggaugccacccucucccugccccacaagcagucugcaaagcggauauuauuauccuacuuaucgguugaagaagcaaaagccucagaaucauuaugcaaccaaacugaucaggcuucuugcaggugugauuccuuuauggcuacccuguggcaaguccugaccuggggacagacacggggcaugcaggagaugugcauggugguggagagggaaccaaaaaacugagcuggguguugcuggcaacuccaugagagcagcacagucuuacuuagcaaaggacauggcucaacaauaaggguggaaacgaaagcagugggaguggguuuuuaugaagacucugucuacagugagguaggagaucuuaagaugccuuaugcaaaaccgcaacucaaaccggcuucaaugauuaucguuagcuucaacauuuauuaucucauuuagcaagaaguccagagauagggcaauuccaggcauguucaucaaggcucagauucagcuucuuggcuuccacugcuacagucccaggcauuguguccggaugauuccccguccagggaacccccagaccucuccucauaucagauuggccggugguccagauucccucaugaggaaggggacuuuuguaacuugccagucaggaucuuccaacugagacacauaaccacaguguggcuagcugagcaaagucaggauucuguuaggagggcaguagguauugcuaugcaaccaagaguggcugcuacaaauggaagauaauauaauuagcucuacuucccccaccacaggacugucguggggaugcaaugagauaauggguguaaaaggauuuucugaaucauagaguguucugcacaugggauggguuguuacuauccuuauagaauaauuauauuucuguuauagaauaauagaugacacuugaaugcagucauccauccugcuuguggugugcuuucuuguucaucauccccuccucgcauacacacaccugucauagagauauaaaaaucaucagcauuuaaaaauaggccagauacuucauaguaaugagguuauggaugucagugcucucugcaaagccguauacaugggggagagauuauugugggauauaacauagauuuggaaaucagucacagguuccaauccagcuucuacaccuuucaugccauguaacuuuagauacauuauuuaauuucucuaagcuuauuucuccaucuagaaaacaggaauaauaaucucuuuccaaagguuucugugggaauuaaagauaaaguauaucaacaccauaccuggcacagagcagguagcaaaucaaugacagcaaacacuucaguagagcucucauagaacucuuuaagccccuguacaacccugugagguagguacuauuaucccuuuucuauaaguaaaguaacugaggcucagaaaacuaaaacuuugcccacgguuguacagcuacuaagugguggagcgaggauucagacucagacaugaguucauguucugaccacccugcuaagccagacuucgcuacuguuacuauuguugauauuaauggcacaaaaccauuuccacugcugccuuccuauaggaccuugggcucauucugucaccuuccaggccucaacuuccucaugugcaguuccacagcuugagcuuauagagcuuugcuccuuuuaagccucacagagaagucauuaggaguucagaguggaaucauccaccuggggccaccuccuggcucucgccuuaccaguggcuaugugacauuggccauguugauugaccacuguuuuccuuaucucugaaacggggauaaugaaagucccuaccucuuaagauugcugugacaauuaaaaauggaugcaugucuauacacagcaugaaugcaaugucuggcaaagagaaagugcucgaucaauaguaacaacaauuauuaucauuguuguuauuagcaagucaucuuccucuucugugaauaaaguucuucugacagcaaaggacucaguuauucagccagaaagcuugagggcaguuucuuucagaaaaucauagacuuacagaauauaaucacuuaaccuucuuuaaauuuaucuucucucaucuacuaaaugggggugaugguaacucagagaguuuaauaugaggauuaaguggaauagcacaaaucagucuugcuaguuuuauuauuggaacucuaagggagcuuagaagggaacucauguaaccaugcuaauuuucagcuaaauuucagacccagagaaguuuggugacucaauucaggugguacagacaaguugauaacugaugauggaucuagagcccagggagucgggacagacccuggauucuaccagaagccuuuauaggaugugaacauggccugucuccucagucauuuguuuaccaccaucccuaucucugcucccaacuuacucaacucuuaguacuuggaguucccuagcuguaucgugcucuucucucccugugagccuuggcauaagcuguucucucugccugggacacucuaaccagcccacugcuguagacacacaugcauguacaacacauaugugcauguacaacacauaugugcaugcacagcacacaugcaugcccacaaugcuuucuuaaccuggccaacuccugguucaccuuuaggcuucuguuuaaauuucccuuucucuagcaaggggccacugagccccaaggcuccaucaauuaaggccuugaucuuuguguuugccucucacagcauuguaggggaauugcauauuccggguuugcucagccacuaaacugggaacuucccaaaggcaggugagggaccuaaucgacuuccccucuaugacuaaauuggggugcugguuggagucccucccuugggagggcugagaacuaagcaggcaggauuucaguggcaggacaccccagagggaugcuuggccuucuuccucaaguggcuggcacugcccuccuccaacuagcucagggaccugugacaaaucacacagaaccagccaccccucccagccucacagaccacuggacacugagaauuuggcuugcagaaacauucugaaugcauuucuuacccuacaggcaccuuucucuucugucauuuccccaaucccaugaaauccaaggcacaugcagcccaugugcaccagcacuaaagucacaggaaugcugcuucucacgaugugcccaagaaacaccgagaagcuuuguacacaaacuucacucagugcccuccacuccagaaagcaagaaacccuguuuuguuagcagcagucagacucugcucuccagaguagggcaagaucugaacuucugagcuuugaauggugaauacccuuaaccuccaaaguaugaacucuuuucucuccagauaagcuuuuuugguuacaagaaacaaaaacauucaaaccucuaauuuuuuuucccaaucuagugcccuuggucagagugaccagccuucuuauuaguugauuucucguuccguccugguguccacuuccccuuugacaaugccauuaguccguuuggugugguugcaggaaaaaaaaggauggguagagagccugcccacuuugguucauuccugcuucuccucuuaugaaccaacuaacuuuagucugucuggagcucauuucaucaguaaaauggaaacaauaauaccuaccuuguaaaaguguugcaaggacuaaauggaucauuuaugcuaaggcuccuuuucuuuucuuuucuuuucuuuucuuuucuuuucuuuucuuuucuuuucuuacuuuaaguucugggguacauguguagaacgugcagguuuguuacauagguaugcaugugccauggugguuuacugcacuuaucaacaugucaucuacauuagguauuucuccuaaugcuaucccuccccuagccccccauccgccaacaggcugcaguguauguuuuuccccucccuguguccauguguucucauuguucaacccccacuuaugagugagaauauggguguuugguuuucuguuccuguguuaguuugcugagaaagacgauuuccagcuucauccaugucccugagaaggacaugaacucauccuuuuucauggcugcauaguauuccaugguguauaugugccacauuaucuuuauccagucuaucauugaugagcauuuggguuggcuccaagucuuugcuauugugaaccgugcugcaauaaacauauguaugcaugugucuuuauaguagaaugauuuauaauccuuuggguauauauccaguaauggaauuguugggucaaaugguauuucugguucuagauccuugaggaaucaccauucugucuuccacaaucguugaacuaauuuacgcuuccaccaacaguguaaaagccuuccucuuucuccacauccucuccagcaucuguuguuuccugacuuuuuaaugaucgccauucuaacuggcgugagaugguauuucauugugguuuugauuugcauuucucuaaugaccaguaaugaugaguaaagcuccuuuucuacaaaugaccaccugcugaggagaaccuguguaggcuagacaagguagucuaguagacagaaaaugggcucuggagucagaccuggauuugcaguuuacugccaguagauccugagcaaaucacuugggcucucugugccucaauguauucaucuguaaaaggggacuuuuauaguguaaguuccacaaggacaguguuauguguugagcacuauugacccaccacccagcccugcagaaagguauauugaaguccuaaucuccaguaccucagacagugaccauaugugaaaacaguguuguugcagauguaauuaauugagaugaggucauaguagaggagggugggaaccuacuccacuaugacugguguucucagaagaaggcagcgccacgcagggagcacacaugugaugauaaaggcagaaacuggagugaugcagcugcaagccagggaaugccagagaugacagcaacccacuagcgcuaggaagaggcaaagaagcaucccccuacaggguucagagagagcauggcccuuguccauaucauuauuucagacuucugcccuccagaaccaugagacaaugaauuucuguugcauauuaaaugucaaguaauauugcugagugcgagagugauuccuguuacggagcuauguuggaaagcacguggcaagugcuuagugcggugccagacacaaaagguauuuggcaaaugcuuauuccuuucucuucacuuaucucaaagguuccuuucuguacagagugcaauuuaggaucaaaaaaaaaguuuguuuuucuuccaauuuggaccuaaagcugccugaaggguuccugcuuuaagaaccagaccuggucacucaggagcaagguuggaaagccauuucucuacauguccacucucccccagcugccuuccucgauuuucaagauuucuuggagugacaguagaggaauuucuagaacucuugguccucauuauguuugugcuuuccccaaaaaaguuucacaaaucuuuauagaaaucuaaugcaagcaagaggccuuggcgcagugaucaaguucauggaaagcuguuucgaaucagggcauuuacuggggaaaagcuguuuuagaaaaauaucucuuaguauaugcuuauauccacaccacauggcuuucugguuuuuuuuuuaaacuuuuuauugaaauauaacagauauucagaaacuccacagaugauaaauacacagcucugguuuuauuuuauaugcuuuggguuuucuuccccacugguugguuuuuugccugguucauugguuacacgaaucccugacugucacucuaagaugcuauggaaggagcuuuagcuguaggcucaggaggccuaggcuggaagcccagauccacaccucacuaggucuguagcuuugagcaaauggcuucacuuugaacauuauuguccucuucccagggcugaugaaagaucaaggaaguaaacucauaaauuuacaaauguacauuauuauguuuauuacuauuauuuauuaagguuauuuuagucggaagcaugugggcauaggguucagcagaccaagauucagcacccagacugguacccaccggcugggugaccuuaagccgccucuguuugagccuccaagucuguaucugucagcuggagaagucuucacacuuucaaggggcaugaggguugauuaagauaauuuacaucaagggccuuccacagugcuggacacauaguagguacccaauuaauaucccugcccucccacccucccacaguugcugguuucccucagaaucuuccuaucucuugccccuuuccuuuguaccuaauacccccaucauuccuccaguaucugaguaggaggcuggacuauuagauucuggucuuacuccaucuugaggccuggaauuuugccacuguauaaauugaauggagggaggaaaacauauauauauauauauguguguguguguguguguggguguguguaucccaaggaaguaauaaaugacuugaaaacagcuauuuggaaggacuuucuuagucaaaucucaguaccaaagugcagagcccaagccucccuguugaagagagcacucugugaccacagauuauucaaggucugccauaaauuucagugacuccuuggucacguuggccagcagauuuugacagucagagauaauccagcuugcuuugugcguuuccucucucccacaucccauggaaacuggccuuuccaucagcccaauuucagccuccagaggugugaaugaaccaucucacaccccucuggaggcagcgcgugggcaagguuagaacaaucugugagacaccaggagcugcagcugacacauggagcucagugagucuuccaguugucgccccacccacccuacccccauaccccaauaccucccucacagcuuuucucccucuugagccauuccugcuugucuccuucacccaugaggcugcaugccucuccagggcaaggaguagacuuaguucuaugucucuagugcccacuuagggcuucacacagagagguugccuggauguguagcuggggcuggugaugaaagggaggugcaggccaggcgugguugcucaccacuguaaucccagcacuuugggaagccaaggugggcagauuauauaaggucaggaguucgagacuagccuggccaaaauggcaaaacccagucucuacuaaaaauauaaaaauuagccaggcaugguggcaugccuauaaucccagcuacuuggguggcugaggcacaggaaucacuugagcccaggcgcucacgucacugcccuccagucugggacucugucucaaaaaaaaaaaaaaagaaaagaaaagaaaaacagaaagaaaagaaaaagaaagaaagggaggugugggagagcuaccacuuccacuuuuugaguaccugcucuaugucaggcccaugguaggccccagacaugcaugcuuuuaugcauuuacucugcacaggacuccuguaagguaggaccacauccugaggcuccccagcucuaaaagaucaaacaauuugccuaaaaucaaaauaaucaguuuuaaauccagaucuuacuugcugccugucuccuggguuggagccccacuuggccccuuaaaaguugugugucccugcacaagucauaucaccucuccuagccucaguuucuuuaucuauaaaaugagggugauggcuauuacccuccuggaugugguaaggaucacaugagaucauggcugugaaaauccuguguaaaauguagaauaaauacuacucacauguaaauguuguuuuuauuaggaggucauuaggucaaaaucgguuguaauauguagugaguacccacuauauguggaauuaccauguggccuguggccauaugaauaaaccaguccccacccucagggaacuugccaacaagaacacccaggcauccugaccuuuaguuugcaguauuugcacaucuuuaaccuggccccugacaaugucucaaggcugauuuccuagcauuuaccucauuguuaugcuucucuaguccuguuagcuuccuugcugucccuuagaugaacuugguccugcugcagggacuuugcaguuguggggcccucugccuaaaagcucuuccccugggugucugcuuggcucacucccucacuuacuucaaaucucugcuuaaaugucaccuccucagggagggcuucccugaccaugcuauuuaaaauaacacgcccaugccaucaacuuuguauuaaguuggugcaaaaguaauuaugguuuuugccauuauauuuaauggcaaaaaccacaauuacuuuugcaccagccuaauauuuaucauacuugaucuuguucuauauaguuauuugcuuacuuguucauugauguuuucuuucacuagaauguaagcuucugagagcaagggcuuugucuucuuugucagugaugccuagaacacugccugacagaguaagcacaaaacaaauucuuggggaaaaaaagcaguacuuacacuuuaguaauaaaaagauaaaucaaguuaaaaauugggcaauggaucugaauagacauuucuccaaagaagauguacaaauggcaaauaaggacaugaaaauaugccaagcaucauuugccauuaggggaaaugcagaucaaaccacagugagauacugcuucauacccacuauaguggcuggaauaaaaaagucagauaauaacaaguguugacaaggauguggagaaauuggcacccucauacacugccagugggcauuuaaaaugacauagccacuuuggaagacaaucuggcaguuccuuaaaagguuaagcauacaauucagcaauuccacuccuagguguauacccaaaagagguaaaaacauacucucacacagaaauguauacacaaagguuugcagcagcauuauggauaauagccaaaaagugaaaacaaccaaaguuugaaucaacccaaguuucauaauggauaacaaaauguggcauauccauacaaugcaauguuauuugucagugaaaugaaaugaaauccuaaucguugcuucaauuuggaugaacccuugagaaaauauuuugcuaagugcaagaagucacaaaagagcacauauuauaugaucccauuuuuaugaaaugcucagaauaggcaaauccauagagacagaaaguagaugagugauugccuaggcugcagggaauuggaggacaauagggagugacugcuaaugaguguggaguuucucuuuagggugaugaaauguucuaaaauggauuguggugaugguugcaauacucugugaauauacuaaaacccauuggauugaacacuuuaguugaguggccuguauggugugugaauuaugcaucaauaaagcugauauuuuuaaaaacucagugaaaguccucaucaaauauaccugugucaaacaagcagacuagcuggcaggccaucccugugugaaaaccagaggaaccuaaagggcucucuucuugauauucaggagaccagcuucccaggcaggcgggugaaacagaggucuguuccugacaaacacuuuuuaaaaaaauuuuuuuaaaguccccgagaaaccugugaggaggaaagcuagagaucaaaugacgagccugagaaauuuacugcguccuguuuuuuaaagaccauuuuuccaacauaacucacagagacaaauggccugggacccgcuccugaaaauaaccauugucgaggagaguugacuuagugggagcugccggaccaggggaguaagacccacaagauuuaauaggcuggaaaagaccugggaggcugugggucugcugagcuccucccauuagggacccaaggaagaaacugucaucauggcugacuuuucuguaugugugucuaauucuguuaaaaauaacauuuauuguuuuuuuaaaaaaucucauauucacaauguguuacuugaaaaaauuagaauauauuuuaaaaaaucaggaaaacaauuauuucuaauuuacugcccuaagauuacuggucuuaacauuuuuauacagauugcacccauacguaauucaacaaaagucagaauuacuuuuuacgcaguuuugcaucaugcucuuuuuauauccuauuucccacgucacuuaauauucuuuauaaacuuaucuuacaauaucugugugauaucagcauuaucccuucauuacacaaggaagcauuuaauuuuuaacauuuaggauguuuuuccuuuuuaacauuuuuuuuaauguuuuacuuuuuacuauuacaaaugauguugugauaaauauccuuaguguaaaucuucugagacaucauacuuuuagggauaaauuccuaaaaguggaauugcucaauugaaaagcuuucacauuuuaaaaaucaguuuauacuaaauuauacuacuaauauuaauguauaaaaaaucuuauuuaaggggccaggugcaguggcucaugccuguaaucccagcacuuugggaggccgagguggguggaucauaaggucaagagauugagacuauccuggccaacauggugaaaccccaucucuacuaaaaauacaaaaauuagcuaggcaugguggcgcgugccuauagucccagcuacuugggagacugaggcaggagaaacacuugaaccugggaggcagagguugcagugagccgagauugcgccacugcacuccagccugggugacagagcaagacuccgucuguaaaaacaaaacaaacaaacaaacaaaaaucuuauuuaaaaaucaacaucuaugaauaccuacuagaugccagauauuuucacauuuauuauuucauuuucucaugagguuuuuaaaaaaaucuuuaaaaguguaaaaagaacuuggcucacaccuaugaucccgacuacucgggaggcugagucgggaggaucaccucaacccgggaguucaaggccacaguacccugugauugugccugugaauagccacuacauucuagccugggcaacacagagagaucucagcucuaaaauaaauuuuuuaaauaaauaaauaaaauaaaaagaacuauauaugcuaauuauagaaaauuuugaagauauaaaagcauauuaaaaauuuucuauugcccauaacagugauaaccguuguuaaugugguuuuuguuuauuuuuaaccaaucuuuuuuccuguacauuuauacaaauuuauuuguuccauaacuauuuuuaaguaucugcuauguuggaggaaucugacucuccauuguaaauuaagucauuuauauccuacauuuuuuccauagucuccuuuaacccucagagcaaccucuugagguguagacuacagcuacugcugucuuuuguuggaccauaaaggaaccuuagagaauauccauccaacagagaggaaaggaucuuggacugcuuugcccacgaucuuggacugcuuuguugaccugcacccagcuaucuggaccacuauuccauugcuacagacugcauccucugauguggaacugaauauguacuuuacugcccuaaaagaggguggccauguaauuaauugaccaaaucaauacauuuuuacaguaaggggaaacuauuauuaauccaugcaggauaacagauguaaaucggggcugucacugacaaacccgaacgaauagucacucuagauuuucagauuuccagcucuuugaaaugcuuucaaaaguggauuccaauccauuucaaauaacuagggaaaccagcucugccucucuuugcugagcugagacucugaguaagaccagaacacauaggugagcaauacguggucccucuuuggcaggauagucuauucaagcaguagacaagaacauaacucacuggaauaaaaagcagggcaugauaccacugcauuagaauuccugacccuccacgagccgcagaccuuucuaucagaaggaaacuucaguuuucuucagugccccauccucugcucagaacugaguauaauuucacuuauucagugaagcaacugaaugcccuauggcuagcacaugagaagaaaaagaaugcauuugguuuuaagugaagaaacuaaaauguuucuggaaagguugaauccaucagggcagugugccacugagaugagguaccugcuuaggucuaaggauuuuguuuuauuuucuuucuaggugucauuuauugaguaauggcuguguguugggcuaaguguuuuacauacaagccucuaaauuacagggcugccaguuaaaagguuauuaggaagcucuuccgauaauccagggaauuaccagggaaaaaagugccuucccugcagcccacagcuagugcucauguuacuguugaggacucacacuuuuccauuguguaagcucacaugaauuuuccuaccauagacuagaugggguuuuaucauagaccaauaagauuccauuugggcauuuagauggauuucucaggacugcugagcaaaguguuaaaaaguauauuuuguuaauggucuuucuuuuugacagaguaauaaacuuguucaucagcuagcccucauaauuuuagucucgugguauauuccaaagauacacuaagaauccagaaugguugaauguucuucuuggacaacuagcuugcucuauuuauagguuagauuucaaaugcaagagaaaguuaccaucaccgauucacacaaggaugugaguaacagaaauuguuucugcagaucuuaggauucccuuguccuauguucucuuuauguauuaggacaguuucccuaacacauugccccuuuuuuugauaucaccaaauaacacauugauaaaaguguaauuggcaggcuugcaaaucugucauugcuucuuucccaaaaccaccauguucucucuaugacagaccuacagcuggagagauggcagacgaaaucaauauuggcugagccuuuacagugagcaagcagacugcugggcuuguggugagcauaagaucaccaguccuucagcaacuguuuucaguggguaucauuacuccuuuuuuucuaaggagaaaauuaacacuaagagaaguaaagugacuuaucaaaggucacacagccagcagcgacauugggcuuugauccuugguuugcccaauaggaaguucauggucuuucugcuuuagcuguguuucccugauagacaggccucucccuuucccuaugccugguggaaaauccaaaccagagcugaugaauuucacucucaccaccacuuggaaacagcauugaaguuauggguugucaucugggccuuacgaccauagacaauuuacuucacuucucuaagccucuguuucuucaccugaaaaauggagaugaauuuuccuagugagaauguuuuaaggaaaaaaucuugugaagaaucugggcccguuccuggccuccaggagaggcucuguaaaugccccaccccucugccaaucuccaccauacaggugucugcacucccuaacuguguuagcccauuuugcauugcuauaaaagaacuccugaggcugaguuucuuuauaaagaaaauagcagucugggcaaccuggcgaaaccucgucuguccccaaaauacaaaaaauuagcuaggcaugguggcacacaccugugcucccagcuacucagguggccaaggugggaggaucgcuugagccuaggagauggaaguugcagugagccaagauuguuccaugacacuccagccugggugacagaguaagaccccaucucaaacaaaagaaaauagguuuauuuggcucauggugcuacaggcuauacaagcacagcaccagcaacugcucugcuucuggugaggccccaggaagcuuuuacuuaucgcagaaggcaaagggagagcaugugugucaccuggcaagacagagagcaugaguauagagagccagagagaggagagaggucccagacucuuuaacaaccagaucucaagugaacuaacagagcaagaacugauucauuuccagggggagggcaccacgucauucauaaagauccacccaugugauccaacacuucccaccaggugccaccuccaacacugcggaucacauuccaacaugagauuuggaggggacagguauccaaacuguaucacucacuuuguuuccuucuuucuccaucuucaucuccuauaagccagagcugggcucauugagacugccucucuagaaaccuggaugguuccccuccaccuucacugguccucuugguuguuggagucgggugugaggaguuucauuucagucaucccacucuuuuuuacuacaaacacaguagaagcaucugcaaugccagguucccuucagcugauaaccaggacaugugggaaggcacaccuacaccccagucccauggaaucaggcauccuuauuugcccacgugaacauacaucugagccccacccaaaaagcaggcucagaucaucuggauuuucaccauccugcccgagcugagccaauuagaaaggagaucuaggugacugagcaggagccuuauguuuaaagagcagauccuucuacaguacagccccggucuugucacuuuccugcuuuaaaaauuuccaugacuccccaauuaaggucugauuuccuuuuucuaguguucucauuccugucuuauuucucacugcucucuugagauagacuuuugugccauaaucaagguacucuccuuccuuccuaccuuccuucuauccuuuauucaccuaacaaauauuuacuacugcguucuaugugcaagacacugcacuaggcacauaugguaauggcaaggcaagcuaguggguggacacagacaaguaaauacugcagggagagaaauguugcaagagggagaguccagggaguugugggagcaccuagagggggugccaaaugcaggcuugaagcaucaggaaagcuucuugagggaggaggucaugaaauuaaacccuaaggaugaguggaagcuaagagacauauagggugguaguugugaggaggaaggaagaggaaaggaagugccccagggaggaggaacaagcuugugcaaaagcucagaggcaaaacuuuugugguugugcuccauggguugccguucagauagauuuaaugcaaaaagugcccuagagcucugcaaacuuggcaaaagagagagcacugaguccauggaaaugagagcaggccagcgugucucagcaagucucaguggacuugguaaggagaagcuaaugguaacaaugagacuugggagguaaggggacagguggggagacagauugcugaagaccaggugaaggaugaaggcuuuaggccagaguauccucccucugccgcagauacuaaugcuccuaucuuuucucauugaaauccuccaaggcucagugaagcguuucucaguuccuccaguugaaaugagccccccagcuccuugcacugggcugugguucuguucugacagguccuaccucugcccugcugagaccuccuugugcacucucccuccccuccuuccagcucccuugcagcugugcuuccuaauuguaucucccucaccuucuagcccaaucacugaguguuuaggaaauguuuguggaaugaaacaggauuugccauacuuucgugaucauacacuguuuuauaaaaaagaaaacaugaagacagcuaguccucacuuuacauguacauauuuaugcauagcaacaucuaacauuuauuauagguauuuacuggcugccacacacaguucucaacauguuacuuauuuuaauuuuaauuucuuucauccucagagcaacccagaaauuaguaggcacucuuuucuuucuuuuuuuuuuuuuuuuuuaauuuuccuuuauaaagguguagaaacggaggugcaaagggcaaaguaauuuacccaaagucacugagcuggcaaguaauggaaccggauuucaaauguaggcaaucuggcuccagagccauacucucaaugugacccuacccugcuccgguacaugcuggauugguacagcagugcauuuucauacacauauuccaagcacucguguauuacauauguuaaaaaacauacuaaacagaaauuugaaauagaugaguuaaaauguuuucuuacaucuuaggaaauaguucuguguacccuaccuuggaaaccacuuaaauucaaaguugccaaugacuaagaggaaggaaauuaacuuguuuccaauaauaacuguacuucacagaaacucugcacaccuacuaagggccuggcaacuuguuacgggcuccuguauguuagcuaugaauauucagagcaacccagaggccagaggagagaccagggaaugcguaggagaaagaagagacagggacgaggccugggagggcucagugccguucugccguucucaccccagggcuucugaaguuuaugacggaacaauuuacuuaguucuggaacuauuuauuucguaaagcuugacagauuuacucaggaagaggcuguaacaaacacccugaaacaacauaucauguuucuuaauuuuugucugaaauucuaacaacucagcauggacugguuaucucaagcucauuagaagcuccgauugaagauuauauugugucuuugguuaauaaaagaugaggaaaucaacguauauuggcuuaauacauguggccugguagacagaacuuuuccaaaacuggaaccguagggggagucaugaaugugguucuugguggggcgguuuuguuaccuuuaauagauauuuggugaacacuaaccaccugcucaugcauauuguguacucacauacauuaucuuuaguccucacagcagcuauauaaaagguaggggugguggguggacaaauuacaaaugaggggccgggcgugguggcucaccccuguaaucccugcacuuugggaggccuaagcgagcagaucuuuugaggucaggaguucgagaccagccuggccaaaauggugaaaccccgucucuacuaaaaauacaaaaauuagccaggcaugguagugcacaccugaaaucccagcuacuggggaggcugaggcaggagaaucucuugaacccgggagauggagguugcagugagccaagaucacacuacugcacuccagacugggugacagagacccugucaaaaaaaaauuaaaaauuacaaaugaggagcuggaaguauuuuuccuaauaucauaaaacuaauaggagguaagucugugauacaaaccccaauucuguugaacuccaaagcucauuccacaagugcacuguaccccaagaauauacuauauacuuucauguaggagacagauacagauaaauagaaauauagcagagcagauauaucagaacugaagacaagguuaauucagagaaaggaaugcagaauguucagcccucuaguacuggguggucaguggugucagggaaggcaggcucucaaggugaaucgggaaugcuggcuuaaaagauuguacggugaaucauagccugaauuuuuagguaaagaaaccaaaacacagaggaagaagccacccagagguuguaccuuggucauuuauuucugcugcuucaauucuucuugcugaauuucuaauaucaaccagccaaguggcacacacaucaacucuguaaaauguugucacauaaaguuaagcucagggguuaaccuuaagagucauggaaccuggggccaggcacgguggcucacaccuguaaucccagcacuuugggaggucgaggcaggcagaucacgaggucaagagauugagaccauccuggccaacauggugaaacccugucucuacuaaaaauacaaaaauuagcugggugugguagugcacaccuauagucccagcuacucaggaggcugaggcaggagaauugcuugaaccuggaaggcagacgacgcagugagccaagaucacaccacugcacuccagccuggcgacagagcaagacuccaucuaggggaaaaaaaaaaaaaaaaaaaaagucugggugugguggcucacaccuguaauccuagcacuuugggaggcugagguggguggaucacaaggucaggaguucgagaccagccuggccaacauagugaaaccccaucucaacuaaaaauacaaaaaaagaaaaaaaaaauaggcagguggcaggcaccuguaaucccagcuacuugugaggcugaggcaggagaaucacuuggaccugggaggcagagguugcagugagccaagauugugccacugcacuccagccugggugacagagugagacucugucucaaaaaaaaaaaaaaaaaagucauggaaccugccaaauccuauaggaauuggugacugugaaccaagugggcugcucuuguguggacagaccacaaaaagcuucccacccuacccugcaaauaaucagccgcucucugugccaccucccccuuagagccccgcugaaccuuaagauggcccacugggucugcauuauuuuuccuaagguucagucuguuugaaaagcuggauggauaugacuauguuauaaaccuucugucacucaaggugggagaaaaugagcagcccuugcuguaagugguugcauugucuuguacuguauacuuuuauaugucugugcuuauguuagcucucuuauagacgauguacugcacauguugaaaggucagccacagauaagacugcaaauugucugagcucaaaguucuugucccaagccaucgccuccuccuucugaagaguugggaguuugcucauagaacuauagaaagcugggguuuuagaaccguggcaugauagaaacuuggggucagacugacugauuuacaacaucuuggaacucacagaaugugaguguccuaaaauuauagcauguucuaaucuuugaacaucagaacuuaagaauccuaguaugugagacccccuagaauuaagcuagucaacaaauacuucuacaaugccuacuaugugccaggcauuauguuagauucugaauauaaagacaugaacaaaauuuccuaagggucuugcuuuuaggcagguuccagagaaugucagaauuuaagaaucauaaaaugugagauucuuagaaaaaugaaacauugcuguguugaaauccuagacugccaaaggugaagccuugaaucauucucuccagcucucucuaccuuuuuacgaggccuagggccuguuccaggcaggucggaauaaaaucucaguaauaggaacaucauaucaguucggugacaucacagaauggccagcuuauaggggcucagggaucacccaguccccacugcugcuuuuaucagcgaggccacugaggccagagaggggcagcuguuugauagaucaccuagccccgucaggacuagaccccggguuuucagguaugucuuaaagaacaggcagaacagaaaaggcuuuccgugugcuuccgagauucccucuuugccagccugcacugaggccccagcucuucagaaggaguuugcagcaacuuucucuguggaggcaucagccccgcccccggcccacgugugcaguagaucgccccguguugggagcccccccuucccguugaugaguguuuuauuuugcucccucccccuccccgugugccucaaaaucaauuuucauuauuuuuucugucuguguuugucuuugugguucgcaggugcucccuugcauuguucauccugcuucaucaaccccuauugagcagucccccuccccgccccccuccccuccggccaaugagagccagaggcgguugcuaggcaacgguguggcccagccaaccccggacucagacucugaggaagaguuugucccuaauucauucuuaguuaaaaguggcuccgccagccugggggucgcggcgaacgguaagucccucucucuuccuacuuuugaggguuuguuuuuaaaauuguccuuccguugcggaugccugcuugggccacuugccgggcggaggggccuggugcguggugggauccgggggagcugggggccugacguggcuccgcgggcucaggcagccccgcucuugccccgcggcgccgcuggagugugcaagaguuggagggcugcuucuguccccaacccccaugagagacaucggacaggcagauguaccgacaaagaugcacagacagacaucacgagaaggaaacaucaggugaaggcccagacagguaaagguagagacaaagauugacacagacagaaaaaaaaaaaaaagguuaagacauaggcaacaccaaccaacuaccuacucugugccagggacugugccaggcacugucacaaccaugcccagagacucaguauuuuaguguccccauuuucacuggaaaaacugagaaggauuaccccauuacccauaaaacagcgcuggcuuuaaaaguucuccaguuucacagagccuggagacaggcggcccugaagccccagccagcugcagggcuaaaugccggcugcagagagagccacuggguuuaagcauggaucugcaagcucucuuauucugagcucuguccugguguucuuaaggugggaggugggguauggcagaagagcuccagggugaccagcuuguauccccugaucaggugcuguuagacuugagccaaggugcuugcccucucuguccagcagaggccagucagcuucuuugcaaggaaacccaggaaggaauucaaaccucuaagagguggggcaggauguacaugagguaaccuaggaucaccuuaauagccccaggauuuccugauguuuggagaagagaggaaaugaaacuguuuccccacaaauaacacuguagguuuuguguugauuuggcaaacauuuauuuauaagugcuugugugguacuaaauuccaggccagauucugaaaaaggaggcagagguucaaagagggauaagacagucuaugggcucuggaaccaaacagcuuugaauuacauacaagcuuuauugcugugggacauuagauaagucacauugccucuccaggcuuauuucuucaagggucaaguggccauuguagugcccaccucaugaugagcacccaucacagugccuggaacacagaaggagugugguaacuguuagucauugccugguccccuccaccugccucuaggggauuuacagacagccugucugugaaagcucccagcacacugcuuggcacuuggggaugcuccaagaaaugucagaugccaucuuuucucuugggaguacaucauuauagccgaagguggcaaaggcgguaggaaccuaguauguucugugacugaggaagaagccucuacucugccuaagagaauuaggaaaugccuccuaaaggaggcacuuacaggacuugaagaaauuagugaggugugccagacagagauuaccaaggguguucugggcagagggaacacauggacaaagaacuugagguggggacaagggaagccugccccagcucuuuuaaaccugagagccugggcuguaaauaggugugaaccuuggaaggguauggaaggccauguggugaaagucaccugagcucuucugagaacuggcuugaguucccccaccaaaugacaaugaagggcggucauuaccuacccuccuuuucuagcuaggaccuccccgcuuccacugucuuuggaaaucagagagaucuuuguccuugaugauucucuucugacaggauuuuacacccugcauucuccaugaccaagacccaaaccuccuccuuuuuucucagugcucccuggggugggcuuguuuucuuggugguucaaugucccuacuccucuaugccuuuuagcugccuguguuucaaaugaugcacagaaacacaggaacccugggcugggagcaaggagaccugguuccagacccagcuuuguggcucacuggcuauuuauccuuggcaaaucacugucuuucuaagccucaguuuccccauuuugccagugauggagcaauuucuaagguacccugauuuuaggagugucacaaguuauuccugccaguagccuucuuaagcuuaugggguaggggggaaauauauauauauguguguguguguauauguguaaugauguucuuuguucauuucugaguaagccuuacacguagaagagaaggcaagagauuaaaguccuuaaucucuuccuuugcaaauuagugaacaagagcaaucacuuuguugcgaguucuaaggcaaauugaugacauuauugcauuauugaugugcagggaaggagaugggggacuuuagccugcagcugucugcucauugcugcuccuccaugcuccugcaccccaggggaccuugucacuuuggaucccuuccccaggcccuugcucugaaugucacucuaaaaguugguaauaagcaugucucaugccugaaggaagagucuggguccuuacuggucuguuccucugggguugggaucaugagagagcucaaugagucucugccaucuggacccugccuacugccuuccucucuccugaaacccaaaaccagggaucuucuaugagccaaaggacaugcugguacugguguggacucagcacuagugagugaagauuagagggcccugguacguagauguagcaggccuaauaaaugcuuuuaugguuuuuaauuugauuuuuuucauggaaaaaaugugaaauuauuuuaauggaauuaucuuuauuguuucugccaauuauaaaaguagcaaugcuuguuaacauucaaauaauauggaaagguaaaauguuaaguucucuuauaauccuuccuccgagauauaacuacguuuaacaguuuggugcaugguuuuucagagacuuuuaauuuagugcucauugaaugagugagugaaugaaccaaugagcaagcaaugcuuaaggaccacaguguagcagagagcuauagccauugcucuagagacaagccugaaauuggaucccagaugugcaacucuaggcaauguuuccaaccucugaaagcauugguugcuccaucugugaaaugggagaaaaccuuccaagguuguugugguauuuaaaaaaguugaagcugauaaaacuuuucuaucucucuucccuaucuccacacccccaucuccuuccaccaauuugagaccuuggagaccacccucaacagagcaguugcuuuagggccagcugggacugcauucagauuauauuuuaaauuacaaagaaugccucuuuggcuccuaaagggugaaaaugagacaguuuccuauggugggagcugaggcuguuggagccagccuucccgggagcuugcgcuggacucuccagcaucaccccagaggcccucugcccacagcugugucaacuccagccugagcugccaucccagaucugguaggccucagagcugcccugcuaaaauccccauguaaagugcaaagaggaccgugggguaucacagaacagcucauugucccuguggagaagaaaacaggggaaguagcuuuuucucuuaucaaaauccuaauccuuccccaaggguaaucauccagaaaucacugauauauauaaagaaagauuucacuaaaauaucaacuagucacaguugaaaaagcaaaggaagugguuaggauuaaguagguauucgucccuaccccauagaaacuuuucagaauaaauauuaaauguuucgugaauuguucucaucuaaauucuaaagcaaaggggcuuuaaaaacuuggugguuaauauuuaagagggucggggaauaaauagcucugagagaugugucaguuucucaaagccuagguaagguagugggugggugggagaauugacauuuaauaaggacuuucuaugugcucgaagucuuucuauaaaacaugcauuaucguauuugugucucaauuuaugucccuuucacuguuuaggaaacugaagcucaauaaggggcagugacuugcccauuagucauuggucauaagggcauggaaaagauucaggcccaagccuguuugacucuagagccccauuuuuuuuuccuucuguuguuuuuuuuguuuuguuucaaauaucagauccuguuacuuuugucuucuccuuaguaggaguuugaagaagauaagaggaauuccaccaaagaaaagcugguuuuaagagaauuccaaguuguuggauuccuuuuaccucacaaaccuuuacgaagccccuguuauaugagaugaaucagaccagaugaccgggcacuaaacuuuggugcagcuuccucagagccaaacuuuggaugcugggccguccaugggucuuuucuuuuuucagcacuggguccuuacugccuugccuuacaaauuucucacuggucagcaucacuguuguuuggcaguuucauugacuuucucaggucuuaagcagcugggauuauuuuguuuugacuaccaauccaguggaggaguguuuauuuuucuuucuaaaugggaaacacugccauguuuguaagcuccuucuaaaaguguuuucuuaaaacaaaaaauucaacuuaauugagaaccuauucagagucccugggggugucaaccaagguccuuuuaagucaguuuaugaaaucagaaagcaaaauugugccuguuucuaacaguugaaaggaagguccagugagauuuuugucuucuuucacuaugaauuucguggagccugggauuuuguuguuguuguuguuguuguuucaugccaacugcaguuacuuggaugugcuucuuuaccuaguucugaggguguagaacacugggguagguaaaguuuucagcaauguuguucaccacuucucucaacucucuugcagcaaaagacccucguugguaaauaaauucuuacuacaccagcuauguagcaaaguuaaguaccuaacuccuguuggcaagacaaauugauuucuuccuuuauucauucauucaugaugacauuuuaaauguuuguggauguuuuccagagagaugagggaugaaggguauucuaaacagagagacccuuuaaaauugguauuuaauuuauuggguuaaaauuccuuaaaugaaacccuuggaaucagaagcacuuuagaauuuggaaauguucagauuuaaaaaagaaaauggagugcauauuuuguauuucuccuaacacuccugcaguaaucaaacacaucacuauuucugccgugaaacaugaauacuuauacucaugggauuuuaaaaugacuccaagccucaugucaguucaggucagguuuugccucuaaaugaguuuugguuaaacauuuagucucagaguuuugggguuucagaaugauggcuaauagauggugauccugaauugugucuucuuaaaaaugagggaagcggagcucagaaagacuuagcaacuuacucaugguuguagagauaacuagauaacuugaaaacuagacagcaugauacagguacaaguugcugaccaggaagcuccauagaugugcuuauuguuuauccauaaucacugcuuagaaaggccuagccgcucugcuauagaaaugagaguucaggaggccaacaccagcaggcuggguggcugucaggccuggaaauucagcaggaaagaagccaaguggucagaagccuagaacuuggcaacucugaguugauaaggagcauuuccugauagacugucugcugucgggcccccuuucuuugaugccccacugucuucuguacucacuccucccuaacagucugggaccuaguuauucacauuucugguucccucgugcaacucccaguuccuagagguaggccuuguguacacuaucuccagggcugagcacagugcccuguguauguguaugugcuaaaaucaaaauugaaaaaaaaagugcugauuuccuuucuuccuucuuuccaccagcaccccguccacacacaugcacagcaauaacccuaggaacggggcacugaggcacauacaugauacagcuguggagagucacagagaugaagcgauuugucuagguacagagucaagaugcaaagcauggccccagacuccaguguucuuuccacucuaccaggugccucccuuaauuagacaagcucucaccuauggccuuccaccuggggcagaccauuauggccccgcauugagggcaguggugacaaccucacaggggucacuucuguuuuuauacuguugacaaagcccuuuuucauacauuaccucugggaaacucuggugacucuaauuuaauugccacauuggcuuucuaggagguaaggcuucuuccugaccuugcaaaauaaacaggucacguuuugaauuaauguaacugaacauccugggagaaccagggcccucuaauuagucacucauuguagacucuuugcaguuccuuuuccacuaauuuccccaaauaccacugcauuaaaagguacaaaaauaacacuuuuccauguauggcuugauuggaccuaggaauuccuacaccacuccccgaggaaggcacauuagcuauguguccaggcuuucuccaucuggaaacuaagccuaguuugugacccuguugaaauggucauggucugcuccauggaucccuuguggacaccagaccacauuuuaaaccaucuccugacacuuuagggcccagaccguugaagaggcaccuggaaggaggccaaggagagugugggagauuaguagaacuaacauuuguguacccucucauucccgaagcucguucuccucugucaucucacuggauccacagaaaaguccugugagauuggagaaaugugaaggagggugaacacuguguccaugugagaaacaggcucagggagaugcagcuuagcacagagcugccccuuggccacaaggcuuggaacuaguuugggcuuuguucauggauggucaguccaacaugugaggcucacugccaucaugugaggcccgcugcuaucaugugagcucaguuucccaguuacaaacuucaucuggagaagccucaucaugaaaaccugcuuacagagaggcacaggccuggaagcaggagaucugcuuugaucccaguucugccucuagccugcugugucaccuugcaaaaggcucaucuguugguucuucggcuuucuagucugagcagugagagaacuggaugaaaccagcauuucccaaaccauauucauuucugugucacugucuuagucugugccacagcggugugcccaccuaaaugguuauuuauguuccuuuaaacugcugccuuuuccaaacuuuuucuccuuuagugaauuuuuuuauuucaaaaggaaauuguauauuacugcugcauuccacuugccauauggcaaguguaugacuugccauaaauagaagguaacuguaaaaauaaauacuaugaaagcagguuaucccauucuggugacagaaugucugcucaaggacagugaggagagauuugccucucugcauuaaacaaggacauuggcaacugauagguggugaaaacacacuaguucccaacuuagacuuccucuuugacaucauccaaaggguugaaagaaaauagaagcuauucugcaugugacucgguguuauuuaauguuuguucucacuguaaucaccugaaaucacaucccuuggguacacagcucuguggcuuuuuccaguacucuguaggauuuuaaugcugcccccacacagccugcucaccuugagaauaaacaucucucgcugcucucaggcccauccuucuuccauuuccuaaacguggucuuugggagccaucuguucccacccuuccccaggcagcccccugcccucugccccugucaucaugucugagcugggugcuuugagcucagcuggaucccccauuacugguuaauggcucccaguuuaaaccaggaaacuuuguggcuuccuuuucucccuucccuuccucuccuucugaacugccauuauuuauauagguguuugagauuaaacaacuaaaaaaaauucccucugcuuuauaaggccuaaaaggacugaagccagaagaaaaacagaaauggcacaauguggagcaauggcagggaaaaauagguuguggagguuuacaggucugugcuguguagucuugggcaauuugcuucaccucucugggccucagucucgucuguaaaauggagaauaguacagucuucucucuugauccacaggggauugguuccaggacccuccccgcaacagcaaccuccagggauacuaaaaucuagaugcucaagcccugauauaaaauggcauaguauuugcauauaacuuacagacauccucuuguauaauuuaaucaucucuauauuacuuauaauacuuaacaaugugaaugcuauguaaauaguuguuauauuguauuuuuaaauuuuauacuuuuuuuucugacuauuuuugauauucagucaaccauugguugaguccauggauuuggaggggcaguuguacuucacaaaauugugguauaaaugagaaaauauggauaaggcuucucucacagugauugcuauauaauagaugcccagugaaugucaguuuccuuauucccuuucuggaccccaaaaguuuuuggccagauacuccugggaggcaagcagauuccuacacucuuaccccuccuggcuuggaagagccccagcaauuaacagcucagccugggagucaugaucuuuaaucccccucccccuccugggugauuuccagagauuucgggugggacaguaagcccaaggcaccagcuaaacaaacauagcauguagucucagagacaaagcuucagaugcucuugcuggagcccguaugcuguuuccaguccccauaguuccagcgauggagugcugauguuugguaccagaugaaacgcugugaugcuuuuuccuucuggucagcuggccuucccccagaguugaaaggaaaggaaaaugacugguaauucauuuaugcuccacucccucuuuccugguggauccuauuucuauaaauaacucugggaagcugcuaaccagcuaacaacaacaguaccuauauuugcacuuccagaaacccuucuucagaugccccaguggaaccuugggggaaugcauaccugaugugaaccaagcuccuuuccccacuaucucagugaccucaccaagcuuaccucucuuacccaguugcccaucuauaaaaugggaauaagaauagcaaccuggggaguuugcuaggauaaaggagaaacaggaaaacaucuaagacacugagaucaaggcagguguuuaguguuuacuggucuucucuuggaaaauaauagagaccauuuuuaggagauaaggagguuaucucaucaaaacuaaaguugugaucaccggucugcuauuauccugagaaggagcaaaaauggaaguggagaugaucccugucuauuugcuaguuuuacaaaaugcugcuccucuuagccaaaacauuccuacuaugucuccuuucuccuggaccgcuucaguagcauccuucuggccucccugccccugucucucccuuuaauccaucccucacguuguuccagcuguuaccucucaaagagccccugcuagugcccucccuggguuucccgcugcuggcagcucggguccugauccuuagcagggcagccccagcccuucuucccagagcccuauccuuccucgaguuuauuacuuucaugcagauucaacacagccucuggucagugucuggugaugucggcagaaaagaccaaagccucacuaaucagagugaaaauagggaaggucuuucugauuucgagugauauggaggaaaaaugaggcuuguugacccucagaaccaauucaacucagcaaauuuuuuguuaaggaccuacugugugccaggguccauggaggauagaaagcagucagcucaccccuguuggggagacagaaacacacuaaacaguuugcccugaagcagccacuaguaaggggaacuggugacggagugugccaggguguguggggcuacagagguguaaugcaaacugggagguugggggaacuuccuagagaaaggugcuaacuacugaggaacacaggcaaguuugcacauucaggcuuaucuggaagugaacuuuacuuuuauguaucuauagggcuccuauggacugaauuguguucaccaucaacauucaccacccucaaauucauguguugaagcucuaacucucuaugugauggcaucagagauaaggccuuuaaggaggugauuaagauuaaauaaggucauaaggguagagcccugaucagauagaaccaguguccuuauaaaagaggaagagaccccaaagagcucucucuccuccaugugagacacagcaagaaagugaccaucuacaagccacgaagagagcccucaccagaaaccgaaucccaucagaaccuugaucuuggacuucccagccuucagaacuaugggaaaauaaauuucuauuauuuaagcaaccuagucuauggaauuuugguacagcagccuaagccgacuaagaccagagcucugguauaaggaugagccuagacauacagacuuugcaugucuguuauuuguguguaaccaaaugcucccaaccuaauuguggggucuggaaguguuuauuuccuccauucauucauucaucuguccauucauuuagcagacucuuccuggugugugcucugugugggguccugugcuggagagugaacucuggucagaccucaucugugcccaccaugggcagccaugugcauugggcacacaugaaggaagcacugcaguccucugcgcagacagggggacaaggcaaggcucucuuccuuucuaggaaggaagggcugccauggcaaaggccagcuuuacagcccacucuccauccauccccuuccagcucucagggagcagcccuugagcacgcugcauuuucccgggguuugaugugggaggagacaagcaacauaaccugcaggcaggugugcuggaaucaaagagggccugaucacaccuuuggacagcagaacagaugagcaaaucccauuccugagcaccuacagugugccaggggcuucgccuuucucauuccauugagucugcucagcugggaggcucuagagcagaagagcuaagaguguggguuugaauguuggcucugucauuauuagcugugaucuuuagcaaaugcuuuuaaccucggaguuuucauuuuucccuuauguguaaaacagggauaauauuaauaauaccuacaucauuggugguauuagaauucaaugugaaauaauauaugugaaguacuuagcaaagugcccaguuaucguacagucuuaauaaauggaaauuucuaucauuguugucauuuuucugguuaguguuuuacucaacagagccuaagaaagauacaauaacuugcccaaggucacagagauaguaaguggcauuuuugcaucccaggugugccuggcucuucacaaucuuuucucacucccaccagacugccucccuuaucuaacagccaucucucccuuucuugacaacccucaggcagccauagggucuaagggaaccucuaaagcagaucagggauuuauucuccccccgcccugcacuauacccuacccugcugcacagaggaucaagcugcaugcacauuuugggagcaguuuaugaccccuggccagaggccccugaauggaaaccgcugaguugcacuccggcucucugcucuguucagaugccucuauugggcccuguguggaugacaagaugaugcaugaggucuggcuaagcagcuuauuugucugagcuggugauggccuuuguccugagguggguuaaugguaaggggcaguggcccuuuaaggccuggacaaugggcaggcuucucaggucaucaaaucacucaguggaauggcccugagucccuuagagcccccucagaacacaggaggccucugcugacccugcucaucauccauugaugcaccccccgccccgccaaccaaaggggaacacuggaauaauggagagagagaaucaaagagcauucaaaugacaaaggacuucagaggaggaaaccgagacagagagaggacagugaucauuccugacuucccaccucccccugcacccaguucuguacugugcuuuccuagcuuggcuuguuucuuucuccaaaugcagcaggcccacaacuaaccagaccaggcuguuuuucccagcuguuccuuucauugcugaaaccuaaugcugcagauuucaguuccaacuucaccuggcagccauggccuaccagaauucacccuuucccuacuucuugagccccucugauccuuccccaagccccuagucuugugagcaacaccauuuagccucugcugccugcuucaacaaaagcagcuugcucccuuugaucaguuuccuacauuugcuucugaauaaagauccuauuuaaagauaacuucuaauauuaggauuuuuuccaaguuugaaacccacugauuuagaucaacccuuuuauuuuauggaaaguugcagagcugggauucaaauccacgccuucugauucccaaucuugacuuccucucaauguauguauucauuuauucauuacacaaagauuucuagcacaccuacugugugucaaauacugagcuggucccuagaguacugacauauauaagacagugcuccugcccucaaggaagggccugagcauuaacauccaguccugcugaggguucaaaacgcaaauaugaaaaugccuauugaguuuggcauccaugugaccacuggcgacuuugguaagggcauuuucagaauguggaggcuaaaaccagaggaggauagaugggaggggagcuggcagaggcaguuuaaguaaaugaucuaaagagacugggcuuugugucacaaauuacuuacuaauuacaaagggaaaagaguuacuuuauaguggggagauuaggaaucaccaccuuaaccaagugaccaaacuuagcacuccauuagugagccauccuaauaugacgcaguaagauguacgucucaucacacaugagguacacuugccaaaaacauguaaccugaauccaauuaugagaaaacaaucagacacauccagaaugcaggacauuuuacagaauaacuggccuggacuuucaaaaaggcuaauaccaugaacaaaaggacugaugaguauuuggguggguaggaggcucugguagauuaaaagagacuaaagaaaucagccaaaaacuugacucuuacaagugauugaauccuguuuuucuaaaugcuauaaaaaagacaguugggggccgggcgcaguggcucacgccuguaaucccagcacuuugggaggccaaggcaggcagaucacgaggucaggagaucgagaccauccuggcuaacacugugagaccccaucucuacuaaaaauacaaaaauuagccaggcgcgguggcgggugccuguaguccagcuacugggaggcuaaggcaggagacuggcaugaacccgggagacggagcuugcagugagccgagaucacugccacugcauuccagccugggcaacagagcaagacuccgucucaaaaaaaaaaaaaaaaagacaguugggaagaauuggagaaauuuuaaacuauaguauguauguuaggugauauggaauaauuauucauuaauagucauauugugguuagaugauagaaugcucuuauucuuaggagaugugugcugauauaaaguguacugaagucuacaacuuucagaugauucagaaaaacuuuuuaugcaucgagaugaaguaauguggcaauauauuaacugacagauuuagaugaagaguauaugggcuuuucugcacuauucuuucaacuuuuccuuaggguugagauuuuucaaaauagaaaaugggagugccuguacuuagauuggcuagagacuggacaauagcaauuggguuuuggaaagauuucuugggacgggugagauugggugcuuuuuuucaugagagcccacccucacaaccaagcaaugcuuuacaccaagcauugacuucgccucuuggaauacagaaccccuccaaaccuuuacagagaaccgaugguuuggcaguugugauaaaacaggcccuuccugggcauggagggaacuucagcaaggcaccggauccaguaaugggaaccacauuggcagaaguguagggagcuccaccccagaaauagcccuucugugccgaggcaggacaacuggaaugaauuaugcacauucauacuuguuaaacugccuuggcaccagaagugauccucguaaccugagcuuuacagcagcacagccauacuuaaaguugggucagccuugcccccgcacucucucugucggagguuuauagcuaaggcauaaaacaauucagcaugagcugaaacaugaaaaccuccuccagauugcaaagguaaacuucucuuuuuaaaguuuucugaggaggcaguguuugggaauaaagucuugucugucuccuucugcuuuuccagguccccacacacccuguccccaccucacucccuaccucaagccuagaccacaauccagucacacacagaagcugcugcauccuguaguuggaggguucuguugugaccagggagucuugguuucugaaacugagccuugaagcugucuggccuugggcaaguugaguccccucucuaagcuucagccucuugguuauuuauagacaauauuuauuacaggguuauccagaccauacagguguguggucacuguguacgugagaccagugcacacgguggguacucuguaaacaaugaaguuugccucauguaucgauucuuccuuuccugaaagauuucucuguacaauggaauguuguuugacagcauuuuacccacaguagaauuucuuucaaaacuggagucgguccucucaaacccugcuucugccuuaucaacuauguugauaugauauucuaaauucuuugcagucauuucaacaauguucacagcaucuucaucaagaguaguuuccaucacaagaaaccacucucuuugcucauccauaagaagcaacuccucauccauaaaaguuuuaucaugagauggcagcaauucaguuacaucuugaggcuccacuucuauuuuucuugcuacuaccaacacaccugcaguuacuuccuccacugaaguccugaauuucucaaagucacccgugagagcuggaaucaguuucuuccaaacucuuguuaauauuucaccccucuccuaugaaucuugagcauucuuaaugguauuuagauugguaaauccuuuccagaaaguuuucaauuugcuuugcccagauccaucagaggaaucacuaucuauggcagcuauagucuuauaaaauguguuucuuaaacaauacgauuugaaagucaaaauuacuuuuugauccacgagcugaagaauggguguuacaugagcaggcaugaaaacaacauucaucuccuuaguuaucuccaucagagcucuugggugaccagguacauugucaguaagugguaauauuuuaaaagaagucuuuucuucugagcaguagcucucaacaaugggcuuaaaacauucaguaaaccaugcuguaaacagaugugccaucauccagucuuugucauuacauuuaaagagcacaggcagaguagauuuagcaucauucuuaagggcacugggauuuugggaaugauaaaugagcacugccuucaacuucaacucaccagcugcauuagccccugacaagagagucagccuauccuuugaagcuucaagccaagcauugacuuuuccucucuaacuaugaaaguccuagaugacaucuucuuccaauagaaggcuguuuugucuauguugaaaaacugcuguuuaguguagccaccuucaucaacaaucuuagcuagauuuucuggauaacuugcugcaguuucucccaucagcacgugcugcuucaccuugcacuuuuauguuauggaggcugcuucuuuccuuaaaccucaugaaccaaccucugcuugcuugaaacuuuucuuagacagcuuccuugucucucucagacuucacagaauugaaaagaguuagggccuuugcucuggauuaggcuuugguuuaagggaguguuguggcugguuuggucuuuuauccagaccacuaaaacuuucuccauaaaacauaaaacagcaaaaaggcuguuuugccuucuuaucauuuguguguucaauggagucgcaauuuucauuuccuucaagaacuuuuccuuugcauucacaauguggcuaacucuuuggcucaagagaccuagccuucagccugucucagcuucugacaugacuuccucacugaauuuaauuauuucuagcuuuagauuuaaagugagaggcacacaacucuuucuuucacuuggccauuguaggguuauuaauuggccuaauuucaauaucauuaugucucagggaauagaaaggccggaggagaggaagaaagacagggaauggccagucaguggagcagucagaacacaaaccuuuaucacuagguuugccaucuuacaccagacacaguuuguggcaucucagaacaauuacaauaguaacaccaaagaucacugaucacagaucaccauaacagagauaguaauaguuuaaacauuugaaauguuacaacaauuaccaaaaugagaaacagaaacaugaggugggcaugugcuguuggaaaaauggcaccaaugggcuugcuugacucaggauugccacaaaccuucaauuuguaaaaauaugguaucugcaaaaugcgcuacagcaaagugaaauaaaacaaggaaugcccuuacguagaucucuauagagaaucguuguuuugauuaugaacagaaguuuuuccaaaauuacucuugcuuucaucuaaaagauagccaaaguacaguccuuaauagaagagaaauaauguggaaaaucacaggaaaauaauuugauuuuauccuuuuauuaagaguuuuuaguagaagggcgggagaagcuuugaagucagacagaccucaauucaaaucccagccaugccacuuacuggcagagugacccagacagauuaguaauccauucugagccucagugguuucaucuguaaaauaaggcauaauaauacugacccagcaaagggaagugaagauacagugugcuuugugaaaagcucuuagcccaguaccuagcaaauagaaagcauuuaaugaacagagcuacaauuaguaccgaaucugagaagagcaggaacgcuccugauauccagaccugucucucaaguauuguucuugggcaccaggaaugacagaccaagggaagccagcugacaucaaaagccuugcccugcagaucuucaaauagaugauaaaaaugcacugugauuucugcccuuuugaagcugucucuuagccuagcccuucaagcuacuagggauuugaugggcugggaggacacugaggaugagaagaaacuucaauuuguuguuucaaaguaaggcagcuccuucagauaaggcaaccugguuuuuucagagccuagguucccagacauguggucagguagggaaaaugaucuucaucauugccuuuuucuuuuggcaaacguacuagggauggguaggaaaguguggaccagaaucagguucuuuguuuuuuuuuucugccugagucaggacuacgaaccccaaacugcuucugcagagguugagcauuuucacuggagucaccacaugucagcuaguucaucccaggcagauuucugcuuccagucccaguucugccucucacuagugaugacacuggagagucacucugccuucuuggcccucacuuugcuuaucucuaaggaaagaagaaaaccagcugcucugguggccucuuuagccugucauauggccucugugagauaaggcaugugaaaguaugagugcucccaagguggggaacagaaacgcaguccucaccacgcacucugcagugaggcaggcacguuauacacacaccuuugugcaacaggcguuuucccaaaaggcuauacccaaacagaauuuguuguuacuaaaauacaugguaaauagaaucuuuaauaaauagaagcauuuuaaguacagaauaggagauggagaaaacuaacauuuauuuaccacauacuacuuuuaauuuauucugauuuugucaucaagauucuugacgguguauuuuugcacauuaaaguagcacaccuggauuauaaagauuuucaaacagguugucuacaguaucacuaaagaucuagguacauuucccuacuagaaaaaaaaaugguuuuuaaauaugccuugaaaauuucuaucccucuggacagaugagaauuuaugacaggcaauuaaaugauguauguguauuuguugaaugugaauuucuccuggugaagcagagaaaguaauauauaaagaggggcagaggguaggaagggaccagacuuguuuccugcucauuugcacaaugggucagacauuuccacucuccacauuccucaggauaagagucugcugcucacacugacgcccaccccuugcccccacaccaaggcguccuuuuuuucuucugucucacuucuuccaagagucaagauccuucuuggaacauaacucaagcuucagaacauacuuccuuuaggacuggaaaauuuccuagaaguuggggugugaaaucucccccuuccuccagggccuccugcccuagcuuggggguugccaccuacagacugcguuugcugucugagcaaacucagcacgucuugucucaaaggugcacauucauuaaggauaucgaguugaaguccucuucucuggagcuaauagcagaugcacauuucugggcuagggagaaagagucuguccuaaagacccucgcaggaccaugcaccgacucuugagggagaguuucauuggauuugaaaaucugagcacuuccggccugacagggcuucucuuggaaagacacaguaccguggaagggcacaggcuuuggagucagccagaacuggcuucagaucaccauuucuccaauuugugaccgcagagcauuugggcaauuuaccucccucacugagccuuuuuuuuuuuuuuuuugucugucaugaaauaaggauaauaaauuuuacguaggagggggagagggaggcaaaugagguaguauuugugaaaaguuaagcaggaagccuggcacauacaaggcacaagaacaagaccauccuuuugcccacuggcuccucugggauagauucugucucguguugcccacagagcuugcacuuaggaaugacuacgggcucagaggagugggaggucggucagccuuugcccuagagcaaacuuguccaacccuuggcccacaggccgccugcagccccggacggcuuuugaauguggcccaacacaaauuagucaacuuucuuaaaaaauuaugagaccuuauuugcaauuuuuuuuuuuuuuuuugagacagggucuugugcuaucacccaggcuggagugcaguggcaugaucucagcucacugcagccuugaccucccaggcucaggugauccucccacucagccauccaauuauuagaacuacaggcgcaugccaccaugcccagcuuuuuuuuuuuuuuuuuuuuuuuuuuuuuuuuuuuuuuuuugguguauuuuguagagauggguuucaccauguugcaccaggcuggucucaaacuccugagcucaggccaucuacccaacuuggccucccaaagugcugggauuacaggcaugagccaccacacccagaagugauuuuuuuuuuuuuuuuuuagcucaucagcuaucauuaguguuaauguauuuuauguguggcccaagacaauuuuucuuccaguauggcccagggaaagccaaaagauuggacaccccugccccagaggaaagccagcagugagcccugguccaccacagcacuacaugcuguccucagugugucuagccccauaguuccccaggacugucaugggagccaaagagagccuguguacaaaagugccuggcacacaguaggugcucagaaaauguugaaucuuacaaaagagaaaucugauuacagacaggccaagaaugcagccuguguugugucagagucagcucucugcccauuucagggacagcuuugugaggugagagugaguccaggcagccucgggcugcagggagagucugcucuggauucuacaacacgcuggggugggcgcugagagccaagggguuccuguucccacaucugcccugccccagcaccugcugcuugugggacacccccccaaccccaccccgccccggcgccgugccagggcuugccuuccugccuccgagccuagaggucaggcugcuuccaagucacaucugaauggguguugcugaggccugaacagaacagccuuucccuacuugggcaccccuucccccacccucccucggcagcuuggccaaaugcuuuaggcaagucccuaggccuucaccuauaggcccacccaccagccccaugugccacuuucuguuucucaaacacaccuggugccuucacagcucugcaguuuuccacaggaacaccuuugcuaagcacguaaggugcuaagugcuuuuaugucucuggucucauuucaucuucacagcaguucuaagacaccagcauuguccucuuuucacaagugaggcaaccgaggcucagagagaucaugcaauuugccaaaggucaggcagcuagcaagugucaagcccacggggauccggugcuagagcugacagucuuugcacccgccaggcugugagcucccuggaagagcuuuaaggcuccauuggcuugcgggggacaugccugccugggcauucaaaaugcaggauguuuguucacucuuucacuugacaaagugaggcaauuugucagguucuuuugguaacuuuucaggcaaaaaggcucaggugaagacagcucuuggcuuuaacagagaauggcuugagggugcuauuucugguaggccuaggaccagggagagaagagaaagcagcuguagagauugggauaagugcuuggcuugucagaaagauaaucuccccacaccugugcccuggaaacacaauccaggcccugagaugcacuuucaucugucaccauggcauccccagggugaccugcccaagcauauccaagccaguggggcucagguuacagggcccauucucaggguccuugagucccaacaaugccuguuuguccuuugguacugccaucucccaggaggaauguuaaugggauggagaauggaggggggcugggaggaagaagagacugacuucagucugagccugcugcccugucagccucuugagugagcucauccgugaaugucugcuaguccuuccaagagacacuuaaaccauccccaggaaagaggaauucguccucugcucuucuagaccagaccaucaucacuccuaaguggggauggggguccucuguuuaaugugggacuuagccuaccccuuggcagaacuuaugauucaagucaagaaauauuuccaaaaacagaaaaacugaaaaugacuuagaugucuaauaguaggagguugguaaaauaacaucuucuguccauuugaugaaauuuuagguagucauuaaaaucauguuuucaaauaauauuugaaagauaaaauucucauaguauaauguuaaguggagauuggauauaaacuguauauacaguaugaaccuaauuugauaaacauaugcuuaaauauguaaaagaaaagacuaggaggaaauguauauauaccagggagcauuaacagcaguuauuacuguuguagcugugacuggguuuuguuuuuuuuccuuuguacuuuuuucuuuuauacauuuuuuuccuuuguacuuuuuucuucuauauauuuucuagggaaaacauguuacuuuagagucuagaggaaauuaauuucuuacaaauuaauuuauuucacuccuacuauauagcuagcauugugcuaggugcuggggauaagagauuuaucugaagaaccuagucucuguccuucaugagcucauagccuaacuuguuuaaaaauauacaagcagauaacaaaaauacguuguuuuuaacaacaauaacagugauuauaccuacacauuuguuaagugcuauggauuguucuaagggcuuuauguguacuugcacuuaaacauugcaguuccaugaaguagguggcuuuuaacccauuuuacuaauaguuuguacaggcugcuaugggaacauagagaauggagagauuaauucucuaugugggggucaagaaggcugcagcgaagaauugguacaucugcuaauucuuucaggauaaaugugaguucuccaaguggacagagcaagaaagaguuuuuuggguacaggcaauaccaugcacaaagauaucaaggaaugaaagaacaagacauuguugugaaauugcuaauaccauguuccuuccuccccagugagaagcuagaagggccuucggggccaguuuaugaagggcauagaagaucacgcuguaaaguuugagcgugauuauauuaggcagcagugagccaucaaggagcucugacauggucagcucugccuuggagaaagaucauucugggcuucugaaacacugugaaaagcucagccguauguggagagagaaguguuccucgggagacugaguguugcaggaaaauucaucuccguuccagcugaaguagcagagaaggagaaaggaaacaacgggaggccacagaaaugugugauuuccauuacccuuaucugcuuguagaaagucacugcagccguguggaaucaagcccccagaugggagcuguaugugcacagaaauguguuuacuacccagaccaagaaaagguguuaccaccagaagagagauuugggaauuccaaauggacuuuuggucuugcaugcaauuucugggcuucguuaguccaaaucucuucuguuuuugcuguaagaacaaaggaaagucuugugugaccaugcuauaagugcuuauacuccaagcuuguuuggaguugcauuuaguauacaaguccccaaaccccucaccauaaaucugacaaagugcuagaaagccaauguaacccuccuugguuuguuugccaagcuuuuggccuaccagaugauggucugcucugcuuggccacaaggguucugcuugcaacaaaugagacgagcagaauaauguaggcacuuguucaucaggauuguuucuuacucuaacauugcccuuccuauuaaaauauuauuuuuucaaugaaguaaugauaaguagagggcauauuuuucuuuuguuauuuuuguucucaacuuaaaaaaaaauugacuaugaaaugcaaaucugggcaccacggagccuauacuuuguugaucuguacuuagugccaggugcuaggaggaaugcagagaagaaucaaacauggacguguuccuuaagauagaugcucugagugguaaaugaugauuaucauuuggaaaaggcuggauguuaucacugagagaugcugggugaaaagugcauaggaacucuuuguacuauuuuugcaaguuuuaggugaaucuaaaauuauuucaaaauaaaaaaggccagcaccuagggugaauggcagggugccagcaggcagaauauagaaaggaguagcaugggguugucauuuaaagcugcagcaggaagaaucuugaauaucaggcuaaagaguucacacuuuauucuguagauagugugaagccauggaaaguuuuugauuaagacccaaacauagucagauuuccuacuagaacaaucacucaauuaucagggugaaggaugauuauagagaagugagccuggggguuguuaaaauaaccucggugggaaaggaugaucuuuaaaaguaucccuaugucaaaagaugaaauuacaacaaauuuagaucuuaauuggcuuuuuuugggauucuagaauugggcaauacucauuuuccaauaagcugagcagaggagguuagcuuuguagacagaaaaggaaaacagaaacagagaccaaaaagugcauucguuguuuaaauuacagcagagggggcuuccuuaucaugcuggcuaaaacuggccuguuugggaauaugacuaucaucucucucuccugauuucuuagaaggccagaugaacagcuucguuuuggcuugguaguggaauuucugcaugagugacuccauuuugguuugcucuguugggccuagugcaagagcucaguccaaaccaauggccuccuauaaauuuuauuuaacaccuaagagaacuagcucugcagguuguuaauaggagcuauuugaaauagggguuccauggacaaauacauuugggaaauguuaagguggaagagauuccuugcuacaggaguucucagcagcauuaacuuguuagcuaaugugcacugugauugucuaagcagaagagacgauaugcaggguuucccaaaccuuuuugaacauggaaccuucucaggaacuucucacaggacuuguguucagaaaagcacccucugggaaacacaugcuggcacugaaauggagagguauuuguagcacgaucucucuuucuauauccugcaaacuagaaaccauggccuaaaugcauauggaacccuuugcacugggagaguggguaucuaccagacccucucuuuccuuccccagcuuucugaaccuccaggaucacugcccuuccccaugcacagaaggcucuucuguggguuuguuaacagcaaagaaacaauaacaucacagaugccuaggacaaauuuccaacccaauuuuuuuuaauugcaauaaugauaaauaauuugauguguuucugagaagggaagcauuuuugaaggauucuuuaagugucacuuuucaaucaaguuccuuaauuaacccuuuuuugcauuucaguacaaauacauguaguuuuaaguuccuuaccccccuuauaagugaaccccaccuugauuuugaccuaugugcuauaauuacuuagggcagccucuccuccuuccccacccaccuucucauucuaacacacuaccuugucguuagcaauaguacaggaugauuauugaaauguacaaguuauucacuauuuuauuuuaguucauuaaacccucugaucuugucacaucugcugguuucuacaaguuguuugaccaucagcuagcuaguuaaccucucugagcauugcuuuucuuauccucaguaugggaagagcaguuccuacuucccauagcuagugcagaaaagugcuaggcacauaguauauuuagguacuugguaaauacucuuucugauggccccuuuuccagugauuagcauuauacuuugcaguuaacaguuccucagaaauacuugagugaacacagguacaugcacacagcugccauuagucuaauaaagauauuaguuaaggaguuaauugcacccuuuaagaucuuuauuuauucuuucucuuuugccuuucuuucaauaaaaacacugaacuuggcaaugauaauaaacuguaaacaacccagugagguaggugauauugcucccauuuuauaaaugaagaaagugaggcucagacucaagcuauauuaaaaugcacaucuuccuguuucccaaguccauguucuuuagcacaaggaaugauaagacucauuccuucuuucacucuuccaguuaacucaacaguuauugacaugugcugggugccauaagaugcauuccagcccugcaagaacucaccuucuaguugaaggagaugaaacgugugcaugaaacuuacaaggcagaccuguaacaccucauuuaucccucacuggggaaugaacuguuacauuaagugaauuuuacagauggaaucacgaagcuuucacucagagggcccuuacagaucucacuguacaacccuauuauuucaaggggaagaaaugcuagcucagggacacugggugaucugcucaagguggcuccauucaacgguugcaaaaccgaaacuagaauccagcuccuucaacuuccugccugggauuuuaaaaauaaguuaaccauuuucuucaauagaguacauauuucuuuggaauuuaugucaaguugaugguuccuaccucauauuuuucugcaugucuugguauaauuguuaucagcauuauaacacagcacuagaacauagcaaugacuuugaacuuucuuaaauguguauuugauacucuguuccuuacucuguggcccagacagcuuccuguuacccaagcucauuaggucauuuccaacccaacccaaaauugcacaaacugugggaacuguauaguuaaacagauucauuuggccgauuagcuuugguacaauuacuuuauuucucugagcccauuuccucaccuguaaaaugggcagaguacaauaaccuaucucauaaguuauuggaguaaaguuauuggaguacaaggaauaaaaggugccuggaacuuaauagguguuuagcgcccuucuuccccuuccuuuuuuccaaguguucaagaaacucuuaaaaguugcauaccuccggccaggcgcgguggcucacgccuguaaucccagcacuuugggaggccgaggcggguggaucaugaggucaggagaucgagaccauccuggcuaacaaggugaaaccccgucucuacuaaaaauacagaaaauuagcugggcgcgcuggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaguugcauacuuccucacucacaaaaugcacagaaauaaugaaguagaaccaaaauaaguguuggucaugaaacacaacccccuccugcauaguaaaucaaaaguuccucuacucuaaaaaaauaaaaaauaaaaaaaacuugcauauaguaugucuaguuucuuccucccaggagaauaaagacagcuuuaacacaaagcauaauucauaucaucuccagaucuugggccauagcaccucaugaaaacuauuaacacaucucccaccgccuacuuuaugaacuaauauaaaagcaggucaggugagcuugcucuagguaauggcugaaucccugaaguauaugaaauuugaccucgugugaagcaauuguuuuaaauucacucugggaagagagaaugccuuucugugauguacauaagcacuccuaauagcacuguggauuucauagacucagagagucaaggcuuuaguacuggaaggaccuuccagguccgccagucuaacccgugaaagauaaagaaacuaaggccuagagaacaccugagauguccccaagacacgcagaguuggggaaagaucccacaugauucauguuucccugagaauccuucgcucaucacauagcaaaacaaugcaggacaauaacugagaucuugcugaggguuuguguuugugccuuuguuuuaugguuccuuuucuuccuuuuaagauaagcaugucagguuuaauugccucucugauucucuaggauugggaaagaugaacaaaugaaugcgugaauaaacagagccugcaucaaagccccaauauugugacuacagccccacucugucuuucugcaggaucuccccaggcagcauucccucagucccccuuuauuggucuuuauuuuugucaacuggaugaccaugcuccuuucccuggcaaaaauacugcccugaguacugcccauuugagggguauuuuaaaauuccuaacaguaucucuaauucccagugcacccuugugcuagaauccccaggagaaauuguccucuugucccccccuuuccccaggaagguauuuuuaauuuguaucugcaguugguggacagaaauagccaaauauaaggcccugagcucuuuauaaagcacagaaggggagagaggugcucacauuuauugagcaccugccaggagcaacauauguucuuucuucuccagaggcagguauucuuacccucacacuacagaaacagagguccugggaugccgagugagacccccagcuuacacguggcuggcugccuuccagugcaacuaccuugcacugccuccccagagugaaccuccuuggccuccugaacgcuucugagauugaaacuuagcaaaucugcagcaguguucuccagguuuagauguugcagaaucucauuggcauuuaacguggcuggguguuugaguguauuuuuaugucuugccugaggccugaauaaaaguuacaagcagcacugaagaccaaaccaagaaugaaaaugugggcagccaaccuuguaaccuuagcuaaucuuuaauuaugccuuaauugaggaucuaugaaguagauauaggaagacuaauaauaauauguugaguuuaugcagcauuuuaauuuccccacuccuucacguguguuguaauaauuauugcugccguuuccugagccccagcugggugccaguuacccugugaagcccuuuauauuauuucuauuuuauuucucuccucagcucuuuagaggagauauuauccccuccuuaccaaugagaaaaccgauucucacuugucccagggagaagcacugggcagccuuuuaccucagaugcagccaggaagccuauuccacagucaaaucuagcuucaaauuuauagguugugcugccuguggaauguggugccuggagaacaggagcggaguucggguccugcucccagccuccaggguacaucaaucuccccuguggaacagcucugugacaaagauauugaacuccagcccaacaguucuguaaagcaagaguccccaacccugggccgcgaaccuguaccggaccguggccuguuaggaaccaggccgcacagcaggagaugacaggaggcauuaccaccugagcuccgccuccugucagaucagcaguggcauuagauucucauaggaacucgaacccuauuuugaacugcgcaugcgagggaucuguguugcaugcuccuuaugauaaucuaaugccugaugaucugagguggaacaguuucaucccaaacccccauccccaccugccacugguccauggaaaaauugucuuccacgagacuggccccugguuccaaaaagguuggggaccacugcaguaaaguaagucuccccaucccaguuuaugcagauaaggaaacugcaacagagaauuuuuuagcuuagcuuggucacauaucaguguuagugcuuccuuuucaauaccagcucuccccccaucaagugagauaauccagagaguagucagagaucuucucggaacacuuccagaacccuucuggccucccccuaaucccaucucaugcucacggagccaucucccaccagagggcaaaucggaggccacagcaucaucagacugagugaccuguaucugcuguccccugaacugaugugcagaacuccugucauggggaauuagcccaucaucucauagggcuggagcuccuacaaccugggggugguggugaggggguuauuguuguuuuucugacuuguuuauuguguuuugcaaagaucugggacuuugacagacagcuacaggaaguuuaguugaagccuacagugagaacguccucuagcaaugccaucuaguuacuucacaguaaugacaacaauggcuaacauuuaucaaguguuuaccaugugccaggcagccuauuaagugcuuuccaagccugcgaaauccuuccauaacccuaugaaguagccauuacuaccuuuuuuuguuguuguuagagaugaagcuuugcucuguggcgcaggcuggagugcaguggugcaaucauggcucacugcagccucaaauucguaggcucaagugagccuccugccucagucucccaaguagaugggacuacaggcauguaccaccgcagcugguuuauugccauuuuuaaaugaagcaacuaaagcacagcguuucauuaaccgguugaaggucacuaaagaauugaauucacaccuagccccgguggaaauccugaucugucugauuucagaaccacuaguacucuuuaccauuccauacugugacucuaccccauagcagcuuagugagccuaggacagccacuuaaccagauacucuaucacggaaacaauaacaccuacuucacuugauuuugucaggauuaaauaagaugacaauuugccaaaagccaguggaugcugauaaagguguuuccuuccuuaugagaucaguggcaaguaaauauuuacugacuucacuuuuagaugcuuugaugcaaauguuauaccuaccacuuauuuucuacugcaccucuuuugcauucaacuacugaaaacaccagugcuuuaggcuguguauuuuagagucagacaaaccgcagggcccagccaacucccuucuugcugagccuccuuucaaggcuguggauauccuuucuuuuuaauaugggccugcuguuaggacucagacguagcaugucuuuuaaaaauacuggcuuugagguaaagaaagagagauagagagaaaccuugcaaggcacauggggaaaucguggacagggcgcuucuccacagccuguuuuguaauuuuccucaugagaauucauagcaagcuggcaccuuuuuggcugcucaaaaagugcccuagucuaccuaaaagggagaguuaacaggccggggaagaguugcuggcggccaucaacaugaugaagugaaauuucaaauuacguuagauguuugcuuaaggaacaacagaugaggcccuguggauucucaauccucuuggcuacacagcaaaaugaaaagcauaaccauuuggaacccuuccccuggaccguaugaagucugggcccaaaagaugaccuuuuaacgauagcuuccugccucugaaggguuagagugugucgaauuuuucuucgcucagggccugguuuuaaucauugccacagucagaagaaagggcucuuauccacaccgcuuacuuuuuaaaauaucugaaauguucuuugagguuacaaucaaaauuuuuuggauaagauuuccuguccuuugccugguaaucugcagugugaccuuugucacauucagcaaacuuccauugagaacccguuguggcccgggccaguucacaugggugggugaauuucaucuuccccaggauccugacauugaggcuuuguauuuuccucauuuauaggugagcguaccgaggcucagauaggauaagucauugucaagaucauacacagcuaauggaugaguaacacuuagcccuuuggagaagggaggaaaacuguuucagguggagggaccugccuaugugugcaagacuaacuccaaguuccuuucccuuuuuacuacacuacagcuaacucucuaaucaaggggaaacuugaccauauucaguggacaaugaggagccacagaagguuucugaguaggauaauggcauaaacagagcuuucggaacauugaucaguuagcuucucuuccuuucuaagucauucacauuuaaucucaauauuacuccaucauaucaaaauaacguaagguacccagagcaaguaggcacuuguacugauguggaaaaugagacccacaaaaguuuuauaagcugcccaaggucacaagcuuagcauuuaaccaggacauuaacuauagucugagcaccauuuucccuuggggaccacaagcccagcagcaaacuguagucugcagaagcccauccucucuguaaagcacccaugguaaaaucuaaauucauuuaggacggaggcacagagcugccccaaccaguuuaaauuguucaguccucuguccuccacuccacaauugcaacggguucuguucuguccagaaucuuaauuuaauuagucuucaaagaaacuuuugcugguaaaauaggcucccagcagagaaggcuuuguuuucaauguuugguggcuaaaaaaggcacauuuugcaccaaaaugacagagucuggagguggugaacuuuugacacaagagaauaaauccuugaagagaaaaucuacagccaccugaagcuuggcuuggcuguauuuaugcaaguggacccagccccagcaggauauuaaaaaccauuauaaccagguucccucuuuaccaucucccccgggggcccugauccuuagcuuaagucuuacauuuccauaauaaaggccaccagcucccauuucaucacauaguccccaagaaccauuuaaagaccuaggcagccccauuguaggaggauuucccuggcuccccuucccuagcccucucuccuucuugucucucuucugaaccugugaguuuuucugagagagagauuaaaucaguugcaaagagcuguuuaauuaaacuuucccccucccaccucugaaguugcuggagacuucuuuugacuucuccuuggcaaugcguaaucacuguaauguagccgauucuguaauuaccugccgcacauggaagcaguuugauugcuguugcuuuguccuauuucaaccucagcugacagccguguucacccuccuugagugucuggaauauccuagcagaaggcaaggugaucugaauuuauaggcaacuuuugauggguccagauuuauaggcaaauggggccaaaggguggauaaugagcauucugagggugagauggacuucccuucucugcauggugagcugcccagcugcaggugcagggagguaccugccagagcacagaugggguggguuuccagagacuccgggcccagccaugagguucacaauucacucugcucucguucauucugccagugcauuuuucauucugcaagaugcagacacaaaacuguaggaaguggcucaugccaccuucacagaucuccccuuucauaaauguagccauuaacucccuuuuacagaugagaaaagugaaaugagacuuuccaacuaguaagugauggcaccuagaucaauccagguccaugucacuuuaaagccugcuccacccaaucaguacuuguuugguagucccuuauauuuuguuauuugauccuuacaacaauuuauuacauaauuauaaacuagguuuaauugugagaaaaacgagauuuugaaagugauauaauauguacaaagucacacagcuagcaaauggaagaguuggaauuugaaccuauguggaucugauucuaaagcccagacuuguaaccccccacuuuaucccuuuuuaauuauauagugaguucuuguguauuccaaggcuguggaaucuauuccgucaagcaccuugcagauuuuugaccuauuuccuuguuguuuugauuuagcuuuauuauacacuuaaauauugagaguuguuaccuuaggaacuaguggcagaaugguguuuuuccuuccaggcuuuuauauauaccuguaguguuaagaccaugggguggcgguguauuuuuugcuucuuaacguaugauauugcccucucaaaacuuuccagcaagcuggguaggacagcccugguccuccuaaucuccuuccaggaaacugcuccagggcacacaaauucugacuguagucagagcggggacccccaggggcugcucuguuuaaagagcugcagaguaaggagacggggaagguggggucuugcugggguagucuagggauggguggugguguuggugacagcuucacagaagacagugacccuaccacaggacuaugucuuuaguuggcaggaaccaguaggcaguagggagauguggguuugguggucuccuuggaagaggcuuaagggaucccagcaggacagacuuagugggcuacaacauacccuugggcugucgggaaguuugaaauggaagcuguggcuaucaccaaggauugcuuuagauugaguguaauuaaaagagagagagagagagagagaacaggaugcuuuucuuccuuuuaggauggaagggagaaaguggagccugguugagugccaacucugacagguucuguguuuugacaugguuccugacuugaaggacaugguuagcaaaacuggcagaaaauuuuacacacaucuucuggggcuucaaagugaagagcccuuugccuuaacacaggugcaugagugucauucaugugugucuggguugaauaagcgcuuugagauggagccagccugacgcugagcaaagggagguacgaaaccuccucuauuuugaauaacaucuucuauaagaaaagccucuguuagccacucuucaagucccauuccauccccuagauauuucuuuuauauuuuugaccuguauaaacuuuuucucauuuacaucccuuagcaaccauguucuaauguuucuugacaccugcuuaauuaucuuuaguagaaaaaugagagaagagguggaguagagccagcuacuuuccuuacaaauuuugucugcauuuuuuucuaauauaaaaauaacacaucauugguccuuuucuuugaaaauaaacugaaauaaauugcugugcaauccauguagacaaagcaaaaauauaucaguuaaaaaauggcacacagcagcuagcaaacuauuuuaacauugaaucaguuccuguguaguagccacaaugcaugcaagcaaauuauucaucagaaacaagcuccaaacauacagcaaaauaauccaugugaaggaauuccaacaucaugcucauacauggacuacaagcaaauaguucacugaauauuagugcacagcaagcaaagaaaaacauuuuaauuguuuguacaaaaaacauauuuuggucagcauuaaugcuuuauaacaagcaacaaaaauguacaguaucauaaagauuuuaaucuuuaucucucaaaccuagaaaaucacgcaaagccagguaaauaaacauuucuaaaagcuucaaaagcccaugucacugauggauuccagaugguucuccuaaucacugguguucaccacauuagaaaacaaguuaucuugaucuguaaaauaccacccugcagcucuguuuacuguguccuuuuucaaagugucuauaauauuaacgucaaaucucauguuaaagcuaugccucuguggcagaaaaaaaaaaaaacaaaaaacaccuuuauuuuuaauuauuucuaaaugaaagugauauguguacaaaauuuuaaaaguuacauuuuaguaaaagguuuauaauaaaaaauaucauuucuggccaggcauagugguucaugccuguaaucccaucacuuugggaggccgaggcgggcggaucaugaggucaggaguuugaaaccagccugaccaauauggugaaaccccguuucuacuaaaaauacaaaaauuagccaggcgugguagcaugcacuuguaaucccagcuacuuaggaagcugaggcaggagaaucgcuugaacccgggaggcagagacagugagccgagaucaugccacugcacuccagccugggcgacagagaaagacucugccucaaaaaaaaaaaaaaaaaaagucaguucuuugccccaucccuccccacucccaagucucacuccccaggagacaggaacucuaaucucuucuaccuguuucuucugccauuuaccuccaugcuucuaaauaacaugcauguacugcuauuuuucauuuauuaauuuuauacauuaucuguugacuuugugcaauagaagaagauucccacacuaccuucucucucguuuucccuccccgauagaacucuaucauaauauuauaaucauuuuuguuaaauagguagucauugguuauauaauuauguaauauaugggcuuugggguuguuuuuuuuuuuuauuucuuuuccuccugagccaaauagugcacuguaacuauuccucuuuucuuguacaugccuucauuuauuuucuuggaguuguuaauugcuuuuuuuuuucuuugccuuauuggagaaauuuuaagugguucaguguagcugggacaggauccuuaauauaagggauacagugacugacaaggcuguaaaagggacuagaucuuaauggaccuugaaugccaggcuaagaaacuuggacuugaggguagcacggagccauggaagggcagggaggugaccuucuggaacauuccucccauggcuaugugagagguccauauggaaacaguuuuuaaacugacauggaggagugugugaaagcaucugcauuuucacaaucuuuccagcacaacuggugucaucuuuaggaaacucccacacuugggugggaguuugucaagucacuaacagacuccagcucuccugcauuuuccuucccugaaaauauggaaaauaaggaagggcaaaaaucaucucacaaguauacccaacuggaauuuccugauucgcuuggaauuauccagucucaaagagguccagguuaugggcaacaggaaaacuacuacuacuaacacacacacacacauacauacacacuuuuuuuuuuuuaaguaaaaauagcuaaaaugcugauggauagaauuugugcauuucccaucaccagugaauuagaauuuauucuacacucagacauccaacucugaagcugaaaucacacaaaucucaguugacgcucuuugcucuguuuuguuuuguugggagagaaggggaaaaagcuggaaaugucaagagaucagaguuagaauacaggauaagaauuaagauuuagaagguuacucaaauaagaacagaaagaaacuaggguuuguaucagcggugacguguaugaaauuacuuuuaauuuugcaaaaucacagcuuugcccucucagccuguguaagugaaccuagcaguuagcauucauaaagaggaaagccccaauguuaugggugaccagggaauguccagauuuccgagagggcaacugaccaacuuacugcuucuguaacauacaaagugauugaauuugcuugucaaauucuuuaaauucuauuaguauagugauacauugcuauuuaugccaagagacaccuuuuuaaaaaaugauuucugcuguuuuuuucuuacaguugggaaauucagcuccuaaccaacucaucaccagaaacacaguggcagacagcuguuagggccgaacauuaucaucaucauaauaccuaucacggagugaaccccugcuaugugccaggcacuguccaggcaucuucacuaagauuacagccuuugacacucacuacagucuaauacaguguaauuucuugccuucauuuucuaguggaggagagaaaaugggauuuccccaaagauguacugcuguaagugguagaaucaagauuuauuauaaaaugagguugaucugauucugcgucaguggagauacuuuuggcuguaauuagcagaaaacuuaacaccaaguacugggacauauauugugacacauaaaaggaagcccagagguagggugggccucagggcuggcugcuccagagaccagcaguaucaucaaggacccagauucucauccugguuuugcucugccauacucaggccaguuuccccuuguuguaggguggcugcuagcagcacuguggaccaugugcuuguucacugaauggucaagacagacuggcuuccauugcucaguauuaaaaacaaagaacaggcuggguaugguggcucacgccuguaaucccagcacuuugggaggccaaggcagguggaucaccugaggucaggaguuugagacaagccuggccaauaugguuaaaccccaucucuacuaaaaauacaaaaauaagccaggcgugguggcaggcaccuguaaucccagcuacuugggaggcugaggcaggagaaucgcuugauccugggaggcagagguugcaguaagccgagaucacaccauugcacuccagccugggcaacagaguaagacucuugucucaaaaggaaaagaaaagaaaaaaaaaaaagaauagcgagguaugguggcucaugcuuguaauccuagcacuuucggaggcugaggugggcagaucacuugaggucaggaguuugagaccagccuggccaacauggugaaaccccaucucuacuuuaaaaaaaaaaaaaaaaaaaaaaaagccaggugcaugccugucaucccagcuacuuaggaggcugagacaggagaauugcuugaacacaggaagcagaaguugcagugagccaaaauugcaccacuacacuccagccugggggacagagugaaacccugucucaaaaaauaaaaauaaaaauaaaaacaaauaacaauuuuuuccagaaacuucuggaaaucuucccauggaguuucaguggcuugaacugggucaccugcucauuccugaaacacucauuggcucaggggaugaggucacccuuaggucacucaggcaccuugaguguagaucaguuccccaaaccacacuguuguuacucaagggaaaaggcagaauggaagcuggagagcaaaagucuuucaucguauccaggacaggcuacgucuuuuauggggccccaggcagaaugaaaauacagggcccuugguucaaaauuuuuucagaauuucaagauagugacagcccaucaaaccaaacacgggcccucugagugcagggcucugggugacuaaagaguucacacacccgugaaucuggcccucaccacagacugccugcugcauacaauguuuaaguguucacugcucugccucccacuugauagcaagaaccaaccacucuuguuugucauugugcccucugugcuugauucaauaccuggcauaugagagguacuccaggaaaaaaacauuugagaaaggagugcuugguggagcugauaucgcuggucugaggaaauagugguaagugguagugauggagaugcugaggaugucuugagcacuggcuggaggcuagcaucauacaucucaccuccuuccuuggcggauucucaucccaggccugagagucuucuaccuccgggugcaccuaaccucccgaaugccucuccuuguauuuuguacuugaggaacauuuuuguuuaacucacuuuccugauaugucacaggucuuaggccuuuggggcugaugccugcugaacuauaaucacauguuugacguguuugaccgggauucucuugcuguugccuucauucacugcuagucuuuggaucaccaugcaaaggguuuucuuuuugaaguuaaaaucugccuuuggauaggauauucagaaaugauauuugugucugugucaguccaaucuguuuuuuucgcauguaggaauguaguccucauuuuaucauaagaguuaagucagauuuuauugcaaacagagcacuguguggacucuagggagaaacagagauuuaaagaaguauuuagacauguuguccuaauuggagacacuaggcaaaaacacaugaggaguuaacaagagaauugucaucauaaagacaucaugagggcaaggcuuaauuaaauuaauuggcuuuugaaagguauaggcugcccuccuauuauuuucugccugccugccuuuccucaugcugucucugcauauuuuauaccuugucccuaucauuuaauucuguccauccuucaaggccuccagagaucaccucagagaccuugaauagaaauguucugcagagcgccugcugcacauggacaucugauaggcauuuauugccuucuccugggcacugucucccaauuuugcaagaaaacaucagucacuccagccucaucacauucaauauacagccugggugccagcaguucccacacugcaucugguuagggcuguugucuguaagccugucuccuucaggaggcucagugccuugaugguagagaugacauucgugcuauucccucucuccaugccuaucacaugaucuuggacauaguagguaccagugaaaguugguugacuugccucuguacucugaaggcagagaagggagagagucuguggguuugagggccccaagggaauucucaugauccucagucugagaucacaagugagauaggcagugugugauuucagucuagugaugagcccaaaacauugccuugagcugucaauaagaccccaggcugcccaggacugacaccucccuccuugccuugguccugcaccuuccaucucuaggccuucccugucagucuacugggaaagcaggauuccccagggagccugguugcuuuggcuacagccccgcuaugcuguacagucaggcucauacacggcaaauacgaacagucaggaaggaagugucuguguaccucaaguguauguaaaggggacagucagacuguaucuucauggaggcuuucgacaucuagaaauauuccuaaaugccacauuugaguucuagagagagagaaaaacagaguuguauuucucaaguucccuugggcacagugcauuugucuuuggacaugguugcugugccguggcacucccucuccagaccucagcuugggauauccagacacaugacagacccaggcaucucccccauuacuuucuagaccuaaguaauaucacgccauaggugggacccaacacaccguauaaaugccagccuucacaggacuggcucuucccagcuuuucuggaucccuguaacauacagugucaaugguagacaauggagagagguagaaagacccugugcuuggagagucaagcuaguccuugguuugaauccaccacuuauuggacagacucaugcuaacccuucacuucccugagacccaguuuccucauucgugaaaugaaguugauagcguuaaacuucacagugcuguaacacagaucagaaagcccagauuuaaaguaccuagcacagagcccggcacacaggaggcucagcauguacuuacgaggaaagacuggccgccacaaaaaugcacucuuugguugaccugacacaaggaagggucaugaaaacagccacagacucaaauacauuuuuccccauuuggaauuauucugccugauuugcaugggcaguuaagagaauggacacauuaaaaggcuuuuauauauauauacacacauauauauaaucuuguuugauguuuuccucucugggaugaugccuaacaucuaucagauggcugcuuuugccuaauuucagucauuagauuaaggaaggaugagguaguucauccucggggagaaaaaaaaaaucaaugugaguaagugugauuaguaacagcguccaggaguaaugcagcgagaggacgagaccgugaacaaagcugcaggcuguguuacuguuacccagaggaugccuauuccugccuccgggcucagcggugcagcugcucccauuuccacacaggucauggucuguccaccuggaaauggacguuaauauuacuuaauauccacagaucauuacaggacauuuuucuuacgaaguagaaauagucagaacuuuauaguaguagagcauuauauuuuaaaacaucucugguuuuaaaaacuacucuuguuugucauugugcccucugugccugauucaaugccuggcauaugagaggugcuccaggaaaaaaauauuugagaaaggagugcuuggcugaguugauaucgauggucugaggaaauagugaacaucugcugagauguugaugagguuugagagagugauuccugcucaucuguucacuaacauucgcaccuacuaugugacaagcacuggacucagugcaagugacauggugauaaauaagaggcaucucgaggggcucacagauuagugggggacauaugcaugcauacgaguuagugugcuagcuggacaagcacagcuaccuugugguuuuggguuccugggacaugaaggaggguguggucaggucugccugaagagugacgcgguguuucagccucugaguugaguucuaaccucacggauugaggagggucuaggaaaggcacucuaggcugauagcacagcggguuaggcaugacucccagcuguaaggauggaaacccaacuccaacucacguuuuuaagcaaggaaaaugucacggugguguuacugaaaguccaggggcuccuuuucccaucagcgcagcuagaucuaggcauucagacgucuuaaugaaucccuccugacccuguuucccuuuguuuuggccuuauucucaggcaggcauuccucauaugaugacaaagggaccccugcaagcuuaucuacuaccagccuuguaaccaaacggaaaaaaacagugccacuuuuucuauagcuccagaaaaaucuugugauugccucugauuggccugaccaaagucacauauuugccugaaucagucacccuagccagggugcugagcauggaguuugaugggugauguggagggagggggcaggacagagaagaagaaucaacaagccugcauuuggauccuggcucuaccucugugaucauggcaccucuaauagcucccccucuuacuaauuguguuauuuuggaccagucuacccacuucucaaagccuugguuauuucaaacuggaaauuggauaauaauacauguuuuaugggguuguuuuuagaauaaaauaaguucaugcauguaaagaacuuaacacagucucuggcacauaguauucacucaguaaccauagacauuaggacuguagacauagugaauacacauuuagauuagauuuacaauaaguaggucuugugcugggaccauuaggaauacaaaaauucauauaggaaacucacuuucucucauuuaagcuucaaucucugaguagguacaauuaucuccauuuuauagaugacacucagagaggcuaaguaacuugucuagaccacacagcugagugaguggcagagcugggauucaaacccaugucaaccggacucugaagcacuuguccucucuagaacaugaaggcagcuuggucuuucuacuuuauuucuuccaaaaaacaaaggaagcagccagguaaaaguuuauuucucgcacuuccuuauuuaaaaagaaaauacagaaugacauucaggcauggguggaauuccuggggaugugccuccgaaucccaauuugcuucagauucaucaggaugccaggccuggagaucuacaccccuucaguggugucagcgcaccucugcauugcaucuuacauugucaagagacauuuucuucaggaugcccugggcuguauaaauuaggcagaacagugaccgcugugguuaugaauauaacuguuugauuaagguuccaugccggcugcauuauuuguuucacaaaccugaacugggcugauuggauuucucucucugucccuuuuuuuuuuuuuuaacauaaguagauucuaaaauuggaaaaauaaaauauuccacagcugagagaaaagaauuaacuuggggaauaagcccagguggcacccacagaauguacaccuuuuguauugaaauaaaguuagcgucguuugugccuugacucugggguuugugaggggacugcucuauaaacagcacaugaugcugugguaagagaaggaguaggagggcauugacgaggaccacagcacuuaagaggacauucuuaaauacuaauaauaguacuauuuucagaacaccuacugcaugccaggugaaacguacaggucagugagggguggaaauuauacugucgccguuaagagcacgggagucgaagccagacagacuuggauuucuuggcacuuaguugccauggagcaugaacacauucucuccccgagccucaguuuucucuucuggaagauagagauaacaauagcuaacauuaggugaguacuugcugugugucaugcguguucuuagcacuuuacaugaauccucauggcaacccuaugacuaaugucucuauaucucaagccaggaaaaugggcacaagaaaagcuaaguaacuugggcagggccacagcuaggaaauaguagagccaggauucaaacccaggccacccuccuaccauacuguauuacguuccucuuaaaccuauguccgaggacucuugggaagaugaaauggaaagacaguggccuaaagaugcuuugcagacuaacuagcagcccagcaagccuucaauauuuugaggccaucauugguauuauuauuacauuucuguugccuagggauugagcugggcacuuuggagaggacuucaggaagacaaaauuucuuuuaucuguuuguaguaugacuuggcuuauggacauugauggauggaauaccugcccaagaucuccugagccgauauaaaaaaaauaaaaauaaaaaaacccacauguggucagucguaaaugaugaaaagcaucucucugauuuguacacuuaguuagaugcuuuccaccuuuucccccaagugaggccuuuuagggccugaggaagaagguaagggucacaugaguaggaggccaccaugcugccuugugacuugcuggauuuggauggccgcucuucggugaagguagaggcguuugcaugcaacuucucuaaaggcugggaaggacucugcauuuggagucucuguuuaugggcucugccaccugggcaagcuguguagccuugcaaagucuccauuuucuuaccugugaaaggaggauaauaacacccauaucuuaggauuguccuucugguguguuaucaaacagcaacacuuuuugugguccccaaaacaucauucauauaacuauugauaugguugcuguucaagcauaacaaaaauacaugagggguuuuugcauuuaauaaauugcucagugcauguagccgagguacuucagaauuaauuuuuucuucuucugccucuaggaggcaucaaaaguagaaagagcaaucagaagcuuguauugggaucuuagcuuuuaucauuucccagcagugugaccaugggcagauuucuuguuuuguauguuguuugcuuuuuaaaucaagaugucacauuuaacagaguugaccccaaugcuagggccugaaauaucccaucauugaaaaaaauugaaaaauuucauaaacaaagaugugaguagauuucugaggcucaguuuucucaucugcaaaauggagaaauuaaguccuacucuauacuguuccucugaagaugaacuaaggaaaccuuuguaaaagcccugaucauugucaugugucaauaaauauucagucucuaguucuacaugguggaauuuuuaaaauaaaggaaauaaauuuaaaaauaaauauuuauuuuuuuccucccugacaaccucccaguguccagaccuaaagacuguacauggacaaaggcuuaauuuaguuucauucaacaaacauuuuauagccaccaagcacuaaguggaaaagcaaauaagauuucugcccuuggagacccuauagcauaaggaaaaauuaauuagauguaauuccaaggagcuaugagagugaauuaauagccuaaauugauccuuucuauuggcuggucacuaugcuaaggacuccauauccacugucucacuaaauuccuacaacaacgcuaagaaguagauuaugcuauuauccccauuuuacagaugaagaaaucaaggcuuucagagguuaaaaacgcacucaaagccacaaagcuaguaagugguaaacccugguuucaaacuuuguuccauuugauucagcacucaaccuccuggccacugugcuguuugaaugagguuuguggcaugaaacugggguccagaaaaggucuguaauaugaccaguguguaugcagggcaggugagauuugaucccgaggcagcuugagccugagccacagugcuuacccaccaugcaauacugcucugugcguucuagcgaccuuuuagccaaccugucccuuucauuugaggaaucucagugucuuuuccaagagaaagucguuucuucaaaauuacugauggcuacaaaguggagggaaagguaugaacaugauggaugagaauucaccucuuccaugugcugguauuuagccuccugcagggcccauggaauugggguuagaauuuggaaaaugaccugauaaccugccuugaccuuugaugcuggccaucaguuucaacaaaguaggcuauucccugcaggagccuugagauucauugucuugauuuucuuuucauggcaucuccaacuguggauaaaaauaaaaaguuuaugcccaucucaauuaucagcugucuuaaaugugcaguuuggagaaaugucaggucaaguuuaaagagaaggaugaggaugcacagagugcccaaaucaccccaggccccucgagaaucagugacaguuccuagguaagagaguccacagaugggaaccuaccugguaccccagagaggguaaucauccacuucuagccucacacaggcuaugauauauuaagauacaaccucugcccuuggagcguacagucugguggaagagacagacccguaaacaaauggugauaacucagagugagccauggaggcuagagagcccaaacuaggagugagaguggucagagaaggcuuccuggaggaggaaacuucuaaucugaguuaaccaggcaaaggugugaaaagccucccacgcagaaaacaauaugugcauagccauggccaugagacaagcagugagcaguuucaugaguggugucuaauuaaccuguuaaccuuggcaccuuuuuaaagagggagguggcgagcuauggggugcuacccuggagcaguggacucaugccggaugguggggggucucguacuguaggcaguggggagccacaaaaaugcuuucaaucagggaagcaacauaacccaguuuccuuuuagggaguucacuccaucugauggauagccacugaauugaagcgggugagccggcaggcuggggcaccaauguucacuaugccccuggccugacucuccaccagugaggaccugagcuaacguaguggcaguagggguggugaggagcuagcagauauguggaagaugacagcuagaggaauugguuacauuguuaaguuguugaaccugaaaaagaaggaagacacaguggcaguucccagaggucugguugauugauugggugggagguucugacagcagcuggugauguugagaucaggagcauuaggagagggaguauagaauuggggcugcagggacagggaggcauuaaguuuaacuguguauacauuuaguuagagcaguagaggcuugacauucaggcaggagguugaggcucauuauauuagcccugcuucacugacaaggagcucacuaccuuaagaggcagcccauucaauacuggagagcuuggcaggaggaaggguuuucuuaagcuuaacugcugucugcuccagguaacuuccuggucuugguugucauucaucuuccuaaagccccauggaguagauuuacuccuucucccaccccuuuggcaguuugaaggcagcaguaguauucucgcuauuuccuucuuuccaagaaauucccugagaggaacaagggaagccaagaggaacuagaccaucaauggcuggaagggacucaggagauuaaaaaugaaggaacuuccuuuuucagauagacaaauugaggcccagagaaagaaagggacuuccccaaagucacagagugaguuaaaggcaaggcugggaauaguucuuccaucuaggaccguugaauacaccgugugauuggguguuuuauuuccuagcacaugaauucugugggcauaagcuaugagacuuggacauuauaaggcguuuagcguuuuucagcuggacuccuaaacacauacuccuucuuuaagcucuucuccuuccccuucuccucuccaggcuaacagcaucaguccucccccuacucccucagggacacaguuucuaaacccuucaccauccaaggaagccagggaaagcauuaacuagcuccagagaccuugagaaggaucagccucuacuguacugaguugaccccgccauccaguaucccuccucugggcccgcuccagcaaaucagcacagcauggccgucccuguuucuucgugcuuuuccucugugaaugcagccuaccuacauuuccaugagcugcuuauccgcuccaucacacugccgacuccuguugagcugaauuccacccccgacacucacacacacacacacacacacacacacacacacacacacacacacauaccucuuacccaucaacuaugguuccuuguugauuugggacuugaccuaacuguuuauggaucagaucauuuuugaaaaggguaagaagguggcaauggaaggaaggaaaacucacuugacagccagaaagcuuucccaggacaaauucugccuugagguagacacagcuuuaaguugggggaaagcauguauccagaaaagaucccaccccuccggcugcagcuggccuuucccaacaaaaucugccuguucagauuuuacaggcagaaacuuugucuaauccaucucuaugucuccaguaucgaggacaaggcauauaaaaagugauguuuguaaaagaaaugaaagcagagaagcaggaagggaaggaaggaggaagggaagaaccaucacauguuucccuuucuuucauuccauccuuuugccuuguuuggugcccagucacacaacacaauauaauacacgacuugcugugcacauauuuuguaagcagauguucauuaacaaguacagguucagaaugauauagucuuagauuuuaaaauuggaauggacucccaccaccuccuuuucuguuugucaauuggggaaacgggcucagauagguuaaguguuuugcccaaggucacacagcaaauuagccgcugauugggauaagcgcaagaaugaaauuugguggaguauauguugugagagaguucuacuuuuggauucaaaugguggcccagucaaauuaugcaagccccaugcuuaaaagagacagguuuugaugcucuuggcuuaauuugucuaugaauuaccaugacccuaggaauagagagcauuguugauuacaccucucucuggcaguugccaaaacucuguucuucccucaauugucuaguuaaagggcaguagggcacucucccccaguccuauccuagagaacauucacugaugguugaggaaccucaugugcauuuuaaugaagccugggaguucugguucacucuuaugacuacucuuagcuuuaaaaguuuggaagucggcuaggcgcgguggcucacgccuguaaucccagcacuuugggaggccgaggcgggccaaaucacaaggucaggaguucgagaccagccuggccaacauggugaaacccagucucuacuaaaaaaauuuaaaaauuagccaggcaugguggcgugcggcuguaaucccaacuacucgggaggcugaggcaggagaauugcuugaacccaugagacggagguugcagugggcugagaucgcaccacugcacuccagccugggcaacagagcaagacucugucucacuggaagucggggugagcccucuuucugaacacccuugaaacucccucuggcuccaggcucuuaaagguggguuccaaccucaucucucuuugugguccauugccagaucucuauuccaugugcccaggucucucaccauacugcugccacaaggggucuguaucuuucagccugugggccuuugcucacucaugccaggccccuaccuagaaugcccucuugcuccccuuuugucugccucuguccugccucuacuucagugcucuguucaaguucuugcucuuccuagaagcuuuccuagaccacucuauguguaaauuguuguauccuggagggauguggcuacugccugagacucagagcggaagcugagcugccacgggcugggggaaaagaagugucuuguucauuaucugugcucuagcagacuggguaauuucuaaagaaaagaaauuuccuucuuacauuuggaagcuaggaaauccaaaguccagggggccacaucuggugagggccuucuuagcaugucauaacuuugcagaagacaucacauggugagagggcaagagugcgucagaccaggucucucuucuucuuauaaagccaccagacccacuacuggggccccacccugaugguuuugucucaccauaaucacuuuccaaaggccccaccuccaaaugccaucaauauaugaauuggauauuauguuuccaacacaugacauuugggguacacauccaaacaauagcaagaagguuacuccagccucucucucuuccuaccuuucaguguccugcugugcucaccauuagccaaaccuauccagaagccagugggcaagggagcccaggugaugcaguccuuaggagucagccuccugggacacagaaaggcagagaauggucuggaacuaaggauggggcuggaggaggcaaacagagaauaaagucuuacaguagcuguuuacccauccuacuguaacuggaguacauauccccugggaucacuggucccagucauugcaugcagcuagccucccuggccaccuccugccaaaggccagcugugcuucccagccauugugacaaccagaaaacacccuuccucauuuccauacaccccuguuuaaaaaccacugcaucauacaaugaggcuuuuucauacauugucccuucaucacuguuuguaaaaugcaaagcaauuuaauaaucugaguguucaccgaaaguucuguccugacuaaaugaaugaggaagcagaaauagccauauuaugaccucaaggugcuauuuuuuauuccccaucagaauacuggaaggggagccagggaagccccacagucugcuguccucugugggcccuuccuugugugugaguccaucugggauuucaggccaaauacuguuuagaagccuugagcacuggccgugacauaggacuaaagugagaaugaaccgaaaccauuuuguccggagaaggagugaauaggcagagaaaacacuacaaaaagugugaccccuagccucauguucagacuggugguuacauuguggacuucauuguuuugauccauucuagguucagguaacaauaauacugauuguuuucucuaacucuugcacaagacuuuacaguuugcaaggugcuuucauacacauuugacaagugaagaaacugaaacucagguuaaauaaagugcuugagauucuacagcuugaaggaggcagaacugagacuggaagucaggcuaucagauuccgacugcugacuguguugauaaagagcuuuccggccuucauaaauuggucguguaggccaagauucauuagcuaagcucucagcacugcuacaucaccaucccaugucagugguagucgauggcauuuuaauggaagccaaauaacucuuucuguuggcauucucaggcagcuggaguuuuuguuuuaugauaacuaaauaccaucaucuuucauaucugacaaucuuuaggacccaauuaaugacugcaguguaugcuugggucaucauuagcuccguagcaaggagaccuucaggcaccugucugccauuugcagggcuggaugugggcacucagccuggcacccuuucuuggagccagagcuguccuuagaucacagggcuauugacaugauugaguuccuugccugagccaaagcucuggaaguuuauggcuuuuucucaugaaugugaucuuauaaaagaauagugguagacuccacuggaaucuuuccacgagggaggcacccugccaucagucuaggggguucuuauagccugucccggccugguucauccuccacguggccaccagaaaucuuccucacauacuaaugugaccccccacccucuggauaaaggccaaggucuuuagccuggcaccuccaggaagugaccaccugggccugccccagugucucuaccucacccgcagccacuguuuucacauagccauuucacucuaguuauaaaacuguccccagcuggccuugcuucugaacccuugcacaugcauuaucuucugccuagaaugccccucagacauaggucucaugucacuucucagaaaccuuuccugagccugacagucagucuggcagcugcccuccauaccuguggugcucccuggggcuguggcguaugccgauaagaauuauuguggucgacacuuggaaagugcucaguauguggcaggccuugauguaagcaccuuaccugcauucacucauugaaugcacacaaaaaagaauguuuaacaguagggucuauggaggcagacugccugaguucaaauucuggcuccaccaauuaaagguuucgaaauccugggcaaauugcuuagccuuuaugugucaguuuccucauuuacaaaacugggaguaauaacaguaccuucuuuacagagcuguuauaaggauuaaauaaucaaaguacuuagaaaguauccggcaaguaguaaauacucaguaaauguuaacuaauguaugcgaugaugaugcugauguguaauuuuaucaucaccaguuuguguaguauauaucuguuuguauauccauuuucuuuacuagacuaugagcaucucaaagucaaggaccauauuuguuuuauuucucaaucucuauguauucaaccuacgguaguccauauucuuucucuuccuuuuauugccauuacuauuauauauacauuuuauagaugaaugacuagaggcucauagaggugaauguagccaguaggagacagaauuaaggucuaggucugugagauccccgagcucugcucuuguaucuuugccagcuguccucccaaccacugacuacuugucaaggaugaggcuuauccccaucuuuuaauccaucaagucccugcauacaacaaggggcuguuuaauauuccuggcugauuaacacuagggccuucuccuuauggcacaccuucaacccagggcagagagguauggauuuggguagcagccccugccugguuugcucugagaugcuagucuaaugcagaaaggagcuuucaucuuugaauacauggugagcccaugugucugguuuuauucugagugucagggcuacagccauucucaucaguuucugaacugcaaguucagcuacaggcacccuccugcgacuagagcuccuaggagccagcagguuguccagagugggauucaguguaauaaaauaguaucacacuucuguuagauauguucugcucuuuuucucucaagguuuuuugcuuuggaaccccuguuguaaacgcugaagagugaucaccauggugaugauucagggcuuugcgauuuauucauucaacaugacuuuauuguaauuguggaauuaauaguuaccauuuuucagaauuccuauauuccaagcauggugcuaaguacucacauacauuaucucuuuuaauucucauaacaauccuauaaggugggcguuauuuccauuuagugauaagaaaacuaaagcuccagagaaaguaagugacuugaugacagucacacagcuucuaaguggcagagccaaaacuugaacucagggcucucugacaccaaagccgagucucuuucucuuacauacggcucugcccagcauuguaaaggagccucacuaugaucuugguucagggaggugcagccaggagguuucgguguucaggauuucugugcaucuaaaaugaaaacugccuaacguguuggaggacacuaguaacugcaaauauauuuaagaacuuguaggaagcaaagaaacuuccuggaaaaccaggcuugcaaaacucagguaagcaagugaccuuuacuggcaguggugugcacaaauagcaguaaaaugacucacauuugggcuugauucacagauauacuugguagcuauaucuguaagaagaggguauaaauuggaauuuccaucacagcuuugcaaguguaccaauguguacucccagguagcgugagagaagcaacugcuugugcaggcaaaaagcccaacuaccugaguuguuguucuuuccccgacauucuguaaauauuuacugagggccuaccaugcaucaggcacagcucugugcggacgcuggggauauggaaagaaaugacacaugggucuuucccucagggcuuaguaggaguugaugguacccauggcucuucauccuccagaaaguggugaaguaggaaagugugcccuuucacacacacacugaccaaggaccgaagagaagugaguuguugcaggucacccagccaguaaauagaaacuauaagagaguucucucuuaggccauguuuaucuuguucacuguuuuauucccaauaccuaguguacaauacuuggcacagaauaggcauucaauaaaugcugaaugggugaacugauucugagauucccuccaaagacgagggugcauauuugucgggggauaaaagaagucuccucuguagccucucaccucugucuucccuccuggccauaggagcaaaaaaaaaaaaaaaaaaggaguccauucagaccagaggaaacauuugcucuuugggaaguuaauguuucuuucugggguuugugagugagguuuccauugcugagcucccaaauacagagcuuuuccuuugggaacccaggaaacaucaagguccccuuucuuaacauucucaagcuagaaagggugagggaagggaaauaaagggccuagcucaagccucugcaacucuggcuccaggcaaauaagugaaggccugcauagacccauggucuagcaggcccagaguggucuacuaugauuuuuugcacacaaauugccccacaugaaccucacuugcuugcacugacagcucaggccauucacauggcuauucauucaauaaacuuaauugagcaucugcucaguucuaggcucuguguucacccagcacagagaagagaagauagggacuuucacaccucccagaggaggcaacauguggacaucaguaugcaugcucuuggggaggaaaugaaaaugagaggucuggguugccugcugucagcauucaagaggaaaaggacagaucaaggaagucuuucuggacggggaggcaguugagcugagagcucaaaagauagaaaggauuuggcccagaacauuccuuguccccauagaaaacauuccuuguccccauaggagaauuuccuuuuagaaguuaguuuuuagaccuggaccagugaucuuacuuaaaauuucaucauugcaggacuuuugacaguucuccugaacauuuaucaagccagagccugguguccccauuagucacaaagcaaaugucuguaggcuugccugccucagacaucagaugcuacugucuucacugaggaccuuuuuccugcauuuagccauggacagacauuccaggagguguuuaaguuuuaugcaaaggcaccaugguuugguagacugaauuuggcuuuuguguuuaugagaacugacuaguuuuguaagccucagcguccucaucuguaaaaugggaauacaaauacugcccccgaaggguuguugugagcauuagaaacguuaaggguuugaaagcacacauuacagaugcuccaauacauagcagaaacuauaucaauuaaguaaaaugccaugagguugacuccuaggaccagagcaggagcaaggacugggucacacuucucugcuggccucuugauaaccauuggacaguagugguucagccacugccucccacugcucuggugaacuacugccagcagccugaaaggccaaggcugggaagaacauucagucagcccaagaggcugcuucugcugcuggcuucugucccaggcucugucugucuccaccgaagugccaccugaggacagcuggacaaaacaaaugacccugcacauucucaccuucuuucucguccaauacucccuguucucugagugggacaccacucugccuggacaaguuguauucgccugccagguucucucccuucccagcaaggaacauccuugcuaguucccuucugguccagcacuacagaacugcauaucuucagggaguaccauucacauucugucaccuuccuggggacccuccuugugggaguugagguuuuggccauucagauggucucaguacaucuccuggccucggaggaaaaauguggcuggaguggaggaugcaugauggagcugaugggagaagaggcuggaagacauggaucggauuccggaggguuuuguauuaauaagccaggugugggcuuuaugccgaaaguagcagcuuguaauaaggaagugauccacuuagagggguuccuguuucuuucucccuuccaccccuaacuccccuuucccgaauuccccaccagauuggcuuuguaccucuuuggcauaaaagguugauuuacucaaaaagcagagugaugcaucuuacacuaaaaaaauccauaacacuaauggugcuucauacuugacugugcuugaugauuuccaaaaagccuucucccuauccaaggaagagcacagcuuuuggaauauugcuguucuuucugauucuuagucuccucuauaaaauacagaauucucaugaggaacaaaggaagcagaauacuucagaaauauuuauuuccuaccaauugccucauuugaucucacaguagcccugugaucccccaaauaaacuauuuccccuauuuuacagaugagaaaacugaggcuuaaagagguuaaaugacuuguccaugcccaugugguuaauaagugguagaaucuagguuagaaucuaauuucuuggccucuucaccacccgcauaauaucaucugcuuugaaagacuaggcuuucugugagcauagcuuagauggauggugaagauuuaccuccacaacuugccucauuugugguaucaccagaaauuguauuuguuuucuuucuuugccaauaacaccuacuuagccacaaacccuugggcacuuuacuuaccugcuccaagucuacguuuuucaucuauaaauuggugaugauaccugguguucugaauaauuaaagggaauaaauaaaguaucucaauguucucaucuguaaacuggggauaaaagcagucccuacucugcagugguugugagaauuagcugaauuuacacuuguagaaggcucagaacgggacucuggcacauucgaugugcucaguaaauguugagugguuuuuaaccaccggaccccagcauggcucacuuuauucaaaagucaucuuucucguuacguggccacccuaucuaaaauuucaccacugcccuuacauacacaggccacaguccccuuccuggcuguaugugcucuuagauuuaucaccaucucaguaaacucuauguuuuacuuuuuuuuuuuuuuuugagacagagucuugcucuguagcucaggcuggagugcaguggcgcaaucucagcucacugcaagcuccgccucccagguucacgccauucuccugccccagccuccugagcagcugggacuacaggcgcccgccaccacgcccggcuaauuuuuuguauuuuuaguagagacaggguuucaccauguuagccaggauggucucgaucuccugaccuugugauccgcccaccucggccucccaaagugcugggauuacaggcuugagccaccgcgaccggccacguuuuacuuuuaaaaacuugguuuguuucguuuacuguguaccaucauauauaaucagcgguucuagaauuuuagcauacaucagagucacuuggaggguuuguaaaaucaguuuccugggcccuaucaggguucaugauucagucagccuggggcagggcuuauuuucaucucuaacaaguucccagacgaugcugaagcugcuggucccuggccacacuuuaaaaaccacguccuaaaagcaugaaacaaugugaaguugcugagauggguaacuagucuuuuuuauguuguuuauuguuucacuccccugcuagaauuuaagcucaguggggacgggaauuuuugucuguuuaguugguuaagguaucccuagcaccuagaaugguaggugcucaauaaacaacugucguguaauuacugauugacugcaucaauauguauaaucugccggcucccucuucuguggucuugcucagaccuccguggcugcuuuuccagccgaggggcagcaccaagcucaccgccgcugaccgccauguuugugcccuagaucauccgggcggccugcagaaccacgcgcggcuccggacgccgccgccgccgcucucgcacgcccacacccccaaccagcaccacgcggccuccauuaacucccugaaccggggcaacuucacgccgaggagcaaccccagcccggcccccacggaccacucgcucuccggagagcccccugccggcggcgcccaggagccugcccacgcccaggagaacuggcugcucaacagcaacaucccccuggagaccaggugcgcggccgguagggagggugaggcugaggagggugggcacccggggcccggaccaaggucuuuggcuggcggggccauucaguguccccagauaacgccggccggaggagcugggguugggugcacgguuuagggaugcgguucccugacugccagcaugggcuuuggaacccgagagacccaagguccagugcuagccugcugauuaccaaaggugugaccuuggccaaguugcuagacaccccccgcaccaaccccuugccucucuucccuuaucuacacaauggccaugauguuugcgggacggaacuguuaaaggagaugagagcuaaugugugaacgaggcuuucacagaugugugaccaacagcaggcucucagucugguuuggcucgggcccucaucuuugccuuucccuacaugauucuaccacccaaugccuagugucagaccugccuggccuggcgucggcacucagcuaugucagucuccccaccucuccuccuucccugcugugcuaccaccuuuaugcccaaagcccuaauaaccccuagcauguauacaucagcuuuggguuacaagggcuuuccugugugugacauuauguaauccucauaccucuaugaaguggguauuaggaugauaauccccauuugggaauuuggaagcugagaaucagagcggguccaucacuagcucacuucacacaggcgacugaggcacagcugaaacuugaacucagguugccugacucccuguccagugcugcuucaccuacaccccagccaccuucucuucgucucugcuggccgggaucccucugcccuguuccuucuuccagcuuuguuggucagugauuugucagcucagggacaucagucuccuugaguucuguagcuguucuccuucccucugccuacacacuguuuuuccaaaaugaaguuuguuuaugauuuuaaaaaccauacaagcucaccggagaaaaugcagaaaacuaugaagacaaaaauuaagauuuacccauaauccuaccacucugagauaagcgcuguugacuuugggagcauagccuuucccuuucucuaaacuguagaugaaguguccuaggcuggcaaaacuggaaccacuuuaucuucuacccuacuuccuaaaguagugggaaacguagauuuuauuuccccaaacuccuguucuuuaucugugaagagaacaaaggucaucccacaguuaaggaaguaaaauuaaccugcaugugaaaaguguggacaugugacugccuagcacacagcuaugguaauggcacaucaagcuuguggaggccaguaagagaaaaugaacauuguuuguaccacuuuacuccuguagaauuguuuuuccgaaagcaaaauucuuagagaugcagcccaagcagcuuccccgcucccgccuccagucucuuaauuuauauuauuucuguuggcauccuuuaaaaucgugugugauuuuucccugugugccucaucaguaacagaguaggauaauugugugucagccugcccaggguagcuuaaucagaucuccauuauuuccaaugugcucauugaaagaccgaacaugacuggaagaagccagccacuaaucgaugguucugaugcucugcauggaccacagucaccacucccucugcuuggauguucaucuuucccacuuaggaucaaguuagaacuuccuauucugagucuccagguuuuucaaggaaaggaagauagaggaugagcagcaaggcgguuuuccuaaugguuagugugaguuguaaagguggucccagcucacgucuccugucuuucugugcucaccugccuuucugauguucuaucuucccacauccauugcucaaacacaugcagcuuuuucuuuuuauuuauacuuuauuacucaaauaagaaauguucauuguaaaacagcuagacaaugaaauaagcaagaagaaaagaaaaucauuuuuauuugucaccaaaaguaaccauuguuaacauguagguauauacucacauaacaccauuuuauguacaucuauauacauauauaacauuauuugugauauauaucauauauauuuaauauucaguguauguauaugcauguaugugcauguacauguauuucccccaaugcgaggcccuuucaugccuuuucacagagucuugcagagcucugccagagucgcucaccuucucacuucguggucuauccaguccuacuuauucuugaagccccgguugaaauguuugaggaagucuuccucugugaccccagaguccugucccuccaaggaugaccuaaagccggaaaaggugcuuaauucagugaauacacaaucagaauucuagaucuugaugcugaccuuaacugguugaaggcacaaaacuaacaaggcacgguuuaggagggaucagcaucaagucuggcagacugaaucacaagcugaccaccuuggcaagguggacagaauauggccuucaaagucagagggaccuucauaccugccuuggcuuuaacgcuuacuagcuggccaaguucccuaacaucccugaaccuugauuuccucaucuauaaauugggauaagaauucgugccucucaaagagguugggaggaaguaaaugugauauauaagaagcacacagcacagugccuagcauuuagaaaacacacucuaaaagcuauuucccauuuuuuucauauacaucuucucuccauauccacccuguggauaaaaaugucauucaaaaagaguuucuugagcuccuacucgccccaaaggaguugaggggaaauaguagguucuaccucuucucuacuucagagaaguaaguuuggccuuauguucugaggguacaagugauggcccauucaccauagugaguuugaagcaccgguuuuaggaucagacauacccuauccucagaaaccccacccuagugcucacuagcuauggaccaagaccuucaauuucaucucuaaaauggagaaaauaaaagucacuuucugcugugauuaucuauugcugcacaacaaacaaaugacuccaaaauuuaguggcuuuggaaacauccaguugauuacacuucacagugugagucaagaguuuaggaagagcucagcuaggcuauucauccacuccacaucgcguugacagggguccacugguaguauucagcuggcaacuggacucauuugaaggauccaagaugacuucacuaacauaauugacaucuuguggggggauggcuggaaagcuggucuuggcaguacccuucugucucaguccauuuaguguugcuauaaaggaaugccugaggguggguaauuuauaaagaaaaaggauuuauuuggcuuacaguucugcagacuuuacaagaaauaugacacaagcaucugcuucuggugagagccucaggcugcuuccacucauggcagaaaguaaaggggagccaguaugugcagagaucacauggcaacagagagagggguggggaggugccaggcucuuuuuaacaaccagcucuggaaggaacuaauaaaagugagaacuugaucuccucccaaggagggcuuuaaucuacucaugcaggauccacccucgugaccgaaacgccucccauuaggccccaccucuaacauuggguaucaaauuuucuuucuuuuuucuuuuuccccccccccccgcuuuuugagacagagugcaguggcaugauccugacacgcugcagccucaaccucccagacucaagcaguccuuccaccuuagccucccaaguagcugggacuacaggcaugugccacccccaugcccagcugauuuuguuuauuuuuuguagagaucaggauggucuugaacuccugggcacaagcaauccuccugccucggccucccaaagugcugguucuacaggugugaguuaccgugcccagcuggguauuaaauuuuaacaugagcuuuggggggacaaacauccaaacuauagcauccucucccucuaagggccucuccaaauaggcuuccuagcaggguaauugugcuucauacucaguggcuugcggcuccaaggcacugagacaggagcuauugaugcuuuuaaggcuuggccugaaaaugcuauagugucauuuccuccauauucuguuagucaaagcagucauaagcuggccagcuucaagaggaggagaaacagaccccacuucucaguggaaaaaguguccaagaauuuguggccaucuuuaauccaccacaccaccucauaaggcuguuguaacaaacauauuaagauaaugucugaaaaugucuuagcauauaguaaaugcucaacuacuuauuauguaguguuuuauuauucaauaaauauucacugagugucuacuaugugucuaccagguaagacauuucagagaacagacuccuauaauagaauaagugcuuugauagagaaaaguacaggaaauaaugcuacuuuuuaauugcccugagauccccagcacacaacacagggcuucccacaacaugguagcuguuugauaauuauuaacacaggugaaauaaaugaaugaauauguauacuuaacugagacuugaguggggagaaaggaaggcuuccuggaagaccugguacagcaugacugagaagagcaagcaggagucucccaggcagaggaggggcagaaaggagggccugagagggcacagucugagcagaggccuagcggcccaacagagcagguugggccaguccccaccagaaugggagccuaaacagcuuuugccaguccccaccagaaugggagccucuugauaucagagaaauagucacaggcccuucccugauugucaaacucagucuguauugagagucuagaauuaauggcugaauaaauacuauaacagcugguagaaugaccaagagggauuuagauuucaugcuggcagaaaaagaaaggcuagcaggaggaugaagaagagagagggcuuugguaaaugugcuccuuucucugcaccugccauacuucuggcagucuccaauguuaacugagucccccauugaggagccugggccuaccugugcucccuuugagcugggguaagauguugcuuuaagcuucuauaggugcaucugugauccauucuggagggagccauauguuuagggucccccaaacccugauccacuucuuuugcacucugcagcaucagacacuuaauugauuucccagggacugucugauuaauaacccaucagguuccuguugggugaggggaagucagagcagaaggcugccagaccuuggcuccagcucaucucaucucaagccugguagggaagccugggguccauuuuguggucacacugaauuuggggaaaaacccugcccacccucagggaugggggccauccugguggucuccagaccagcccuagugugguucccagaauggcacacacagugccuucuggcaggccaggucagccccagagcguugcagagaauugggauauacagucuuccuuguaauuuggugauucagucaaagacaugcagaagacacagccaacuguuauuaagaagcucaccgucuuuugagggagacagaccuguaaaugaaugaggacagguaccaugacugauguugugacagagggaguccucugagcagagaagagagcaugguucccucugcuugggagcagcaguagagagagcccuuacugggaacggccaggugcuguucuaaguucuuggcacauguuaacuucauucuucacagcuauuccauaagguggguguugggaguccccaggcccccacccccagguuugaugauuuacuagugggacucacaagacucaacacguaguugaguauagguguuaauacucacagcccugguuuaucacagugaaaggcagaaaagcagaaucagcaaagggaaaagaagccugggguagacucuggggcaaaccaggcacaagguucugggguccucucucaguggagucacacaggacgcacuucauucccccagcaacagguugugacaacgugugaaauguugccaaucagggaggcucauuaaagccugagcuccaggguuuuuacugggggugcucaugucggcacccccugcccggcaaguaccuggauuccagacuccccaaaggaaagcaguuauucaucauaauuguugaggcacagugagccagccacucucgucaguuaaugguggcaacucuccugaaaccugaguucccagaugccagcccagggccacuguuauaagaaggcauugcaaaggauagcagucagggcugcugucuucacucuucugcgcauguagguagucauauucucauccccauauuagagaugaagaaucugaagcacagacaaguuaaguaacuugccucaggucccacagccaguaaguggcagaaccaggguccauccccaggcuggcuggcuccagggcccacacaccuaaccacuaugcagugccgucuuccugauuguucaaaauagcuucuccaggcauaaauugguaggaguuugcaggggagaaaggaauuuuuagcugagagauaggcacagagccaggagagagcuuggcauuuuggagagauggcaaguaguuggcucaagcgggagcacagggagucucuugaggaugagauuaaauggagaucagcaauggaggaucuugggcuacaugaaaaggagguuguacuuuucccugugggccuggaggcuggggugguagacaugagggugaauagcuagcaagagcuuuuaaaucagaaggugccauuaugggauuggccuuuuagaaggaugaccguggcuuggaagaccuggugccugguucauuuuuuuuuccauucauuuguucagcugccagccccaucacuaacucuguguggucuuggcugagucacuaacccccugcacaccuggaggucucagcuacagaauauggggugugaucccugccuguccugccccaguagguaguugugagaaucagaggcaauuguggcugucccguggcuuuguggguggaaacacggcccaggacagcgggcucacugugagagggugaaccguugaucagggcgguccugaggaacuacuggccuuugcagcuuccuggcuacuuccuucccaaaagcccuuugcucugcccuugagaggugagcucagccugccuuaagucagacacaugggacugggagccccuccuacaggcaguucaggggcuaguccaaggccuccccacaugcuuagagggaaccagucuauccccucuuuaagaacagcccaccacuuagcugaagguuccucuccaaguacucaggaaccucuuuccugagaggcagcucagggcugugaggucagagagaucugguuuaaaucccaucuucaccuaauuuuuccuguaugcugggcacuuaaccuuucugggccuuaguuuccauaucuguaaaaugagguaauagcacccaccagugugagggucaagugaaucaggugcccacacuugagcucucagcagcagugagcaggagacccugcgugacuaugacccaaggugggcucugcagcuuaggguccccaucaagaaaggugggcauuuguuucucagaagaacuagacaccuagaguuuuggggaguggguggauaggagauuugaggggagguuccuuuaacuggaagucagggugccuggguuuuaguuucagcucugccacugacuugcuaugguauggguaugagggcagggcacaugucucucugggccucaguuuccucaucaaucaaaugacaccaaguaauuugacccagaacuaaguuuaaaaguacagaacaagacuauuucguuuuuucuuuuuuuuuuuuuuggagacggagucucacucugucgcccaggcuggaaugcaguggcauaaucgccggcucacugcaaccucugccuccuggguccaagcgauucuccugccucagccuccugaguagcugggguuacaggcacccgccaccgugccuagcuaauuuucuuguaagagacaggguuucaccguguuagccaggauggucucgaucuccugaccucaugauccaccugccuuggccucccaaagugcugggauuacaggcgugagccacaacgcccagcagaacaagacuauuucaaggcgguaguagcauucugaauagccagaauugucuucuuuuuuuuuuuuuuuuuuuuuuuuuuuuaaggccgagucucguuggaccggacuggagugcagaggcuuauggcagccucagccuccccggguucaggugauccucccaccucagccuccccaguagcugguacuacaggcacguggcaccaugccuggcuaguuuuugaauuuuuuucuagagaugggauuuugccauguugcccaggcuggcgucaaacuccugcacucaagccauccaccugccucagccucccaaagugcugggauuacaagugugagccacugcaccuggccaauagccaacauuuucagcaagugcucaugucucuccaaauuccagagagaucuaaauaauuaauaugcacaugagcaugaguguggaagcucuuucaggagacuggggcacccucuuacucuagaaauccuuuacucuguugcaucaccucuuccccucuccuaacagaucuguacuuuuagaagauaauuguccagucucucuuuuuuuaaaaauaacuguuucuuuuuaaauuguaaaaguuaaaaucagaaucacuguuuuuccagucacuugaaaauccuuacugcuaacauuuugaucuuuauccuuuaugucuuuuucucugaauguauuuuuuuguuuauuucugaugguuuuaagguauaaauuugacucuguaucuuaaaaugggaucugagccuucugacucaagccagacucccaggucuucuagggagcaugccaugcagccagccucaggucccggggggcagcaggaguucuuccuuggaccugcucaugcuguagagagaguggacaguucccuccugaaaugcagggauggaggaaacaaucagaaugccuucugcugccaucuucaaugaagcacugacuaugugccugcuguaugccgggcaugcuucccuuuguguauccugaauucagcaguauucagcacauauuuauugagugccugcuaccauguaccacauauuccucuagacucugggcacauagcagugaacaagacagauaagacuucugccuuguggaacuuaaaaugcauuaggaaaaagcacaauaaucagauaagcauauauauauuggauauguguguguguguuuaucacuuccuaaucacuuccuggccccuugcuccgguauugcuuuauuuuucaucagaaagagagagagagaaagagaggaguguguguguguguguguguaugugaaguccugaaaaaucaguacaaggggccagggagugauugggaagagugggcugggagcuauuuuaguuaggguaagaagcuaauaguugaggaggggaggaaggagguuauauuccaugaagauauuuucaggaggguucugauucauaaagauaguugagggaggcagaggaaagccaagguuuagcuuguuuaagaaacagcaaggagaccaguguaccuguagcauagaaaaugaggcuugagaaguacuagaggccagagcuuauaggagcuugugggcccugguaaggacuaugguuuauucuaaaaugcuuaugaagccauuggaggguugagagcagagaagugauaugauccaaauuacacuuuggguuuuguaaaaugaacaauuauccccuucuguggaugcuuagagagauugggucaccugcccagggccagugaaugaugauuaugggaccugaagcuagaucugucuggccucagggccuguaugccucccauugggccaccaggccucccaucagcaggguuaucugccuggugauggaaauagagccacucugagggauguccacaccucugaagcuccucccaggcacuggggaagacuuuaggggcuugcacaccagcagaacagacugccacccaggccgcuggcccagacagugcuucacgacucaccaaaagaggagguccccaccaccacugcauacucagcacuguaccugcaaauaguguugccauaugcuuccacugucccaagggauguuaacgaaaggggauuuccagauaguacuuacagccccuccucguuugggucuuugaggcugaccaggggcaguagccacaaagcugugcagagagagacaggguuauaaaguggagagagccugaguucuggggucagauaaccccaggcuccagcuuggcucuccacuuguuuaugauauggccuuagaaaaguugcuucuacaagcuuugcuuugccaaucuacaaaauagagaugacgguacugacuuuguaggguuauugugaggaauaaaauuuaaauuagauaguugcagagcuucuggaacaauaaauaauaugugguagauguaggguagguaguaacuauuauacuuagcauuaguacuccuauaauauuuguauagcccuuaauacuucuuccaccauuaucucagccgauccauauaacaaccuugugagcucaguacuguaaucccuuuuuacaugaagaacauaagauaaagaaagguuaaggguuauacccaaaguugcacaggaagagaguggcauaaaagggucuugaauuugggaaugcuggcucuaagaccuggucgaagucagaaagaagguccuuggcagggcuggguccaaaguuggcuuucugcagucaguuccuuucuugggugcaugcaacaggcugaagccaccacuggauuguuacaaaugauucaccacagagucugaaagugaggugauagcuguccugaaaagaucaggagacaggcuccagccuacuugagugugaaucaugucacucagcagaccugguugagaccaaaaagggcaaguaugucugucuucauucuggguuagaaauagguaaagucacaaaaugcuaugcacuuggggaacaaagagcauccucuuuugucuuccguggagcuccauccuugcuagccaguuaucacccaggucccugcaccgcuaaaggacgaugauccucugaccauggucagcauuaaccugggggccugggagaaauacagauccucaggccccacccaaccugcugacagaaucccuagggaugggccucagcaaugcucagcucuccagaaaguuggagaaccauggcuuuagaagacaguggccaaaaaugcuaacuuuuuuuuuucuuuggacuagccaaaugagugucucuagccacuguuuaagcugauguaagcagccucaaguagagagagagagcacaggcuuuggaaccugagcucuaauuccugcuuugaacuuugcuagcuggugaccuuggcaagacccauuaccucuccacaucucaguuuccucaccuguagaaugaggauuacauugccuuccucacauagccauuuugaagauuugagaggcuggauguagcauaccuagcucagucccggacacaugucaguccucuccagugagaacugugauuugaugcacacaacugccaaaccuuguuuuuauauagacaguauucucucuggaugcucugugccagguggaccccuugcacauguggcuugcacacugacccauugccuggaaaccgugucccgcuggucuuacgcacacagcugcaccaaacagccacuuuguguguuucucuacuagcccccuucaucaaugcaugacucauugcuucauucaugucuccaugugugcguagaaaccuaggcaagcagccauuccuagggacauugcaggacaaccucauugagauggacauucucggcgccucccgccaugauggggcuuacagugacggguaggugacauccccauucuccucucugugugugcucuccuuguggcuccugcacuugcaugcagacccugagaccuuucccugggaucuucugggggaggugauccauguggcaugcucaucaccaaguccguguucaacuugcaacaguuuauccuuuaaauacccuaucccccagcauauuaacagcagucuuguuaauaugcagcucuuggcaucucauuggcugccguugccauuccaaaaccaucucacauagcauuuuuaaugcagcacaggcccuguauuguauggacucuggcccugaguguguauucugugaccugaggcaccuuguaccccaauagggguggguuugcccuaaggcuucugggggguacagugcaaccagcacacuccauuucccaggcugugugcaaguccucccauggccaugguuaaagccaagcuguggaggagcuccugacaccuaguuuggucacaaccaugugcuuugaccauaccccgcugcccucaugacuaggcuguagggugcaguugccugucugucccccgacacagcuuucaccuuggacuugggaggcagcagucuggcuucuggacagagugcuuugaaggcauuugcugccauuggcugugugacagccacuaggggacuaauggccauggcauaacuuaguggugguuucuuggcuucaacaccaauaaaacccccuuuaaaaagaaggguauuccaauccucaguugagauacaccggcaacagaagcauuggagggagaagaacaauuuuaagucucauuaucuccaggguacacaacaggauuuuagauccuuuccaaguuacuguaauaauuuuagagaauaggaaguuuauuccccaagaaacaguaucccagccccauccguucccaggaaaaggaucucagugccagccuucuguugaguugguuaacaccuucugccuugccguggguggguuuucccauggguagggcugucccauccguguucaguggaaacgugucucugugugcccuguuccauggucuaguccguagcucuccuuguuccuguccuuucccaggucucuguggugacucucucuauccaggcuccucugcaugcuucuucuacugccgccucuggccuccagguuugucugggugccuggucugugggcagccccugacacccucuugcugcucuccaucugcaggcacuuccucuucaagccuggaggcaccuccccgcucuucugcaccacaucaccaggguacccacugacguccagcacaguguacucuccuccgccccgaccccugccccgcagcaccuucgcccggccggccuuuaaccucaagaagcccuccaaguacuguaacuggaagugcgcagcccugagcgccaucgucaucucagccacucuggucauccugcuggcauacuuuguggguaagcaccucuucaccccagcuccccuugcuccucuuuggcccagagggcagcaaccaagacacgugugggcacugaaggcuccuuacuagcauggcaggcaaagcacgcagugugagccaggcagcccuggaguucuggacagucugcaccccugacacugcaagggcagcucuucagggcccuccucucuuuccucuccaucccucugcacuuauaucaggaaggaagcugggcaucuguccuuuuguguguugggugccugguauuaaggcgugagugcucaguaagacuagccuuugagauggggaucuauggcauaagugucauggauugagucaauacaacuaaaugacaaguuggagaggcugaacagcagguagccucuccuguugggacuguguggcugcagugaggagcaggaaggagguggagcacccugggcuuggagggaaacuggcaggaaagcacgucugaagguagaugucuggcaaggcagucugaggguauugugggaaccaagguccagaguuaaaccauggucaggaacccagggaaauucugacugagaagcagaaggucccagccagcacagagagcagagaacgcuggcugagggcgcacagacacggagcagugcucaccugacccugggugcaaacacagauauaaggagcuccucccgaccucugccuugauacagcagauggcucccccugugcagucuucugaugaauuuguaacacagucugaccccuuccuacuucugaccccuugcuuuggucuuuucccaggaaagauauuaauccaaagagaucuguggguguuguguagcaucugcugccucuauauaaaucagccucuuaguaaaggcauuggaagggagauuggcuuaacccuagagguccuuuccuguaauucaaaggcuuaagguagguugggccagcuugagaaggccucgaacccaugcuaaggaauucuaagauaauucugcaagcaaaggggacuuuuucagcacaagcccaguaaacagaaauagaacuaacuggcagaggccaaaaaagacagugcugcccacugugaaaaagaacuugguaaccagcaaagucacuguggcugaacaggggcugucuugagaaguaguaagaggugucacuaagaaugauuaauacaacaugggccaucacauguucaagagauagagaagugguucaagcauggaugggguuugaguggcauaagcuguaaggucaauuccacucaagauucuugaauuuuauaaaaauaagugaccaggaagaugacaguccugcaaagagggagguccccuucaauaucucaagcuguaauaagccuccucuggcaugucaggucucuuuuccccuucugaauauuggcuuagacaauuccauggcuccaaggccaagguggcaugcaugucaucucuucuucugucugauuguuuaguugcugcugccuagaaugcuguguugaggaagauacuggggcuauauuuaggcucaauguaagagacuaucugugauugauuagugaugucuguuauggucacagaaauggagaauauugaugacaugucaaguauuugccaucccugcuaugggucauuguauaaaugaaacagccagacugggagaggucaaggccuacccaggcucugugaggugcaucguugauauagaguggguuaccaaugaggguuguauaguuccaguaccauuacuuggcaugaagguuucuucuggcaccacgaauaguaugucaccaccaaccacuggcacagcucuugguuuugacuaacauuauuauuuuucauaagugaguagacuucuggacaggcagucauaagucauaauuugaguaguuugcugcuauacacauccauuuguuuugcguugaagucuuaagguuuauaucauauagccuaauucagugagaaagaguaaguguuuacaugauuaaucaaacucucuccuguuuuccaucucauggcuucuuucucucccaguuaauaagaauacaugauuagucuucagcuauuuaaagauaggggcaacugugggaauuagugagcucucugucugaggaaggauacagauagagcucagggaccacuuagaauaagauucaagcacugccugggaguuuucacuggguaaccuuuaauuuuccuuccaacguugacagucuucaaauccacaauuuugugaauuuuauuuuucacucagcaaaccauauggaauaccugcuuugagccaggcucuaugcuaagugccaggguuaaauauauagucacuacccuugagguauucguagcuuaaaagaagagauagcuauguuagcaggcaaaucugaaacagugacugauuuacacagagcucagaggcugugggaauacccaaccccagccaagaggaguagggaaggcuuccugggaaaggugauguuugagcugaauuuuaaaguaggcauuagccagaaguagacauacagaaaggguauuucaaagcaagggagcuuacaaagacuugaaagaggaugaugugguagcaaagauguuuucuguguuugaagcauuugaggaguguggggugcaccguuggagcuaauacagaaguguuucaucagauuguggagaucagcuuggaggacaaguugaggaccuaauugggugggcaacugggguaccacugaacaguuuuaagcagugauaggacacagauuuuuauuuuagaaagguaaggguagaggaaggaggaguagaagcuuaccuguugggaaacuauugcagucaacuagucaggaaaagcugaucgcuucaauuacaacacugacaacguagguggagaagaggagguggauggaaggucaauuuugaagaauuugugucuugagccaggaauggucaguucacugauaguguguccuugccaagaauaacacagauauuucuacacagauaauauugugucugugucgaaauacuuggacuggaugcuagggcucauauacaaggaucaagccagagaggcaagccugggcauucccuuuguuuccuggagagucagcaagguguuggggaagagcuuacaccuaccaugacagcccuggauuccaggcccugcucuaccacacagcagcugcucacccuugggaaagucauuucucuuucugaguucugauuugcucaucuagaaaauaggcacaacccauaccucagaaggaugcuugugagcuugguauaagccaacgcaggugaacgcguugcaggugugcaggccaucccacccuugcuucacaagcuaggggguagcagccuuauugcuugcucuccugcagcugcugaggacaaggcauaagcaucuuguugcuuggccauaauuacaggcugugacgacuaacuuggaaggaacuaucaauuauuaaaaaucaaauuaauugucucagcugagcacaaauaucccuaacaaagacccuuuuccagcagaccaaccgaucuaaucaacaggcaaaagcacagauauuuaauuagauuuuugaugaaaaauuguguuuaauuucaaguauaaucaauuauuaauuacuguaaugagugagucugacuggguuuacuaauuaacucauuuaagaauuaugaauaaccuuuucauuuguaauuauuuucuacauccuaucagguuccagauaagaauugcaucagcucaccaccagagugggaggcagaaacagaggguggaaaauaguuuuucuuuugcuguuaucugccuagggcugucacgucugguugguaauccugacagauucauuugacauuuaguuuguuuguuuguuuguuuguguagagaugggggucucacucugucacccaagcuggagugcaccggcacagucauagcucacugcagccuugaauuccugggcuccagugauccuuccaccucagccucccgagcagccgggacuacaguugugccccacugcaccuggcuacuuuuuaaauuuguguguguguguagagaugaggucuaauauguugcccaagcugccauaaacuccuggccucaaaugaucuuccugccucagcuucccaacaggcugggauuacagguaugcggcaccacgcccagcugauguuccauuucuuaguuagaaagugucuugagaaacuugugccaccagggacauuucaauuacagauacauuuacagguauuuucaugagaaaguagagacacuggagucagcacuuaccaccaacagagacugcggaagccagaggcuugcccaugggccaucuccuccucuccugggagugcuacuuggcugcucuggccugagcugggaauccagggaggacccucacacagcugugggaucucuucagagagaaaauauguauuuuugucuccaaaggcaccaauucagaaggacagccacugaggaugaguuuacagugcuuuauucaccaguucuuccuaguacaguucucagguccuuguuagucuccauuugaauacccggucuuuucuuuucuggagaaaucuguuggcagaacacaaugggggcuguugugcagguuacaugagaugaugucgaaaggggcaaugcuaguuuuaggucagacccugaagcuuguacugccaguuguuaagcaauuaaaugcuuuauuguauagcauuuaauuguuuuuaaaacauguuuagcaaaaaaggugugauauagaguaguaaaaaucacauuuggcugcuguuuaucauucauaaagagcaguuaguuuugauuguaugcuguccacgugcccuucuguucugagcacguugcuuguguuuccucacugaaaucuccuaacaaucaugaguuauuauucgcaauugacagaugaggacacugagcccccaugagcuuaaguagcuugcccacuguugcaugguaaauguuagggcuaugauccucccaaccacaggcacucaagcucuugagcugaugcuuucgaauuauuuucucuuuugagcucacacuuuuaaccuguaugcuguaauucucccaucuuaauauuuggcuuuuugaauuuuugcuaugugccuaguacugggccaggcccauuacguguaucauuucucuggacccucaccacaauucugugggaugaguaugauuuucuguauuuucuagaaaaggaaacuaaagcucagagaaguuugcaacuugccugggucacauagccaguauaugacauagcugggaugcaaccaagacuugggauuucaaaggccaugcuuucagccaacuaugcuauauaauagcccugggcuggaacagacaauguagaaucaaaagaucucaccucagacccuggcuguaucacuugcugacgguguaaacuugggcaguuugcuuaaccucucugaaccuugguuuucacuuuccuuauggaaguggcuggaaagacugucccauuuuauaggagagggaaccaggagccgcaugaugguugagagcauagguucugaaauuaggcugccugcuuuuaaaucucagcacugcugcuuccaagcuuugugacauuuggcgaguuuacacaaccucucucugccucaguugcccuaucuguaaagugaggauuauaauagugguuacuucacaggguuggggugaaauuucuguaagauaauuuacaagaaguaccuagcucacucccugacacagagcacucaguaaaaguuagacacuacuguuguuaaaaguauuauuagaauuauuagcaucucauguaacagaguauuaguuacuccugagugagaacuuggaccuggcuugucucacugcagcaccaacaggcuuccuggcccguguuagucacaagggcagcugacagaacaaccagggggaccugucagaaaacauuuguagggaugucucacuguuccagcaaugcagccacaagaagaaucgucagcugcaaagcagcucacaucauuucucuaacuaggacaaaacuugauuugugauucacuaacuguugcuucugugcagauaaaacugacagcuucccuuguguucugaauguguauguaaaacgcagacacugcgugcugcagaagagccucagauuaguaacuugagguuucuucaagcaccugucuugccagguaggccuuuggaauaggagacgaaaaaggcuuguuaauaaaucuaaaaugaggagcggcuuuacauuuaaaugaagaccugagaggacacugguugcugauugcuguaucaucagguccaggucugcccugcagggcaguggcgccauuuucugugauuucucuaaugcagcgugggguucucaucaggaaggaagaugggauuuggagccugaccaccuccgcagaaaucucagcacugccacucuccagcuguuuagccauuugauccuugguuuccucaucugcaaagugggaggaauaauaguauuacuuucauaaggcuguugugcagguuaaaugagaugauguugaaaaacgcaaagugggaggaauaauaguauuacuuucauaaggcuguugugcagguuaaaugagaugauguugaaaaacacagagcaugugauaaaggagaugucccuuacuggucgccuugggagaugguuguuacccguccuuggaccucacccacaguguggcaggaguggauuguccuguaagguccuuccuagucuguauuucuauaucucuaggaaauugcaccaggauauaaaggguggagucucagaugugggcuucugcaucuucuggguaaccacaguggaacauuccaauuuguguaauagcaaugagggauccuuucuuaaauuagguugcaucugcauuuuucaacugcacaagaaggacugauuguggaguacaaaaaaaaaaucagaacccuugcuugaaguggugauaguuuaauuuauaacugagaauguugcuaagcuuaaugcuuaauugcugcucuucaaaaggcagcuauuagagagcuuugcuuguuggaauaauauugcaguucuuggucuggaagacccugggucaugcaguucuugaggcuaucuaggaaauggugauagaggugaacuugagcauuaagugcaaguugcguagagugguauagacugucaauaucucugacauuucaucauacaaacuggacuucaguaugguagcaauucaguuagaagacauauuagacuucccuucuuuuuaauggaguuucacucccccaucuccucuugucuuacucucugcuuucacauacucaaucccuagcacaaagccuggcacaagguaccugugcuaaauuaagacuugguugaauaagaggccuugcaaaaugguuaagucugccaaggguacucuaggcagaagagcagcaugggcaaaagcaugguggccgaacuguguauuuuauguucuggggcuaagauacaggugaaauggacaugagauguguagagaaagaauuacagauagaggccagggugaauuuauccaccccccaacacccauucauuuccaucuggcucagcucauacaauaucaggaucucagaugcuguugccucauuagcaugagccuauuacacuugggccuagguguuauuugugugcaguaaggcucauuuucccuccuuucucuuugacuucacaucaggccuuuuggacaggagccauagauuuaacuuuauagcccaaagaaugggaaauggagaugauugaacuuggucuuuuagaaggaggaaaaagugauaaagauacaggauccugcauuaacgccuucucucuccaagaucgauuccuucaugcugcucugugggaauugcuaauagcaagauauauauagguuguucucauuauaacaggccacagacagauaucuuccagaucccuaaaaggaagacuuaggagaccagcauggcucucugcaguugucugaaaugcugacgaagggagaagggaccaacucgcucugcagggcugaagagggaagaaaaugaacguuuuccaguuugcagagccuccccaugauagaagaguuugacagugcccuuccuggcaauggaaguauucaggcagcggguuaugggguuugucauuugaucauucauuugcuuuuaauuugaggagaguuuaagaagcuggguacaaaagugagggcagugugucaaggaaugguacuacccccuggcuaaugguucuaggauaccaugaaggggcaugaaggggcaagggggaaggagggguuacuagaaccuggagaaguuagccagcugagagugcugcuugacauggauguauggucuucaauagaggcauggcggugagggagccggagaacggaaaucuccaccucacucucuucccacccugacaaccuccuccuggugguggaacccaaccagaagucacagcucaagggaaccauugauccaggccauguggaccagccucccagggcacagagcagggugaaaaaggauagagagugaguguggaaggcagcgggaugacaucugucuuccccugugucauaauuccuuucccuagccaugcacagggcucugacugugcucuuagggaccuaacuaggauugaaaccccagccacugcucagacauugucccuuaccuuugcacccacucagccaccaggcccaggccacuuccuucauaucagauuuauugagauauaauguacauacagaaaauuaacacauuuuaaguguacuacuguaugaauuuugacaaacugguagaguuacgugaccaccaccacagucaaaacacauaaccauuccaucacccccaaaaguucccucaugccccuuugaagucaaccccccucucauucucagccucuggcaaucacucaucuaucuauucucugucucuguaguuucaggcacuguuuuugagaaauauaguaaagaagugauuuauuuacuggcuuuaaaaucagauauuaccuaaaauaaucuccaaacucagauauuucaguguuguugagaaauuuuuuaagguaucauccagaauucaagauacuggggcaaacaacagaaacauucugcgguuuucuguguguuauccuugaccuccauaucauggcucauaguuucugaguuugggaaugugucaaaaagaaaggacccacauuuacucauauauucauuuuuaauaacaacagcagccacagccucagcauagucaguguggauaaacagcuuuauguccuucugccuuuuucacaggccauuuuuucuuucuuuuuuuuuuuuuuuuuuuuuuuuuuuuuuuuaguauuuauugaucauucuuggguguuucucagagagggggauguggcagggucauaggauaauaguggagagaaggucagcagauaaacaugugaacaaaggucucugauuuuccuaggcagaggucccugcggccuuccgcaguguuugugucccuggguacuugagauuaggaaguggugaugacucuuaaggagcaugcugccuucaagcaucuguuuaacaaagcaaaucuugcaccgcccuuaauccauuuaacccugaguugacacagcacauguuucagagagcacgggguuggggguaagguuauagauuaacagcaucccaagguagaagaauuuuucuuaguacagaacaaaauggagucuccuaugccaacuucuuucuacacagacacaguaacaaucugaucucucuuucuuuucccugcauuucccccuuugcuuuucgacaaaaccgccaucgucaucauggcccauucucgauggucgcugucucuuuggagcuguuggguacaccucccagauggggcagcugggcagaggugcuccucacuucccagacggggcagccaggcagaggugcuccucaguucccagacggggcagccaggcagaggugcuccucaccucccagauggggugguguccgggcagaggcgcuccucacaucccagacagggcggccggguggaggcgcuccccacuucgcagacaggguggcggccgugcagaggcgcuccucaguucccagauggggcugccagguagaggcgcuccucaccucccagacgguguggcggccgggcagaggcacuccccaccucccagacggggcggccgggcagaggcacuccccacaucccagacagggcggccguguggaggugcuccccacuucgcagacaggguggcggccgugcagaggcgcuccucaguucccagacggggcugccagguagaggcgcuccucaccucccagacgguguggcggccgggcagaggcacuccccaccucccagacggggcggccgggcagaggcacuccccaccucccagacagggcggcugccaggcagaggcgcuccucaccucucagacggggcggccgggcagaggcgcuccucacaucccagaucggguggcggcugggcaaaggcgcuccucacaucccagacagggcggcugccaggcagaggcgcuccucaccucccagacggggcgaccgggcagaggcgcuucucacuuccuagacgggguggcggcugggcagaggcgcuccucacaucccagacgggguggccgggcagaggugcuccucacuucccagaugggguggccaggcagaggcacaccucacuucccauuuggggcagccgggcagaggcacuccucacuuccuagauggggcagccaggcagagacgcuccucacaucccagaugggauggugcacaggacauuuuuucaugcaaacauuuucaaguacugacacaauucucauucuugccaaguguaaaagccauuauauuugugcuauuacuguaucauuguauuccagcuguuuccaguucuuuggcauuauaaguagcacuucuguaaacaucuuugugccucugcucuguuuucuuauuucauaucuggauuauuuuagaaaggguguauuccccagagcaggauuccugggucacaaggcgugaacagcucuguuacucacugcuagauccucuucagaaggguaggacugaacuucagggcucccauccagguauccaauuuccccacaguccugccagaagaaaacuuucucucugaucuugggucugccaguuuaauuggugggaggugggcgcagggucacaaguggcucugagaccaaaaaaggcugaaggauuccugaagagagcugcccaucaccuccuaccccacuucuaccaaucaguucuuucucaagagcuuagcucaagugucgcuacuucagggaagcaucugugagccucuccugcugagccaggaacccaguucuaugccuuuauggugcuuguggugcuccucacaauugcugcuaaaugacugugacguggaucguuuaauaucuguccccagcauuagauuaugagcuccaugagggccgaaaaaauuuccgucauacuuaguaucauagccacagcuucuugugccgggucuggcgugauguugcauguguccagcaaaaguuuguucaaggaaagaaaggagggcaggaugacaagaucagaacccaacagauguugcaaggcauggagaggggagaaagaaaaaggaaagaauagagguuccaaguucucacagagaucaaagguggaaaguguauaucagugagugaaaaauggcugcucgaaacuauguggagggaaaaccagaggagacaaagccagaggcggcugcugaaacauagccggcacggggcacaggcuggcuuugcccuaacugcucaucugcuccuaacuacuuaugacucaagcaagaaguguacucuucccagaccucaguuuccugacccaugaauguagauaagaggcugcuguggagaugaaaugauucucaggcaccuaguucuuaauaguaagagccacucauaaaugaaaucugccugccccuucccccuggcaaacaagauguguugaauuugagggccaagcaguuucugaguuuggaaaugugucaaaaagaagggacccacauuuacucauauauucauuuuuaauaauaacagcagcagcugcagaaacaacacacucuccuagggguuggaggcccugggggcaauuuaaagcccccaggggaggcagcacagccaugguuggucaggaaggacccccaacugcaucucugggugcuccuuuuacaacauugcccagggaguauggaaaaggaguugauuuuauagauuuuuagccuucuuggaaaggaauuuuccccgucucguuuguauuccagacuaauuacugugaaauaacauaauuuaauugcacuuaagugcagagagaaagagaaaacagccccccugauggcuauucuugcacugaguaaauaccuaacuggaggagaaguuaggaaggggccaaacuuaagucugcuaggcuuaggggacaaggcgggagcagagcucagccucuuuucauggcagggaggaagagcaggguggaaggaagaagggagcagugagaggaagagagagggcugaaaaaaccacaguauuucuccuuccacucagugcuucuuccuaucaguaaaacaacaaaaccagaacuaaacagcuucauccuucuaaagacagcaauaugaucucagagcaaaagcacagacugggccgaguaagaccugcauuccaaacccagcucagacacguuuucaaaccucucuguauguugguuuccucauugguaaaaugucaauuaguaucuaagugguguuuugagcauuaagcaagagaacaucugcaaagggcccaguccaguggaugacccauaguagguguggaguaaacgcagcuuuccagcagcugaaucaccaggagauuuuaaacccuuucagguuuagcagccaagagccaucccuggaugcagggauuucaggugauuaagcagaaggagcuuccccaaauucagguuuaaacugguggggagcauucacugagccugucuuuuggacugugucccaggcugugaggagcagacaaagccagauaagcuagcgucacugccucugagccauccauacuuucuuggacagccagauguguaaggagcugauggcaauucuaugcagaugauaaagguauauuacuggaguuugaaccuaucccugugggauuccaaaggagacagcaauucauucuaacugggaggaucaggaaaaaauuacaaggcauugagcuuguaaaucaaguaagauauugaaagagaagaucggaauggcuuucuggaagaccgaacagccuaagcaaagguagaggauaguagacaggaauguuggauauuucugcaucuguaucagaagaguccacauuaaaguguccauuugugcauuuuaccuaucuaugggccucaaucuguacuuucauucuguuuuacugaagacuuucaguauaaaacuacagaaaucacaagugcugguagacacuggcugccuuuccccuuagaagagaggcuccacuaggcaaauacagaauaaauaccaugccuuuauguaaggccuuuuaauuuuucucuccagcagucaaugcacucucuauaauuauuaacugcauuuccuugcccugcaagccccagauguggaaacugaggccugcugcagucaaauaacuuguucggcuggaauggcugguaaguaguagcgcuggaccuagaaauccaguuuuccaacuauaaacccuaugcagaccgugcugccucuaaaagcccuccucucaugucccuguccccauaccugaggcucagaacaaacaagggccacauugcccuucugucugcagcuugccuuugccccugcucccagccacucccagcaaagccuaagcugauguaacagcacacacaaauauggcagcacacacaaaucuagaguuugccuugugccaggcaggugcuauucugaguguuacauguauuuccucauuuaauauucuucaacagucuuacuuauccaguaaguauuuguuaagugcaaacaggggcaccaugcuguuuuuauuuccauuuccauagaugagaaacugaggccacgaagguuaaaugauauguccaaagccagaucucuagugagagaaagagacaggacucacacccagagcccauccucuccucauuggccucuacccuucccauaugcuggggggcauuuagggaagguuuucacccuucugaacuacugagaggaugcaaguagcuccuugcuaaugaaagaaacuaggcugggcacaguggcuuacaccuguaauccuagcguuuugggaggccaaggcgggcagaucacucaaggccaggaguuugagaauagccuggccaacauguuggaacccugucucuacuaaaaauacaaaaaucagcugggcaugguggugcacgcauguaaucucaacuacucgagaggcugaagcaagagaaucacuggagccuaggaggcagagauugcagugagccugggcaacagagugagacucugucucaaaagaaaaaaaaaugaaagaaacuaacuuaucuucuuaugaaggaaaaaugaacauccauccgucuguccugccccguguacugugccagcacugccaugcacaugugcacugacuggggcggcgguuugcacccaaagugcuucaggacuggagccaacaggaggccagguuaugaaugucaggagaccucaaaaccuauugcuuauugagcaacagcaccuuguaguaucugauucugcuguucuccaggcuuccuccagcaugaguagauugucacuggcguaacaugucacuuuggagaaagcccuuccugcuggcauguggcaggcagcuagauugaucaugcccuugagccuagaguuagauuuuguucacagccuccagugggaaagaaaaaaugccaguaucauuaauuguaguguggccuccauuucaucacauugucucaaauuuuaccacucagaucaucuguagaauggaguauauuccucagaccccugugugugucucagccuguguguggcacuguguauauaagcacacacuugauuccaacucucuuugcaaaaaggguauuugagaggagauggaguaggaggguaacaaagcuuuaaaugaaaauuuuaggauaauuagcacuuuucuuuaccuagaagcugaaaauucuucuuuucuaccuuguuuaugucuucugacuuuucuguagugcaguaagucuauuaaauagcacuaugcauacaccuaauuguugaggucugaaacugugugggugguuucacauauaaaucuuuguaacagucuguguauuaaacacagacuguauuacauuaggacauuuggguguucuuucauucauuaacuauuaagcaauauuauaauaaugccuuauauuuucaauauacuuuauaaucucuaaauucuaaauucuaaagaauccucauuaaauuuaauucuuacaagagccugggagaugguuuucuauuauuuccauuuccacagaugaaaaaacuaagagucagguugguuaagugacuucccuguugaugcacagcugguaagggccagagcugggagccuuacugucucucuacagaucuguuccacuggguacuaagccugguagagaaaucagcaagggacaggaagcacagguaugcauaccaugagggcaguguuuaugggagaggggcagaaauaaugauaagggcccagggcugagggcaguggcuacuuuuggcugggagugaugguggaaauccucacagaagaggcaauauuugaaguaugucuugaaggaugggggaauuuuuucuuaauagagaagguggugaccguucaagcagagggcaucguaucagcaaaggcauggaggcuagauggccaggcaggcucaagagacagagaaauccacacaaagugagacuccugagcaggcagaaguagcguagaccauugaauauuguguucaacacacauuuaaaaugcucuuuuaacauccuuucuguucugaagagauaccaugucaagugucuauuuucagaaaaauauugccaacgaaauuugaguaaaaaggcagguccauauaacaaugagauuggcaauguugguuucuuuguuuuuuguuuuccauuuuugacauuuucacagcuugauaccuaaucagaaaagcagugugguauagugguuaggggcagguuccaucuggacuuaacucagaucugaauuuggucucuaccucuaauuagaagguaacgugggacaaguugauagaccucuuuaagccucaguuuccucaucuuacaaaugagaguaauaacaauacuuaccccauugggcuuugugaggauuaaaugauacuguuucuaaaacacucagcacagugcuugguacaguauagcuuccaaguaaugacuauggcuguuaacauuaucaucaucauggucccuggaauuccuuacugccuuaaacuuccuaguuuuaguuaaagacuaaaccaaaccaagggucuguguguaaucaaacaagaagcagagguaacucacauaugagugccuugcuccgugcacagauaaaggcaggggggcaggaaaauaugauaugguccccaagggcuggaaaauacccaugggacuggagacugggaagcuguaggguguaaaggagggacaucaaacacucuguucugugugauuuuaaagugcuauuuugaaauguuucucauuauaaagaaauauuaucccaaguuacaaaucuggguggcaggcuccacguuaagcugucugcccucauuccucuugcugaagugaaugauccaaagggaaaaggccucuccuaauaauacauacacaaauuaaaacuccauuugagguacaguggggaccaccuccuaauugacuuugaucaugaaaaaaaucaguugcauggcuggcacaccaaagaaaaucagaagacuggaggguugcucuauacagccaaguagcaguacauuuucuuguagcuauggaaauggagcauagcaacaagcaccuucuccuugugugagcucccaagcaccaacuaaacacacauuucucuuuccugccucauuugaucguuaacacaggugagggaggggaugaugcaucucaggugagaggcugguccuuugcaaguuggaacaccuuuauauagacacuucagauagcacugggaauggugucaucauggacucaagggccacaaagaaaggaaugugaugauggcacacuugggaaauaacaggcaccaucccagaccuggcaguggcguguuguaccacccaaagggcaaugcugacuccucacaccagcagagcaguuugaacaggcaggagauccuuuggguucagugaucacugcaucacuagugaggccugacuaugaagggcagaugguaggcauuguacuagguuuaagcaccccuucuguguggagccgcuuccuagaaugcuugcccuguugauagugauuugacaaaagcugcauuuuuguccugaucaggaugaaauggaagccuguccugugcuuccuugaugacagugugacaagaacuucauaucuggcaucacuggaaucugcuuuuggaucuuggcacugcuauguugaacgguacaauuguagacaauucuggauccucgguuuucuagagauagaaaauuaaaguaguaauauguacuacuuaucucuguuuugaggcaccuaaucuauaaaauggaguuacuaauacuaucuaacuuaaagaguugugaguuugaaugacauaauaaaugugaauccuccaguauuauaucaugcacaagguaaaauuuuaauaaguaggagcuguuguuucuuuaauaauaauccucacucugucuccuuccuuuccuugcuuucuucuucaccccuuuggaccagguucugggggggcagagaugacuggaauaaucccugcccuaaagggagggcugcuugauggccugacauggcccgugcuguggguucauuccccuuaccuuagacccaaggagaugguucccuucaccugggaagcagcgccugauggaagaacaagcaaugaggauggcuguccugcucuggacaugauuuucuauugugauuaauguaauaacagggucacuucgugggaagagcuuugaacuagaagucugaagaacugggcuuagcucagucccaggcccugacacaaaggcgcuaaucaagccugaguuucuucaucugugcggugaguggguugguagguaccugggagcugagaugucagucauagcaauguccccuaauacaaaacucaggcuucucacuccccagguccugauauguccucacuucauuuuucagugaaaaccuugauacacaaugaagaugaugccaacaaagagagcucccaucugguaguucaugucaguaaauaccaagcuccaugaggagcucauaaaacacgucacuucuuuuaaucuccacaacucucaaagcuagguauuauuaucaccgucuuauagauggggaaacagaggcucaaaagaguaaaguugucauguaacuggucacaucagaaccagagaaggaacacaggucucucuggcuccagaggcugugcucacagccacugcucuucacagccauuuucuugacuugggaaccagcacaaugugggaggucuggcagggagaggucagauaacugggcugaggugaguccaaagguuggugggggguggccaacuccuaaauuaguuauauacggaagaggucuuaguagagcccacccggggaaaggugcccagaaaacacagcuuucuuauucuauuacugcaauaauagcaguuuauucuguacaaauuagguuucaguuccaguuccccuacaacuugccuugucaccaguuuucagugcccuccaguuaaggugacauuccuccucuguauugguggugggcucaccuguucccugccucuguggcugacugcaccugauccucuggcucgggaccaacuccgccaugauuuaaagaaacauugagcagcacccaugaauccuugcugaaaggccuccuucccuauaacuuugcauggcacagagaaaugauuaacugugccagaauccauucuccagaaaacacuuaauuugggagugagagacaguagcccugauuauugcagccaaguuuuuccagagacaggaggaaaagcaguauauuuacuugauuaaaaauuacccccacguagucaucagugggauccugacaggcaguuuuauagcaaucaugcuuuuaaaagauguuucaucuauugggcaaauaucucuaguucccauuaccaaagucugucagcuaaugggagcaggugagggcccucaauuuaaagaaauuggcaacuggcauggaagggaacuaauagggaacauauagaaagaagaaaaaggcaguaucacagagcuggcuuaaaguuuucaguagauauaggaauuagggaaaucagcauagcaaaaugacagugaugauacaacugccauuuacugagcuccugguauguaccaggcauaguucuaagcaaauuacauuaucucauucaauccuuugagguggauauuaucagcuucauuuuacaggugaagaaacugagauucagacaggcuaaguacuuugcccaaagucacaaaaccaguaacucaacaagcucugagugcuuuuauagaaagacccaaacacagacugacugugccuguggcaaguugcuuacuggcaucuacaugguuuuuguuuguggggaucaguugcuggucaggcagucaggauaugaaaggaugggggcccaugcuuugucccugagaaaaaagccucuuaacaaacuaucucaaaagagcaaaucuagcuaugcugucagcgaaaucuuugucuuaaaauuuuuuuuuaaauuguaauguaguuuucaggcauuguaacucaucaccagugugaugugccaggaggggaaccugggcuuuggaaccauucagaucuguuuuuagaucgggguucaaauuuggccuuaguacuuccuaucugugugucuuugggccagcugaggagccuuucugagccuccaguuucuucauuugucaaacgaguuucucaagauucauguaaagauugagugagagagcauauguaauuccucaugucuggggucggacacaaggcaaaagcucaaagucaggaccccucccccaugcuguaucaucuuucucuucuaccuauugcuugugacacuaaguuggaggcuuccuuuuuaaugcugaugcacuaaaaugaguuuggaaacuaggaaauaaucgucugcuguaauucaaauccugaggucauuuuuauguauuucuuuacaaauuguuuuucauaugcauacaugguuuugcagagaugcagucaggaaacacaugcaauuuggugcccugccuuuucuuuuccugacauuguguuuuaagcauuuuccugcaucgcuguuuaucuuaguuauuuuuuguaaugauugccuuauauuccauccuguaccuguaccauaaguuagcuaagucguucuccuauuuuuagacaucgaguuugcuuccaauuuuuuuucuguuauccugccguguacaucuuguguauauaguuucuugguuuggaacuuuuaaaugugguggcuuuguagcaaaaccaggaagauaaccuagggaaugaaagccugucauuucuguuauuauuuuaucuuuuuaguuuuucaccccauuagaggaccauaagucaaagaaccucagugacugauuucauagaaauagucauuuaaaaaaaaaaacugagcacuaauauaaaacagaaaaguggguagcugcgugguuggguugguucccacugccuuuugaaaccaaaaaugccacuugaaucaacaguuccuugugguuauaaccgugucuagucacucccuggagcugcugaugcacagaugcaaguggguuugugcauuccaguuuuggaagggaagugugcaucgugacagcagaaacucaccuguacugauauuggugacuccugcauaaugacuuuguuaauugccuccugcuggccgggugcugaggggagccuucaaugucugaacaucuauggagccuuucuuuaaaaugucaagauagagcuugcacuuucugagccaucucucaugucucacuggacaggaaaaggcgacggggaaaaugucagcccugggaugagauugaccagagccaagagaaucagaacuucccccaccuuggcucuuggcuuuuagaaaucauuaacauuucagcgugggugaucuugugaaccagcuaccuuuccacagccuuuuucugaacuccuuagcaucuuuucaccuuuucacugaauuacaaacuagucuaacgggaaaaccaguaucaaguuacuuaucuaggucacuuugaguguacuugaggaagguuuugcacaacaguuauaaauacacacugcagaguaucauauagagaauccugugacguaacacagaugaugaguaguuaccguucauucuucagggaacauggaauacagugauuauaauuuauauuguuucaguggcccagucuauccuuagcaggcuggggagaaccguuuauauuuguuagcuuuuuuuuuuuuuuuuaaucuguggcucugucuuccaaaucauuuggauaacacgcacucagcugcuauacacagcuuuaaaugaagauugcugugggccagggaauauuuaucaucacuaucagcucccccucccuaaauauuuauuucaaauuuuauuugcugcuggcuuuaucuucuauuuaaaauaaaauauauaaaagaagaagcuuggcuugggagcacaggguccugaguuuuaaacuugccucaaauuucuaccagcucuguggucuccaguaacuuacuuuacuucucugaguaaaucagaauauagcacuauagcucuauuucuauucuacuuccauucuccaguaauguuuuuucaaccuacuuuuauauaaguaugaaacugaauaauauaaauaaagcacuuggcauguagugugcauucaaaugauacuaauuuuuguguuaugauuuugauuauuacaaaggauaaagaagagaggccacucgaucauauguauuucaugggcagacucuggcugagaaugugcuguguccuuuggaaagaggagagcagagcaaacuacuucucucccuucccucucccccucucccauaacccagaacuauagaauuaaccaccugccuaacaauacaguaaaagaaugacagggucacuagcaugacuuauauuuaaaaccuuggaucacagauuaaauguccccuuuauuuuggcuuuaagaugacuuugcuguauucucacucauuugugggagcuaaaaauugaaacaauugaauucacggagauagagaguagaaggaugguuaccagagguuuggaaggcuagugggagguuuggagauagguggcaugguuaacggguacaaaaaaaaaauagaauaaauaaagaacugugcuauuugauagcacaacaggguggacuauagucaauaacaauuaaacaauacauuuuaaaauaacuaaaaguauaauuggauuguuuguaacacaaaagauaaaugcuggagggaggggauggauaccccauuuuccaucacaugaguaucaugcauugcaagccuguuaucaaaacaucucacgugucccauaaguauauacaccuucuaugugcccacaaaaauuaaaauuuuuuuuaaaaagaugacauuacugguugaacuucaugucucugaaucucugcuucauccuacuccuuacuuuccagguagccauuucucagcccaaccuugguugggugacccuagguuuccuucccuacccaccagcuucuaaaguuauuuuugaaugguuaaaucuccugagagauucagucuaaguuggaguugaauacagagcuuugcuuucccagauaguuuucaggagugcaucuuccacaggccacggagacuauuggccagccucacagcuguguuggccucugugauugccagggggguacaguggagaggaaggggugccaacaccccuccccccaugucucccccacccucauaacuguggacuguccugcccucauuaacuucccugggaccccagaccuguugaucauuuucaccugcaacacuuuuuucccuggcuuauucccaccccuacccacaacguaucuuuuuuuuuuuuuuuuuuuaagcaaggacuuauuugcaucuuguuaaauauaaaagaaagcugugacaauaaaaauguuucucuucacaaagcugugagaguucuauucauucugggauuaguuaauucucaugaccuuuuaacaagacagcacuguugcacacuuagaugagauaauugauucuaauggggaaagaagcauugcuuacuuagcugcauauaucugauucgucuguagcucaaacaauuucuccguuaccuuuggaguugcuaauauauaaaguaagaagguaaacagaauuuugagcuaauccagccuuggaaauagcagaauauucacugcuuccaggcagguuaacuguucaaguauuauugucaccuacauaggagguagaggagagcagugcaaagcaccucaccugguaccugguaccaaaaaaggugcucaauaaaugucagugacuauugucauuucauuaucaucaacaguacaaaugcaaugaaugguuaucacguauaguuaucacacauguguacaguuugcaaagcauuuuaccauguauuaccucauuagguacaacaauguuuugaagcuuucuauacucauugcucagaugagaagaaugcagcuaggcaguggcagcugagauucaaaacuaguuucuuuccucuggucccacacaccuucuccuguaccacaguaaccaaagaaaaaagcaaagugucggaucucguugcuuucacccgagcguggccuccuggcugaagcagacuuguguguguuccccauggcuuguguucagacuagaagucaaacggguaugcugugcuccagucuccucgguaguuuuuuugugugugucuugauggcagucacacagccccucaaaaccaccaucagugacaccuucauacacuggggccagguaacagaguucccucucuagcucacaggauccuguguuacugccuaaaaagagacuuaaaagccuuggaggcuguuugauguacaaaagggggaugucuuuguaacgcccacccugauagauacaccaagcaagaggugcccuagccaagcaggcaagccugggccuugaugccgagaagacugacagugcauguuuucaggauuggaagaguuugggauuauagucucgucucugcaaccuguuagccauuuaaccuugcguguguuaauuagucuuguugugccuuaguuucuccaucuguaaaaugggguuauuaauaccucauaggauuauugugagaguuaaaggaauuauugcuuguaaugcucucagccuaaugccuggcauaucauuaaguacucaauaaauaauaguuuuauggcuaucuuaauuuuaauuaaccuucugagccuuaauaugcaccucuguaaauucagucuggugagauugccaugaggauuaauauauacaaguucccccacauacugccugucacacaguaaauacaauuacuaugggccuucaucucucugaagauccuucccuguguucuucuagccccccuagcgggucaggcacccccuccucuaggccuucuggucuugcugaagagacuuuguuauuugucugucuucccuacuuggcugugagcucacugaagcaaggacucucugauuucauucuggcucuccagaaucugccauggagugggcuuucagacaguguucaccaagcaaaggagugaauguuacauccagggugucaugaggguccagggacuugagcgcuuacuuccauguguggggaauucagaugggcaucagaagaggggagccugaaccacugacaaggcccaagccuggaauccuaaaaugggauuuaagcagauauuuugugcuagaucacaaacauuauuggagaugaacuucccagccuucucaagcauguauaucucaagggacaauguucauucuuuugcgccuuauggucucuuucuagauugucguacaagacuuuuuagcaguugcuaccuuggaaaaauaucuuuuuuuuuuuuuuuuuuuuuuuuuuuuuuugagacggagucucgcucugucgcccaggcuggagugcaguggcgggaucucggcucacugcaagcuccgccucccagguucacuucauucuccugccucagccucccaaguagcugggacuacaggcgcccgccacuacgcccggcuaauuuuuuguauggaaaaauaucuuuagaacagaaauauaugcacauggcacaaaaugaaaaugugcaaaagguguacagugaaaagcaaguuucccuccuaucccccgauccauaguaucucuauccuucacaggacacagcuacuguuaccagucuuucauauucuaccagaaauauuuuauacauuuccaggaauuuuuaaacccaaagguaguauaucaaauacacuucugcauguuauacuuaucuuuccacaaaaauacauaaagaaccucuuuauucuuguuaaugguugcauccaauuuuguuguguggauauuacuucauuuucuugccccuuaucaauggacugguuucuaauauuuugcuauaacaaauuauacugaagugaauaaccuuguauguacaucauuuaguacauguauaaguauaucuggaggaggaauuucuagaauuggaagcuuuaugucccaggauaaaggguauguguauuuuaauguugcuagcuuuuaucaaauugcccuccauagauuuuguacauuauauucucacaccaguaaaauaugggaaugcuugcuuuccauucucugccaauauaguguauuuucaaccuuuuuuaucuuugccaaaccauaugugaaaaauaguauuucagagucuaacuuacauuucuuuugcuaugaauaaugccaagagucuuuucauaugauuaugggcuauuuguauuucuuauucaguaaacuguucauauccaaugccuauuuuccuacugaguuguuggacuuugguuauuauuuguacaaguuauuuuugcguuaaggaaauuaacauugucauaccaauugcaguuuuucccccagauuguuauuuaucuuucgaagcaaagaccaagaccuccugagacuccccgauccugccuacucccaguuccaccagacugugagccccuugagggcagggucugaaccuugauccucucuguccccagucuccuuugcagggcuggcacuacaagagcuuccuuuuggggcuacuuguugaacugaacugaaugccuguguucccccacccugcccaccuuucccuuauggcuugggagucccguuucugccuccagcagaaaaagaugacuuuucucauugcucaccacagccaugcaccuguuuggccuaaacuggcaccugcagccgauggaggggcagauguaugagaucacggaggacacagccagcaguuggccugugccaaccgacgucucccuauaccccucagggggcacuggcuuagagaccccugacaggaaaggcaaaggaaccacagaagguaggguugcugcguuguccguguugugaguccucugugucugccucugagcugaagagcccuccauaacgugcgugcaucaugugccuggcucacagcuccaugcucuggcgcucccuccauccuuccacacuccacgccagcugucaagcugccaguccaccugugucuucaucgcaguuccuugucacugagaguucgugggaggcucaggaagggcucauggugcucagcagaaucccaucccaugccuugagggaagcauuaggggcuucacacugcugggguggccaucuuuguguggggugagaggagcucuucugggcaaaccucaugggacaguugggcaucugugggagugggguauggggaggcagguagaugggguguuguaauggaaagauucuuggacucuugugguuuaauagaaacaccaguuuaaguggucugucauuuacuaaacgugugaccuugagcaagucacuuauuugccugagcuucaguuuccgcauccgcaauaauaacaauaaucauuaguguucguacagcauguuuguuuuaaaacuuuuugccaaaagcauuucacauuuaauucccacagagauccuguaagauaauuauuuuauaauuauucuagauauagaaacuagaauuggugcaaaggauugcacuaauuaagugauuuggccagagucacacagccaguaaaugguagagucugggauaugagcccaggucugugacuccagggcucucgcuaucuccauaagcuuccccaccugacuuaccccaagguuacaaggcccugaaggagaugugggugugaaauucuauuguacaaugagacauggauauuuccuaucaaugauggaaauggugguggcauuggguuugcuauuccugagugggauauccauaggcccauguucucaaugucuuagaaauauuucuaacaugccauggacauugucagccaagaguggcacagacucacaaaaauuggcacccagaaagaugucugagcuaauaacccagccugguugucauucugggcaguguggcguucccuucuccugcaccugcuauggccugcuuucucucccugugacccuucagucagcacauuggcaauagcugccucuaacuuucacugcuuacaucuucuuuucucucaguugacuuuugggucauagcaucugagccucucugcccuugcaauaauuugccuuccagccaccaguuuguuuaacaggguggcauauacuuggucagaguaucuacucaugaccucugaaaugaggauccugagggccaaagucaacucuuggcuucuggucaucuuuaagggaagugggaacugagaucauuuccacacagaaccccugcccacuauuuugagggacaaagccaguccucucauuugcaaagauuuuaagucuuaaaaugcuaaauagugcacacuuucuuugccucuuaauaggauauggagggaggaaucaugaaugggaccugggaagagcucuggguuagaagucagaagcccugaguucaauuccagcugcagccacugaccugugguaucaccuuaagcaaaucccuugaacacacuuucugggaguccuuuucuccucuucaaaaggagaauauugagcuagauucucucuaaggugcauucugauuuguaaguucuacauaugaaaauagcaauagaaucauguaaguaaccagauggcucuucagaaugucauguuggcccuguccaugguccugccuuuuggcucguggugcccaugucagcuucuagcgucagaugccauggguuaauaccauaaugugaagacugucuuuagaucagcauguacaaauguagauuuaaaauaugcuuaacccucaaggaacugguaaaggaucucauuuggcaaaacguauuuucuucccucuaugaucucuaucagacguucuuuaaacaggagucggaucuaucugaaaucucucacucuaaugaaauuagucuguggguuguuuagguuuuguuuuguuuuuguaaggaacaggaggugcagauaagagauaaaauaaaauugcaccagauuauugguuuauuuuaauuggaguauuuuugcuuaaagggauuaucugucauuacugaugcaaauggaaauccuguuugcaaaugccuucaaugcagcacugugcugcaaaguggucagcaucagaagcaaucacugugacaaaaaaaauacgucagacuggaaaccagaggacaaagcuuccuauaguuuaugugagaccacaauguucuuccuuuauuuugcccuggucaaaccaaugucuacucaguguauguuuuucauugugauguuaaaaaugcauuccccuagauauaucucaaugcagaaagucuuuaacucugaugugagcacauauuucucaucccuucugaggauauucaagaagacagcugauuccagaauuaagauuagagucucugcuucacaaugauggagaaagcaauguggugugauagaaagggguaaaugggccuuggagccagacaguauaggauguuaauccugacccugcuuuauauuggcucuguuaacuuauggcacuuacugcaucucccuugaccuuccucaucuguagaacaaggauaacuauaucuauccauucaaagccuaauguugaaguggcacucaacaaauauuuguucucuucuucuuauccacucaaaucccaugccauuccauauuaguuauuaaaaucccagaaguccagacuaauuaacauucucucccugccacagauucugcaaagguuugagguauuuuugaauauguuaaagaauauauauuucuuauuuauaugaauuaaauguaugauaauccaagaauuguaaauguucaucauguccuugagaauaacaugaaacugcaguucauacuauauuuuccaaauggcuguaaccauuccaggguugugaugggacagaaaccaaauacagcagcuuuucgaacuaaagccacaagaacuuguguuacacauuaauggggaagggaaaaaaacauugaauaaacaggcauuucugaugguugaauuggugggcuugggauagcauuuucuucuuucugcagugaaauaaaaauugcccauuaguuugaaccaugcaaauugcugugcgcaggcucagcugggcucuccaaaacagaacagcuuauuuugauaaccaaauaaauuucaaccaguugcuaaggaaacuaaagaauucuucaugcaaguuauugcauugaaaagaaccaaaaagguggagggagagaaagaacauuaguugauuaggaauuuagaaucuauauagguagaucucaguucaagaaaguaaaggcuaugauugagaagugcaugaaauuucaguucuuccaaaucuugcuuuuugacugagcuauccauuuuagcaauucauuaagaaauuucuuuuauagacaugauugcauauuugcacagcauugcuaugggaagccugaaucuaucuagcuuuacaaagcaaaggacuauuaucaguaaaaucugccuugugaggccuaaucuugcuguaggggagcccuaauugugaccuaagcuuuuugcaguguuuguuaagucucugggggcacccagugauuguagaguguccuucucaugaauguuuugagacccugacuguugcccuuuaacuuuuggaccuguuuguagguuccuaauucauacaaaugaucuuuuuguacccuaggaugccaggaaguuuuuuaaugggccuuggaucuaccuggucaagcucugauauuuagccugcuggggcugugaauccuaucggacucuugaucuuuaagaaggucaaugcaccccaccaccacugagaaugucuuuguaguguuuuaauuaaucauucaucaauuugaucccuucagaagccauauuuuaauaaauaaagauggaucccaaaaugguuucuuaagcuuucugagccuccauauacagauguuaauuaacugaacugauacacaggaagguaccugccacugugcuuggagcucaucaaguggaagccaauaugacuaguaauacuaauaccucuaccuuuauugcuauuuccaccauuaaaaucuauuacuauuuuuaucuuccagaguguagguagggauaagaagaauuguauacacaagacuuuuugccuccaauugccucuagccucuccucucccuuaugauuccaccacugguggcuuuugcuucaugguggaggauauuuuauauccuagugcucacagcuuugugcucagaauuaaggacaaaaagucuuauagcaucuagaaaguguaaggcaauaaggauuuuuaacaagcaagacagaaggaaggcauuucacuuucccaacccucagcccagcccaugucaugacucuuuccccucagguaaaggugaucagcaggcuguuagcauuucccccucaacagcucccagccugucccuguggugggauuuggagaccacuggugaccagaggcccucaagguccugauagaggauaugccccagagcagaguucacuuuuuuuuuucagcauauacacacucaagacaauuucucccucccauccagcccaucuaggugaaauacuaaagugcuagaaaaguccccuuuugucaccuccucugggguaagagccaacuuauuuaugccugaggccugcagaccucugacuuauaaggcugcaaaaccuagcugauacagucacugucuccuaaaaauacgcucauugagggagaaaaugaacugugcaggguucuccagcagcaugcuaaaaugggggagcaguuuuccaguauuuauuuucagacaugggaauuauuugaauucagacaauucucaaaucccaucagcucagacugccaccuacucacaaaggaaacgcauccuuggaacuagcaguguugugcuuauuucuuuucaguuucuaggaggaaaaagcucagaaggcaucugcuuuguuucauucucccucuuaguucugccucccuagcaaaauuaaaagcugauggcagacuauuuccuccuggaauauagaauggcugugguauugggaacccaaaaaucagauaagaaagaauguaaauaauucucuuccaucucaaugcauugugaauuuggguucugucuuugaacuuugugaaucacagcguggugguuuuuguaucuauauuugaugucugaaguacauuccuuccauaaaggaauuaaaaagcaaacucuuucccaugcuaaugacagaauacuagugguacuuuuauugauagugcacauuuuaacuuuuuuguuggcauauuuuuaauuaaaauaacauuuaacaguuugaagcuaaaaaccugauguuucugccuaggaguuuauaagggagugauaacauauggagaaguuuaacauuuaaauugaauuuuauuauuuaaaacaguaaaauguuuuaugacuacaacaaugcccugccaggcuucauuucagcaucaaaugugcuuuguaaggagucuuacaaagcuagggggaaagaaagacauuuuaauuuccuauuccccaaaugcuguuuacaaaaaguuccaaaguguguuuucuuuacaaaugaauucuuguucucugaagugucucuucgaacaucucuaacaucacaaaaaaaccgcuuggaaccaggauacccaggaaguccuucauaacaacaaauaaaauacagccuguugacuugaugcuggucuuucagugugcuaaggguggucuuccuaacaucccuagagucucuccuguuccuucucaacucuucaggaggcugaugucuggcaggaaguuaggguuuguauuuuucacauaugagugugcuuaauuacuaaauagaaggaguuugauaagcugccuuccuugcuugcauuuguggugcccccagagagcugucacccuccuaaucaguauagaaauggccgagagacuuuacucaugacacccugcauggaugcuuagcacaggguugggagccuggguggaauuuccagguauggcauaggcuuggugugugaacuugggaaauucccucagcuugacccauuuuagcacagauauuauauuuacccucauccaaagacaaaggaacauuuugcagaaauauuuccucuuuucagaaguaccuuuuccucaucuuccccagccccuaacccugcccuaagcacaaccccccauccacauaucagccucagaauuuggcuuccaauguauacacaaauuagugagcuuuuuaaauaccuuacuccaucaagucaugcuucccacugcugggggacucauucugaguuggaaaauuaauaacacuuuguucccccauccuuucuauuuuaccgugagccccuuaacacaccaaaucacagagcuauuuucaugugaccacaaaugauuauuuuuaggaucaaaauauaucuuaacaagcuguggaauuaugcaguaaacagauggcccuuggggaggacccauacugcuuuggaagaaugcauauuuuuagcagaauaauuugagcaucgcuggggggaaaaaaaaguucuggaccuuuuuacuccuccauguggggagggccaggguggggaggaagcugacagcagaacauuauagagaaggaugugaggcuaaggagagucccggguguucagaugcccugguuucucguuucccauguggcuaaccgagaugucuuugucuucccuucccucuaucuugguaggaaagcccaguaguuucuuuccagaggacaguuucauagauucuggagaaauugaugugggaaggcgagcuucccagaagauuccuccuggcacuuucuggagaucucaaguguucauagaccauccugugcaucugaaauucaaugugucucugggaaaggcagcccugguuggcauuuauggcagaaaaggccucccuccuucacauacacagguaaccagaaccccacauacccuguugaucugcaugggcuccuaccucaaaucuuaacccaaaguuaagaagcccaauccagagccuuaagccugaagggacauuuauauauuuuauagcccauucauucauguagucccucucagacccacccuuucagaugaguaagguuauaucacuggggcuuucuaggaggaaagaauucuaggaaaucucuuaacagccuuucugcuauuacucagucuccuaaguuaaauuauccaggaaaugugaucuagagaaaaaagcaugcaguuuagaaucagacagaucugaguuugaauccucuuguuaucagcauuguaaccuuggcuccaucacuuagcuucucagagcaaguuuccucaucuauaagaugccgguaacaauacccacuuggcagggcuguugugaagaaagaagaauaacauuuauaaggcagcuagugcaggaccuggcucagaauaaaugauucuucccuagucuuucuuauuccuucucuccuucaggguuacacauugacucaaacacaugcacaccagaaacacugaaaaaaccuuguccaggaugacugacauauuaccaaucaugauuaaugaagaacagacacuugugcaagguccugccagcccuggaauuggaguaauguaaaucauaggcauucaucaggcauuccuaggccaaaugcagccuuccuagcccuaguaguuauuuaagauuuuuagcuaaaagacagauauguuugcuaaagaaggaaucacaggagaagagccuugagacccuguugacugcagacugguaugcuaguccuggccugcauaucuccagacaguuuuucaugaaauugaauaaauaucuuguuugguuuuuaaagcuagcuagcuagcuagcuagauaacuacccaauuugcuugcuaauaggccaguaggacuuaaccaccuacuuguuguuaacacaguguaacugacuuuucuggagucucacacaagcagucuccgaucaauuggcaauuguauuugacacagcauguaauuauugauagaguuuugagcuaauccaguugaguuccccuaaauuugcucccugaaacuagaacauucagaaagaaccauugaccaaaggaaaauagacauaaaucaaauuuucauuugcacaugacugauguuccaaucacauccaaugcuccaaucccagucccagccacccgccucugcuccccuccaccaccccccaagauucuugucaggacuugcaugaaguucaaccaauuguaaaguggcuguguuucuaaccacacacccggcauugcaaaaaagcaugguuguccugguacagacucagccaggggaagauucaccaccaguacaaaaagaacuaaaacaaaaugagacuaaaaaauaauccucuaauuaugccucacucacaggagaaccgggagaauaucaccaugaaaaaaugggucuggggaagaguugaguugauugaucaaccuuccugcacccuuagccucuuugggcccuuuuugccucuauuuguguuucccaauguccucuccaggagaagccccgggaaggacgcuggugcgugguggaacagacccacugcuaacugugcuuucucugucuuucaguuugacuuuguggagcugcuggauggcaggaggcuccuaacccaggaggcgcggagccuagaggggaccccgcgccagucucggggaacugugccccccuccagccaugagacaggcuucauccaguauuuggauucaggaaucuggcacuuggcuuuuuacaaugacggaaaggagucagaagugguuuccuuucucaccacugccauugguaagggagccacacccucugggggcugugggauauugucucuuuuggucggaggcugcauggagauucugggacugacacugacaaggggaugucagagcuguggauggcccuggagcuuggcacgagacccuccugacugggccugcuacacagggaaucgcccgccauucugagcuggcuucugagcccagggcuguugcccgcugcuucucuccugcugucugugguuggugugcagugcauuucaaggugggaguggaauugugagacaggaauccuggacaagccacacagaggcaacaucucucuucuuggcacuucucucccacguauuugucuuuagagucucacuugguucaccucacugauuugugguuuggguuuuguuuugguuuucauucuuuuuuguuuuggagccaacaaccccuggccaaugagaaaagaggauacaggcuugaagagagaguaagaacagcagugcaaaaggcuggaugaaccaugccaucagucagacugggguuuuguugagaauagagauguccuaaucucugacaaagagugggcccugaugugcgaaauaaaugagugcuuaacaccuucacucucccucgcaguggaagagggccucagcucccaguucacccugagccccugggccagcucagaagccuguaggugucugggaagccuggcacccuauuuaaagaguuucucuucuuuaccaauacauugcacagaaugugucugcuucuuagacugcccuaaugugcugcaggacacaguggucuuggcaguucgggucagaaaacauuuuuuucugaguuuauauuagaagcacuaugacauagucuggagauaaaaauucccuacaggaaaauaaaaguuauggaagaauauaacuccauuaaacagaacaccugggaaugggguuucugcuuaaucaacaguucuauguggucuggaguucaccugaaaacucugucucagucguuggcuaggaaucucucugacauggaaaaauggaguuugauaaaaguuucugaauccaggcuaggugugguggcucauacuauaaucucagcacuuugggaggcagacgcaggaggauugcuugagaccaggaguucaagaccugccugggcaacauagcaagauccuccuuucuacaaaaaaaaauauuaaaaguauccaggugcgauggugcaugccugcggucccagcugcucaggaggcugaggugggaggaucccuugagcccaggagauugagguugcagugggcuaugaucauacuacugcacuccagccugggugacagacugagacacugucucaaacaaacaaaccccaaaaaaucucugaaucugguacuagguuuccaaaacucuuacaagacccugguucuuacuuuuuguuuuuuagaccaggucucacucuguugccugggccggagugcagugacucaaucacggcucacugcaaccuugaacuccugggcucgggugauccuccugccuuggccucccgaauagcugggaccacaggcacacaccaccaugcccagcuaauuuuuguauguuuuguagagaugagguuucaccacauugccuaggcuggucaaacucuugggcucaagugagccgcccacuuugacuuccccaaaugcugagguuacaggcaugagccaccaugcccagccccugguucuuacuucuaaacaacaggagucauuuucaguccauuuccugcuuacuugaaauuugcccuuuguguugagacagaaaguaucuucccauuaaauacaggguguggcugaaaagcuucugcucuaaauacaggcucaauauuucaccucuuggcaaaaugaaggagguggaggcuuucaggcaacuagcucugauguagaaauuaucacuuuguacaguccuuguuuuagagaugucugucugagccgcuggacuccgaaugccuagagggcaggggcuuugacaggaucuugucugccuccuggcacccagcccaguggggugcagugucgugcagugaaugagggaacgaacuccccuggcaggauuggcggcagcaacugccaggcaguuguggugcuguugguuuccucccuggauaccuucuugugaacuguggcagggauugugcuccauuuucagucuccagcacaaacuuggguuuugaccuugcacaaaucacuugggguucccagcucuuaguuuuucaggauucugguauuugaggcugcagcucagagucacuggugacauuaaggcuaacaguauagccuguucccugucaucagaggccccagucuggccgucaucuuguuaggcugucacuuggcaggguuugggaggcuacaggcccugauucuuuuuucucuccggauaggaugacgacaguuuagggacaugaucaucaagucgugguggugcuugaguuacagcuucauggucucguggccugauuucccuuaagcgugguuuacagagaagcauagaguagugcuuguucaaaacuaagugcuuuuacaaucagaauuccuuauuuuuaauaacuuagcauaaauaugaaaggauauuaaucaaaccccagaagaaagccacuuuuaauuaggauacacaucuuagaggaauaaaccauaggcacagugaggcaucuuugccaacccuuggcuugucagagcuugcuaaccugucuucucauaauuagggagacggucuucuuuucccuuugguucugccauucucaccuaaauguggacaccugucuucacuuccucuuaacccuguauuuuagggccaauaggucauaccgugcuucucagacuugagugaaccaccugaggaucuugauaaaaugcagauucugcuucagcaggucuggguggaccuuagauucagcauuuccaaccaucacccagugauacugaagcugcuguggaccacauuuuaaguggcaagggguuagacauaguacuuuacagaugguucucaaauacuguugaauaaaagaaucaccugggaagccaggggaacauucauauuccugggccuuuucuccagaaaauaugacucaguaggccugcggugaagcccaggggauccugauucugguguucugucaaggaagcuuugaagacagacgccuuaugagaacuacuuuccauuccuuccuuccccacugucacauguuagcucugugaucagagacagucaugccaccucucugagccucauucuucuuguuuggaaaauggaacaauaguacuuugcaauccccaucgugaaaauuaaacagagaaauagaaagugcuuagcacaggcucugggcuaccacaagcacucaauaaauggaagcuguuuuaauauucucucccauccucuuucuccuuccaccuuucucuugcugccuuucugaccugucugugucccuucaagcuacagugaugguuuaaugaauacuguuuuuuucucuaauacaaaaacagacugauucugauguugcuauuaaucccgcuuuccccaagagucccuggcauugagucucagcugucugugaucauuacuugugagcuaugaguaguaauuugucuuggcagguuaauuaaaaguuuaggucuuguuuuagugaagucauuauggccccaauauauaauuguaacucucggguuugcuuaacacacaaauuggaaucugacccuuccuucauuauaugucaaaaugcagaucuagaauuuaagaagaucugagaugucagaauccagaguauuuaugucuguuuguaauuaaguaacaggagaaauaauuguguuucacaaauggcuauauuguguauguuuuugcuuucuccuccauuuaaugcaauccagcugaugauuuuaaaugaaaugaguuuaacuuuugccuuuaaaaaaucuaaaagcacuuuacaaaccguacacacaaauauauacgcacagagaccugauguugacagagcucccagugaacuagaugcauuuacacacacacacacacacacacacagagcacugaaaccaagcaaguuuuagaauaaaacauggaagcuuuuuucagaaacaacaggcuuucccugcagguggagauccagaaucugaggguacugacccugguccuggcugggccgaggugggcugccuagcugaccccagaauguugaauaaaggaggagaauguauaucacuagcugaacuauaauucacucauugcaguuugcaaaggguuuucacauacauucuuuaagacuugcaguaauuccaugagaugauuauucuuauuuuuauuaucaccucccuauugcagaugaguaaauuaagguucaggguuguuaaaagaaaaguuaggacaugaauuugcgucugucugacuccaaagcuuaugauccuccuccuuuagcaauuugccuucuucccagcaucaaacccccguuuuugguaucacuuacuucucuuuuccaucuauucauucauucauucauucagcaaauauuuacagaacaccuauuguguguugaggaccaugcuuagcucucuuuuuuauguuauuuaauccucacaagaaguuuagacaauagauauguugaccucaacuuuacagaugaagaaaucaaggcucagaaagcuugguugacuagcccaaaguuaagguccccacaauaccacagucucucacuauuugucacgguuacuauuaaauauuuuuuccauuuguauuauauggaauguaauuucccccuugccuuccauuauuaauaaccauauuacaucaacccaagaaguuuucuugagaagucauuaagaagaccaugaggaaagucucacaucuaaaacuuuaaaaguaaaaauaccuuuguaugcauugcuugcaacucaagaccuaacaaguucguuuucauucuucagguagcaucuuaucuuuucauuuuggcugaugcugaagcauagaggacagaucagccugacauuguggcaaugugagccaggcuggagcauaacagaggugcccugcaguggauuuagaaaccuagagaaaagaaaugagaauugcuguuagaaaauguagggacugggaauuuuuacgagaaacuugcucuggccucucuggugcucauugaagagaagagucauuuuguucguauccaggugguugcuguaaaucagucuguucuuuauguccagggauuagaaacagauuuaguuucuuucuuccuucuauuccuccuuccuuccuuccuuccucuuugcuuuccauuauccagcaaggauugcauccuugcucuuucccaagcugaggauacagggaagguaugacaugguuucuggcaaaaguagcucauaguccagauuaagggagaugaaagauuuauacgguaaacagcucuaagccaaggaaaagaguaagaacagucacuccuggagucacuggucaaagacccaugaggguugaaggaaggugaggacuugccuagcuggaugggucaaggagggcuuucuggaugaagugacauuuaauuuggaccuuaaagaaugggugaaauuuuuacauuuaaaaaaggaaaaugggagggcagguguuaaggaaauuauuccagguaguagguacuaccagcaugagugaaaguucaguaggcagaaaauuaagagcuggcuauaaggagccagcaguucuguuugacuagagcccaggaugccuuaaagggcagaaaugaguuaucaaggagagccuuaaaugccacgcuaagcaaaaaguuuauucuuuaaguauuaggcacuaucgcaggcuuuugagcaagggaauaaaaugauuagagcuagaggucuaucugaugagacccggaacaagagcucaugaauuuauguggucaagggagguuacugggauugaacuuagugacuucagaagaaaaaaaaaaaaaggagggagggaaggagggagugaggaaggacaaaggacuuguucaaugauguucagugguguuuuucauuugcuuucccuacaauccauuccucuuuuucucuagguaugccucgauacuucaccuaaguuccuaucuuccaagagucaccaaaauuggguccuucaugauuuuccaaagaacacuggccugugcuauuucuuuauuucuccuacuuugauuggguauuugccucugagugcauuugcaaagauccggagagaaaaaucucugacauuauauaccauaauuuguguaaaaaccugcacuacuucauugaagacacuaagaaaaaugauugaggagugauuuuugguuuuuaauaagccccuucucuaccucuccuuauguccccuuccucugaauuauauuauaagauauaaauacagcaaugaagaauugaggucucuugguaauaaauuaaccuucuuguaaaugacauuggcagcacuuugugaaauuucuaauggaaacacuucuuuggaaaagcacccugugaauuuaccucucccugauacagugauuuauuuggagcaaucugguauaaguggaaugaaauuguaggccaagggagcucaggucagcacauuggagacagacuguggcuaaaauucugcugaggggaagagagcuaggaguaucagagcacuacaucugcagacucagagacuagcccugccaguagcugucucugcucacugaagggcagggcuccccacuguccccacccccagcaucucugcugcccuugggaucuuaccuucgauugcugaaccuucugaaucuuuaccuggaauugcaagggcaggaaagaagaaaaaguagcccaaggacacugcaggaaccaagcaauaaaggcuugucuuucugugggaaauacuuagcaaggcauuugguauacagauaaccaaaauccccacuagaguagcauuuaaguagaguuuugauguucuggugcacacuuuuugucuaggagaugggcugcuguuuuuaugcuugcuaccucauggucauaaaaugguagcuauaguuccggggcuuaugucugcaugucaggcaggaaaaauaagaaaagauaaggaaguaggaaagcagaauuuuuccuaaaacauucagcuuacauuucuuuggcagagcugugucacuuggacacucagagauauaaggaagucugaagaaggggauauuuuuagcuugcuacauugguacucucaacaaaauuaggguucucucagagagaagggaaaugaauaugggguaggcacauagcagugucugccacagacuucaucaggucuguuugguucaacaaagaccaacugagacccccucuuacugugugccagacccuugucuggacauuggguauagccaggaggcagacaugguacuuggccuugagguuucucaugggcuaguaaguuaggguaagcgaagcugagaaaaaggagaagcugcccauguaauugagguggaaggaaaauggcuugguucagucucuuuguaucauccaggaaccauggacguuuuccauuaugccucgaagcaccuugcaugaugcuuuaacggggacagacagcaggagcaaguccagagugguagacgccaguugcagacagaccuagacacugcaucuguucauuuguucauuauucaacccguguuuacucauugccuuucaugugccaguucugagcaggcauguacugucacugguauguaaaauagccaugcuuucugccuccaugguguucauagacaggucugaggcaguuugagauggauucucaaguuuaaauacaaucaucaaauauauauacacauauguaaagauaaauaaugauaagugguaagcacacguccuagaaaagauauccagagaaacacguagaagccuaauucagaaaugaggcucagagaucuaaugcuaauugccaagaucucauaaauaggaaauagcagaguuagguuagcaauccaaaacacacauucuuacucuuacaucucagugaccaggucuaaauccaaguuucuggaguggugacauccaugugugucuuuauacccucucguagucagagaaucagcaagacagauagggucuuagagaccauggcaucacaccuccuaggcucacagugugcuggccacgugccugcaguccgcucaucugacuuauuuauagaacaucucuaaccugguacucacuccuguugaaggaaccccugcuccuauccuccauucagauguagauucugauagaagauauuuugucagcagugguuuaauuuuuauaacugaugauuaaauuuuuauuuucuuuuagcucuuuuuuuuuucugucagucgcuaaaggcaguugcucauucccguuugccagcuggcuuuuccacugacagaacggcagcuuugagaggguucucacauagugauauuauuuuuucuuucccuuuacagcaccacugauaugugggacauaauuaaaugugaggccgccuguucgguaacacccucuuaggaauaaccuagcugcaaguaacaugugaaucucugcuggaauuggcacugguggucgauaguugagguuguuggaggcaggaguacaguuggggguagagcugaccagauagauggugugguccgaggaaaggacaaaggcuuuggagucagcccagccuggguuuagaugcgggcuguauuaguuaugagcugugggauuuuggauaagucuuacccucaccaaacucaucuauccuugggaaucaaacuuacuuuagagaaucugacaaugaugugaaagcauaggauuugugguagguacucaguguguuucuaaaugugucaaguauucagcauuugcugaacaucuacuuugcugagugcuagaggcuucacagugaauaaaacagaagcuuugcccucaaagagccuauaaucaaucgggagaaccaacccuuucauaaauaauucuaguauaauguggccugggccaacaaaggggucugugggagcuccaugggagcagagaggagggcugcuaccucugccaggcauguagaaggagguugugaggcagaaaggacauauuuugagaagaguacuuagugagcuggaaagcaguguacaaauaauuauuaacaacuuggggccagagcagaagugggaauccagaaagaaaaauacaagaaaagagucacccuaaaaagaagaaauaaaggaguguguuagucugcuagggcugccauaacaaaauaccacaaacugagugguuuaaaauagaaauuuauuucucacaguucugaacacugcacauccaagaucaagguacuggcaggguugguuucuggugaggccucucuuccaggcuggcaacagucgccuucuugcuuuguccucguccucaugugggcuuuucucuguguauauauggagggaaagagaucucuggugucuuuuccuccuuuuuuuuuuuuuagacagagucucacucuguugccaggcuggagugcauuggcgcaaucuugguucacugcaaacuccaccugccugguucaagcgauucuccugccucagccucccaaguagcugggauuacaggcacacgccaccacaaccagcuaauuuuuguauuuuuaguagagacgggguuucaccauguuggccaggauggucucgaucuccugaacucgugaucugccugccuuggccucccaaagugcuggaauuacaggcaugagccaccgcacccggccuuuuccucuuuuuauaaggacauaaguccuaucagauuaaugccccacuacugugagccucacuuaaccuuuguuaucuccauauaggcccuaucuccaaauacagucacauuggggguuaggcuucagcauaugaauuugguaggggacacaguuaauaacaaggaggaauugagaagaccauaagauaguagcagucucugcucaaccacacagaugaacuggcuggaaaggaucauuauuugcauuuuaaagaugaggaaacagucugugaccaguggcucacacaacauaaagccgagucuucgaauccaacuccaguaacuuccccuggagcccagcugccugacaagacagggaacauggaagacccccaucagagggucagugaacaccuagcaagaaggucaggcaucacugauguuuuucccugcaagcuagaagcuucuguuaugggcaugaacuucuuaucggcagcuuugagggaaugaaggcacagccacccuuucaaggcacugccagguaccuggcuaaggaaggcucuuucuguccucaggacuuuaugcaucccaaggcugcuagauuccaucuuucuuugccaguacuccuuaacucaaaaauggaaaugugaguuccagaacauuccaaagcacuaacuuuuauuuguucuuauaaauuuggcuuucuucagaguucauaaggaacuucuccaaugucccauucuaguuucggggcuuuucaaucuuuacaaauucuucucuggaacuacuuggcaaaauuaauaauuuuggcuacuguuuguucaaugcauacuguaucuaaguauuaucuuagauauuuaacauaaacuauuucuuguuuuuuuuuguuuuuuagcaacagggucuugcuuugucacccaggcuggaguccaguggcacaaucauagcucgcugcagcuuugaacuccuggacucaagcaauccuucuaccucagccacccaaauagcuaggacugcaaaugugugccaccacaccugacuaaauuuuuuaaaauuauuuuuuguagaaguaggaucucucuauguuuauuuuuauguuuuugagacagagucucauucuugucacccaggcuggagugcaguggugcaaucucaguucacugcaaccuccaccuccuggguucaagcaauucucuugccucagccucccaaguagcugggauuauaggcgcccaccaccaugcccagcuaauuuuuuauuuuuaguagagaagggauuuuaccauguuggccaggcuagucuugaacuccugagcucaggugauccacccgccucggccucccaaagugcagggauuauaggugugagcuacuaugccuggccucucuauguuaccccgacugguuuugaacuccuggccucaagugacccucccaccucagccucccaaagcgcugggauuacaggcaugagccaucacaccuggccuacauaaacuauuucaaaccuuuacaauaggcauaugaagcaaauauuuucugccuaccaccccuccauaggaaaaugaagcucagaauauuuaaaugacuaggcagaaguuaaauacccaguuagugaaggggcuagaguuugaauccaguucugucugacccuaauaucuacacauuucucaccauguccucucucauguaugcgcuuguugugugagugccugguauguccaggagacuggaaguaggaggaguacaugagagggugauacccagaggagagccuggaaaaugagguucaggccagccugggacaggcuuugucucuguuggcuagccagcuuggaagucugguuuugaaagcagugggaagcacaggaugguuuuuaagugaagauguagcaugaguuggguguuguauagguaucuuuggcuggcagcaacauauauaaaugagacagggagaccaauuggaagacuguuucuuuagccagugggauuagaugagagaagagaaccuacacuaaagcaaaugccaccgcuuuuguauaaaggagggaagacauuccaggacauuauaggcugguucuauugaccacuuguauuuuaccuuguaagggagaggcauugaguuucgaccuuggagaauagauggauggugauaucacuaauuacauuaggaaauaaggaggggaaguuaguuguugagcugcuaauggaacuucccaguggaaguuaguuguuggcaguuacuaauaggcagauggguaaguaggucuugacuuggagauagcucugaauuugagacaguuaccugguggacagcaugaguguggguguaacagaguagcagguggagcuuagaguaccugaggagauguaucaaccaagaagcaaggaguuaaggauggagccccaacguucagaagacagacgggaaaaaguagagaaaacuuaggaagaugauuacaaagaagcugcuggcauuggucauuaggaggucacuggcgcccucauugggagcaguuuccacccauuggugcaggcagaagcagggucaccacgaguucaggagugaaugagaggcauagaguggaaacaguuacuucuagacagagcagggaaggagacagaugggaguaaccugaggaggaggcagguucaaguaaagguuuauguaagguggggaagcccuggacgugcugucagcugugggaaaggagccaggggggaagacuggaggcccaggagagaggggagaugacuaauggaagaaggugggaggcauggaauggcaggcagaggcagaaggaggagccuaggaaaggaggagacacaccucuucccaugggauggggagagggcaaggaagaugagaucaaccuugaagguggaggggagugggauacaggguaggauucacacugaucucagggucagcagugcuuuccagaaauggauugccugacagaguaacccacuuauggccuaaauuguguguguucccuucugugugaaggcagucucaagguggcacuaaauaaaauagugugcaauauaacaauaaagagaggcaguguggcuuagugguuagagaauggauuugaagccagguagcugguugaauacagucucugccacuuaauagcagugggacuuugggcaagaaagauaacccaucagugccucaguuuccuuaucugaaaaaugacaauaauauuaguacccaacucaugaagguaauuaugaaguuaaaaugaguuaauuguaaaauauggagaacagugccuggcauguaauaggugcuauauaaguguucgcuauuguuauuggcaguaacaugcacuaacauuuuugagggcuuacagggucccaggagcaugcuaaguguuauaccugcauuaccuaacuuuaaguuuguaauagaccugggaaagcaggaacaacucuuauuuucuuuauagagaugaugaaacaagguuccgagaaauuaacaaacuugcccagucacacauugaguaagagcagagccaggauuugaaucuaggccagucugccugaagaaucaugcucuauccacacuggcuuucauuccugggccccucccaagucaguacccaguuccuuaguacccccguguuuccuuucauacaacacugggaagacaguucagacugaggaugcugcagggugcgagcuuugucacucccugacacuucucugggcggaagaguauauaccaagaaucucuguuugggggaagagcuccuuuacaauuaagcaaagauuuagugauggcaaauuugagggagguuagggcugguuucuugcugcuuaaacagagcagaagacuuucuguugaaacgccagcacaaugaguguuauaugaaggguuauaacaaauuguaagccagaaaccucugagcaucugguuuuaguuugaguagcugcuuguucaugccuuuaucuaagcaaugcucauguucucggcuaaaagaagcccaguuuguuucauuccugguucauauuacaugucagccugauuuuuuuuuuauuuucauuugugucauaggccaagagagucuagucaggguacaagggauggacuguauaauuuugagaaagugagaaaaagcccugugaccuaaagcagaaggcuaacgugauguuuuccacaaauagaguuugaguuuucucaggccuguaagugcacgcuauuccuuggaaagcuugcauuugggagauuguucuaccauuaucucuuucuuuuaagugauggaggaagaaagugaaaucuguugagcuuuucuuaggugccaaauauuacccuaagcacaauuuauuuacguuaacuuauuuuaauucucauaaccaacuuaugcagucagaauuacuaucuccauuuuccagauuaggcagggaguuguguugaaggcaggcagaggcagagcuagggaccccagcagguguaucugguucacauguauuuugcaagcccccaacacuuuugaaugcaccgugcugagaugugucuuuuguguucacuaaguaacagaaacaccucugaggacaauacuaagucauagaaauacugaaaacgaaagacagaaaaagaaacagcaucauaagaacaucagcuuuuagucaaaagucaauauuaugguuccugguuaaauguuugaaaaauuaucuuuaaaaucacuaauaaaauaaggugcaccgauuaguuagcauuguuuuagaagcuuuguccaagauaagauaugacauagaaacaagaggcugagaaaaagucaucguuauuugugaaggguguguuuguauuccuagagaaaaaaaaaacauuaacugaaaaacuauuuuacuuaauaggaauucagaacuuguaacuggggcacaagauagcuuuuccaaaagucaauagauuucccauauaccugcaacaaccacuuaugaaauauaaugaaaaaugccccagucaaaaaaaaucaauaaaaauuaaaguaucaucugaaugaggacuacaugugaccugugugacaaaaacugcaaaauuuuauugagagcuauaaaacaggacaugaauaauuaggaacuauaacauguuccuagaugggaaggugaaauacucuaaauaugucaauuuauaaguuuaauggaaugucaaacagaauccuaaagggaauugaagagauuugauugcauggcuaaagacuucaucuggaauaauaaacagaugaaaguauggaagaaauuacaggaagaagaaucaugaaaggguacucaucuuuaaauaucuuaauauaucauaaauccuuaauaaaugagaauaggagucaagcagauuagugaaguacuacaaauauuaccaguuacauguaaaaauuuauuauuugaaaaaugaagaauuacaaauuaauggagaagagaaggcuggaucaauaaauguuuuugcaauaacuuggaaaagcaucaaauguaacccgagucugcaaaguggcauucagugagauggaugcaguugauaagacacagagaaggaguuuuagccugcaguguuggcccacuauuuaacauuggaugacccuccauaaaacuacagguuuauggcuucccuuaaaaaauuagaagaccaaaauuccugugagaacaaggcccugcccccuuuggauggaacucauacucuguaauucacccaucuccaccuccuccauuuuucuuacauguaccuggccugcuuuacuccuuuaacuuaccugccugcccccuagaggaauuuucauuuucaaccucugauucagaccucaccucauaccauaugccaaaauaaauuucagacggauuaaagagguaaauauuuaaaagucaagcuagaagaggguaaaacccaauauucacauaucucugggucgaagaggacuuuuaagcacuaaagucacugaagaaaccacaaagaaaaagauugagaaauguuuacauaaauauguaaaauuuccacaugucuuauaaaacuuacaaaauaagaaaaaucacagaguaagaaaauauaugcaguaaacaugagugaccaagaguuaauauguauauuacauuaaagcucagaugcugugggaggaaaaaaggcauuaugaucuuacagguaauggcuaaagcuuauguguagaaaagcuuuaaaaaauguauaguacgcaauaaacauacaugaaauauguuuaaccacacuaauaauugaagcaguacaaauuaaaauaaugguguaucuuuuuuuuagccuaauaaguuagaauccuucaaguuaauauccaaucccauugaggcugcgguggaacuauaccaauauauauuacuaguugcaucauaaaucaguacaacccuuugggaaagcaauuuggcauuuuguauuaaaccauaaaaauguucagcuucugagaguaucucuuaaagaaauaaaccaguaccuaggaaaagcugcacacuuaucacagcauuguuuaaaauuguggcaauuuggaaacaauccaaaugucuaauuauaagaaagcauauaauaaaauauaguauaucuacuuaauauuauauagccauuaaaauuaucauaaaagucugaacuaugggaaaaugcuuauaauuuucaguccaagagaaagaaaacagaaguuauguuuacaauauaaacauguguauuaauaacaagguaauuugccuaauccacauauuuagagguagaguuugaacuggaauucaagucuuucaacucugagaccauugcuuuuuccaccugcccacuuccuucccuggaagccaaggcaccauuuacaggguauggucaggagaagguucaucagguugaucacuggaguccaguggaucuaccaagcugagccugauguggugcuucaaagauucugauggggaugugaaaauguauuaguuuguuuucaugcugcucauaaagacauaccugaaacuggguaauuuauaaagaaaaagagguuuaauggacuaacaguuccacaugacuggggaggccucaaaaucaugguagaaggcaaacagcaaacagcacaucuuaccugguggcacacaagagagaaugagaaucaagccaaaggagaaaccccuuauaaaaucaucagaucucaugagacuuauucacuaccaugagaacaguaugggagaacugucaccaugauucaguugucucccaccgggucccucccacaacguaugggaauuauggaagcuacaauucaagaugagauuuggauggggacacagccaaaccauaucagaaagacaacacuuuugucaacccuaaaaccucuaagagcuaggauuuucuaagaguuuccuccucuccccauuuagcucaagugauaaaaugaacaaauguaaaggaccagaaaaggaucugaguugagcaaaagucuuccugccaguguaauuacuuaagugccccuggugacaugggcacguguauguuuugucagcucuguuacacaccuguaugcauauaaauauuuuaaauauuuccaauguuguuugcuuuuguuguuuaagaaauugcauuaaguuaaaaccauuagccaugaaggcccaccauguuucuaaaccaguuuugcuugagaggaaaaaaaagaccccagauggucucuagaucuugaaggccuaguguuagaaaauacagagaaggcuuacugaggauucacuuuaagaaagaaagcauauuuuaaagaauccugagauuugaaaacucgagccugcuguucuguuuccuacauccgcauccccaaaacagacaagaauuuucuguguaacagaguuuaccauuacaguaauaauccccuacauuguguaagaguuuagcuuacugaacacaaugacauaccauuuuuucuuuuuuccuuuuugauccacacaaccuacugaauaggaugguaagauuauugucccaacuuaguagacacagcaaacugaguuucagaaaaauuaaggcucuuuucugaaagguuuuuuucuuguuuuuuuguuuacuuuuugggacagagucucacucuuguugcccaggcuggagugcaacagcgcaaucucggcugacugcaaccuccgccuccagcauucaagcgagucuccugccccagccuccugaguagcugggauuacaggcaugcgccaccacgcccagcuaauuuuuuguagaaacaggauuucaccauguuggugaggcuguucucgaacuccugaccucaggugacccauccaccucggccucccaaaguacugggauuacaggcaugagccaccauacugcccccaacccugaaaggcuuucucacugguccaagaucacacagcaagugugacaagaccagauuuaaaugcacuucucucguuucauucauucauguauuuuugugaauguguuuauucgguauguguuucuuuugcaccuucuauaugccuugcacucuggucaggcuguggcugcuguugugaacaagcagacagggacucugcccuaguggaucuucaagucuguccggaaagacauugaucaguaaugugacugugaugagcucagaggaaaaguauggggccuaggagugcaccaacaaggggugcuaaccuaauugggguaggagucagggaagguuuauauuaaguacaugacagcgacaucuaagcugagaccucaaaaaauuggauagagagagcuaggugagaaggggggaucgguuuaaaacagaggccugaagaucaccaacaauuaauaauuagaggaagagccagaaaaggaggaugaggacuagggccuacagugguaggauuauuggaaagcaugcuggcuuuuuuuguuuguuugauuuuuguuuguuuguuuguuugagacagagucuugcucugucaccaggcuagagugcaguggcacaaucccagcucacugcaaccucugccuccccaguucaagugauucuccugccucagccuccccaguagcugggacuacagguguguaccaccaugcccagcuaauuuuuguauuuuuaguagagacaggguuucaccauguuggucaggauggucucgaucucuugaccuugugaucuguccaccucggccucucaaagugcugggauuacaggcauaagccacugugcccggccagugugcuguuuuuaaagcugagggaaaagagagcuucagcaaagaggagcuagagaaucaugucaaaugcuacugagaggagcuugugguugacuguuacaugccucaccgcccuggagucccacuauaauaagaguaaugauuuaaaacaagcaggaguaaacccacaaggacaaacagaauaagagacaagagccagcaagagaugccagcagacuuuugaaaaaaagaguggauggaguuagcaguguggagacacggaaugcugagccccugcugagggagguaucaauuagaagcagagucacagaaaaccuccagguacagcaaaggcaggggugaggcacagagcuggaaacggguggauucagagucuaugugacguggaagcagcagcaaugaaacccuuaaguuuccucccucaucucacauggacaagcgacugucuucucccacccuggcagaggaucggaggcuuguuccguagagauaucaacaaggagcuuccagauucagggaagggagagucaccauaccaaaaacagaggaaauaaguaccaacugaauuuugaaaaugacauucuagaucccauuuuugacagccaaauguaucauaucuccucuauaaggaaggagauuagaaaagaaaucagcagaagaguggggggaccaaaagacucugguagugccuucuguggauccuccacaaaaucccuggguccccacuccaucaccuuacgaugacagucagcaguugacacagagcuuuuuggcaucucacucuuaaauaugaacagaggaucaucagacaucugaggaaaccuuccagcaaguaagaaaagaccaagacaaauaggaaaacaaaagaacucaaaggaaacaaaauaauauaggagaagagaacuucaaagagaaaaagacuauagccugucaagauaugaaagaaaauauauuacugucaauguaaaacaagaacauauacacaaagggguauagaucagagaaaaggagagcacucuuggacauuagaaauaggaaaguuaaaauucccauaaauggguugaaagauaaauggaaggggaggugugcuaaaaauaaauagaacaaaauagguaagaaaacuaaaggaucaauucagcaaguccaaaaucugacuaauaagaacagagaaauaauacaagcacauuucccauagcugagggacaugggcugacggauugcaaguggccaaccuaguuaacuuuuucaaagucacucaucuuccugaaagcucccagaaagggaagagauuacaugcaaagaguuaggaagcagaugccaauagacaucacuagagaagagccugaagaugaauaaccuuaagaauucugaggggaaauuauucccaauuuaaaauucuauacccaaauuaucaaucaaguguaagaguaaaagaaagauaacgucagccaugcaagaucuuaaaaucauacccccgauucaccuuuucucagacagcagcuggaaaaugcacucugcugacaugauaaaguaagccaaggaaggggguccaggaagcaaaagguuuaauaaagaaggaggugauaagaagucacaaaugaugaaugcuuagcaggccuggaaaacaaccugaccagacuguggccaggcagagggcuccagcagcaagggcucugggcagaugacagcugugggucagauaaaugaccugguguguuugaccaugcgggaaagucuaugucagagggauuuuauaguucugucagcuaauuuggguggagguauuaauagaaacauaggaaauuaaguaagcaaaaaaugacgccuuuccauuagauucuacuggucagaaguggcagauaaugcaauggagggaaguaguagagaacaucacaugacaaucaaaaauugcuguauaagcacauuauuuagauauguugaagugaauucuggaagaaauagcaaaggaguugagagaauggcacucagguaugugggugaagcagaagacuguuauuuuuuauuauaaacuuucauaguauucuuuggcuucuuaaacuguuuacauauauuauuuugauuuagggggaaaacauuuuaaugcuacagaggucaaggaagaaaggacauugaagaaugugcauuggaggcagcgguaggaacuguaggagaccugugggguuucuucuacaucuccucacuuagcaccgugcauuuggauggcuuauuugagggcaagguccacacccagcauucgacccaaauaagcaugcauuuauuucucuccaggaagagagucuguguuucuaggcauucauuaucuagaauaauccgaguuaaggauacuguggugauuggaacaugucgacaauuuagcagccuuuccauacacuguuguacggguucagaggauaagcucuggagccugaguacacagguucaaauuccuccaccugcucuuacuagcuacauugccuugggcagacuuagcaaaggcaacaaguugggaaauggauuaauaauaggcccugcccuuauuacgaggauuacaugaguuaacacaugcaaaguguucagagcaggcuccccacuaagugugcaauagauguuaauauuauuuuuauuccaaauuccucuuucauauuugcuuucacacaauuaugaaagucacacaacuguccaaauuuagauuuuacuuuuuaaagcccaacucuauuaauauggauaaaaagcaaaagcaaauccauuuacaaacauauguauugguguugugugugugcgugcauacgcaaagcacuaugcugcucccaaaagggagacaaaggcagugcaagucugaggucccuguccucuaagagcuucucacagccugagaagacuuaacguugacagcauuaaaaacaacaauugggggaguacuauauggcacaaggugaauugucaagggaauuuugagaaagccaaccaugagggucacuauagacuaggguggaccaagaaggcccggaaggauuuggauaggaagaaaggaaaggaaaaggcacugaacaaaaauccaagaugagaagcugcuugaaguaugcgggaaaccuccugagacuggcugggaaugagagcgggguucccauccugguucugcagccacccagcugugagaccuugagaacaucaguuauccucccugagccuuggaaggauuaaugacacaaugcaauguaccagcacugugccugacuugcaauaggcucucauauuacuuuguuuaauuuguacuuuuagucugaaucccaaagcaaggguauauugacuggcuugggguucgaaugaggaagcuuucuggagggagucagagcccuaggcccagaccuguaguuccaacagccugguuauugucagucucaaaagacuguucagagaggagaaauauuuacaauaguaggcauugugauuugccuaaaauaaagcugcuuugagccuucagcucaaacuaugggaagucucuuuuguccuucauuacuggcaucugucagcugacgcccuuugcagcuucaguucugccgcuccuccugugugccagccccgcugcacuaccuguaauucugaaaacaucugccuuugaagguaauguucuuucuuucuaaauauucccugugcccuucucugccuggagaauaucugcccagucuccaagguugagugacaaugccuuccucgccuucccugagauguugcuccaucaucugggcuuuacgcauuuauuaccgcaagcacuuagcacauugugcaucagacugugagaguagagggcagaggcugugccuucaucauaucacaacugaccaagcauuugcucuucacccggccaggagcugggagcugggagcuggggccauagagggaguuaggucccaccuugguccuccaagcucguguuacaguacagcaggcagacaugcagaugacuaaugccagugcaguuuuccugagcugccaugaaacuugggcaguguugugggugaaccagagaagaaagcaauuaaucccuuaauugccugcacauggcacauaguaggguuucggugacuaguuguuugggaagccugacaguuuugggaucugcaagucauuucacuucucuaggccuccauuuucucaucugaaaaguagggauaaccauaccuaacuuuuaaugcugggguaagaguuaugaaauaauguaugaguuuaauggguuuaucacagugccuagcacauaggacucaauaacaggugguggugauggcuacuauuguuaccuuauuucaugucuaaauucaucacuuuauuauuaaaaacuuggaucugcacuaaaaaucagagaaguuuagaugggaugaaugagaggucaaauauucuaguacuucuuugacuuucaguggauguuuuugaaaguauuccugcccggagucucucucuuaauuuacuguccuggcggcugagugugaagguugggauuuccccagggucugagaggaaagcgagguuacacucagccaucguuaauuaaagcugcucuccccaagccuucggagagucguagccuggaaagccaucagaugacccgagcagcggccaccucaggccaacugcucuggaggggaugugcaccugcguccugcuaaacacuggugcacugccaggcauggagggcucagcaggggggagucugcucccugggagggugcugaucuguucuuccugcuuuccguuacauuccuuugaagccuugagaccagcaagucuagccucagccccacuucucccucaguuuaacagccaacagugagcaggucucagaggccucuccuuugugcacccucuaccuugggcugcugggcccagccccuggcuguacugauggaucaggcccagucaucagaacagccucccuggucaugggcaccaccgagguguccagggugagcaguaguggaggaaagaagccagacauuggccaguaugaugggaauuuaugggaaaugccccgggggguucuaggaauaggcuagaucuuuaaaacucaucuuucacagaaagagggaguaaugucuguaaaauguuuguccauaccuuggagguaugagccaaaaggaagagaggauucagcagccccaauacguccaugugggugcaucccuguguguugugguguaggcggaagaaacaucaucucacacggacucacugugucugaaugauauaagccaguacuguguggagaugguguuggagcauuaauugcuguuguuccaggacaagauccaggcucccucuuauccuguugucacaaaguacacgcaccugcaugcacaguaugcuaggagccccuggugaaggagaagaagugagcuaaggccagcuaggggacagccacuagaaacuaacccacacagaagggucugcaggccccuauuuccagucuuucccuugcuaauacuauaaucccugcuguggacaggggcuuucuuaucacucccauuuuccagacaaggaaacugagacacagagagaugaaguaacuuguucaaagucacaaaggagauagcaaaguagaauuagaacccccagagucucauucugaagccugcaagcuggugcauucuccauuauaccaugcagccuccgacuuggccugucccaaugguuuugcuuuguuugguuuguucugacuagguuucauuuuaccuacuauuaaugagacauuuacugcaggccccguuaaaugccucccaugcauuaucucauugagcccuccaaccccaacaugaaacagauaagugaggaaaccagagcucagagacacuaaaugguuugcccaagguuacacaacuagugagagucagagcuggaaaucauacccacgucugucugauggcauaguccaugcucugccauggaccagggaguucagccuugucaagucaaaacaugccagagacaagauccaccccugaacugaggggcagucagagacuucacauggggagauagggcccugcuggccacacgugggucacacucacacaccagcccaguggacaaguagaaagaaccagggacccaggaggaaggcuggccagacagaggggcugcagucuagugcuugaggggccccucaggcugucuucaucuaggcauacagauagcugaguguaggagcaccaaaccacuuccaaaccucccacuggguggagagcagauggccccacaggccacccucucauuggucacauuggucagggaacuggggaggaacuggcccuuuaggccaggcccaggcuggagcuaacauuuguauuauaacuucauccagugguggcuuaaaguccugcugcugccaaagucagaaauggccagaagguucuauaaaguuuucacaacagaaacuauuucucaauuucuugcaagauauguagcuaccgcuuuugccacugggcaguuucugccuagaggcugaggaaguaucugccuagguggcuagagcagcuauaaaauauuugacuugaacauauaauuacauuaccaugaucucuaauaggauuuggugucaagaagaaguccaacuuggccucuggcucaaagauauagacccaaguuauuauguugaguguuaccuaguagauaaauaagaaagaaauacuguucaaaucaucgugcugcugaccaacacgcauuauaauuauugugaagaaaaauccaccgcagccugagaauuuauccaucuugcuauucaacuuacuguguuauauccugauagaaauaauuuaaguacauaauucacagaugccaucuuggcagcucuugcuagagaaaagaauugggguccugcaaagugauauuacuacaugccccccaaauacaugguuagugcuguuuugggagaagagaggccaguaccaugucuagcuaaacguaaaaggcccagaggaagacagaucacagugaagcugcaggucuggaaacaauuuauaaaaagggaauuugaaaaaacagaaaucagcaaggaaguaagcagugcauucuccacagagagagcccagccuuaagauuugaggcugaacacaccaaaggacauaaaaccaaccagaaauugcacuuugucauuugauauuuaaaaaguguugacugcccagcuacuccagacagaacacugugcuagucacuguggcagcacagauaagagggagaauuggaaauggauccuuccucucaaugaauuugcagucuacuaggggaaaacagccauacuuauacauaacuagauugcaaaguagacagcaguagguaauaagugaaagacagaaguaaacugccaucaggauucaaaugagagcucuaucuugcuaggaagagccagggggaccuucacgaaagagguaauauuuaaacugggcuuuggccgggcgcaguggcucacgccuguaaucccagcacuuugggaggcugaggcaggcagaucaccugagguugggaguucgagaccagccugaccaacauggaaaaaccccaucucuacuaaaaauacaaaauuaaccaggcaugguggugcaugccugcauucccagcugcucagaaggcugaggcaggagaauugcuugaacccgggaggcggagguuucagugagccaagauugcacgauugcauuccagccuggccaacaagagcaaaacuccaucaaauaaauaaauaaauaaauaaauaaauaaauaaauaggcuuugaaggauggauaggacuuggacaagcggauaagugggaaaagaggauuuucagguaaaguuaugagcagugggcucagucagggaggcugaaaagggaguguggguucagguggggaguaauuuggcagcagcacaaagagggcaugagaaagaccuuacuugaaaagggcaauuggauccuuaaacuccugguucagaaauuugggcuuucuccucuccaguguuuucuaaaguauaguucccaagauuauuuuagauuauacauagacagacucuauuucaaaaauuauguauuuauuuuaguaaacuggaaaaauauaguuagauauagcaaaucauuauuucauagugauauugaauuucuauguuaaauaaaguuaagaaaauaaaugaauugaaaaaugcuaagugaguaauaggacagaugguaugugaauauggcaacagcauaaaagcaguacccaaauaagugacuuuuagaaaacacugcuccaggccugggugguauacucggaugccuagaaaccaggcaggugacauuagugcaggaagcuacagagauggccuguggcugaucauagggucugggccugcccuaaaugagaagagauuauucccauguuggaucuuccaauuuaaaaacuuuuuuuuuguauuuaacaaguucuaaguaucgaaauagauauaugaaagccaacaugaagauuuuucuuugaccucauuuuuaaaaaguucuggcaacuaauucaaauuuuugaaaacacuacauaaacagaaguguccauagggcuccuguuuguaauaucuacuccagaugauaagggacaguaacccuauggaaggcuacugccccuuaucaucuggaguagacaucacaaaggggcaggccuggagacagaaguccacuuagaaugcugaugcagcaguccaggccaugaguaacauggccuggauauuuccauuuuccagguacaguccaagccaacauagagguuuuuaccuguaagucucuagguuaucuuuauauaguuuugugcauuuucauaucugacuaugcugacuuaaaagggaggagaccggccgagcaugguggcucacaccuguaaucccaacacuuugggaggccaaggaggguggaucaccuaaggucaggaguucaagaccagccugaccaacauggugaaacaccgucucuauuaaauacaaaaaauuagccaggcgugguggcacaugccuguaaucccagcuacuugggaggcugaggcaggagacucucuugaacccuggaggcagagguugcagugagccaacauugugucacugcacuccagccugggcaacaagagcaaaacuccgucucaaaaaaaaaaaaaaaaaaaaaaaaaaaaggagggggauuugguuuucuauuugguuuguaaguaguagagagcuuggugacaagccuggauaaaugauuggagacuaauuagcagcuccccacaccccacuuccucagaaccuguuucuuuuccugcauugucugucaucacagaagaauucaacacaaagugaugcucauuagauggaacucucuagccagcagcugaguugaguguuuuacacugauuucuuaaguaauuugucccagagacagacuugacaugaaguuggcauuaugaucagccggucacugugugggagcagcaaaaaugauuauucuggaucuggcucuuacucuuacuugaccuccaucuugcccagaacugcuuugcauuucaaaagccuguauauucuuuaagagcuauucaaauacuaccuccuggaggaccaagcccuccucuuuggaacugguccacaagcucuuuugcauucuuggguaguuuagaucuuucugcccccucuggcuuguuuuuuacagacuuguguguaaagucugucuuucuuccagacgagcgguucucaaagccccagcccaaggauauuaucaucaccagagacccuaccccagaccuauuaaauuggaaacucugguggguagggcccagcaauccauguuuuaacaagcuuucagauggcugacaaggauaaaguuugaaaaucacagagcuuauacaggaguaaacuaauauuuccugaguaucuuuuauguaccaggugcauauauauggugguuuuauuuuucacaacuguguaaggcaaauaguuuucucauuucacuaauaaguaaacugagacucagauacagugacuucuccaaaucacacccucagaagucacacgguuggaauucagaccuagaccgguguagugacucuaaaggcuaaagccuucccagugcuccucgagaauaaggacuaugcuuuggauccucccuccugacagcuuuaacacaguggagucaauagagacuugaucaacaaaucaauauuuuuguccaagugugauacauuugcgaguggcuggagcagcauuuugauuuuugaauacugguaggcauguuugaaaaccagaguuucaguuaacaaagccaaaauagauaccaguuggaauguacuggcccuggcagcauccucugcaguaguccugacucuauaauugacuaaucuacaggcaaaaggaaugggaucagcaugugauauaguuuagauguguguccccauccaaauuucauauugaaauguaauccccugguggcccacgccuguaauccuaacacuuugggaggccaagguggguggauugccugagcucaggaguucgagacuagccugggcaacauuggugaaaccccaucucuacuaaaaauacaaaaaauuagucggacgugguggugugcgccuguagucccagcuacuugggaggcugaggcaggagaauugcuugaaaccgggaggcggagguugcagugagccgagaucgugccacugcacuccagccugggcaacagagcaagacuccaccuccaaaaaaaaaaaaaaagaaagaaagaaaugcaauccccaauguagggggugauuagaucaugggaggagauuucugaaaagggaguguguacuaucccccucgguacuguccucaugauagugaguucucccgagaucuggucauuuuaaaggguguagcaccuacccccacucgcuuuugugcucuugcuccaugugauaugcaggcucccacuucaccuuccaccaugccucuaagcuuccaguggucuccccagaagcagaugccgguguuaugcuuccuguacagccugcagaaccaugagccguuuaagccucuuuucuuauaaauuacccagucuccaguauuucuuuauagcaacaugaggacagacuaauacagcaugcuuuuauuuuuuuaaccggauuggcaguugugguaugguagaagaaucccuagguuagguaggaguagaaauccagauuuugauacuggcccugucacuuauuagcggcaucaacuuaggcaaguaucugugccuucauguucucaucuacgaaaugggaaagaacacuuucccuuccuacauacggaacuguuguaggaaugaaauaaaacuguauguggaaauacuugaaaaacaaaaaguucugcacuuaucagcuauuaucaaagccuccaagcuaugaaguagauccuggugacgugccaagguaaauuaguuuuuuccguugcaaggggcaaaacacaagcaaucucaaggaaaagcugauguggcaaugaagucguuucuaaaacauuccuauugcuggggacgaaaauaggcaccgagaagcuucuaggaauccgggcagcucaggggccuuucauucauucauucucuuccuucaugggcuucacugcuggucuugcugcaguguucccgccucuuuccaggcuucagcuccauucaugagcuuucucuccucacucaggacugcuuccucuucacuuugguuccaccuugaccuuaaggaccucaccagcccgucucuuccuaucacaccccuuggcuccugcuccugaaugcuaaguucccuggguacauuuuaguucaaauacuagagaacgggcucuuauuggcccggaaccucugcccagugggcugugucacagagcaccguucagccugugccugagcuuggcuugggucaggugcucagccggguccaaucagcugugggcagugggaacggggcgagguguugucucuugcaccugggccaccgcugggcaggcgcugaggccggggcauugcacuggagcugcuguggguuaaggguggagggaagacgaggcauuucccgggagcgcucgccucuccucagaagggccuagugcucuugaagagcgcggcacuuggcugucuccccaguacuuggugugugucucagugaucucucuggcacgugcucacggggcaccgcugggagacgcagcagaacaagagcccagaguguggcacuggcauccgagagcgcugcugccaacagccaggaaggaggcuaaccucggggccgcuugaggcucccaucaagggauggaugauaaugcgauacuguuaucucaggaaccgcagggaggguuaaaaaguuaagguagcuccugaaaugagcaaacgucucccccucugcccucugcccggccacgaacaugaugacuucuucuuaauuuuaacuuacaguuuguauugguugaaguaauaaaauguaaaucagcccuuaguuccuauuucuugucuauuguuuuucuuuuuuuaaaaaaaaaauuuuaucuuaaguuccaggguacaugugcaugacgugcagguuuguuacauagguaaacgugugccauggugguuugcugcgccuaucaaccugucaucuagauauuaagccccacaugccuuaacuauuuauccugauacucucccucuacccaccccacaacaggccccaguguguguuguucacguuccuguauccauguguucucauggaacaugacgauucuuuucucagcuuuuucaucuauauguaucauuuucuaaguccugacaauucagguugauucaucagaucacaggagguuagaccugaccaaucacuaaagccauccacuucacuggaacacuuccugagcuagaguggauucuuaguaaauauuuacugaauaaauuuuauaaauuuuguagaugaaaagaaaggcccugaggaggaaagaauuugaucagugucacuuaacaaguggauggcaggaguaggacuagaacccaaguuucuugagacaguccaagcaaguuccuuuacaccaugacucacagagucauaagauuucaggcuuggaagaugucauacgcuucaucuuuaauacccccugcaguauccccacuagucauuaauuugcucucuccuugaauacauccagcgacugaaaauauaugacuuuguagaucaccuaggucauucguuuuagucauucagcuaacaaacauucauuaccugcuuugagucagauauuauuugccagagauccagagaugaauaacacauuuccugccuucaagaaguuuacaauauuugggcagauacauacauguaaacagaacguaacccaauguaguaaguaguauucagcucugacucuuagaaagugaguaaguugauucuucuuuugaaccaagucuguuucccaaggacuauaguccuuauucacuggacccuggucaaccuauuagggccacaaaacaaaguccuuauuucaccugauuacguuucagauauuuuuaaacagaugucauaacccccuuaguaagcugaauuuucaauuccuucaagaauucuuuauuugaaaugugguuucaaguucuuuaaucuuucugguuguucuucagugaacacguucuagcuuaacucaucagugucuuaaacguggcucccagaugugaacugcugaacuccaaauauggucugagaguacaauguggaauucagcuucguaucacuguuuauucuaggcauuguaauaaaaaaauagaggcaaaggaaacaguauguuucuuggccaccaaacgccucuggaaccugauuauuguggcauccccacuucucugaccucuuuccucuauuuuccccuuguauuccugcuuuguuuaucaauacaauaaauauuauugaguucuugguuuguguuuagcaaucacaagacucuuuggagaaccagacauaauggcuguguugaaggaguucacagucuuauugguaaaauuugguuuguccccaaagaaauaauuaacaaauagccaagacugaauauaauaaggaaacaaucuuucuccuagaccuuuccuuagagcuggucuuaauagugguugguggacuucuggauaugacugaaaacagaucuuccaauucaaauguuggcacagaacuggcuucaagcccagucugucaggggcuuugucaaauuuuugucauugcauugaccuagacuguuguagacugaaggccuuugaauuccaucgucugcaaagaaagcugggacauccauagggaccgacacaucacaggccauggaacagcuuuccagcaccuggcaccugcccagugccaaucuagagugcaaugggagaaaacuucuuucagauguuggcaggagccugcuuguguuugugcuucugggagacaaguuuaauuugcuuucacagcgcuuucccccaggagaaaauuuacucaaacacccugccuucuucacauucagaagcauugcuuguuuguuuuccaguuuuuaccauggggaguuuccaugugucuugugugccuaugugucuguggguuuaccccccagaaacccacauuuccuuguuuggauucauuugaccaagucagauuguuuuuuaauucauaaauggaagacaugugugacccuuccuuaaaaccaaaauaccagcucugccagguccugggccaaccucuuuacaugcacagcaucacccuauuuggucuucaaaauaacucucugagguguguguuacuguucaccccauuucacaaaugaggaaaguaauguauagagauggcuuguccaaaggcaucuagcuaguaaggguuccagagcccauacucugguccaggccaaaugcugcaaacuuuggcugcauauaggacagguucaccuaccagauuuuccccuaucagcugugugaccuugagaaggugacuucaucucccauucucuaucuaagacuguaaaauggugacauaaguaccuaugucucauaauucuuaugaagauuaaguuagaauauaugauuugcuuuucgcaguuccauuucagggaaugagagggucucuguuggacucuuccuucaaccuugaguugcuguagaauuaaaucccagcuaugcuaucuaguuuccauuucuucuuuuugguugcuaauaauaaauccagcccuucuauuucaggagcaaaggggaugaaauagguguaaccugaaguauaaaugucaccagcugcagucaaagugauauauccagguggccauccuggaguucaagcuccuucuugccuguagcauuaucauccauccuccucuggggaagccaggaggagucagaagguagaucucuggcaauggguauaccuugguacuucaaccagguguucccaaagaguuccugacaaccacuuuuauaauuuaaggagacaacaaaaacagaaggagauauuaguaguaaaugcaggcuucuauuagccuggacauaucacaagggaacaagacauacaggagcuucugggagggagggauaaaguguggggugagcagaaaggagagaaugagagugucgagugggccuugaccucauucacaaagcugguuccuucugucuuugaugcuggaguccggcaucaagcucgcacguccacagagguuugcccacucagagcaaggcaagaggcagguaugcccaugccauggugagcugacagaggagaaaagcugccuucccuuuacugauauuacugccccugugagacaguuaaggaggcaauugggcuguccagguaguccuccuaauaggauuuucuucuguggucucuccuuguuuccuacaaaaugaggcuucaggauuuuagaaaggaaaaccagaaggaugcaaaugagggcagacuuuccucaacaucaacccuggacucaggagaacuuaguuaucagcugugaucaucuuucaccuugacauagcugcgcuaaugauuuguuucugaaaacaaaucaggaguagugaacagucaaaacgggcaccgcaguggguucccugaggccucuguggguuccugacucucaugucuccacugggaagaagcacuguugucuuuucuuccuucugcaguugccccuuuguauuucaagcaacauuuuguucaauauccagagaacacucccacucacaacacauguccagagaaugagcuaaggaaacacuuaaacucugcauuccaauacagaugaaaggaaaaacaaguuccugaaaaucauguauuuuuuuuuuuuuuuuaccaggacccacugcugugauagaaaaacaagcugggggaaaggccccauuuuccaacaugccauauacccaauuaugaaaaccaauuauucauaggcugcugaauuuuuaauuuggauccaagcagaucuaaaggcacaccuucugcuaaaugaaggcagcugcagugugaacaugagcaaagcaggagagacugugggggaagaaauucaccaaacacuaauugggaacauccacaguacuuacgcauuaaaguucacacuuuucccaagccaaagaauaucauuucugcccuagaauguagcacagagauaccuggucaguggagacucauuauuugugggauccuaacugaaccucaaguuguugaaaucccuccaaguggaagaaaaauauauacauaagcauuuuaucaaaagaaaauauucucuauauuucuccuuuccauuuccuuguugcuaucuuaaaauuauuucgugucucccaaaacuucugccuucucuaacaccaguagccuggggcaaguuuuguagcaaacaggcuucuaugcugucagguuuagcaaccaacacuacacucagucacagaaaauaugcuuucgucccuuucucacuaugaaggcuuuucggcagaugauaaacagguuguaucuugcagacuccggaaaucagaaucuaacaaaguauauaacacuuaucugcaguugauccuguuaaaaaugcaacuuguauuuauaguaauuuuauuaggagcuauacuuuauaccauuggguuugagaaggauugaaccauagaaauuuagaucugggagggauuucugagcucaucuaguggaauucuuucaggaguagaaacaaauauuuauugagacccuccucuggauugaauaccagggcaaauacauaaaugaguaaacucaauuucuauccucaaggaguucacagucaacaaugaaaccuauaugguauuuuaauaagagggagggaaaaagaguucuggaaguaacuuagccuguguaagauguccaggccuuuccaaggagguggcauuugaacuggauuugaaagaaggaauagaaguugccaagcaggaacguacgguaggagcaagugcaauaaugagaagacagguaccgaaagaucaugugacauggccaaggguucacaaccacucaguagcaggacaacaccuggaagccaggccgucugccuuucuguucuauacuccuuccucagcccugcaggcaggacugucucuccaauuguacaauuagcccaguagcuuaaaguggaaauuaucuugccuuagacuuuacucaaaauuuuaauuuuuuaaaagaauauucaaagugaaacuuccuaagugguucuuucugaaaacaguguuuaggaauccacuacugacuuaaaggucuugggaacauggauucuuccaaguaaagccaauggagaauagagaucuucagguccccagccuaagccuugcucugcugggacccagaccauuuugcccugaaacgaggccacguguuggauuagaccuucuuguucuuaacucuguguuaauauaaagcacugcuuguguuagcagagacaacacugagugaguggaauugcccacucacuaaaggagccacacauuuggaccauuuuuccaaacuuuaaaaauaguucuuaaguugacacuuuaagaccuugaagaaggacauuucuugaaaaugcaucugcuauaaaugccgccaccuccaccuauauaucaccaagccauuuuucaagcccacguccucugagaagccuucccucugcuaauuuugccccauuccagcugccacaguacuacccuuaagugcuaugcugcauuuaaguuuugaugcccuugucuagaugccuuuucuccacccuugaucucuuaauuaauuauagacucauagaauuuuagaacaggaagcaguugcagggaaucaucuccaccauugccuucauuucacauaucaggaaggugaggcccagagaggggaaggaaguugcuuuaggucacagaucaugguacuaagaguagaucccaaaacuagguuuucuuaccuccaggcagagcuuuuucuaugccucaugcaacaguugacuuauuauuuuauucucccaguuaagcugcaaauuuccuauaggcaaggcuuguaucuaauguaguaacauucauuuaacacaggccuagaucuuggcuucaugacuuauaguugugagcuaagacaauagacugccugcuuaacuaaccuuuuccuuuacuuucaaaucugacucuacugguucccucugagaccucgggcaagucacugcccuuccucugggucucaguuuccuucuguaucagaugagaucauugggcuggaugucucuaggaucccuccaagcucugaaaguuauagaauucucuauccuacaaauagauccuuugcugccuucaggaugggcuucucugucccacuguuugauccagugaacccauagcuagagucgccacaaaaauagaggcagggaaguguucccaugagggggugccccaaacuaucccaagauagggcugguugggauugcaaagaaagaagcacuaaaagccagguugaucuguccaaagcauuuauuaggggaacuuacagagugcuguagcaauucucgugcagacagcaagagaaagggauuuucuaccuagguaucuccauagcaaggugcccaggguauggaguuuauauagagauuuaaggaguuuggcucaaggccagggcuaguuucuuuacuguuuggggaaacaaccuaaacaccuuuuucaguaccugagaauguucaaggcuucagcguggacuccagccugcagaagaguugcuaauggcugugucagucacagagcggucaaggccuguauuucucaaucaggacacagaaaaagugggaaguugggggauccuauaccgauagaucugccuugcucauuuccccagauucugcuguggaauaaguuccuucaagauccagauagcauagugucaugcagcaaggccaggcguggagcccgaaggcucggguuccaguccuugcagucuugccucuuugauuuaguaucuguggccuuccacaggucacuucauuucucucagccaccuguugguuuuguuuuguuuuguuuuguuguaaaauaggaauaacaauauguacuugucagauuuggugaccgugaaaugagauaaauuuguggaaauacauggcacaaagaaggcauuggcauauaguugcuucugugccucauuccacauccagcauuauugagaaaugagcuguuccaaauaaacacacauucuggauaauagguuuaccaacaggagcuacaaaacagugccugacuuuugauuaaaaucuuucugaaauugauucuauauuuucuugaccugucacacagagcauguaacaaacguauuaggaggaguuagagaaaggaacaucucugcaaaaggggggcaugacagagagcgugucuggggaugcaaguagugcagaaggaauaggaaagaaaacuuuuuuuuuuuuugagacacagucucacucuguugcccagucuagaguguaauagugcaaucucggcucacugcaccuuccgccucccagguucuagugagucucccaccucauccuccugaguagcugggauuacagguguacaccaccaugccaggcuaauuuuuguauuuuuaguagagauggggauucaccauguuggccaggcuggucucaaacuucugaccucaaguaauccaccugccucagccucccacagugcugggauuaaggccugagccaccacgcccagccagaaaagagaacgucuuugucucuggaaaggacuuggauuuuuuucaucuuagcaaauggggagcgcuugaaggguuuuaaggagagugauaggaucagauuuguuucaaagaaauaacuuaggcugauggguggugaacacaucaaggugaggagcaagagggaaggcugaaaggccugccucaggcugguguaguggcuccagugagagacgguggggaccuacauggauauaugaaaagccagaggugggaaaagacagauuuguaaaugcucaguagcuuuauaucaaaacaaaguauggaauaucagcccauucugagaaaagcauaaaauacaaaaaguauaaagaagacuauaagaaucacccaguaacacaccacccaaagaaaaccacuguuaacagguuaaacuguucucucucaguguuuuuagcugaagaaucucuaauguguuuguagauacaaauuugauuuauaaaaauuugguucaggcagacauuuuccagaacacuucugcuaaugucaauugaacugugcuuccauaagaguaaaaauaacauagaauuuuaacuccauucauuccuuucagugacggggccacaagagcucaaauaugugggucuuggcuaaccuaaagcuugauuccugggcucucuguuuggguaaggaaauuuguuuucaacucuccuucuccuuucucuccccagagucgguggauaacugccccagcaacugcuauggcaauggugacugcaucucugggaccugccacugcuuccuggguuuccugggccccgacuguggcagaggugagaacucugcauuggagcucuggauuucugcuucccagaccccucaggcagcucacuucuacuucucagagcaagugcagaauccagcccaccuucugaugcccacgagaaggguuuccaagggccauucuccagaagcccuuggagggaggugugcaggcagagccauaaccuugucagcugcuguuauccacauguggaugaucggggaggucaggaagggagggugaauucacugugggguggccacagugaagucagugucuguugcuggggcagguggaguggcaguggggguucuuuuaaaacguugauuuccucuuauagcaaugaucgucccuggccgugcaucuuugaaguuuaucuucaugcuagugugaugucucucuggccuguaaauggggagccugacgacugcucuguugcuacuuucuaacagcacaggcagaaucagccaagaccccaaggggagggacugaggaggccaggccacuuuuuuccacagaggacccuaauggugccugauauuuagacacugccagugcccaugauaaacauuguggagauagucuaaaagccugcccacgaucuaucccaugcuuuuggccaucauuucuguccuggaauaauuaacaaggaaagugucaaggagaucugcaguccugauaauuuggcacuccccugggaaacuaacuuggccccuucuuuuguuuuguuuuuuuaccuuuuucccuuauucaguagccauuugcuucaugccuuuuuagggauugguccugugcuaggcaagacccaauccugggagcgcugagucuggucucagagacagacaaguaaauagacaacugcaaagcaguacgauaguaagugaaauacgcuauaacacaguuaaauacagggagcuucuaucagaguagaagggaagagcagucugagaguagaagggaugaauuucaggaaaggauucccaaaugagggugacacuacacccgaguccugaggcuugagaaauuguucauaaguagaaggcagagaugauuuuccaggcugcgugaacuacacccugcaaguacuaugccaugagagucuguuuauucuuccuaaugugagacagacucaguuugaggcagcaaagcuagcagccccaaggaaacacagugauuaccugcugagugcuuuaaaaaggaaagaagccagguggggaccaggggaagguggugcagagagagaugagucauuccuucuaacaagaauuaccgucucgucccauaugcacuuaagagucacguguaaaaaagccuuauuggaucuugauaagacugguaaguacuuucagcacaaugcaguauaauuuauuuuuauauaguauccuucauagagaagaucacaaaauccuuuacucuaagaggcagaaugaaaagauaauacuuuaaagagccaaguugggcucugcucucuucuuaagggggcaguagaauauggggcuggaguggaggacugaaaggcaagggaagcugagauuugcuggguuaaagaggacaguaaguggcgcugcagaugagguguggggaagugaaaguggaguguuauuagaggagagcgcuggaggagggauucagggcaggcaggaggcucagccacuggcuuuuccagugagauggaggaacagacugaagcuuccugucugagguuccuggcagccacuguaccccaucagcaacaugaaggggaugggguuaaguggauaccuacccugccaggcccugcacugugcacuaucaccuacaaaucuagguguguuuaaacuggaaagaaauaaagcaagagaagaagacagaugggcacacauggguguuuguggcagagcaguugaggcuacuggugaagccaggcaggccaggaggagaaagagacaaaggcaguuggggugugcuggacauugauucaugccagacuccggugcugucuccccagccuccugccccgugcucuguagcggaaauggccaauacaugaaaggcagaugcuugugccacaguggcuggaaaggcgcugagugcgaugugcccaccaaccaguguaucgauguggccugcagcaaccauggcaccugcaucacgggcaccugcaucugcaacccuggcuacaagggcgagagcugugaggaagguaagaguugcagguggcagcuccggcaccuuccucugagauagaggcuggcauauagugccaagagggugaccagggagcaggggaagccuccugagccauuuugugaccccaccuccccaagccaggagcccacccaccagcaacaguaacuaauccaaaggaagaggccaaacacaucggaguccuggucaaugaaggggagaaaugucauguauugagcacuuaccauauacggggcugugcuagaagccucgagucauguaauucaaaccuuauuagggaggaguaaucaucucuacuuuauaguuggggaaucugagacucagaggguugaauaacuugcccaaggacacauggcuaguagacagcagagcugaguuugagcccagucguucuggcuccauagcccaaguucuuuucacuccccucuaggcucaucugcucauuuuuaaucuccauuucugaagugugauucuauuauaggccuccaaacucugcccucuuuuaucacacucguguguguguguguguguguguguguguguguguucauguguauggcucugcagugcccaugagcaugccucuccuuuauaaaauaaauauauggcuguauagauugaggcuggaaaagugaacuguugauuuaacacugacaucuguucuuugcuaggaaauccaaccaagugaaauaaaugaauauuucuaucucacaaauuaagaaacugaggcccagggaagggcagugacuugcccacagucauagaacugacuaauggcagaauugggauucagcccaggucucacuucaaauccaggacucuuccuucuugacugcaugguguuuccagcugagaggaagagccuuauucgcaagcaauguaaaguagcuguuaaaagugcacacucuggaaucagauauagguuugcauccuggcccugccacuaacuagccucaguucccuugucuauaaaaugggaauggcuuccucugagggccauugugaggauugaauuaaaugacccauguaaagcacuuagcucagugucugacacauaguaaacgcuccauaaaugugagcucuuauguuauuaguauuauucuggggacaauugaagcacauuuccuguuucgccccacucacuucauccaaggucuuuuuaaaugguuggaauuugccguuugaaacugacggaugaugcugugugccugucauuaccucccauucucugccaucuagcacccuggcaccuuccccaguggguggaagaggcuccaaggagagcugaucuucuaaaccauuuacuguuuaacagagagcccucucccaggcgucauuuugcucuaaaaauaaaacagaacauuaacaggcccauuuucaaagaguggggaacaagaagagauuagugucugaaaagcaucgccucucugagacaagcuguauauaaaccccaagcguggcuggaaguccugauucagaccuguuaacuuugauggggauuacuuugggcugucugagagagaaggaacgccaaccccuuuaacaaaggaacugggccuuuuuauccagagaauggugaccuucaucugcugucccuuuuuauucgagucacuugaggugaagacccugagaaggaaagagaaacaaagaggagauuccucuugaaacugugagcugccuccaaucccacccauguugugugggccaggaaaaggcagucguccuuccccagaugagcuggcaucgcacagcaccccagagcugcaguguuauuuauaagagagaaaaaaaugucuggaacuuugauuuacguuaucuauuugaaaagaaauguucuuacuccagcuuucuuuucugaggagggccaucugguacugauucccauuauuauuucuguuucucuggugaagcgucauugcguuguccuuguguuuauaaugggguuuucuuggggccuuuguccuccacacuucuccuccccuccucccucugcucuaugcuaacugguuucacuguguuuauaaaacaucagcuaacaagcucacuuuuuuuucucccccuuccuucuucugaaguuuauugccccauauuuuuuaaagcuugaacgcagccaguaggacacugggaaggaguugggggaggagcagaaaagaaaaaaccuagaccuuucacagugaaaagugagacccuguguuuuugguccugcagagugucuaauagcuuguguggucacugaagcauggcauuuuugggggaaagaccuguguccgcagccuggucaugcaggccucaucauuuuguuaaugggcuaugcuucugccagaaauuuggcuugaauggcaagcucugcaaggggaaaaaagguaacuauuugacacaucucuaagaggaaacuaaguuaggcugucuuccagacaaaggccagcccaccucccugaccauugcuccuacuccuucaucaccacucccuuccaccccaagcuggccgcuucuccccacuuuacacacagcuccuugggaaaucaccauuguuccugaagcugucccagugugauggaaagaagccaacuuuaaucaccaccccagaggcuccaggaugcaaaggcagaggcagagucuaccuaccaccucuuuggcagagcaucauuguggcauagauacuggcccuauaggaucaguagagcacaaggacagugucugcccagccccagcaggaaccucagccaguucagccuagauuucugggagcugccuucccuccugagaugcagucuuccuuaaaacuucccuccugcuccacaauaacuugacccaguugaccuucagaagcaaagauuaauugccuggagguagccucucgucaguuccuucugaucuuuguucucugccugggccaucugcugggaguguaggauucacuuugcugguuccuaaguccuuccuuagacucauuacgucuaaggaagcacacgccugugccacccagagccucuugcugcacuuggcacccucccagccugcuugcuaaugauggggauuuauagguucgaccucaagggugcccugggauucucagagacaguuucaacccaaaguugagguucaggcacuuacagaaaaggaaauaccuuuauuggccucaggauaggaauugcugaguuguuuccugucaaauuggaaagcucucugggucuaggggauugucacagaagccuaaugggccagaauaauccuucugagguuccaagaucugaggcaggucaugagaauuuaucacaauuauuacauuuauuauuuuuaauuaucaggcauuccaacaggucaugcucuaaccauuuuugaauggugucaggagacugcaggagaagagauucuuugccuucauuugacuucauuaauccuccacauugcucuauuucuuuucuuguuuugauuucuauuuuuaagacauuuuuuguguuuauguaaguauauaugcaugcauguauuucugaaccaguaagauuguaaggggaaaugguaagaggccuaaccaggaaagggugauucaaauuuaaauucuuccauuugccauacuacuguguaaucuugggcaaguuauuuaacuucucugugcuuucuguuuccucagcugucaaaugaacaugauaaaaguagcuaccucauacuuacauuguuaggauuaaaugagauaauguccaugaaaugcuuaauagcaaaauauggcagagaagagggaauaaguuaauguugauuguuauugugaucauuacuguguuauuaccaaaugaucacuccugaaccccgaucgucuuauuuaucauuuagguuauuagguugaacaccuuuaagacccuaaauagcaaaauaacuuucuuaauaagcuaguucucaaaauaaauguucccagaauauugccauuuguaaaguuuuugcccauuugugucugugacucuuaccuacccagccuggguuucccagucuuuuauguaaaagucaaauauaccagguuacaaaauauaauuaaugaauacauuuaaaggaugucugaauuaaaaugagcucugaccauaguuuaccccaagcuaugcuacugaauguccugauaggauaggaagauaaccucuuugcaacaguuuauacgguccuuucaaaucaucaugucauuugcuccucauagcaaccugagaagucaguagucaguaucuuuaccauaccugcuuuauagaugggaagcacagagcaguuauguaauuggaccauggaccuagaaccaguacauuuugucccuugacccuugaggccaaauggagagcuuuuucuucugcagcauagggcucccuagugaguuccuauuaggaggggccugaccauacucaucacagugucaucagcacccuuucuccaacagcuacauguugccccuucuccccaggauaccaccguccccuaacaauuauaaaaugaauagcaucccuaccucccuaaagagaaagauagaccuaacaacuuuuugguagagaaagaacaugaaucgaccuccuuuaccaauccugucuucucucugccaccuguugcacuuuccauaugaacuggagccacuucaguuaauucucaguacucuucuccuuuuccaugcagugcuuugcagaagauuagaggucucuguuaauguuguuguagccccauaacuaaagcuuugauuagggaaagucagccccugauagaaauauuggccucaggaucagacagagcugucuucagauucuggauguggaguaauuggaacccuugugcacuacuggugggaauguaaaaugguagaacuacuauggaagacagcaugaugguuccucaaaaaaucaaaaauagaauuuaccauaugauccagcaauuucuuuucuggacauauacucaaaugaauugaaagcagagucccaaagagauauuuguauaucuguguucauagcaaccuauucacaauagccaaaaguuggaagcaaccugaauuucaguugauguaugaauggauaaacaaaaugagguaugaacauauaauggaauauuauucagccuuaaaaaggaaggaaauucuggccgugccacaacauggaugaaccuugaagguauuaugacaagugaaauaagccaucacaaaaagauaaauacuggaugauuccacuuacauuaaguaccuagaguagucaaauucauagagauagaaaauagaauggugguugucgagggcugagggaaaggggaaauaggaaauuguuuaaugggugcagaguuucaguuuugcaagauaaaaagaguucuggagacaguggugaugguugcccaacaguauccauguccuuaacaccacugacuuguacacuuaacaguggcuaaggugguaaauuuuauguauguguauuuuaccaccauuuuagaaaucaggaaaagaauuccucucuggcagaguuuagcugugugaucuggcauaaauuauuuaccucucagagccucgguuuccucaucuguaucucacuggguuacugagaaaacugaaucugauaguguauauaaagugcuuagcauguaagcacagagcagauaacccacaauguuacucucucuucccucuuucuggauuggucuccugagaccacuuugacccuuggcccugggagcacuaaagggcugccuggcugugagccaccacuaugugacucaccuaccacaugaggagaagcugugcaaagucagcacauauugaaguguuugcccucaggaaagugaauuuuuuugucuuuguuuuguuuguuuguuuuuuagagacagagucuugcucacugcccaggcuggagugcaguggcacaauuauagcucauugcagccuugaccuccuggacucaagcaaucuuccugccucagucucccaaguugcugggacuacaggcgugugccaccaugccuagcuaauuuuuuucauuuuuuuauuuuuuguagagacaggaucucgcuguguugcccaggcuggucucaaaccccuggccucaagcaauccucccaccccaaccucccaaagugcugggauuacaggugugagucaccacaccuggccaggaaagugaaguuugaaaguucauaucaaucucaagaauuuggggaagaugauaaaaucuaauggaauuuaauuaaaaauaaauuaucauuuaaaugaaggaaucuauuuuagucucaugccuacaaaaauaaaccugcauuaugaagugauaauaaaaguucauucuaugaagacuuauuaaacaccuccugugugcuaggcaauguucuaggagguggagauucagaagugaaugaaacagaaucuaguagacaugaagugcuaugcugaugcuugagacacauuucuuacuuugccccacaaacgaagugguagggauuucuaccuggguggaguugggaagccaggucugccauuugccgcaguacugcucucaccuuacuaagugaccuaugcauccuucugccagaauguaugaagccccuuggccacaaagcuaaguaguuugcuuaaagaagccucaccuuugcuggucagaugcuuaccuauguucuccuuccuccaucucacaguggacugcauggaccccacauguucaggccggggugucugcgugagaggcgaaugccacugcucugugggauggggaggcaccaacugcgagacccccagggccacaugcuuagaccaguguucaggccacggaaccuuccucccggacaccgggcuuugcagcugugacccaagcuggacuggacacgacuguucuaucgguaaaugcagggggagaagaagcauggguagagggaggggauuuccacugugacauggucaccaaucacgugacuguucccaaucacguagcaaugcauuccccgugccucugagugcuuuuccucuuucucugaacucuagccuucaacaccucuacucuuagacaaagagaggauucaaaaauuacauccuuacaucauuccuuccauaguaguggcccugagauucaaaacuaccccuuaacaauggagcuuauaauuacagauguguuucaccgaacucucaucucauguuaagacaucaucccuggaggcaaggccauagggaaaguguaccuagguaagcucuguaggggugggccuuauaggauaaaugucccagccaucaaacccuucaguuucacccauuucucagaaugaaguccaaacucaguguaguguuuaggguucuuugggaucuggcccccaccugcccuucuagccaaaugcucuguuagucacuaagcuccaugaggguagcaaacaugucuuguucaccucugcagccccaggacucagcauggccugacccacagcaccugcucaauaaauaaugauaaaugaaugcaugaacacaugauugaauguguucuugauuguggcauuugguucaucacaggguuuguacauauaagguacaaaggauaauuauguuggcacccuucuguuugaaaacacuaugauuuacagguccuuucaaagugaagauuaaaugggaacauacgugagucaccuagcacaguauagguauauaguggguuauggucacgucucaucucucauuuaaucugcacaaaaacccuacaagaaagcugucagcuauccauguuuuaccaauuuacauaauacuuuaaacagcaaauacuuacugagccccuacaguauaccaggcacucuucuaaucagagaggauggagaccaaagagccccugccuucguagagugugcauucugggaaaggggaggggaacaacaacaacaaaauggagauaagugaacugauaaagaagcuaaggcuuggaaaaauuuuaagugauccugcccagggacaaaaagcuaaaaagugauagcaucuccagcuaugcuuuuuuacucaaaaucauuuuccucggcacuccacgcuguuuaaacaaagugaguaucagauuagcucauuauguuguguauuaacaguucugguugugaccaagaaagauggcugagaccuuuggcaaaaaugagauccauguagcauucaugccuuugggauacuuugaauuaccuuucccuguugaauagagaauugauguucaauacacagucuaaauuggacuuuuauccuuguuugcaaagcucauguaaaggcaugauuguaagcacagaugugcagggucuuaggaauaauucuuuuuauauagcucuguuuauagcgauauaauaaaugguccucuuaaagcuacgcuggcuugcauuguucauuauguggccacaaagcuaauuuaugauagguauauaacugcgucuugcacuguuaaucccugaugaaaccccacagccucugaggagguacguauaacuuuggaugagauuacuaaguauucuuuaguuagcucaguaaacggaaacaaccgaacuauuagaagggacuuugaauagaauuaugagaucucccuuuccucaguccuggcuauaccacuccccguaacuggugucaaacacguaucuguccucaugugcaaaggcaagagagaaccaugugaugaggaaagucccugagucagacagaccuggguucaaaucuuuuuuuggggguuucaaaucuuggcccugcuacuuacuaauuauaauuuugggcaaguuacuuuacccuuugaagcuauaaaauggagauaaugauaguaccuaccuucuggaguuauagugagaauuauuuaagaaaaugaaaggcugggcacaguggcucacgccuguaaucccagcacuuugggaggccgagguggguagaucaugaugucaaggaguucaagaccagccuggccaagauggugaaaccccgucuccacuaaaacuacaaaaauuagccgggcgcaaugacaagcaucuguaaucccagcuacucaggaggcugaggcggagaaucucuugaacccggauggcagagguugcagugagcugagaucgugccacuguacuccagccugggcaacagagugagacuccaucucaaaaaaaaaaaaagaaaagaaaaaaagauuuggcccauuauaugagcucaauaguuguuagcuguuguuaugaugaugauuaaaacacucauugguagagcacuugauauuaacaaagacauuugauuauaagauggaagaugaaaucccuuucagaaauauagauucuaauuuuuaaaucucuauccuauaaaugacuagaagggucucaugauugccacaaggccaggaauauaaaaggcagcuuuaaaaguauuguaauagugaaaacaauuggcguuuguugagugucccauagcauacaaagauguuucacauggcaacacacacccugcgcaacagcagcccugugagguugggaugacagguacgguauugccccuguuccugugaugaggcuagaggaguggccgugacuugcaugagccaugcuggugagggaggaagcugggagucaaggcuuggccccacgcuggggcagccugcuuuccagcacucuccacaggccacguuccuccucagcugucacuucaccucuggaagcugguuugaaggagaaugagggcauuucaacuguucucucuccucagccccugcugugcaggaacugcuggccuggguuccacccugcuucugccacauguuaaccaugcgaccuuggcaagaaagcucacuuuucuugacuucaguuuccuuaucugaaaaauggagauaguaauaguaccugccucagcggguuauguaaucauuaaaguacaucguuuugguaugcacguagaacaguguccgucauacaguaagcacuuaaugucuuucuaccaccucccuuccaagggcacuuucauugagugaaagcuguuuuaaagcuauugaguuuuugcagugaagcuaugcaaggaaugccucguugccuggauucacuagagccaagaaacuaucuuucuguuuagggaguuagcuacagggcagcagaacaggcacugggcuuuuugggggaagaguugcuccccacucguugaauggcuucaucauguggcuuaacccucuaacccuuaauuuucccuuagguaaaauuacuuuauggaaucacugugaggauuaggugaggaaauuugggcaaaguaguucuuguaguaucuggcacagcucacacccuagacaaacgguagcucaagucaucuugcuuaugcugcuugcugccuggcauggcagagcuggcacagacacugcccagucccucccaucaggagcugcaggccaaaggacaaaucccaagugauccuugcaccaucagcauugguucuggguucuuggguugguagagaugggccccugcugccugcugccuccuaggagggaacacugucuauucccugagaugagugucuugcuguuuggcaccaagaacaggauuuaaugaaagcagcuuaaaucaacaugcccugcacucaacaaccagcccuguauugaaaugugagcugacaaguuccucagcacuuugguuagguuuguggaaacagugaagucagauuuuauacaaguguuuacucaguucccuggcuuccuggcaacuuggcuuccagucucgucucagaaauuccucuuucaguccagccucaugcauguggucuuccuuccugauaaaucacacgacauaacuguugcaacagauucuuaugccccagaagagcacaggacauaggccccagugggacuucacuuccugagucacuugugaggaugauacugaucaugguggugguagugauggugggggagguggcuacugcuguugcuguuaaacagauagaaaagaguuggaagcggggaaugacuggcccuaagugacucagcuuaccugaggcaguuugaauuaaauccaggcccuuuguucccaaguccucagcucuugccucaugcccccuuucuauccaaagagguguucauguugccauucuuaucucucuuucugacaagccacaggauagaguaacaaagagccauccauuucuuaguauuuagcauguaccaggcacugaacuaaguccuuuacaaccuuaucuuagcuaagguucauaagaacccugggaaggaaguauuacuaguauuaccauuuccagauaaggaaacugaagcucagaaagauuaaauuacauacuggcaucccuuuucucccccaacccucacccgacucauaaguggcggaguccagauucaaaccacaucuggcuccaaggucucuccuaaacacuauguuauauugacugauguauucuaaucaaucucucucucucucucucucucucucucuccccugugaacucugugaggucagggccuauaaguaucccuagcauagggacaaacauacauuagguucuuggugauuauugcaugaaugacuuaaccagugaauagucaaagaaagaaaaagagcccccuggaaacacagggaagagaggggcugcagccgaaagcucuguccaggaagaucccagcacacuacccgacagcgaaccuaaucccuucucucaggacuccaccuccuccccaccuccucauaaaccccuucccucccacuccccacacagugugcugggcuaacaccaaaucucugugcuccuugucugucacuucccagaccuagaucauguuaguuucaugcgcagugccagccagccagaagcccuccuggacaagagcuggcaucauuucaccuccuucaagccaucuucccuagggagcaggccugcugggcugaaugccucaucaacuuuugcauaaaguggguacacucagcagcacugcugagcagaacaacuccucccaucuccccuuccuugugcuuuaguuggcuuuucacccucuuggcucagagcugucucagaaaagggaaagaauuuaaucucuuugagaugguccuuagaauuggaaaggcucaccuuucuuucagagcuuaauggcuucuaaagauuuuagccucuguggcauuuuccaugguacgcuuucaaaagccaucccuuagacucaucauuugucccuguugguucucccucaggucuuccuuccccacccuuacccccauagccucucuccucagccucauaaauuuauuccucauuuccacugcuauaugagcucucuccagucuugucucccauaaaugacuuuuauuugagagggcccucucccuauauuuuauuccuuaggguugcuggcucacagaagcaauacauggcagagauuuugccuguaaaaugcucaugcugcggguuuaugauucuuaucauuugauugcaauugaguuuuguggaauaacagguggagauguuuuagagauucaguggcacagguuuggagguaacacgugcagucagcaagaauugcaugaaauuuggaguaggaccaggcuagauuuucaacacuaagcuuaagcauagacuauggcuaaugacaccugccuugcaggguuguuuuccaaaucagauuucacauguauaugguggcugcauucaguaagcagucaauaaaugaaguaguuuuauauaguuuuagaaugcaugauuagauuuaaguuauccaaacaguccuuagacucuaacaaguguaauucuuaggacaguuuauacagugaagguuuggagccagaaggccuggaccugaaucuguguaaccguaaacaacucacuugcucucucagaggcgcaguuuccuugcaguuucugaaucucucuaccauccccuuuccccagccccaacacuggucauugacucuagaugaagagucauuaucuagaucauugucuagaugaagagucagauaaaagcugacacauuaaccccaaacaacuaggucaguggcccacagcacaagggaguuagggucagccuccucucagcaucacaagcuuccugagguccauuccagagaagagcacaaccuccucagagagagcaccccacaguagcuccagaccugcucccacgcugacacauucacugcauucauucacugaaucuuucuggccuauccugugugcugggcauucacuguuuuaggcaccgaggaucagacagccccacagccuggucaggaaaugagacgccuaauuauucagcaugagcagagcucugauuguuguguguacaguaggguuugggagcacaaaagcagaagcagugaacuuggccaguaaugggaugggagaggaaauggagaagguugucaccagccagagaucugugagccagacccugaaaggggacugaagggaggcccccugguggccaaggaggagagggcagugcaggccaagggaacagcgugugcacaaguagagagcaugcaugaucagcuggacagucgcggcucaguccagcuggagauagaagcugcagggguggguggcaggaaagaaggccagagguaggcaggauccaaaccucggagcccgcugaaugcugugccgaaaaucuuggcuuaaaauaauugucaaugaacauugacuguugcccuuucagacuccacaucagaucucuuucuuuggcucucucaacucaaucuggccuagauucuaccuuaacacaguggaacccuccagaauucacacucagauccucuaagcuuucaguuuauucucuauuaaucuccuccccuacccaaagggaaagagaaucacaaagcauaaauaauaacaauaacgacuagauggauauggcgcugaaaagcccuguuaucaaauuaggucacaaucgacagcaaaauaaacucaaugcuuuaacaaaaauaagcuuaaaguagcaaccggguuaaaauaauuaaagcucuaaacauagcaguugcacuagagcuaaauucaauuuuauuuacgaggcaaaauauaauuacauuuaaauuugagggaacagaauuuaauucuuauuaaugacagaaagacugagugagaugcuuuaaugccagagaaauugucuuauguucauggaugggagagaaaauuagauucagcauugagcauucuccccuguuacaagucucauuuguguagcuagaauuguuccuucucugagaagcauuagcuucucaguccagaaagcacagcaccaacauccaauuaaacaucaaaaggaaacaaucaaguuaggcuauuucuguauaggcauguuauaggaggggaaacucaagguuagaaucucuccagaggaauaauauccauugagacuugacauuuccuguaccccuucccaacagcaagugauagccugaaaucaaaguucagaauaauaaauauccaggagauugacaguggcauagagaggaagggaagugucagagggcggcacggaagagccucccaguugccugggagguaguguggcgguuuagacacaaugagauggucaguuccuaacauuuaaucaaagacuggaaaauugggcccagacaagcaugcugcuaaauacugccagaguuaaagguugauaaaccaagagcuggcagauuuguaauuuaguagaauuuccccugacagcccuggaacguuuucuaucagaauuggaucucuucaguaugcaaauauaagcccuucugaaauugggcuucagaaugaaguuucuauuuggaugcccaagcugauaucuuguacaaaaucucuaguugucuuccugaaucaaacugcuguuauuauaacuuguaaucuuaaaaaaaaacuguucuuucaauggaaauuuuauauuuuacagagcuccuucauguacgugcuucaugacuuauucaaacagcaaauacauuaaccucugacauugcagaugguguuacucccaggaaaccaggguccagagaacuugcgugacuugcucaaagacacucugagaaaacaaugauucacuuccaggcuucucuggcuucagagcccauguuuauccucugcacaacucugccauuggcuauuaccaagguuugugcugaaacugccaguaaaucagguaucagguuuuggauagcacuucauuuaguaacacugccagaggaaccauguaaauuggaucaugacuuugguguacuaauauuacuacaaggguuucagaaaaagaacaauugcucucaaccaauggucagggaagcuucuuggaggaaguggaauucaagguggugguggagguuggauaugaguagguagugauaaaaggaagaggcaagcaccuugcaacagccaauuguagaagucaaagauuugcaacauauacaaagaugggagaucaaggcauuuucuaggaaagaugaguagcuugaaguggcuuagcuuuuaggauauuuguggcaguagugagagggggaaaagaugaggaaagccagcaugaauaaucuugaaggaguuuagguuuuuucugucuuugggagccacugagaaguuuuaggcggaggugugacaaggucagguuugguuuuagaaaccuacucuauugucagcauacaguuggagguucuugggggacagccagguggaaguguccaggaaagaguuagauagaugagcuuaugacugaguggagaaaugagccuuuuacaaaagguuauuagggucagaggucauuaggaagagaguguaacaucagcugucucuucauuucacccaguugggcccuuuuagugggggucagguuguguuccaguccuggccgaaaauacacaucccagucucguuauuuggcuuccuugcucacuaguucuuuccugacuuguuauccuucugcaaagucagcuccuauuuggaggccuccuccaagcuggguuugaacuccucuaaucaggaagccagauacucuccaauuaagaggaauagcaguggcuuacugcuuccugugguaggugcuuuguaaagacuugaaaaucuaguccugggggaauagauguggagaccugcucugcacccacauacuggaauccacuuuucugcuugguuugaaagcucuccaagcuccuugaaugaggugaaaggccgugugguuuccaaggcucauuaacuuuccgccaucucgauccguggaacagagccauggcuugaagcagcucugacucucgggugauagggagggaaguugaaaagcacaggagaguagcuuggguuuggccucaaugucuaaaggagacuaauuacuguaaggaagucagagguuccuuugcuguaccuucuuccccuucuggcuucuuccugaaaccugcacugagacugaaagccaucuguccaacuuagugagggaggcagggagacagcgugggugccauacuuucagaaugcuaauuuguacaaaauauauggagaucuggucugugggagaaaaagcuaacuuuuaauuagccuacugugugcugggcaugguggcuggcauugugcacauuuacacacauaggcagacuugaguuucuuguggauacgaauaauuucauauaaucucguauccucagccccuaggccuaucugucacauaguagaugcucaguauauuuuuaaaucuguuuuaaaacucugauagauagauaucauuaucaccauuuuauaaaugacaaaaauaaggcucaaaggugugcaguauuuguuucacauagcuaggaaguagcagagcaggcucuuaccugauuccaagccucuucucugaaaaaucacagaaucuugaacaguuacgugagcacucuguccuguaccacuggaaucuggcaauacagauacagucagaagacauguuuccuguguaagacucacuagggaaugcagagauuaauuugaugauggcaggguucucuagacaacucagguagacuaauaacccugagaaagggagauccacguaaaagugcuuugggaaggcagaaggugaaacuccuuccagcugccgggaggggguuucaaggaggagguggcauuggagccagaacucaaagcacauuuagauuugaauacaugaagaucacgguaaaggagcccagacuauggaaauggcccaggcagaagcacagaagaaggcccaaagagcgcagcgaccaccaucuggcagcuacuuguccagcugcccccuuacauugacuguuugccaaggcagccagcaaguuccuacucaaguacugacaugcaugucacuguguggcauaggauaagguacuuccuagaugggcccuaguuuucccaucuagagaauucuuuucuaaccauaaagccugcuccucuaguuuugcucuuuuucuuccuugacacuaauccaccuaaaggaaauguccuggccagaaccaggccacuuccuacccagugccaguucucuccuggcucaaucuccuucuacauuuucugcucuuccgcugguccaucacucacagcucccuggucucugugccuuuauuccacauccaccuugcaaaacccaggaucauuuuaaccauucaccacuucugaucucaaagcugugcuucugaaugccacuaagccaaaucacaucaugcuccugaucuuuagccucuccugggcccucccagcugcaguucuuguacuuugugaguucucgcucucauucgccagggggcuguuucaaauguucacaucuauucaccagcacccugcuccagggagauucccgccuccuaccucacggagaacgcugaggccaauaguuuagugcugccccauuauccugccugcuucccauacagacugugucccacaugacucugucugaucccucuacccagagggugaaguacccacuaugcccguuccucugauugugcuucggaaacaguccucucuaccuguugaaaggcaccucagcugagcauccccuugcucccuccaguaucuucaaccccuccuuucccugaugcuuuccagcacauaaacaugaaauaguugggacacuuagauggccuggugacacacagcugguuaggugauuacacauuuggguggauggacagauagaugggcugauggaugagcagacaguuggauggaggaugaacagacggauaaacagacaaacaaaaggaaaagugcuuaacacagucagcauuggguugaggugaggaaggaaacugaaaacacugauuccagagaucuuauagucuagcuggggcuaugaucuaagauguaauuaacaaucaggggauacacucauauggcaucugagguauugucuaaaccugaucccacaacucauaggccaaaaaucaugugaaucacagucaccuuucauuucuagcuaaguaccuuugagcacuuaaugucuccaagcuguuuccucaacuaugauaugggagugaaagcaucauugcaggacuauugagagaauuuaaugaguuaauauuuguguuccaacaacaacaguugcaguucuggaacauugaagguacuucauuuucuuauuuuugccucaaaugcugacuauuaaugguuuggcuuggacuuuaaguaugccagaauuucugauaaacucccccacuugugcaguaacucagaugagcuagugauaaaacaaaaaaucguggcaggaaucauuuaaaauuaacccucuauuaaaauuucuuaaggucacucuuggaaucucagguccucagcaaaauagaacaauuauacuuauuaccucuucuagugcuaaaugcagacuuaugaaaggacuucccaggaggucccggggagcaagacucuguuuccacaugacuggaauuuuagaaacagcuucauuugcaccuguuccuugcucagcaggaaggcgugcagaucuuugggcgggggcccuucuacccccuacuuguaucaguuuugagcaucuuuccaaguagaagaaauuuugugggaaaauugugcauaagucuuucccuuucggagaaaggcacagcuuccccuaccagcuauuuuaaugaacaggauuguaaaguaaguccagacaaauuaaaacguagcagcgauaggucccaggcuucaucugggcuugcacggggauuaacaucuaaugagacgagccuggggcagcuuuuccuguacauauacauuuuuugacauaauuaaccaagagccaaaccuugugucuuuucccugcucuuucgccucuuccucguguguucacccccuuccacaucauagaaagagaacaagugugacuugggcauuagcaugaagaagaugugucuguggguguaaggacugaggcauuguuuuaaauuacagaguucacacacagagauuggagaaaaugaguuucuaagaagcuuaggcacaaaggacacugagccucuacauaauauauuuaacaaaauaaccuguguacaacguggcacugagauagagucgcaucaaccgacauacaccucuuccauuaaagcuuuuuucauucaucuauucuuucaacaaacauuuguugaaagccaugcugggccacaccuggugcuagugccaggggaccacauugaucuucccaucaggugggcuuccaaucuagagagaggacagugcacgggugaggcagggaagaggugggguagggaaaggguggugcuauggguuugacuuucuguaggggaagagcucacguguugccagguucaucuccaagggccuguacaguucaaucaagaacucuguaagcuuggaauaggaauuuuuggacaguuggagauuuuccucugauuuugagaggaaguccaggcuacaaauacaaauggcuucuaccuagguuuugauacucuuggcugaugaugccaugcuaggugaccagaggaagagcaugcuuuucuaguaguagccccaaaguuugagaccacuacuagaaaagcaaauauuucauucuucaggaacacauuccucugcuggguuacuuggagcugugcugauggaaucaucuuagguccucaucaauuagucauacacagcauaguguacacagagcuuuucauauaaacuauuuucuucaguugucaccacucauccuagagggggaccauuauuacucuccucauuuuagggguaaagaauuaugucucagagagauuaaguuccccaaguacccacagcuaggaaacuggggagucagaaucugaacucaagucuccucuauggcuuguguacuccuaguacuucaaaagauuccucccagaccccagcccuccuccauuaauucagaaagcucugauguuggucaugugaaagccaacuagcauuuaucaaacccucccuuguuauuggguauguugcaaacgucagaauucauaucuggucuucuaaguuuagucuaguguacuugccacuacaucuccuuucucauaaaaauguguguauuuauuauauccugaauaugugccaggcacuauguuagaagcuauacuuuuguucaugcuaaauugauuuagguuauaucugucugccaugcuagaauguaaacuccuugaggucaaggaaaaauucaugccugucauaaucaccaugggaucuccagugcccacuguggggcuugcacacagggagcacccaagaaaucaaccaaaugaaaguaauuccuacagcaguccuccaaaguauaguaguugacgucaucccuguuuuacauaagggaacuugugacuaggagaggagcuguaacccacauuucacaaaggaccacuuacauuauguaaaagacauaugagcugucaaagcacauucuuuagcauaguccuguuuagcuuucacuagccacuucaggaaauuuuaucugcuuuaaugucaaagcagaaucugagaaggaaaaauaaaacaguuccuuuuguuucaagguauuugaaaauaagaaaaaaagaaacaauagggacuaugacuugaggccaaaugguaaaguagcaucacagguuucuacucucaucuugagucugugggucucuucacucagucagaugggcccaucugcagagaauccaagcacucccaagcuguauuaccuucaguuagcaccccauaaacaucaagggcccuuccauuaaaauguguaagagcucacaacccagcuuguaaagggcugguggaggagugcccagucaccaggccacuuuaacuucaugccaggagagcaugucuaguguaaacuggcaaggaaguugaguguuuggauggacagagcaguagucuccagaugggaagggugagacuaagugccugggaaacucuguguagaggaccucauuucauuucacauauaucagggucugacuuggauauaacaaaggauaagcagggccaggaguggcaggagguggggaucugcuggaaaagcugagaguuucucucaaagggaagcccaccugugacaggucaguguuccuugccuguucugaggcuucguuuccuuaucugugaaaugucugccuugaaguacuguuccaaggauugucaaaacaaugaaaagacacuagaugaucacaugaccucauagaauguucucauacuaucugggccucaguacccacaccacuaagaaggauaauagccaggcauuuucacagccuuguugugauaguucaaugagaaauuguccaugaagagugcuuugcaaacuguaaaacuugaugugagcauuaguuaaauaaaaaauggcuuucccacauauuaccucauuugaucuaacaccaacccugugaaauuggugaagugggaauuaucaaccccauuuuacagaaauggaaagcaaggcucaaugaauugcauaauuggcagcuugcagauuacccagccaguaagugguaaagccauaggcagaucagacuugucugacccuaaguuccauguucuuuaauucauuguacauagcaaaaaggugcaggcaugagucauagcuauagauuauuuggauaaucuuuugaaugccaauauuaguuugugcuuuaucuggacugagaucuccuggggggcagagauuauaucuuauugaccucuguauuucuagcaccagguacagucucuggcauauaguaggcauguguggauauuauuagaagaauacaugaauuaguaugaauugauugauaccuacuauauauaagguaggaagaagccucugaagugguugucaucaucauugccacuuugcagaggaagaaaaggaagcuuacagcuauugaguaggucauagagcaggcaaaacugagaucuggaaucacaucugauuccaagucuuacugucuuuuguccguacugucuccaggugacuuaauaaaggaaugaaguacauuuuagcuaagaccugaagucuggaaguucauuguggggaaaagccugccucuucucuuggucccugaugggcuccaugugcucugcugccugaaaacaccauggcuuuggccccagcagcccgccccucuccuggcucacaccucagugaauaguaugcuuucugcuguuuacuuucacaccauaaaccaccaccuggcaaaagugcugaguaaacccaaacaaauacuaagcugauuuuucaucucuccaagggcccucaagggaaaguuccagcccugaccccaggcccagccuccagagucaccaggaagucauugcccuuucaauguuguacagaagaaaugggaauuacagagacaggaccuaggauauccuggggccuggagauugucauucuuuaucuugaggcaagcccaaguguuugucuaugugagcaagaaaggaaaagagcuugaacaacauccuagggggcugcuugacauagcuccgcagcccuguccucacgugggacagucucauacaggcaggucgcuagagagaaacagacaggugggccugguuggacuuuucagccaggcuaagugggguguggugaauguuuaccauucucaggcaccuauagccccaggcauaccguaauucauccaucauccaacaaaccuuaguaagaggucuauucuauaccaggaucugugcuugguacccgggauggaggugaucaaaggaauuagaccagccucggguuccuagucugaugauaagacagacaaagaaacagaaaaccacucuaccauguaaaaaugggaaggaaagaaacaagugaauaacccacagggugaauuacaggagauuucucagaggagggggugcuuuucagccaggucuuggggguagauuacacugucuaacagggagggugcucugucauagaaucccacauucuuacagccugaagggaucuuaaauaccauuagguuccaccugcaacagaugaggaaacugacacccagaagagaggaagugaccuccccaaagccacacaguagauuaguggcugagcagguauagaucucacaaaccuccuagacucccugucugaaguucacugugcugaccucaauucaggaaaccuuucuugaguugcuugaucuuugucaugccuuuuugucauccacuucacugggugcucgccagagcccaguuaggucagcaaagggcugcugcaaggcagcaucaugcagcucacacucuccagacaaggaacugucugacaggaccaggaacucuccagacaggaaccguagcucagugaagucaagggaccugccccaggucacacagcucagaagcuccugagccuggcauaggauccaggucccuggcuccaggucagagaugucccuucccacuuuacagcugaagaaucugauguguuacugcacguaauaaguaccucccuuuugagguaaugugcuuggcaggaugucuggcacaggaacacaacauacauggggacucguacuauuuguuaaauucucaaacauuuuauucauugucuuguagauugguaggaaggucugagccucugagaccuaauuuuguuuucuuuucuuuuucaaaguagcuaagauuauuagcagcuucuaaacuaagcaugcaguuuggaagggagaugagcaaaugcaccuugacagaggugccagcuaauuuaguuugaaagaaaugaaaaggauugagauuuucaugugaauuugaagcauguggggccacgaggcaugagaaucaagucagucucucucccucagagcccuggcagagagcuucaguggacaugguugcucaaccuguuuccuaaagagcaguuguauuuuggaagacuuuaccaccgcucccugcaguaagcaugaagcuguugcuggccuggagccugaggggcuugugaaucgggcccuguguguuuugcaccaucucacagaugugccuuugugaagggugggcagcuccacucuggcuaugaagggccccccuccaaaccauuugcuuuggaucugaaaccccauuuagaugguucuuggaguuggggugaggaagcaggaagcugaaagagaauaaacccagcaaaagcucagaacaaacugcagguuuuggacaacaaccuagaguauacucaugggguugggguucagccucccucccgcaccccaaccucaaucagaguccaggccgucaugaaaugcaggccccagaacucaucacgugcccagccagaccacaagcacuucauugggcgaaggggacucauccuuacuuuguuuucacacauaacugguuuuuaauuacauuugacuuuuccugaugucuguucagaaugccgguccccuuuggaaggggcaagcacaaaggcagggacagguuggcaagaaggagaagcaaauugagcagagcccuacaauccuuccucuuuugguggggaaacaggcacagggcaggcuucugcccagagaauuguucucaucugagggucauuguccacggagauuagucucgcgagccucuggaauccugaucugucacagaagcccagguauguagccaagugugacuuugguuuccaacaauaacuugcucaauacuuguuguuuuucucucuccucucuccccugccccucuggccacugccucccauccuggcccugguguccucccuucuucugcuccuccccacagagaucugugcugccgacugugguggccauggcgugugcguagggggcaccugccgcugcgaggauggcuggaugggggcagccugcgaccagcgggccugccacccgcgcugugccgagcaugggaccugccgcgacggcaagugcgagugcagcccuggcuggaauggcgaacacugcaccaucgguauggcgggccgagguccccggguaccuucucuggucugcaggacaucuuugucuguuggggcauuucagggccagccugggcccucaucgcauguggggauggggaagaaaguccuuucaucuggagguauuaugacuggcauuuccuagccaucgguuggauuuaaacucacgauuugguauuuucaaccuuauuacucccaauuuccauuucccauguccugguuagcugguuagcacaccuugcucuuuagcuccuccaaggcuacaugcgguauggaucugugucagggagcucuguguugaggaaugaggcagaugagcacuucuuagcagcuaugggcaagccccgucaacuuucugagccucaguuuccucacucguaagauggggauaauaauacaugugaagaccuuagcaaaggcuggcauacaguggagugcccaguacaugcagccauuauuauccaaugcauuaucuugcugggauggcuggggcuuagcucugagcccuccaugcccacugggcuccuaggucagaauuccccaagaggucuggaauccuggggagagcuccccacaggcccuaaggccacaucuggaguccauuaggccugggaucuucccccguccucagcuuccauccugucugcauuugucuccuuuccccucccuuggggucuccucggcaccagcuccugcugaagcagcucugaaaacaagcugaucacuucguucccuuccuucugccuuuccugccgguuuuguugauuuuaaacucagccagacguuuugcuugguuuauuauccuggaaugagcacucaccaaaagcucuuuauugaaucaaccgguuuguguauauauguguguuuuagcuucuuccccuuccguuuuuguuuuuuguuuuuugguuuuuuuuuuaaaugaagggucugugaucagauggugagcacauggcuuuagaaggcaggauuccagguaccuuucuggcuuagaaagugaccucuugggucuuagagaaacuggaagacaagccccacagcuuuggagagacaaaggaauuuugagcaaacagagcuaccucuuaccccuugaggguuuuuucagucuucauuguuuuuguuuugaagccuaacauuaguuuguauccuuggucccugccccugcaacaucccuggguuuuggccauggaauaccuuacauuuauuaauauuaauaauaauaauggcuucugauuuuuaaguauucacaacgugccgagagcugcacuaagaacuuuagcugcauuauuuuauccuccuuacaaucacccugugaagcaguauguauuauuuccucauuuucaaggaccugaggcuuaaggucacggaacuucaaagagguagagcaggaauuugacacucgauuuuuccuuaccagcugcuuacucugcagcccuugcacgauaaaguccugguuuuccacugaggcaucugcuccugucccuccuggagacugugcccugucguggcagcugcacucagagucccucaccuaaucugcccagccuccacccucaacagagccacuccaucacaauggcagccacugcagguugugcugcgucauguuacugugugcaccuugauggcuucuuuauaucggugucauccucccuuacacuuguccuggaaaccccuuagugagaaguggcccuggucaucugagggggccucuucuuuaaacucugcuuuccccucaccuucccuuuucugcaugacugaggaugaaccaaccuuucaaccucccagcccagaagaaagcccacaccuaucuaaaaaacaaaaacaaaaaaaaaaaacaaaaacagaaacaaaaaaaccagagcccagagagggcccauucuguuugcugucucuugcuuacagaguccucagcucaucuuaccaaacuccaaaacguuugcaaauguuggacaaaaauguuauaagauaaacgcaucucaucuuagggaaccucucccuucgucuagucacacaugacucauguuggggcuugugggcaggcuguuuuacaggcaguguuuucuggauauucaucagccuggccuuaagaaugucccuuuuauuuugaugccaagaagucaaaccauccacuucuaccuccccuguaugcucuguugucgcucuucuagaacagauuccaccuuggggaugcagauaccuuuuccccuccagauaagaaauacaucaaaguaaaugugcacaauauaagaauaagguugacgguccuaaauaccaaagaaaugucauaggacauugaagaagcaauagacuagucauaguggcucagcugaaaggacuuuggcugggaauucuauuaauaccucucauuguguggugagcauuuucuucguccuugucuaauuuuccugcaugguaaccuucucucugugggucucugcccguggccagcugcguccccaugagaaacucaccacccucgugcugaaggaacacuucaauaacccuguaggauauaagggaagggggaggggaggcaaaguagagaaacaauggucccauccuuuucuuguugaaauagaaaugagaaggggaaauccauuuuuagucuuugaugguaacaagaagcauuuccuuguuuccagagaacuuuacucccugugagagucauuuaggaaaagaaaaaaacugcugaugugaaaaguuagaaauucaaaguguuaaauuuucucuuguuaucagauuucauuaucauacaauaggucauuaucguguagcuagcuccuagcugcaauaguuauuucccauaccagagaaagagcugguauccaugacacugauuucgagaccucuaggcaguggaagcaaaaaaagagggccuguuuauuuacauacugccgaccugcguaaacaggaaggaauggcuugaugaccuuacagcaggaauacagaauuuaaagaacaagacaaaucugggccccuuauggccaaguccccagcguuaagagccuuuuuaccccagugacauuucccagagcagauuauuauaguaggaauuaaauaucuucuuuuggagccuuuggcucaccuuaucuuucauggaagcuacaugauucuucucaagagagguugguuuucagaaugaaagggaauuugacaguggcauccucuucaaugacaguauuuuugucaaacagcaaaaauauuucacauucaauccuaauuccuuauguuaggaaucaccugucucuuugcaucuugaagaagggucuuugguaaaagcaccagggccagaccacgcaguugccugaggcuuuaguuucucuauccaugaaucacagaauggaguggcuggaguagguccccaagggugacagaaguucaucccccuccuccacugcccacagaacugcacacccaucagcccaaaagugagucaccugcuccuaaaaauaucucaugaagaaaaagggauucuucauuuuuacuguuacuuacauggcacuaauacucccacuugcauauaugaaacccaguuuuccuaguccagaagucaggcuaagauggauugauuuggaucuguuucucaaguauaugauugacagagagucaccaagugcauauuuuuggaucuuuucaaggaguuuuauggauccaugaagucuggugcuugaccucugauuuccuuugagaaagcugaaaaucguaguuaaauuuaacaaggcguuuaauuuuuuuccuauuucuuugaaaacacuacuaacauuuuggaucaauucuaucaugguuuuucuauuuaccucagugccccuugucucuaaaguaaagaaaacaccuguagaaaaugccagcuucugauuacauuaauaaaauuccagcuugacucuaaagcugugauuguucaagauaccacauauacagaauuauuuaccagacuucaggagagcuguccaauccuagaaguccugauuuuuaaacaaaagcuuccucuggggguaaagaucaaaaugauacccugaagaugcaauuacuugugugaguaaaaccagacuucccaaugaagagaaauuauaaagaaaagccacaaaaucuuccgugcuuuguccaguuuuuuuuuuuuuaaaaaaaaagacagagucucacucuguugcgcaugcuggaguacaguggcaccaccucggaucacugaaacuuccgccucccagguucaagcaauucuucugccucagccucccgaguaggugggacuauaggugugcaccaccacaccagcuaauuuuuguuuuuuguuuuuuugagauggaguuucacucuuguugcccauccuggagugcaguggcacgaccucggcugaccgcaaccucugccucccggguucaagugauucuccugccucagccucccaaguagccgggaucacagacgcccgccaccacaccuggcuaauuuuguaguuuuaguagagacagaguuucuccauguuggucacgcugaucucaaacuccugaccucaggugauccaccugccucggccucccaaaguacugggauuacaggcauaagccaccacgccuggccuaauuuuuguauuuuuaguagugacgggguuucaccauguugaccaggcuggucucuaacaacuccugaccucaagugauccaccggcuucagccucccaaagugcugggacuacaggcacgagccaccacaccuggcccuuuguuugcuuuugaaugauagcuaucagauuucuuuuucauaaucagaaaauccuuaaccaagagcccacaaaucacucaugagguauaggacccugugauaacgcuaugguuaucccuccugaaagcauucacucacaacaggaccugugguuugacaagacagaugcugacaaggagaaagagaaaauguacagggaucuaccucaaguuaucagagcacaaguuuaauuugcugaugauccugggagacuucagcccacacgugguggggugggaaucuggcuuugaauuucucucagugugggugucacugaccacuuauccaaagagagaagagcacugauguauccaagagcuuagcaagaacaucucuuuggugguuugucacccauccgaaagaaguucagaugacuagaaccgccaacccaucaccugcuguagugauccuuguuucuuguggccuaacauguaccaaugaugcagccguucgaguugcccugaggcuccuggagaguaagaauggaaagccucuugccauguucuccauaacuuuggauagggggccccugaagauucuuaagauuaucccaagagaaacuuuuggaaaccucuguugguagaggcaagucaaggaaagaaguuuuauguuggugaucagagaaaggccaaagagagcuaagaccgugcagaccaaccucaugccaaaagcucagucuguagcauaaauagcuauaguaccuuuauuaucuccggcuuuucacacagagauaggaacauaguaggaguaugagaaacauuuguacaaugccaaagaaacaagcguugcccaagagaaaagaugccuacugccaucaucuucauccugaaguucugaagagaaagaugcaggaauugaugaaguccugaauccaccuuucauaaugcaaagcuugcaucaucuuuucuaaaaguugguacuuuaaaaucaugaauuuuuaaacaacuguacucaacagcauaugugccaagguuuucaaacaauaaaagcaaccacaguauggacuuccgcauaugccuuuuauaaauaaauggcaguaaaguucaaagacccauuugucacucccauuuucaauagccagagacaaggaagcuccauuccauucccggaaaacucauggacuugguauuaacuggcuguuaccagcuuuuggauucacaguguggcucgggggcucuuuguagcaaaggaaucccuuuugauuuguggagucaggauuugaaguuuugaaugucuacuuuugucuccugaaaacucacagugcugaugguaaccugagccugccuccaucauuuccacugauuuucuuuccuaccuguggucuggagaaauuaguaagaauuuuuaaagguaucaaaaacauauuuucacuuaauagugcucuucaugguuaugugguucuugaaaaugaaauggcauuagaagagagagagcucucuuaagucagccccuggcccuggggagauuauccuguagaauggauauaagcuucacucaccaccagaaccacuauacuaccauuaaguuuggagacaaucaggaaaguuuuuuucaucagagaacucccucacgguggaagcuaugaccacuuggaucccagugauggcaucucauccagccuagccaucccugggaaaaaaaaaucuaggcucacuacaccucuucuauaacuggauucagaguuauuauaagaacuuauaauugggacccuccaaaaaauucugcagauaagaaagcuaacaaaaccacaagagccaggugauucuauguauucaugcccuuugauagcauauccugggagaugagauauaagaaauuuuagaccacuuugcaaaauuagauaaauuagcuugacuaagacuaaagugacagauaagccaagaaucaagaaagauuucccuuuagccagagguauuuccuaggccauuuuucgugugggcuguccccauuuuucauuguuuggcauuccauagcuuuguuuacucaccccuacuuaauaaguacucucuuucauguuccuaucuuguauccugcaucucauggacuccacgacaucuguaagaaugaagaaaagcauguagccucaguuaaaauuuccucuucccaauuuuccacuuggcugugcaggcuccagaagcauauuucaucuugaaccagagaccacacggauaccugaacuaagaacacagccucucauccacuagucuuugaggcuaauauauagugaugaacaacaauaucuguucuauccagagaauugaaaaaauauaauuuaugguuuuuuaugaagagaguaagaauauuuaaagaacccuagggauuccugauaaggccacaccguugcaguccgguccugucugauggacuuuugauucaugugugaaauucagcuggggcuggagugcagccuggcugaaggcaucagauccuucaggagacugcccagcuacccggccuuugcagaacacacuaguaggagguguggagagacagagaaagagaagcuccucaaagagcuauaacuacagccuagggagggcaggugaaaugguauuagugauucaugcugggaauuaagaggccugcccugcucuaaacacacagccagacacccauauauagacacagugggguuuauuucagagcaaccuuugaugcucauccucaaauaagcaaaacuuuagaaggccaaauaacucaaggcuuggauacaaccccuccauuggaaaacaaagcacacaucuuucuuuaggguuaauaagcauugagaaguggucagauuuucuuugcuuugucuuguuuuucacagugacauccauugaccugcaccucauagucuguguacgaugcacaaaggaggaaugcaucuuacuuagaacgcuaagcauuuugcauucaagcauaugugggcacauguguacauggaaaauucaagaauggcaaacagauaauccagcaguauauuugaccaaagacucaacccccuucacuagugcauaucagagaugauucaaauuuugcguauuucuaaauuccaacuucuuggaaaggccucugccgagaugggguaccacuuguucuuguuauggcugcuucaccuguagggagguuggaugcugcucugaguagucaaagggacgggcucuaguuuuccguaaagccagacgaagcuggcagagcaggaguguggccacuuuugcaguuucccauccuucuuugucuguuuuccuuauucauaugucuucuuguuucugugaucacauuuccaaaugccuggaucacagaaugaguugaaguuccuuuuggccaucccuggagaaugcuugcucucccuucuccucucucaugucauccugucuuugguuuuauuuuccccaccauggcauaggccugucccaaacguggggcacaaucccuuugucuguguagcaucuggcaugguuauguggcaggcgauauugcacuuacuggauccuaccuuaaauguccugucuuuuaucucccuagcucacuaucuggauaggguaguuaaagguauggucuuccuuccucuauuuuccuguugucuuuguguguguguuuguguaugaguauaaaagaagaaauguguauauaaaaauguauauacaccacauaagcaugaugucuggaagcuaaugcauccccaguuuugucgcagcauccauugcccaaaggggauggguuuucggucacaaggugguugauauaccuggagugucauucuccccacaagaugcucagaucuguuugugacaauaccauuguacuuuuguuuuucccuccccccgccccacauacauacaccuuucacucuuuccaccccaucucaugucacccugcccaucuguuauggccccugguccaccagaauuaagaugcuggcaaccaggguggguggccugagaaaggaagagacccaagagcaaguuaagaaauuuuaaggacuacuuucuaguacuacuguguucauucguccaacgagcaucuauggagcacccacuguguacuaggcaccugcgccagggucuggagacaaggggacaaacagaucccugaccucagggagcagauggucuguuuguuuauuuguuuguuuuccuuuucagagaaggccugacuuugguaaguuuugucuuugaagaguguucccuagaggcaaaguaauuccuuccauuuuaaacauuuacauuaguugggugguaccugauuuuccaaauaggccacauagcucuaagaacaagucucagaauaaucagauaugugugcucugaaaagacucuaagcuccuugaggagaaauaccaugucauauucaucuuuuuguucucaggcccuaacacagcaccugguacaaaaugugugcucugcagauagggacacauauucuagagucagacugcuuggguuugaaucccagcuucaacacucagggaacuaagugaccuugggcaagugauuuaacuucucuucucuugcuaacaggacccaccucauaaggcuaguaugaggauuaagugaaguaacaaauacaaagugcuuaguauauaggcaggaauuaugcucaauaaguaugaauuauacugcuuuaucaucauauucuuauucuuauucucacccuuaauuugaagaaggacuucauuagcuaaauuaauuuuugaaacuguaaaggaaaaggcuaaauuggcuuuuaauaagagauagcaacagcuguuuuaaaacuuauggaaaggguuuuggggaaacauaacugacuaaaugcuuuucagcuaggacagcuuugccaaauacagcaaaggugucgcauaggauccaacagauggaggaagagcaagggucuucauauuucaugugcugguccucaacugacaauaaaaucauuccagcaagaaagaguaguacuuccuagccucuuuaaaaacaggcauuucacacauuaucauuagcagaggacucuucagggugggcuaaauuuuaucauguuaccaucuauuugauggaaaauuuuccuacuaugugaaguuuuuucacauccaugagucuuaggugagucaugugauuuuuuuuugagggaauagauauaaugauacccauucaauugaaaaaggaaacugaaguugagggaguugaaugggucauccuggcucacacuucuaauaaguagcagaaccaggacucugcauuuccugacuuuauccauguuucagcauucuaucuucugucaccauaagucaccgagaauguccauaauuuccaguauauuuuccuccacaccacaucuuccaaacuggcacccuuacugggaaguggccuauauucuuucucaaaucaccugcucugcucuucaguucagaaaauaucaucaccagaacuuuaguuggauuaggucaaugaaucauaacuuguuuuaaaaggcaaauguuucuuggcaaaaucaaggucugacccaagcccucaucuggcugauauuuugguauaauggauacuaauucuaaaaaaauaauucagagaucugugucauggaagcucaggucuugucagaguagaguacuuuacuguucaaagaugggccggauuuuguucauugcuucccaguugcuuugguagagacuaaagaaacaauguuuacucaacaaauaugcugaacuccuaagugguaggaaauaugaauaccacauaacagauauggucccugcucucaaggugccugcagucuagcagagaagacacuaaaaccaauaauuccaacaaagugugaugaggguuaugacaggggaguccagaggcuaccacuuagcaaguaaccaccccacuaacuuggauuguuggggccuuauagauugcggaauuuaacaugaggguauaagaaagcgucugaagguuuuuaaaagcaagaugauaacuaggucacauuugugauuuggaaguucagucuggcccuauugugaaaggagaauugaggggggaccauugagaacaagaagaccgauuagcagacuauugcugucaucuagguaagagaugaugauggcuuugucuagggaagugaauauggagagagaaaaaaaguacaagaggaccaguaagagaaacauaaagaaaugggccauuugauauaugauaaguguauugcauagaauccaugccacuuaacuaaaaaauaaauaccuucaaggauucugaaagucuucuaaucauaccuggugcuagcugcaagggggacuucuucauaggccuaagcaggagauugaagauaaaguggucccuugucauuuaaagggcaucauuucuuuugaaaagcuuuguuagcccuucucuaaacuuuaaaauuacauuacuuugacucuagcaaaugccuggugugagucuuuccgaagggauuauuaaugucacgugggcugucugaauuauugaugaguuucaggguuugcggaacuagccucaguggguaaggacgggcauauugcuuuaagaaagucagcaagucauccuggaagagccuuccucaugcuggcuaaugggggugugauuauccuggaagcaaauggcuggaugaaagcaaaccuuguuccacccacagguacucaaagucccucugaaacuuauaggauacugcagaucuucaggguaucacuugguccauuugaagaaauugacuguggauuuccacauuugugauucucugugauuccacaucuagagcuaacccucccugagaacaccugcuucacaucuuccaaacuggcaccucaaugauucauugacccaaucccacuaaaggucuggugaugauauuuucaggcagccucagagcagcauggacuaugugcccaagaugccaugugccuacaggaguucacuagagcagggcuucccagaggggguuccauggaauggaauauuacacagguuacugggugggguaaagaguucugaggucaaauuggauaaugcucuaguaaucgaauaagcagcuuucuuuauucuaagacuucuuggagccuuuaauauauugauauucagugugacuuucuacaauaagaauauaggaugcaacguuuuccaaacuuauuugacugcaggagcuucuucuugaggaccucauagaacuacuauuucacaagguucacuuucagaaguaugguuugugauuauaagaccuauuuuaaacccuuccuggaacaaaguaugguauaaauaaagagaauguaaaauuuuuuagggcagaugauauaucucaucucugugaauuaacacaaaguccagcauccaccagguacugaguaaaguuuauugaauuuaagaacagaaucaacuaacuugacguuguuuugaccuucucuauugggucaguuaugcuggaaggaccuaauggaucaucucauccaaauccuuauuuuauaaauggggaaacugaggcccaaagagagaaaguaacuuucccaacuccccccauauuaggccagaacgcaggccucuugucccucucauugauuuauuuuaacaaauauauauugagugucugcuacaugcaggcacugguacauucuaacggaagaaguaagacaaugaaacuaauugcagaauugaucauuucaguauccuugggacaguugcuauugagagaaguacaauaugcuaggaaagcaugaaugguggccugcacugggacucgcagcccugaacccaucaugccgccucccacugcacugcauguucacggagccaugaggcaagcccaguguuugucuugaccguuuuuggcaaggauuuauuuauaaggaccauagcuuuugaccuaaacguuacacaaguugggcuggcaaagguuuauuuucuuguuuaugaauuucuuagugaaguuauacaaacuuaaaacaaguaaauccaauaauaauaauaacagcucucauuuauugaaucccuauguauguuacccacugugauaaauaauugauauauauuaucucauuuaauacucucacauacucuuugaaucagguauuaucuccauuuuacagaugagaaaacugaagcuuagagugaaguaauuugccaguuguaacacagguaguaaguaaaaugauggugcuaggauuugaacugagguuuguccaccuccaaaguccucgcucuauuacaacacauggcuuuuacuaaaaauuuaggauuaaaugguguaaaauuggaucugcccuagaaaaucaagaucugaacauuuuuaacaaaaaguuacuuauuuuagaaaucuauauaaagugccuagcacaguggccaguccuaguagacccucaguauguggcagcugucauugucucacuguccugaagcaucuaaaccagagguuggcaaauuacagcccacagaccaaaucgggcccaucaccuauuuuuguaaaucaaguuaguuggagcacagccaugcuuauucauuuaaaaguguguauggcugcuuucaagcuauaacggcagaguugaguaauugcaagagaccauauggcucacaggccuaaacuauuuauucucugggucuuuacagaacaaguuugcugacucugaucuagauaacugccucaguuuccuauuuugccuuucugugagccccaccugagguuguggguacaacauaugauauuauaugcccucugcccaaaauagagagaagguaaaggugaguagaagauucagauauugucuuugagcuguaugccaggcuuugugcaucaugcauaccuuacuuaaccgcccccaaaaccccauuuuauaaguaaaaagacugaggcucaaagaaauucaauaacaugccugagucauacagccacugagugguacaggcaaacuuugauaugccucucaagcuugugcucuuacguaagagauacuguuugcaucuuacaagaggcuuuaucuuacagcaaaagaaagcagucagcuaccguuguuaaagaucagacccuacuuccuccaggacuaauuccaaauacaaaccaggcuuaauugaaaacaagucccggcuggacggacaaaaauugacaugagacuaauugaggaaaaaagaaagcugugauugcuuagaucacuaaugguggcugauguuggcaaccaagucagauugccuggauagccgccugugugucacagcucugcuccuggggcucgcuuuuaaaacuucuuucucaaucacuuuuugggguggccaugcugguagccucucaucuuucccagcaggcuucugcuauacagaaacccauagucuacauacacuucuaacuucuggaggaaucccuccgaggcuggaguacacaauuguuacauguuucuuccuuugaauggaaaacacaguggccaaauugcuugguuguuguguggaacaucucaaguggaaauaaacauguuauuuucuuuuacuuuggaauaacagucaacuaucaaaaguccugggaacacucaaguuuuagauucugauugaucagccauuuagugaguggcuaucuuggcccaggucuuguacuggacagccacuuucacauuuguugucccauuuaagaauaaugagucaauuucccauuaauucauggcagaagauccaguuuguggccauauuuagagcacuuugcugcucauaauaauaaaacaaaugaagcuuuauagcugacacagugcuuucacauccauaccucucccaagacugagcagcagcagagaggagauggaacucuugccagugacaggugguuuuugauagccccuuggagaaggggguuggcaggauuguuaauauaaggacuugagugaaaaccaaguggcacaauagaagcugaagugaaccacguaauuuaacauauucucaaacguagauuucugagccacaaacucggagagguuuaaagauguggcaaucaaaaaaccugcaaaucuacuuuaauaguauuuuuuaaaaacuuccccacuuuauaauaugguccaagcagaacgaacacagcaucuaaauauugccugacccuucuugaucaaaucaucuacagcccucucagauggccacaccuguguuaaguucccaccauauuuuguacgucuccuuuagggcauuuagcaguuaaauuuuuugccuacauaaauuugucuccuuugauaggcuucaugcaccucaugaauaagaacgggucuuauucauuucuguaccuccagugcuagcccaaagaagaugcuuaauaaaugacagacaggcaggcagaugugcauaugagcguaaugagagcagagcagccuggcuguaccugcguugcacucacagacagcccuaguuaguguuucacaauggcgaucacagcuccucugggugcagggcccuuuucuaaguguagcuguagacaagauguuaagaaaaagccccaagcccucuuccucaaagcaaagacaguuguuuaggagaaaauaagacaaaauaaaugaaaagccuaggguccaauaaaauugaccuacuacaagaguuggaaaaaguaacacccuuuagaaugauacccagaagugaugaaggaagcaaggaauaaacagaaagauguuuccuuugugcuaaacagccgccagagauaagaggaacacaugagaaugaacaagaagcaaggaucaggcaaaaagcuccauugguuagauucugauaggccaacauccacugacuccggcuccagaaucccggucacuuuugaaagaggggcuuuuagaugcagaagguguggguuucagcccugucccugccgcuucugacugugcgacccuggcaaguccuuucaccucucugagccucaguugccuucucuguaaaguggcaauuccuaaugauaccuaccucccugggcugcugugggcauucgugugcugauggauaugaaggcauuuugcaaguuggcagguagcguguuagugugugugauggcaguugacucugggugaucagaccucaacccuguacuuugucuuucagaggguugcccuggguugugcaauggcaacggcagauguaccuuagaccugaaugguuggcacugcgucugccagcugggcuggagaggagcuggcugugacacuuccauggagacugccugcggugacagcaaagacaaugauggagguagggcucuggcacccaugggcuccaggcggcuccagagggugggaggcccagaguggagaauggauauuacugagcuaacaggccaccaacacaccagucauccagucagggggaccugcggggcaagcaaaaaacugcacauguggcuuagggaugagugcauaucacagguguuccauuugaaucaauugaaauuaacuaauguaaaugaaaguaauugauauccagcagccacuauagaagagaaggcauauggaagaaagagguuucuaacaauucaacaguaggaugagaugucuggcaaaguuaugggucccccucacuggagauggauaagaagagaccaucuaauucuuuaucacagaagcugcagagggacgcuucucccagggaaggagguugaguuaccuuuggucaaggucucuucuccucugauucuggagguuacccucacugcacaccagcagacaccuuuuguaauagaaauggccuuugcuuuggguuuuuuuaaagugcuagacagucaaagcccaaggaaggaggugcucaucuuuuagaacauucauuagcugagagugaagaccuggguucuaauucuaguucuggcuuugacucccugugcauccuuacacaugcuguuugguggcucugagccucacucucccuauuuauaaaaugaggcagcuggcccaugaguaccauuucaguccuuaucuuagucguagaauuagccuucauuuuucuguugcauucacuuggguaaauacaaccauaauguguucuacuuucccacuuggaagauacaucaauccuuccugauucucccacucacaggugguuauuaggagaauaaaaagauaaagauaugaaaaaacaucaaaacaguuaacccuuucuuccuagugauggccuaacaauuggcuuagucccaacaagucuauguggcucccuaauauuuauaccaaaggacuuucuaauauguugcacaggguaggaaaucaauaggucagaaacucagcauccuaaccuuugggaauuuucuauuuagagggauucucaaaccccaaagcaccauaagaauuaaaaggccaagugugugauguugugauuucugugguuuauuugccuugaguggguuucagcagccuagaaagggcuguuucggagcacuguucuuugagccagccggcuuucagcccuuccaccugcugccuaaauccaggagguaauugggccugauguacccaggccugggcccaguggagcaauugucaacagggagcuuauggggcuggccacaguagcuaggcagaaacagaaggccuauguucuccugaggucuuggaggauugaaauaucccuuaaucgaucuaaaacuuguggaguucauuaauuuuugugcuccauaaauauccagaguucuuauuuuagaguugggcccuauaccaggcauagagauaaggaaguccucucccuauaugccaggaccucaaaugagggagaaagacccaaaguuaagugcuaauaaacugugauaagugcuguuguagaguuauauauuaguuguugugggaguaggaaagcauucaucagaaggugacacuuggauggguagcgguuucccggaaaggaaagggcucucuauucagagacaucauuaugggccaagccaggacaaagcagggaagggcacuaagcacccaugucuucagacaaggcaaaguguauuuauauuugcucuucguaggaaagagaugucagccuacauuaucugcaugauuuccucagcauuccccuucaguuugccuguguaggcacaauuccaaugacuaauaauaacacucauguaauagaagaaaagaagagaagagccaccauucccuucucacaagucaaaagucuuggccaaagccuuuaaacagcuguugaacaucugggcagcaaaaugacugcaugucuuuaggaaauguggggaaagggcguaccucucucccuaccgguauacauacaagcguagguuauagaacaaggcucauugauucucucccaugaaaugcaauucaaguguauccuuuguuugccauacuucagagccagcccuccuagcacuagaaugcaccagugguaacauggggcauaggcauaccauagcccaaagcccacagcucggggggagagagagguucuugucauaggaaauggggcugaugcagaccccaggggaauagagccuccuucagcuguucugagagaugagccaguaggaaguggaaaagaucaaccagaaaauccccaguugugggagaauaugccacuugcauuuuuggagcauguuaugggcugaaaugagcuugcacguaguuuauucacucacucaaccaauguuaaccaagugucuacauuguuaucaggcccuguccaggguacuggggcuucagcgauaaauaagacacagucccuacccuugugaaggucacaaucuagagagagagagaaacagcaaguaauugcaaugcagugggacaauugccaggauaaaggagcauccacucauucaacugauaucagaugccugggugcccuacugggaacugugaugugguuucugucccaugggacuuucagaacagccgggaagacaucccgugggucaucaugguuggaaauagaaccagcugggaaggccaaauuguugaggguccuugaccuuggguucucaacuauuaaaugaggaaacgucucaccucagggcccucucaguucagugggcuguccacccacugcgggagccaaggggaaggugcugaggaccccugcuuugcaggauggcauagaugaaacaaccauagagaguggacuguccccaagugccaggguaguaaggguuauccucauuggccucuauuacucugugccuuggccaaacgggggcaguuuuaguggagggagagaggaagaaaggagcacaagaguaaaccauauuugcauugggcuacuuucaguucagccaagcacaccuuuguagggcucaugcuaucuacaaggcaccaugcuccuuuccaaggagacauaaagaccagugaacauggcccagucuuucucccucaagaagcucacagucauuuguaagaaauugucauccagaugacucaaucuaauggaagcagaauuaaauaagugccuuuauuucagccaugacaggguauacagcauaauccaagauaaaucauucaggcuggagggaaauuguguuagagucucacuagugguuguucuuagaugauaugacucaagucuuggagaagaaauuaacagaguuuaauguugaguaacaggauugaaagggacaucagagaacauugacuuuaacucccucuccugcauguuuacagacaggacaacuggagcccagagaggagaggugacaucacacacaucauaaucacagagaaagucauuacauggccuggacuagacucuucagccauuccacauggccuugugaaccuagagcacuucugccuucuccuagugauuuauccuccaccuagaaguguagugugaguacuuacucagauuuaaauaggcugcagcaguaccacaaggcuuacgagagcguaauaacuuguaugucacuuuacaguuugcaaagcaauugugcauccauccagcaacacugugaggaauguggccuuauuauccacuuacuauucccucaugauaaggaaaaggaagcuuagcgauuauuucgcagaagucacacagcuggccggucgcagaaacugccagaguaugugaggucuuggcgacauuagagcuucucacuguguccagaccucugacauauggcccauuguagaucccuguagcccuucaaguuaucuaagaucuccggguuacucuucuuucccaauuugcuggguuuaaaacaacauauuuuaaauuaaacuugaauuucaaguuucauaaagaaugcuacagcaguguuuuuaaacuaugagacaaaaagaaaaaagcuacacuuugggaggcugaggcggguggaucacuugaggccaggaguuugagaccagucuggccaacauggcgaaaccccaucuguacuaaaaaugcaaaaaauuagcugggcuugguggggcgcaccuguaaucccagcuaccuaggaggcugaggcacgagaaucacuuuaauuugggaggcggagguuucagugagcugagauugugccucugcgcuccagccagggcaacagaggaggacucugucaaaaaaaaaaaaaaaauugggggagccgaacaguaugacugagccagggagcagcuuuauuaguuuguuuuuauuuucauguaugguuguuggcuagauuuaaaaauggaaacaagaucccucacgugacucgaugacugccagucuccugaugcucucaccuugggcacuggcuccugagagggaccagaagguagacaagcagaggggcccuaacucaccuacucaaagugaagucucuaugugccccacuugacaaagaagguguaccccauucauacugugugcuuugagaagccccuuauuagguacagacacaugcaucuucugauuuuauccucuuauagggauguuuauucaugcccauuucaaagauggugacaccaugccccaaagaugcuaagucacuguaaaaugaggauaauaaugcccaccuugcagggcugcuauaaggaucacagguuauauauugaaaggcccugagaggcaacauagcacaaugauuaaaaguacaagaucuguacccagauuaucuggauucaacuccuggcucccugauuugcucacugugugaccuugagugauguacuuaacuucucuaagacuuaguuuaucaacuacagauaucaguuguuucuccugcuucucuccaccugcaaucacagaaacaugauauuuauuauaaaauauguauuuguaaauauuuuuaaaaauuggaauuauguccucuauaaaauuuuacauucuauuuuuucauuuaagauuaugguauauuucucuauauaauauguuuucaucuuuuucauuuucuguguuaaagucuguauuccaaacuguuacacgcucuuugcuagaaaagaauccaaacguacauaaaggaaaacagcagccauuuuugagcacauuccugagugccaggcacugugcuagacgcucugcguacaucaucuccagccuuuacaacaaaguugcaaggcacacauuuacauacagggaaacuaaggcucagagaacugaaaugauuugcccaaagucacacaguggcucagcgggagagcuaggauuagauuggaaccuaugcuuuuuaaaaagccuccaggauaaaaacuccacuggauuuuaagcaaccaguccucuucugauaaaggaucuuuaagcagcuucaagguaugauaaucucuuuuggugcucuuguucccaugaaaaaacaaucauggguugcaauagauaauugauauaugcaaccuagaaggagaaauuucaggaaaacugagaacaaaggucucugucuucucuuuuccuccucaucucuuauugcuggaagggagaguucacauaaagccaaagaauuuggucacccuucaaacuaucucuaaaccacauuucucaugauaagagacaagagagaaauugaccuuuaaaaaucuuguguucuaacgggaagauaaagacuuugcaagccuuuugaaagaaggcacagaauuuauuauagcaaaugacaaaaucuucuccccaguguguacagaaggggagacacauuccaccuuccacccccagggccuccucagauacuauuguaaaacaguucuguggccagacugcagacaagagcgagauaugguuggcuaaugggucgucaagccaaggaagaguuaagccugcaaaaagacugaugggcuugcuauacacuguccauggggcugugagguuaaggaaccaugcaaacaacuacaguacaaagaguuuacuaggccacggauugccccaccuugcccccgcccacacccccauucuccuuuuuauccuugcccauccuuccagauucaguuuaagcauucugucuuccaggaaauaauccagcccccagccugaguuggggucccaccuuugggcuuccacagccccuucuacuuccuucuucuccagcacucaauugucucugucugccccacuacaccaaauccuuuagaggcgugacucuuuuauuccugagcauccagugccuaacacagguccugccagccacauaauggguacuaagugaacguuaacaggcauguucccugugucucuuuucuaaggagagggaugagcuccuccuguagggaauggcuuccaccacaccccauggcccuugaugggcccugucaagcugauggagcugucuaauuugagauucuuacauaaaaaaaugcaugcauuuauucauucauucaaccauugugaugcuuacugugugcaaagcacugugcugugcauuugagauacagaaauaaacaagucaauuucugccccacguggagaggcgacagggcuuggaagccagaaaauccagagcauugcuguaaagaguuguccacuguggaauugugccuaacagcucgauguacagaaagauaauggaccaaauucccaguucugcucuuuaacuagcgguacgaugucagggaaauuacauaaccugagccccaguguccuuauuuguaaaggugagaagguuggccuugcccccaucuuuaauagcacgcuccugcauaccuuuuacuuccugugaaagucacagcaagcuggccaccagggaaaaugggucucugguguguaaaggccaggagguggccaucagacaggcccacagccuugagacugccccauguacucuuggccucccugauaaggacgcagacacaagaaagggaaaugaggggcccaagggcccaccagucacuggccaccauuaaggucacacaacaaacaggaagccacuucuagucaggacugcaauuguucacuuggccuaugucugagcccagccccugucuccagagggagcuccagagaacagcuaccagcaugggaaagacacucaaauuucuuuuguugacuuacucguucacucuuuuagacucuggagcccuucagcaauccugagagguuggcagagccuaguauccugguuucacaggagcaaauugcgucucgggcauaggaagggugugcccaaggucucauggccagagaggggcagauacaggggagaggcuaggucuucaggcaucuagcuuggauuucuuucucccacacaccccuuucccucguucuccgggucauuugacaacuaccugcaaggcaggcaucaaagagggaucucagugagaguauggcagggccuucauccuccagccagagcacauagaugaaaacguuagcagaagccagcccuccaugcaccagcagcaugugagcaccacagagcuucaaguucaagggucaggaauaugugaaccacuuuggauuguuucauugagugcccccagaugcuggccccccuucuuuuuuucccccuuuucuuugcccuccacuccccaucaggggccacucgagugcagcauggcugcaucccuagcguccagggccugccuggccuuuuugacauuuucuucugccucuuuucacugucaccauguaaaaggggguguguguuuagaacuaugaggaaaaaugaaauuuccgggaaaaaaguuauuucccaaaagcugggguuuaggaggguuuuacagaaaauuugaaggacauagaagcaaacccucugcuuuccugauuucuuuuucugcugugauaaugagggucucugaauggggauagcaaauauacaaaacacagagaauuuauaagucaaccaacuuacguaugauauauaauuaagugagauaugaaguauuuggaaacuauaaauguuuccaagccacccaaaaaccagagaaucccccaaacuguguauuaauauguuucuagucuaucccaaaaauuacauuucugucccuacagcacgcuuuuuuuuccuuuuaaugagaaucuucuaaaauuugucaucuaugccuaagaaaauuaaauugggagccauucccccucacuguagaacagccauaugcacuguuucaggccaccauaugcuacauuugaaaauaaaaagaggguuuuacucagaagcuggucuuguaaacugcagccuuugaaaagaaugcuguaagcccuacucauuugugugucucauuuauacaggauugccuccauugguggaaguuuuguccgcaguuacuacucagcaaauauuuguuaaauaaaugauuaggaagcaucaccacaggaagguauaggcauuaaucacucccaccugggaagcauggaguaagacauuccacagugccagagccucucauaagagcacaguuugugauauuuccauugcagaggaccccaaucugcaaauccccagaggccucuacuacccuaauuuacagugcauugcuaugaccauguuuauccacuucaguucucuaaggccaaacugcauuauccagaaaggguugucauguaaugugcguguagggaggggccaguauagggccuguuaccagaaugugguucaagggaggcuccugggcaggagcuaauuuaaguaacuaccauuugccaaguacuugcuuaguugcuaguuaucgugcuaagugccucacauccaugaucucgccucauccucacagcaacucuaugaaguaaguuugaugauucauuuuacagaucagagaacugaggcucagagcucuugcuggaacucuuauuuucagcaaaauggccaacuaggucauacagagauucucugaugacaggguacaacuguucguguauaaaauugagcaaagaagaaaagggagacaagggagcccuggauucuagaaacaagaugaagcugaugggccagagcagugggcacaggagcccaagcuacagcaggccugggagacgugcaggaucaucagcgccagggagacucagaacagaauaauuucagagucagcagacagggcacauccacagugggagguuggaacugaggcccugcauaaagcugggauccucaaaggcugcaagucaugugagaaaaggacuaaaaaaaacagugccuacuagaccagaaggaugacauggaggcauuucucugccauggcuugucggggcugggggggugugcuaagagaccaagccuauaccucaaaagaccuugaaaucuaaacucacauacuagagcaguccuagaaccccaaccuaagaaaucaaccugaaaaguggucccagacaaaugguacccuugagguggccagcugacguaaucagaaaaccacccugggccaggcacaguggcucacgccuguaaucccagcacuuugggaggccgaggcagguggaucacgaggucaggagaucgagaccauccuggcuaacacggugaaacccugucucuacuaaaaauacaauaaauuagcugggugugguggcaggugccuguagucccagcuacacgggaggcugaggcaggagaauggugggaacccgggaggcggagcuugcagugagccgagaucacgccacugcacuccagccugggcaacagagcgagacaacgucucaaaaaaaaaagaaaaagaaaaaaaagaaaaccacccuggaggguuaguucaaccauacaagauucccauaggaaggcaagccuuccgagaauuaacagaaucauagaacacguaggaaaugauugaccaugagcuagaaucaacaacuacaacaugcagaaggaugaccacucccgagaacuuaacagucugaaaaaggcuauaaaaugaauacacuuuuaaaugacuaaagagagaaaacgauauauaaaaaccauagaacaagacaauaucaagaaagaaacagguggauuuugaaaaauuccaaauagccuauucagaaauuuuaaaguaagauaauuuaugacccgaagaacaaauuaaacagcagaccagacacaaaugaugggaaaauaagugaaguagaauagagauuugaagaaacaaaucaggauagaacgcggauaaaaagauggaaauuaaggaagagguugagugacaugaaagcuagaagauccucuaagcauuuaguaguuaauuuccugaagacuagagagaaagggagaggaggauauucaaagagcucaaaaccaaacuuugcagaacuaaugagagacacaaauacuaauuaaacggccaugguguggccuaucaguuccuauguggagcaggcauacaugcugggucccaugcuugcagucagagucucagucuaaaaguuccucucuagaaaauguuugucucauugucacaagacauccaagggaaguuuugugcuucacgcuuggcuguagagacagauuggugagucuaaggaauuaaccauccuucuuuuucuccccuauugugcauaugaagaaacugagguuuagagaaguuaagcaacuuggaccaagucacacaguuugcaugagaauugggaacugggguccaaauccagguaguuugccuggagagagggcucucuuaagcaccauauggccaccgaucacagaauaaaaggcuccgucgaccucuguuguccugugacguggaugcuggauuagugggacaggccugaccugggucagucauuuauucaucccucaaaccucuguggaguacagucacuguuccugcccaggucugggcccugggauaaugaaaugaaucagacaaccccugaucucuaggaggucaucguuuggguugcagaguaugggggucaggggacggagagaaaaucaaaauuacaauauuggaaagagacguacugugauggaaguuguccaagaggcuggaagaggcacagaagaguaguguuucacuaagauucagaaauucauguucucugcuuaagaaauaguuccuaaaagucucuccagagcuuaaagaacauuauaugccucagaaagaacugaguucagauuccgagucagcuucuucacugacuacaugaccuuuaccaaguugcuuuaccacuuugagccucugguuccuuuucucuaaaaugagagugacaacaguggcuacuucauagaggauucaaugaugcauuccuuguaauauauuuagcagaaugccuggcacucaauaaauguggcaauucaucaucaucaucgccaucacuguaauauagauauuaauaagaacagcuaucauuccuggcuaaccuucccccaggacuagagagcagacaucccuucucacaggaagcagcucuuuccaggugccacagagcugaauguuuauaaaaggguaaaacacaggcuuccagggacugcuuuggugguaaacaagaccaggaaagagcuaauaaaauuucaaauuagccaugacuuuucacggcccuucaauugugcuagcugauuuaauggucaaugucccugcucacugggauugaauaauggagcauuucugcagaguuauggaugcaacagcugaaucugucaugcuaacaucaauagcagaaugcaaauaacccucagcucgggcuguaauuauguguuuaagcaaugucugacaggggcagcaugagaaugugugauggaggcugccgacugcuggagaagacaggugcuuugcuaggcaguuguaucugggagcugggacaggagccacaaguuaggaugcaggucaaugcuggggugaggggaggcauuccuuccguaucucagagugaaucuagcaggugagcagagaaaggaugaauggcucuucauguuggugagccauguucuaaguucaggaugaggaagggaaacuaacccagaauuaagcacuaugauaccaugugucagauacuaugcuagauuuggggacauaaugcugcacuuuuuaucuauauaacaaauacuuguuugacacuuacucuuaugaucccccuuuaagagauauggggaacugaggccagagaguuuaaguaacuugcccaaagucacacacuaguaaguuucagugccaggauuugaccccagacagucuaucucuggaauccauacucuuuaucacuaucugccuucaaggagacuauaagcuucugggcaccaugcagaaaugggagagaaacagaaaggcuuuuuguuacuaauuuauuaaggaaaaaacuagguuuuaggacaaucaaguagcuuaccugaggccacaccacuagcaaggaggaucggggacaccaagucuaaccaaugcauuugcaguacuuuggugggcagcuucuguauuguaaacuccauggagaaaacuagagaaguagguauaucacuguuacucccacauuauuuaugaaauguggcucagagagacuaaguacaggaacuuguccagggucacuguugggggccauacuuggucuugaacuuuagucucugaacaucaugguccuccuaccauagcacacugcuuaccucaaugggaugaaguuacaguuuucuggcuuuuauggacuggcauuugucacaaccccugcuucacuauuuaauucauucaauucccauucauuuauuuguauagcaguuauguuuuaagcacuuccacuaagugcuggaacacagaacagaucugugcgcucccacgguggugaggaaguuucccaaagucacacagcugagacgcagcagagccagaauuugaacccaggcaggaauacaugucguuagacuguugucugccgacaaagcacauagacuguaccccugggcuuuuccuguccaccacuuuggacacuaccugcuuaucucuuuguuauguauuuuaagcuggucuauuaauauuaggugccuguaaaaguacuuugauauaaugaggccaaaaaucugugaucugguggacuuucuuuguacuuugggaagauaguagagcuguaauacaaguuccaguccugaagaagcccauccaugugguaaagagaauucccugcuaauggaaacucugucagggaucugaaaccauccagcaaacucaaaaagcacaaauaucccugcagccuccucucacagaaagcagagcaggccuccagaggaccgaggauucagccgcaggccacacgcuuacacugaggcugggagagacgcugagaauugcugugccuucacucccaaagccaggcagucaccagggcuuacaguuuuaccuccuaaaugucucucaauaccaucuacuucucuuaauugccacuguuacuacugcagucuaagcaaccuuuauuuuucaccugugcaaccucagcgaugcccucuucuccugucuggcucccagcucccacugaggcccccuuugguuucaggagugcacaccagaugaagucaccuccugcuuaaaagccuucggugauucccauuguucugagggugaaauucaaacucccuaacuuggccugcaaggcccagccuggugugccccugucaaccucagcagccucacauggugcucuuccacucaccuucuggccaucagcauuugaauauagcaucacaaauguucauguguuaucucacuucugggucuucauacauacaaucucuucuauucucgauggaaggaaaaacauacaguacagacacuguacacuuacugucuaucucuccuucuagacuagugagcuaggaccacaucugagucacuugcaucuguuuggugcccagcaaagacuuuggcuuauaucagcauuuaauaaaguuuuugaaugagugaaaaauagagaagaaaugaauuaaggcauucuggauaaacauggcugauugaacauagcaauauaaaccacaugcucugucacuccugcagauggccugguggacugcauggacccugacugcugccuccagccccugugccauaucaacccgcugugccuuggcuccccuaacccucuggacaucauccaggagacacaggucccugugucacagcagaaccuacacuccuucuaugaccgcaucaaguuccucgugggcagggacagcacgcacauaauccccggggagaaccccuuugauggagggugaguccgagggccccagcuccagccagggcucucugagggagaacugaaucacucuagagccucuuuuggaugaaugggggugggaggaagccaggaacgugagagcauccaugguuccugauggaaugucgggggaggcagagaagcagccucagguaccuacauuuauaaaacuacucuccaaggaguuuggaauuuuuaugagcaaaguuuuguugcucccacugggugacagaugaagacagugagaaaccaaagguccaaggggaaucuuggaucaauacccacuuugcagucagcucuuacugauccuguggucuccagaugaacugaaaggcauugaugcugcucacccucaaagcagacauccagaagacuuugcuaggcaggggguggguacaucugcugccaucccaggccacauacccauacaaucucccuguuuucaguugugucauccauuggacaauuuuauacggaggucuguggcagguccuuugcugggauugcagaguugagcagaacacaguuccugauuguuggucacucccaguccacuaggaagacaaaaaagggacaguuacagugugauuaggccagaacuuuguccccaggguacuguggagcacagaggauguacuccuggguaggagggaggccagggcuuuagaaucaagucuuaaagaggagagacgguuaacuaggcaaggaagggagagagugugccagggagaaggaagagcucaugcaaagacccagagacacaaaauagcucucuaaucucugcacccuagaucagggcagugaacagcauauccaagagcagggauuuauaaucauuucuuuugaaugucuuccaacguaguggugccucauaugugcagaacuuucucuaaaagucagugugguuaauucagcagucaccgugcaccucguauguucauuuuucugugccagagggucccuguccugagggaacaaugggguagugauggggguaggaaggguaagggacauuuucaagcucuauuuaaaggggaaaucagcaggacuugguaacugauugugucugcgggaugcugcagagaggagucucccgcuugaaugccuggguaaauggugguauuuucaccaggcugaggagcagagagcaggagcagggugggagcaaggugauaaagggacacaccacaguaggccacccacgaguaaaugucuaucugcaguuaguaauucuggagcucauuuagaguuagggcuuagaguucuugauuugggagccaucaaugaacaagcaguugaaaccaugagcacacaaaagguugcccgaggaggcugggcgcaguggcucaugccuguaaucccaacacccugggaggcucaggcgggcagaucacuugagcccgggaguucgagaccagccuggucaacauggcaaaaccccaucucuccaaaaaaacaaaacaaaaauuaguugggugugguggcagguaccuauacucccagcuacucaggaggcugaggugggaggaucacuugagcccagaagguugaggcugcagugagccaagaccgucccacugcacuccagccugggugacagagcaagaccccaucucagggagaaaaaaaaaccuugcucaaggggaauauguaaugagaaaagagcagggacugaagaagaagccauggggagccucccugugaggcagcugcugucauccccagagggugacaagggaagccaaagagaaguccucacugcuggaacaugacggagcgggaugcagacaugcaggucugucagacucgggaaggagccccugcacuuuccaccacccuagcccauccuugcaaggagucgugacgagaugagaaaggugagaugaaggaagcccagcaagugcguggcagaauucaaaccuccaccuuucuagaggugaagcuacuugaugguccgaacccuccaacuuacccccggaguacugagaagcugagagguuaaguaacuuucccaaauucacaaggcuagucaaguggcagagccggagugaggagaaaaccuauucauuuaucuuggccagaaaugcugcuucugucucugggugggaagcuuccugcuauuuucuucaguugugugauuuuguauguaugcuuguaggccuucccacagugugaguuuuuuuaauccacuagagauauagcuaauauuccuaccaaggaaauugucacuugcucagucauucuuuacggggcccauuauuggauccaauuagggccauggcuuguuggcugccuauggcuguucugcuuacuggaugcccuugccaugccagccugaucaaugccagcagggacacgucuccuguauguccuccuggucacuuccugagccugcugcuuaagcgccaugagccacugugggaccugcacacaggucucgguauuguugcuccagcaagucugacuggccucaaggagccagccaaguauggaguuugagaagccugugcuggggaaaauggaccccucagcaguagggaagacacaggccucagagagaggccagcuuggucuucagauccuggcucugccgcucuagauacauagcucuggacaagcagcuuaauagagugcauccuguaaaugucugucaaccccuguaaaccaaguccuccagggaaacacuucaucuuacacauuuuagcacuuaguaguugcugaaaacauauacauauaaauugccuugaagaauaaagaaauggaagaacugagggagggaggaaggauggacauauuaucuauuuuaccuaauuuuauacugaggauucagaguccagagaaguuaaaucaccugcuaaaaaucacauugcagauuagucacagaagcagaagaagucaacuuugcagaucauuguuuauauaucugucaccuucaguugguuauauacacuuugaaaacagagaccauucaucucuccaaaccuguaauacuuuggccagggccagggauauaguauuugcucuacaaaugaauagauaauggaagcuuccaaaauguuacugucucuuuaaaaaaaaaaaaaaaguuacuguaaaaauuccuuuuaccuaacauuugccagaaucauuauguaccagcucuucacugaucuagauucagaagaaacagcuaucaggaaggacccccaaacagauuccuguguaaaauaugcccaagugacuagaaauguagaaacaugaggcagcagaugcuuuucucauuagacuaacuacuugguauucgaugaucuuggucuggaccaguaggacagugcuuauuugcacagcugggauaaagugaaaucaacuacccaguuuaaguaguugcuuucuguccucucauaugagggaguuugguauaauagcaagugcccagaguuacaauccuggcuuuaccucccacuagcugugugugaccucagggaaaugauuuaaccuuuguguagguggcucuaguuauaaauuggcaauaaugguacucuuucaugaaagcuguugaaaggauaaacuaaaauaaagcaccuggcccagggcuugguacauauuaggugaucaguaaaugguggcuuuuguagcagccgcauaucauagugaaaauagcacaagccugggaaucugacagaccaagauuaaaaggcuguugcauccacuuuccaguuuuguaaccuuaggaaaauuccuaaauuguucacuuauaugagcuccaacuugcucaucuguaagauuaggguguuaacgucuaugugucuagggauugcuaugagaauuaaaugggaacaaaaaguacauaaagucucaaccuaguaccugccacacaaaaacuugcuugcuaauuacauggcggugaugaugauguuaauuaaaaagaguuuccaaauccacuuccuuaauggaaaguaaaacuugagaggaaccugcccuccagguccagcgaccacccagagaggaggcagguuuaggcuguugaaucauuauuugaggaagggagaaaaggcugcauucuugccagccagcugucaguugggauccuuguuagaguggagcccaguggcguuucuccagagaguggaauuucugauggggaggcagaccugacuuggugccuguguaugacaauuaggccuguguccaaccaacaaaaccccauauucuccugcaccccaugugcugugccacaauuuguaguuugagauuucauuuaacagccuccaggaagcagguugucacccagaacccaacagcauuucugagaccagcaaggaaaggcaggccucagaguggagcuccuucucucugcagauucccagcugggucagccucagggagccucaaguaugaggcacacugggaccucagcugcugggaccagaggagggaggggaauucaagcccagggcuuggagccaacuggccuaccuugggugugaaagcaagcaagccaguccccagcacccagggcucuccccaagacucacuuccucagaggccagaccccaucuccuggagugaugaaggccucccugaggggcccucucugguucaucuguguccccagggccccgcacagugcuggguccagagcagguguuuaaugcagguuuaaugaauacaguagcucuaucugacauccugccacugcuguccucaaacccacagaaagugacagagcugugauggagagugacagagaugaccuaaaguaggaggggacagaguaggcaugggaaccacugucaccagauuaagugguuugaauaccaccauucucuccuggccuggaugcccgggucccaucugccuaguggaauacuugucccucccauggagucauggggagaauacagugaaggguguccacuauugacacuuaggagaggaggagcucugaggucugcaggaccuccaacugcacugucaauacaaagaguccaggacacacacugugggguuugggaucagagagcugggaaagggagggcaacgugagacaucuccugggcaagcacucgagccagagcuguuucccguuguugggugcaucugugcucuuggggaggacuccucugacugaaagggcuggaugugggucagauauccccucagugaauaguuacagguugccgaugcuggacagguuagcaaguuacaggaagagguucugacgaaccacccccagguuauucaaauauagauucagaauagguuugaggacacaguauuacaaccacccagagaggaggcagguuuagauuguugaaucauuauuugaggaagggaauuugagaaaucaugugauggcaaaucuugcuggguuccucuaauucuaauagguuauuggcuccaucaggcaauagauggucguggacagggagcuacaagacucagcugacaggagacacugagccccaagagaaaaggcucaagaagucaggggacuuuagcaaaaggaaggaugggugaccagagaauuuaccccaaaggaggcagagaaucguauccuauacagagggucagagccuaugaggaggagagacugggcaggcuuagcgagggacagagcagagaaaaacacacaagcugcccaagcaugcuggcucacgccuguaaucccagcauuuugggaggccgaggcagauggaucgcuugaguucagaaguucaagaccagccugggcaauguggcaaaaccccgucucuaugaaaaauacaaaaaauuagccaggugugguggugcacgccugugguccaugcuacucaggaagcugaggugggagaaucacuugaacccaggaggcagagguugcagagagcagagaucacuccauugcacuccagccugggugacagagccagacccugucucaaaacacagacacacagacacacacacacacacacacacacacacacaagccucauuugguaaauauugaccagcaccuacucuguacuagguguggaauaagaagauaucucaccccauuacuuugggggcucuuugugggucccaugccuuguuugucauugaacccaaaggaauuggcacagagugaaccacagugaaugauagaauaaaucaaugaauuagccagucccugcugagugccugaagagaaguagagacaaaagugcucugugagcucaaaggcaagaccaucacucucacugcacgucugcccccugagccuacaccaugagagcugccucuccuacagcuuugcuucuccagcauguaacacagggcgggcuuagaguagacaauauuaaaaguuugcuguugaaaacaaaugaacaaaugaagacuucuggcaggagauggccuucagccugagacaaaaauuucagucgggagacuuggccauuagagcaucauuuaucaaauugcaggucacaacaaacccauuaguaccuuaugaaaucaauucagcaggucgaaacuauucuuuucaaaaagagaaguaaauuuaacuggaauggaguagaaggaaauagaaaauaucagugcaucacuguaaaaagaauauguauuucaugaaacuuauuucaguuacauguguauguguaugcaugaacuacuggauaagcuguauugcuuacuguggguuucaguugaacaggauuguagaaagcauucuauacugcagaaccagugugagcaacagcauaacuuuccaggacaaucagagaauggagaaaauuuuaaugugucuggaggauaauuauggugacauuauuuuccacaucaaaggucagaagacgugcucugacauuugaaaucaagaugggcuuaggaaaucugugguauaugagcauggugagcaaagggggcaugugggagaaagaggaacauagggaacuaugaggccagaaaaguggguuaggggcaggaacugagaaagaucugacccucacccguucacuaaccaaguuccagcauuucaucucaaucaggaccuaaaacuggcucuaaacaggagugaaauaaccuugauuccaccuaagucuuagaauuccauucacacccuauagaaaggcacaaagcuuccaggaauuuuaaaagcaagaguuuucaagagugaaaaaugauggaaaagagaaaugaccauguaugcaaugugauuuuuuaucagcccacugugaaccuaaagccauaugcaagcgucaguggcauagcaguuucagaagagcauuugcuccccaccccacaccuccacccaggcuuuagacagccuucaggaagcccucaagagggcgagcagcagagaucaucuaauggacuucaaauaaacaccaacuuccugacagcuggccucugagcaaauuuauuauugaauuauacuccugcauuuucagaacaagcugagcugacaggguaccccaucaguuuaaaaaaaaaaaaaaaggaaagaaagacaaugauaaauuaccugauggaagauagaagaaggcaaagauccugcuuccuccaaaaugucagccauuauauauuauucauguugguuuuuuaaaaaucccuccccgcguugaaaugaauguuuaugaugauaaagcaacuaggugauucaauucaggaugcaggcaacgacuucucacaucauccugaugagcagcuaacaacuccuccucugccacuugaucaucccuuuauugauuucaaaaaugaauuacgaucucuguuugcuuuguagcuugagcuuguuccuaguuguccaucacagaaagcauuagcagaggaugcuguggugcagcgggaacagcuuggguuagagggagagagccuggauucaaguccuugggaaagugagaacaugggaccuugggcuggugagacucaacuuccuccccucugauguggggucacuaauuccacccugccagguuguuuggaagauuaaaugagauaaaauacccagaagcccgaugucuggcucauagcaugcguucaguacuaacaccuaacauuuaccaaggauauucuauuuggaauguuuuauagguaguaacaccuuuaaaucucuggcagacccuaugauauagggacuuuaucacccuuguuuuaagcaaugaaaacugagcuacugagaauuuaaguaaucugggccauggucauagggcuuguaauagcagagccaacauuggaagccacgcccaguuggcucuagagcccauguacugagccugucuucuucuccgcugaguccuuuauguucccugcucagcaucuucaguucagaaauccauacaguguggugccacuacaacccuagcaccccaccuggcccugacuuucucuccaauauucuacuacaucauaaaaaacccaugugcaguaaggcuucaugcugaagagcacugaccucagagguuggacucucagccucacuguuugcuagcugugugaccuuagacaagucucuuaaucuuucugugccucacuucccuccucuacacuaugaaaauaauaauccauaucucauggggauuuuguggggauuaaguuagcacauguaaaacacuuagguauuagggcaguaagcauucauuuaagugauaguggccacugucacuaaauagcaguaauguuaauauuagcauuagcuauagcauuaguauacauacagguuuuagcgucacuacugagaacugggagaaaaaugagaaucuuaaccugaagcaucgguguaguuguguaauuggggcaaauguccuagcaccuuaggauggcaggggugaauggaccuuccagaccaucagcccucugugcuggaagaggaaucuccaaggccagagagagccccuggcucagcaaguuaguagccaggccugagucccagagaaccuggagucccaagugaagguucguauaucucaaacuauaaacuguaauucugcuguuuguaaaucaaagacuuucugcauuuuuauccaacacugagaaauuuuaagcaauaagaaguuaaaauauuuagagagccauguuucacauuacuaauauugcccucaauagagaauauaggaucaggccuugcagacaccucugcauguagucuaacuggcccuccaauuagaucucagaggcauuaagaguuugcuccaagcaaaucccacagugaggggcuugacagggagggaugcggccucuguguggcauuuugcuagaggggagagauccagccccucgugccuccccugccuggaucuccuccucccaccacagugggggccaugugaguccacccugugggucuaacgcugcaggccucuaggaccaaucccaaucugagaagaaggacuuagagcagccccagcugcucaaccucacauccuuccuacuguugucugucugacccaugacuugccagcugugccaaauggcuuucugccuugucccugaauccuggccccacuuucugugucugacuucagcagccuagugcccuggcaccaaaggacucaaaccuugcccucuuuugacaggcucccaucccugccacaucugggucuggagcuccaucccugcuguaccugggcaugauaaccuagugacacacgggacguccacauccagaugccucugggagccccuucaccauggcugucuuccugucagccccuccucccucauccuuugaauuauuauuuccauuacaggccagcuguguauugcugugcaccucagcuccagccuauugagcugaacuuugugcagacucccuuagcugcguuucugccuggcaucagccccuuccccaugaagugggucugaucaugguucauucugguuuccccuuuccuggugaagcaggaccugcccugucccugacagaaggcgagacacauggucaugaaaugaacuugucugcugagagacuguggcuagagucacauuuuagcagagcugccuuguauuuuucuaacagcacaaaccaucaccugaaaagucuucuuugaaacaagcuucuggccacacagcauagaaaacagccuaucugaacaugcaccacauaucccauguccccaggcacaacgacgguauuucugagccauguccccagacaugaccaacccacuuagcugggacaagggccuugcucccugcuggccagacugucucaguccugcuucucccucaccauagucgaugggcucaguucccuggaagcauaguaugguggacaagucaagggcucuggucuuguguacacuuuuaucagccagcagaaaauauuccagaagauuccuaugggagaggacucagccugaagcaucagcauugagcagccaggcugcccacagccuugacagauugauucugcagccugggagcucacgcucccuuggugucugaaggagcucaacagccaugcuuagcuaggaggccacagaacagugguuucugggcucugcgggaagcacagccucaggucccugaagacacuaguaagugcugggccaucuugcuguuagauggccccagguggugucacggcaccauggcggagcuggugguacccccuccucaaggagugauggaagggaugccccaccuucagauaucacugaccucaccuguacaugaggaacguggacucagucacucagaagaccccuguaacuuaaaagguaaacuccucccuccugucaaucugaaggagacuauggagccuguaaccccagcuacuggggaggcugaggcagaaaaaucucuugaacccuggagguagagguugcagugagccaagaucaugccacugcacuccagcuggggcgacagagcaagacccugucucaaaaaaauaaaaaaagggacuagaucaaguuuuacugguuugggcauaaggcuauuggaaaauauacaugguaaauauaggaugagcuuugaaauaaguuauaaagauugaagcacaaugagaaguuggcuuugggguauaauaauaaauagcauauucaaguuuauuuuguauacaaaaaagucacauacacacuaucauagucccaagguagauaccgaaggugggccaugagaacaggaagaaaauuuuaggggcucuaucuauacaguguuucuuuuaucuuaagaaauaagaaagcaagacugguuuauuucuauagaauguuggauucucaccgauuuguuccuuuggucucuguguuacuugguuacaugucuggaccagcacaugaggcauucugagggagaucaagaucuacuccacagaaagagggacaguggacgggcacaguggcucaugccuguaauccuaccacuuugagaggccaaggcaggugggucacuugaggccaggaguuucaagaccagccuggccaacauggcaaaacccugucucuacuaaaaauacaaaaaauuagcugggccaugguggugcacaccuuuaaucccagcuacucaggaggcugaggcacaagaaucgcuugaacccaguagguggagguuccagugagccgagaucacgccacuguacuccagccuggacaacagagucagacuuugucucaaaaaaaaaaaaaaaaagaaaaagaaaaaaaagaaagagggacaguggacccacacugguuuguuguguauuauuguguauuaugauguaauaguauauuacaucauaauuguuuguaugcgugucugucuguguaucuguauaaaaucuaguguuaaccaaacuuacucauaaaaugguaaaguggcuuuaaagguuucuugcaagguaaauacaaauggaagauaauacuaauagugcgaguacaagcaaacaaaauggcagagcugauacuucuucuacuccuaauauuaaauacuuuccucaaccucgcuaugagguuagaaaugauuauuuucauaagacugaacaaaaaguuaacuaagagauucaaaaugaucaacaaucuuagcagaguucacuuaaagagucaaaauuaucaagcaggcuauuugaaauaugaauacucaucaaaccuugcaccaaauguauguuacccuucccaaggugaaccagcgaugguagcacaugugugcgauuuauaaaugaaugcaaguacauugaaggagccugcucaaaaauguuuacagaaagggcgugcaaucaaaaaugguuccagaacccggcucuaauuaugugaacccugaauugugaagccaagacaaauugggauucucaauuauuucaguacgugucggucagacugcaaguaucuuaagagguggagugacucucccaaguucucauggcgaauccugcauuugauucaguccuggcuccccacaagucugcaagaaugggcaaguccauucccugucugaacuuuauuuucucaccuuuaccaaaagaaguuugaaagaggugaucaggaaggguucuucugacucgaauguuucauaaucagggguuucccaagaauacguauauaggcagaagauguugggcuggaaaagcugguucaagaaacugagguagagcgucagauggaaaacuaggaagagagagcuacagaucagccugguggcugggcuugaaagauggucuugggagcugcagagaggacaaugucaggcugugacuggaaacaccuucaguggcaguaauuuaacaggcucugaagugaggcuucucauuugggcccagguaauguucuuacaagacuucagguaaauuguaguagaugcuggaaagauccccauucaaucagcagaaguuagcagaaaacaguuuaaggauuuacacaagucaggcaaaaaaaccuguuuaaaauacacaaugcaaaggagugauuuacauaaucaauaauggcauagacuagcaaauacuuuaaaggagagaaaggcuagauuuaucauuugccaccuagaucccaaaugauauucccgucuccugaauaccaaaguagcugcuuucacuuaauaacaaaauaacacacacacaaaauaauaaaagcugcaguuuuucucccuuugccuuccuuuaucugcuuguauaauauacauugaauaaucaaucuaacuuuguuucuggcauucuuuuucaaaguuuuucagaucacaggugguacagaugaggaggguauagaaucaaagggucagggcuaggcugaggcaagugagucuuccaggggaagguacccaagccuugagggagagugcgggcuggccucuugaaagggcacaacccuuccagcccuagguucucuaaccauaucccugucaaggucaaguagcucaaaguucucuaacaucgcccucaccuuaaguuacagaagcacauaagcucuuuauucauugcauaaauaauuuaucaagaacuuacucugugcccugcauucgaauuccagagcaaacaccuguuuuggaggagguuuucuuuuccccacucagaaaugaccaucaaccgugaucaaugcugggaauauagcaguaagggacaugugguuggucccugucuucauggagcucauguucugcuggggaaaagauuguccuggcagagcaacagcacucagaguucaugaggaguagcccagaaggagcaggagugguguauacugcuuggugaaugcccuaggagagguggaaguuuccagauagagggaacaauuuagugauaaguauaaguauugcaugagcuccauuaagauucugaagccacgugcaguagggcugcuuuagcuggauuggguaguaugagauuaaaacaguuauaaauucuuaaacauauguugaauucuauuuuauaccagguugggaaaaacuucagccugcauuugacagaugagagaauggagguucagagaggucagaugacuccaaaaucauacaguuaguucccagagucagaacugggaacuaugacucccagccuagugcucuugccaccacagcccuacaacuuuucccugagcaacaguugagguuggcuuuuuauuugcuugauuuuguuuuggagugguuuugucucuccagcagauucuucuguugaucccaaaccuugucacucucuucaggaagcagucaggcagaucuuuucccuuguuggcgucggcaagggcaccucagucaggcccugagugugugguuggacucaugccaguauguuugacaccacccuuggcuuggcacaagcgcucccuccuggcagaguucaccuagccuaacugcuuguuuuauaucccagcugccugacauaugccaaacccaaguguugacucacuggugucagagaaaacuacacgggggcauuucacguuggcuuuagugagcucuagcaaguaaguggagaucguaauucauacauuucuggaacucagcaccuaacacagagccuggcucauaguaggcgccugauuuuuugugaaauuaaaggaauuuuagugacugcagguacauaacacaguaguaagauuaaggccucagaaguaagaagaccuagcuuuagugucagcucagccaagugaauucauuucugggugaccucgagcaagucuuuuucucucuuucaguuacuugauuguuuuucacuuaacaaacacucugagagcagcaucccgugcuuauccucucuggagaugugguccagcccuccucuggcucacacguaaacaugugagauggcuauauaaugcaaaugauauaaacauacgaccaucaaauacuagagagauacuuauaagguguauaaaagcccaaaggagggggugauucauugugucaggaaaaguugaugacaaccuuacugagguggugacagcuuagaugagacucuaaggacgaguagaaaauaacaguccaaaacuccauuacaccaagacagugaccaugaggaagcaaaucaugucaaauagaggacugguaauagaggaucauaugagcuagcugggaagccaagucggugacagugauuugcucccacguuaaugguuuuucacuaaggcaguuaaggcagucuuccacugcggaguucuacguucaaagcagcaacuauuucuuagccacaucuccagcccugagcgagugcccaacccucaguguagggucaguguuccaguggcaugcagaagccagcuugaaccaguucgcaagaacugauuauuaaauguucagaaauucugcaagcugguuguuaaacacagccauuauuaaaaauuaaauuauauaaaauuaaauaagguacauuaaaaacaaagguaauaaauacucaaaacuuacuacuuucuaauuauuuugccauguuugauguuacguuugcucuugagguuacucaggaccaucgcgucuccacgguggcaguaccgcauaauggcauccuccugugugucucuucccaccucuguguucaguggcaucucauugguagcuugaaaacagccaugaugagaguauuuacaccacagaaaugagcaaacgcugcaacugaagcugguuuucuuuuuguuucuuuuuuuuuucaaaagucggucauuaaacauuugccagcaccccacugauaguauccauuaaauaaauggaugcagaaagcaagcauugggaagcccagcacucacaucuuuucaaaccucccaggacaaaugcauguggcacaagacacaauucagaggcccccaccaagcugacuucccaucuccuuuguuccagggaaggcuuuauguuaaucugggcuuuccagacaagugaaaaucaugaaaacagaacagggauggaaguguuuuucuccaggauuuaauuccugagccaaaugccuguguuggcaagaggccucuauggccuaucggcguccagggagucaaccuaaucuuccccagaauccaaaagcaauccacgggagcccaggcuaaacuugcaucugcucuggcuugccaaguuggaggcuacaugguagccaaauggugccgauucaauguuucccaauuaucaggaaauccccaaagagagaucaaucagaggaggcuggccugcauguguauuaggggcagcagccaggacagccccagaaaggaagccauccccccaggacugguuucuguccaggcagaauccagaggcacauaugucuggagaaggcuggcugguggccagcgucaggagaugagaucugucaguaauucucuggaaggacagaguuccagcaauacgaaauucaauuguccuccauuaaagaaaacaucucucagcaccagcugaauacaaucgguggaauaaaucuuccccauuagcggagagauaauuucacauaaauacauuggaagaccuucagagcagaauugaaagucuuugcugagccucacccgcuuaacuuguuugccguguaauugcauuuagaccaagggccucggaaggaaaccacugacugaauuagcauuaaccagauuguguggagugaggugaggaggguggggugggguggggagucuggugcauuguggguaguuguucuugccuucagaaaggacaagcugacacuagugagaccagcugcuucacaagccugguguuaauugcuuuucucguccaacagagaaaaguuuaucacucuaggaagguagagguguggguacuucauacggcaguuacugaauuugagaucuuuuuuuaaugaaugcccaugggccucgucaguagcucuucccuaggccagaagaaaaagccuucucaccugaggugaauagagaagguuauguggugcgcagcaccugcguuuuugacucagcugucuuucagcgagggcuuucuccccaaugugcggauccuugaggacauugcaccagccagugccuucauuuccacccacggccaguggcaagugacugguuagagugggaccuggaguggugaggcccagguucaaguccugccucuaucaccugcuuucuauggagcuucgggcacauaauauaaccucucuggaaaccaguuuccucuuccauacaaugagaaaguuccacuaacuuagggaucuuccaacugacuucugcagacacggaaacuccacagaguugccuucaaaaucaccccaagggagaggaggccuccaucccgacuucauccagcguagaucuuuucauucguuuuccacuuuggaguccuuauaaaaugucaucuacccuaacguuucuguuucugaauguuuaaaaagccaccauucuagaugaucucuaguugucccauuuauuugcucaaccaccauguuuucaguggcaaccuagcauuuguuagacauaguucaggcacugugaggagaaagaaagaaaucuugaccuacccucaaagagcucaggaucuaguggaagggaggaguguguaugguuugguagaguaucaaggugucugcaucagguuuugugggagagaggaacuaguucugauuagggacaucaagaaaggcuucaaggaagaggugucauuaauaguuggcucuucaagggugaaauaguugggagaggagugcaggaaugacauuuuaggcagauggaagaacauugcacagacagaggcacuaagcaacauuugccuggcaaguuugggaaaagcagguaauuucuuguccaaaauauagaguaagagugggaggagggauauugggagaggugucagguuccaaaacucacucugagagcaugcuagcaucuguccuucuccugucucgaaugucagaugaaaggaaguaccuucucuccugcucacuuuuuuguauguucacuuccaaugagacuguuaauaacaguaauagccauugucauuuguggagcuuacccuauaccaggaugaaaaaaaaaagccucaaagaacuggcacaugccuacugaaguucagagagcuaggaaguggcagagccaagauuagaccccagaucauugaacuacacauccacacacagaacuaggcgauauugcccucugugaucagcuuuaucuccuuacagcauaauacaguauccuuagaaaauaaccuccgagugagaucauugaaucaccugccaauaguaauucucucaaggacacuuugaugcccuaaacugaggugauauuuuuuaaagauuauuaugcaucuugagugaacaccaugaaccccuggguacaagaugugucugagugacugauuuucuggcuucuggccucucgggguucccugccagccagggcucugaccaugaaagguguaucauguuuauucucucuucucuucccacaggcaugcuuguguuauucguggccaagugaugacaucagauggaaccccccugguuggugugaacaucaguuuugucaauaacccucucuuuggauauacaaucagcaggcaagauggcagguaggagaccuucuaugagccagaaacagugaaggucccgcucuuguggucuugccauauagcugcugcuggacugauaauguggaaagaggaugggucuuggauucagagggccugaauucaaaugcccagcucugcaacuuacuaauuguaugaccuuguaccuaacucuggccuaugucccuuugacucuagauuuagcaguuucuucucauuugguucucagaguaaggagaggguaccuuauacauauccugcuccaugacuuaugauauaaaacagucaugcgaaccacuuucugcagaacagacagcuugagaaaucucagccauuccuguuaugugguuuccauccugcagcugcuuagaucuauguaagccauuugggugaugacagaauucugaccuuugaauuccuccaagaaccaucagcagaaugaaauaaaacuuccuuaauggcccuagcucucccaccugcuguguguccuaggauaauucuccuuaccucucugugucuuggcuucaucuguuaaaugguccuaaugcuguuuaucucacagauugguuuugaggguuagaagauauggugaauggggaagcaccuggcgcauaguacgugguuaacaaaucuuaguuccccaccccacuuugauucauugcuguauuuccagugucuggcacauaguaaguauacaauaaauauuagcuauuuguuaaaauuacagauuauugaaugaguaagugauggugacaggacaggcaaugagaauauuuuggagaaaaggaaaaaaggaggaaaguggaauauuuaggcugucaguggugacaaguccucuauuuuuaauaaaaccaggugguggcaguccaucuggcuaagcgugggcccauaagguugauuuucacucuguguuggaaauuaugcuccagcuugauugauuuuagcaccucuuuaauccaauaucagaugugaacaugucccggccgaggugauaaugaaguagaggcucaucuguuuguagacaugugugccucuuagaugggguuggcaagcuuggcauggggugcccccuccccaccucucacuccaugugaauaggaagaggcccagcuggaagacauuaguggccagucuucagggauaaacuggccaggccaggccacuguucccuacccuauacaccuucccacccaggaaggcccucaugaagacucccacuacagcaugaaggaugcugccugcuguaugaaaguggcagaugugagccuccuaggcaacagguauucugaccacauuauuaccugcugugaaacauucauccaaaaggagucuuucaggacugacuuuugccaugaaacuugccagucacuccugugagauggcaaaucgucaguccuuaugcccuguugugguugguuagaguagauucauaaaacacaccgagucuggcauaaguucaguggccuuuggggaaagcucagucucugacacuuccugauuccuccuguuugugcuuccucuacaauuucuacugcccacugagagcauggagcuaaauaucagcccuguuuccugcaucauccuccuaaauuacaucacguagccagaauugcugcaacagagcuugaauuucagaucaauucuuaccaaugcauuuuggggcucaaauuuucuucccaacucagccacugcauaauguaugggaaaguuaucaauuguucucuuaguauccaaaaaucucuguuuguuacaugugaacagguaucacugcccucccacccuuccuuaacucaccuucuuucuuaccucccguaccuuacgaaaaaccauaagacuaagagauauagucuggaaauaacagugugcacaaguggacugaaaguccagggacauguauucuucgcuuuccaggaaggcaccaugauacuugcccucauccagcucccccaccccuacucacaugcacgcgcgcgcacacacacacacacacacacacacacacacacacuugcugaaaucccagacuucacaccuuaacaggagcuuacaaacagaaaacaguagcagagaaguuagccaaagagaucauuuaaaaaauggaaaauagaggccaugaagaaaaacuaaaagaacagcaggcaagagauguagauuaggcucauugaauuaaaaauugggggccagaugcaguggcucacaucuguaaucccagcacuuugggaggccacggcguaaggaucacuugagcacaggaguucaagaccagccugggcguucaagaccagccuaggcagcauggcaaaaccaugucucuaucaaaaaaacauacaaaaauuagcugggugugguggcaugcaccuguagucccagcaacccaggaggcagaggugggaggauugcuugagcccagggaggucaaggcuucagugagccaugauugccccacuguacuccugcacuccagccugggugacagagugaaacccugucucaaaagaaaaaagagagagagaaagaaagaaagagaaaagagagaaagggagaaaaggggaaaggaaagggagaaagggggaaaggaagaaaagaaaggagaggagaggaggggaggggaggggugggagccaagacaagggaaugugugaggcccugugcuuuucccaucuauuaucccaucuguauaaucaauaacccugccaaaugauuaugaucaucagcuucauuuuacaaaugagaaaacugaggcuuggaaaggugauauaauucacccauggagcaaguaguaguguucagaauggcccugcgcuguuugggcuucauaugauaaccaggccuucccuuuggggucacauucacauucauguccaaagcaggguuuccccuccagaggagcgggccuagccccagcucauuacuugcucuuggcaaggccagcugcccccugcuugcucacugccuugggaauaugucuuuucauguuugucuuuccucccuccucacauacagccucucaugaagggagcuuauaagucuggcuaaaauucuguuugacaguuaaaaauguucuaucaaggcacagaugcuauucaguucugugacagaaaaauuguucuuugaguauuuccccaaaaccauggguauucuccuggagagccaaaaccugaauuauugauucaaaauaaaccccaccucagguguuucucugucauugaaugauggugguacucaacuucaucuaagugaaugaggaacaggcaaacgggugauagcuccugcaaaggguggaagagucaggcuuuggagcuuggagccccaaaucuggggaugccaucuaccaagagcagaacuugacacuaggaaaggaugguuccaugcggaauccuuucagucucuggaggagagaagagcaagcugcagcaaugggcccauucccacaugguggauuuaucagagucaagaucagauccugcauugaggucucucacaccaacugcccagaugaaccuuagauuuaacugcaguaacagccaaaguaagaagggacguaggguguuuaguagaugucaguucaggagcagcugaugcugucacucaugcauuuauuccaucaacuuuuaagcaucaagcacugggcuaguuucugaaaagacagaggacucaaugucccugggccagagagcucaacaagcaaugacagugcaaugccaugcguguggggcaguggaacccagggaggaagcuggaauucugacuggguaaggcugugugggggaggugaaguuugagcuauacaguuugauaguuaggaguucuccauccaacaaagccaauuaagacaggcuuugaaaaugccuacuacagccagggugugacagaaggaauggacuaguuugaagucacccaggagacagacaucaggcccagugaauaagaagcuggaaagagagggacccacacucaauuuaaaaaaaaaaaaaaaaaguucuaacagucagaacuaaccuaaaacagaacaguccuccuguggauauagcaaucuccucaucucuggaauugcauaaguaggaacugaaugagcccuugauggugguucuauagaaggaacugaugcaucagaugggaggggggcuaggucagaugaccauuaaguuccucuccagugguucaccuauuacuugauuucaacuuucuguuuuaagaagagaaaggacacaaaauucuagucuuacaucuuuuuauuuuuuauuuuuuauuuuuuauuuuuuugagacagguuucacucugucacccaagcuggagugcaguggugcaaucucaacucacugcaaccucugccucccagguucaagccauucuccugccucagccucccaaguagcugggaugacaggcacccaccaucacuuaguucacaucacuuuuguauuuuuaguagaaacgggguuuuagcauguugaccaggcuggucucgaacuccugaucucaggugauccgcccuccucggccucccaaagugcugggauuacagaugugagccaccaugccuggccuagucuuaugucuuauugcaugauagggcuuuaaguagcagccaugcuaugcccucuucuuaauucagcagacccagccugccggauuagugauguaccuugguucacauguggcccucuuuucccauuaucuauaaucugaguccaucuggcuucuaaacauguggcugcagaacccucaaaucagguuccauguggggcugggcagugucagaaacauuggguguacaaauagggaggaacucaguuuucuucaauguucaaaaaguaaaagugcaugccaaggcuuggaugggaacgugccuugcuagguuugucugcaggugauuggaguuaagaugccagcaccaaacagagcugccaguauguuucuggcuggguccuguuugggcacaagauauucuggggugaggcaaggaagacucugccuguacaauccccacaagccugaaacaagagggacuuagcagggggucaucuaggaucagggaaggccuggagaccaucauagagcaaacccauuuggugucacauugaagacagaacuaggacuaggagggcagguuucuccucagaccuccccagcauccucagaggcugaugaacagaggcugggcugccagcucuccagaugcugucacagugaucucaucucaacuaggaggcuggcacucagucuucugguucuccuuucacuuguaagauacuguguuucuaauugagccaucuuuaaacugcuuagcuauuuuguaauugcaaaggccuuuguugaguaaucuaucacaauuagagcuaagauugcuguggagucauagaaucuuagagacuuaagaauaauccauuugagccuuugcauuuuacagaugaaaaaaaugaggaucaaagaggcuaagugacuuacccaagaucacauaauaguugaagacagagccaggaccaggcuugggguucuaacacccagaucaaggcuugcccuacuuuauucacugacuuuucacugggcuuucagcucugacaugguugaaaggcccuaaguaccagcagcaccacugucagcucuuguguauccugaaaaauggcucuccacagcagugguucauuucagcaaauucucuaugugaaucauuuuaugggguaaaaaaaaacugcuuucuaaaaucacugccauuguuuggagcugcagucaaauauuuaggcauuagagccucccucaagaaaugcugagacccuuugguguaauuuucuccccuuucuuugucucucucuuucucauccugguuccugcucuuccugcuccccgccccuucucaaccuuccccucccaaacagcuuugacuuggugacaaauggcggcaucuccaucauccugcgguucgagcgggcaccuuucaucacacaggagcacacccuguggcugccaugggaucgcuucuuugucauggaaaccaucaucaugagacaugaggagaaugagauucccagcugugaccugagcaauuuugcccgccccaacccagucgucucuccauccccacugacguccuucgccagcuccugugcagagaaaggccccauugugccggaaauucagguacccagcuuuccuaauugcauuccaccaugcuuuuauuucauuuuggggguggaggaggaucucagagacaguggaaagagaaaaaacaccucuguagggcuugggucaggucccaucagccuguuaugcaaaauccagccaccaaaccccacagcaggcaugguguaagggcaugaggggcaccccucuuacacauggaaaacacaugagugccuggaacugccuggcacacucugguuuauacuaaauucucucugucuuuccacucuccugguuaguucacuucugccuacuuuccuuuuccccagccuccugugucccucugucauuauuucuguuaaaacuacuuaaaauaaaugguucuaccaagaggaaugugccaaaggaucccgaagagugagcauuauaauaaagauuaaaugagaaaaauguauaugagaugcuuagcacaaugucugucaccuaauaaguacucaauaaauuuuagcuauuauuauuaagauuauuuaacacacgcugccuucaugccaauuaaggauugccuuggcucaaaucuguacauacaacugcuuuacuuaacuaucauuaaaagaaaguaauugggaaagaugcauuuuaaucugauggaaaucaagauagauauuuucaccuaacaaagcucugccaguugaauuuccuucgcuguccccagcccaguuucuaauggcagcagugaaggccugaggaaguggagagaugucaguguagaagcccaggagaagucccgguugucucaccugccuaaugagaacucaggcaaugugccuauuaauggauugcgggcgcugguggagcagggauuuuauauauuuuuuuguguauauuucaugccuggcugagcaaacaccuuuccgugcguacccuguugaguggcuuccgaugccagccaacaagaaggacauacaaucauuuugaaauucucauugcacucacagguugaaaccuccuuuucagagauucagcgccugucuccugucucaacuaccaggcugaccuuucuuaugaaaugguugucaguggagacagagcuugcuggagagaaguaauuuguuacucaacccuggcucagcuccagcuagacauuuuucccaggagcagggacucuggaacaaaagggguuaaaggucacacccucuuuacagugcucccugagcugggugccugcacguucaguuagggcaaaaaucuugcuuauuaucagauucaugaaauacacauaaacaaacucuuggauuuucccaguccucucacagguuaaccuuugcaagugcugggagauaugaauuuuaaaggguauguuaaagaagguaaauauuuuugagagcaucaggauggcacuucagucaugccaggggcucaccaggguauaaguccugcuuugccucaaacuuauaagcuguaguuuaggaagauugccuuaguuuaagcccaaucccuaaaauuuccuguguucaggagaauggggugaggguaaacguucacacuugucuaugaaauggacaggaugaaaaaggcccagauccacuguaaacguaggguagaauagccauugucccuugaauagauacaauagccucaauugauuuaauguuccuuucuugaaacagagcccagcgcaucaagcugauaaaguuaucugcuuuugcugucugcuugggcaugcuggcauucauuuaaacuuuccaacuuagaacuaggcucauugcacccaguagcuaagugaccugagcguuccccgggucauagccuuccccacucuguccaucuggcacuggagcuggggcccagaguggccagaagcuccgugcagccaguccaaccucucucuguggaugagcuggggcugugaaccacagguccugccaggcuguggucugaacucugcauaauuauuuguuuggucaacaucucguagugucuguuuaauuucccgaaaaggaaagucauuuggaacagaucucauuugaggaaaguuuugagagagaaaccauccuuccugcuuaggcagcuggccgcaguagucucucuucauggcaucccuccugccagcaccaccaccagcagcagcagcacugcaugccaccugacagcguuucugugcuaggcacuuuaccuaugugaccuuucucaguccucacacaaagccagugaggagacugagauucagagguuccgugagcuuucuaggauaacacagcuugagaaccaguggcaaugugaucuaaguauuuuauaugcauauccuauguauuccucucaaaacugcagugaaaugagugcugucaucccuguuguacagagcaggaggcugaggcuuggcgaggugaggugacuccugcagggucaccacaugaaaacuggccccagauaccagguccucugacauguuuuacuccuccccaaucuuucucccaucucauuuaugcuuuucccuuccuccuccuccuccugcuucucuucacccucugcuuccccucuucuuuccacugucuccucuuuuuuuccccuccucucuccuucugccuuucccucuaccuccugaacacccagaguccauggggccacgccaucuucccuccacucggugagucgacgaccgucccuugcugugaucugccucugcuuucuaggcuuugcaggaggaaaucucuaucucuggcugcaagaugaggcugagcuaccugagcagccggaccccuggcuacaaaucuguccugaggaucagccucacccacccgaccauccccuucaaccucaugaaggugcaccucaugguagcgguggagggccgccucuucaggaagugguucgcugcagccccagaccuguccuauuauuucauuugggacaagacagacgucuacaaccagaagguguuugggcuuucagaagccuuugguaagccucccggcugcaggacucagagaauagcucuugcagggaggacucuuucuaccucccuaguuccuucuuccuuccuuccucuucucagaucaaaaauaccuaaggcuuaauugaccuuuaagaccuguccgugacuggccaggaccuaaaagaaugugaacugaaagaccugaauguagaaaacccgaccauuacaaugaggcuacagaaccaaagggcccugaaaagugcugugcuggcuugugaggggcuaaaagaggucaugugccacaaaggcagggccagguggacauugccuggccaccccacagccauccugugggaacuuacccauuaaaauaggagagcuaaaaaaugguuucuuucauuuuuuuuuuugaggugcaguaacuaagauucuuccuccaucaaaaaugcuuuuuggccucuuuacccagucagagaggucaucucuuuguuuuuguuauugcugucucuuuguaagaugaaacagaaguuggcuguagccucaccuggaguccuagccucucuuggcccuugggcuuccaggggcuggcuguaugcauuucugcuuccagauuagaggagguccuaggaagggcucagagcuagacucucagcaggccuaacccugcggaguugauccaccaagcacuuaagaguaaccauccagcaaaucccuucucgucuugaaccccacuccaauuucauucccuuagguucagcaaagguagagauucagcaaaggcagaaugaggaagcagagaaguaauguuuuuagaaaggaaggaaguggggaaggaagggagggaaggaggaagaggaagagagggagggaaggaggcgggaagagggaagggagggagggagcagaagcaaggaagggagggaggaagaggggggaagaagaggaggagagaggugggaaggaaauaaaagaauguugcuugagcaccuacugugggcaaugugugccccuguacauuagucacuccauuaauccuuauacucugugagucaaaaauugucacccccaaauucugcauuaagaagcugaggcccagagaauugagaugacuucccagugagaugcacagcuagaaaggaacagagcuggauuuauuccagaucuuuccuauggguucgcauacaauccuaccaaagaagggcacagugggagcaaaggugccaucucucacuguucaugaucccuucuguagaucaagccacuucugucgucuuuuuuaaaaugaggccuuauaaccucuugagaaaaaaugagcacuucuagugcccgccagucaguuaaaaagggaagugacugggcugcagucacuuuccuaagaucacaagugaccacaguggcugcuuaaggaacucaaggccaugggggaaggggucacagggacgucuuccagcccauucccccguugccauaaauggucggcagucuuuuauggcaucuacaagaaacuuuaaggagcugcucaguuguuaauuccugucuugaacauguaguagaauauuguccacuggaaaauaguggcugcccagaaagacgcuuggaagaaauagcauuccugucucugcugguuccuuuccauaguccaguuacaggacuuuuuacacacccaggggcagggaggcugucauguuuagccuucaucccagugaccuucuaagggguccuggauuuaugaaacaaaagcuuugaaaccucaaaguaacuuccagcuuuuuaaaaguaauccaacuaaguuccuuuucuauauauucacuguaaaugacuuuaaacauuuuuccuaauuuaaaaaacaccauagucguuaauaaaaauuugaaaaauggacaaaaauagaaaaaagucauaugugauucuguaaacaaauacaacuaguuuucuuuuuucauacauaauuucuuuuuuuuuuuuuugaggcggagucucgcucugucgucaggauggaaugcaguggcucacugcaaccucugccuccuggguucaagcuauucuccugccucagccucccgaguagcugggacuacaggcgcccaccaccacacccggcuaauuuuuguauuuuuaguagagacgagguuucaccauguuagccaggauggucuccaucuccugaccucgugauccgcccgccucggccucccaaagugcugggauuacaggcgugagccaccgcgcccaacccguaauuucuuuuaaugcaaauuaccauauauaaccagucuuuucaacugagcauugcuccauaagcauuucccaggucaccacauucuucuucacugugauuuccaguggcgucauaguauuccuacaguggaugcacuuggguuugcucacccucucaccccucuugaaccuuuagauuacaucuaaguuuccaauauuaaauaauguggugaagacuugugcacaaaauauuuuccauacuauauuaguccguucucguguuguuauaaauaccugagacugggcaauuuauaagaaaagagguuuaauuggcucaugauucugcaggcuguacaggaagccuggcagcaucugcuucuggggaagccucagggagcuuugacucaugacagaggcaaagcgggagcagccaucuuacauggcaggagcaggaccugggguggugggaggaggugcuacacacuuuuaaacaucuggaucucaggagaacucgcucaccaugaugagaacagcaccaagaggauggugccaagccguucaugagaauccaccccaugauccaaucaccucccaccaggccccaccuccaacacuggggauuacaauuaaacgugagauuuggguugggaacacagaaacaaaccccaucacauacuaaagauuauuuccuuggaagggauucacuuagauccuuuuaaaguaauugguacauuuauuuuaacuuuuccccaaauguaaaauugaucuuccaaaaaaaagaaaaaaugauuaaggcucagcaaccuuguguuaguguuucacaucguucugguugccacuuagaaauaugacccuuuuuuccucuucuacaaaagauaagccaggggccuugccuacaggucuaaaggccaaagagugggcuuugcucacuuaugcauuuugccucauucugucaccuacaguuuccguggguuaugaauaugaauccugcccagaucuaauccugugggaaaaaagaacaacagugcugcagggcuaugaaauugacgcguccaagcuuggaggauggagccuagacaaacaucaugcccucaacauucaaagugguaaguggauuaauagaauuacuugaaccaggcugggguggaaccuugucucauaucccuugugcccugccaaacaaaaaauucacauuuugaaucccauaggcuccuauguggucagagagcucagucaacagauauugcuugaagaccuccucugagccugucacugugcuaggcacuggggauguagaaaugaauggccucaaggcuuuaugccugugagacacaaauacucaccaggcaguuucaauguugugccauaugcacccugacaucacagagggaggcacagggcacuaugaaggcuagaagaagagcaccucacccagcgucuugguucaucaaugugucucuuuggcaagaacuccugaaaugagucucagagggucuauaggauuagcccuguguaucaaguagggagaacauuuuaggcagaagguacaguaugugccaaagugcugaagccuaaaagaaaguuacuggagagaagguucauugugauuuaagcagaggaugacaugaagggaacagcaaaagacaaaacuugggugugagcagcuggaacccaggguaagaagauuaggacuuucaacuucauccaaggcaaaugucaagccucugcagggacuaacgcaugcgaguggcaccaucagaucuguauuauagauaacucacucugaccaugagccgggaugggacagcuaaauaugguaaugaugucagauaucaccugccugaucuaaaaaggcagugagugcccaucaaaaccacagcauguuuucagggggaauugacaaacuaauucuaaaauuuacgauagaauacagacuuguaaauagcuaacgcagccuuuaagaacaaagaagagggacucaccagauauuaagcuauccuagaaaaaccauauuaucuaaaacuguguggugcuggcacaggaacagauaaauugauuccguggaauagaacgcauucagaaacugaccugggaagaguaauuaaacuaagcuuuggccccaaguuucagaaaagccaaaauaacugaauuggaaauaaaguuugcuucucacucaccucacuucucacucugcaagucuggagguagauaauccagggcugcagggucugagacccaggcuccucucucucugugcuccacucaggcuuucaucuccaaagucaugauccaaggggaccacuucagguccagccuucacauccacuuuccagccaucaggaaggaggucaaggaugaagagcaagucccuugcauuguaaggacaccucccagaagcugcccauaucacuuuuacuuacaugccauugcaagaacuuagucguggauguagcugccuuggagccagggaucguggucuguuccaggcagucacgugcccagcuaaauagcagggauucuguaacugcaaaagaaggaaaggguggauaggaaggagaaguuucugccacauaccauguguauauaagaacuuggaacaugacagagauagcaucauauaucaguggagaauggauggguguuuuagaacuuaguauugggaaaauuggcucaauauauagagauaaauuaaguccucacuucacacuauauauaaaguaaauucagauguuuucuuaaacaucuaaaugagaaagauaacacuuuaaaauugauggaagaaaauauuuaaaaggccaggcaccguggcucaugccuauaaucccagcacuuugggaagcuaaggcgagaggaucgcuugaggccaggaguuugagacuagccuggcaacauagugagaccccaucucuacuaaaauaauuguuuuuaaaaaauuagcugggugugguugcacaugcuuguggucccagcuacucaggaggcugaggugggaggaucacuugagcucaggaguucaaggcuacaguuaagucaagaacaugccacuauacucuagccugggcaacagagugagacccugucucaauuaaaaagaagaaagaaaagaaaaaagaaaaggagagagaggaaaggagaggagaggagaaaggaagggagggaaggagggaggguaggcaagaaagaaagaaagaaagaaaaagaaaagaaagaaaguaguuaauuaauuaauuaguggaguacuuguaaaaaucucaggaaaggauuuccuaaaaccuaacaaaguacaaacuuuaagguagaaaaaugauugauuagaguacguaaaaauuaaagcuauccauugaacaaaggacagcuuugacaaagcuaacagguaacaguuugggagaagauccugaugaucuguaagagcacagcucacuugggcuucaguauggaagaggugaggcagcgggcagaggauccaguuuggaggcugugaagugugcaugaggaaaaaggaagauccagacuaaaaagaaacaggauggauaugggaagaagcuuuugcgucauugaggucaauccccucauuuuguugguggggaaacaggcccaagggcaguuaaagcaguaaagagaucuauacaggagcugggaucagcccauuaauaacaaagccagguaaaagccugucgcuucuugacucuccuuugaugagaagagacugugaguuucacucauucauuucuauaaacauucacugguaucuacucugugucaagcucugcgcuaagcacuggggauacagaaaggaaaaagacauagucuccacacuugaaaugguaucaauugaaagagaaaaacaaguaaguaugauaaauaauucaugcugucauagagcuauggacuggguacaugagauauggacaaccuaccugagaggcaguguaggugaauggcuaagcgcccagacucuggagcucuuccacuuaucuucugugugacuuuggguaaggucgguuaaguuaccuggacaguccccuguuacaguagggauaauaauagugucuaucuuacagagcuauggagugaauuaaaucuguaugacuuguuuaggacaaucuggguuccauugggggggugaggcaaagccuugggcuaugauccuggaaaugguugauggagaucuugcaugccuugcaaaaucaggugacucuguggucaaccacaggaaaagauacccauuuccugcuccacaggcaauucuguucuuuccuugucccaggcauccugcacaaagggaauggggagaaccaguuugugucucagcagccuccugucauugggagcaucaugggcaaugggcgccggagaagcaucuccugccccagcugcaacggccuugcugacggcaacaagcuccuggccccaguggcccucaccuguggcucugacgggagccucuaugugggugauuucaacuacauuagaaggaucuuccccucuggaaaugucaccaacauccuagagcugagguauguaaggugaugcuuucuucauaguuccuaauaauaugccuuugccauccuuugggccccgccacauuaccugcugagcccagggaagugggauaggacagagccuugcccgucaggcucugagacuuuucaccucccagcucaagcaggugcugcuuccccagugcacuacagugaagacaagcuacccaggacagggagaugucccuggcauccagaguacaucugugacauagaaggcugcuagcagccaaaaauuagacuccuuggaagccacugaaucuucuuucuguuuccuggaaguaaacugauuagaaugagucacaugaaccuuuuuuauaaaaacaaggggcugggugccauugcucauaccuguaauccuagcaccuuggaagaccaaagcagaaggaucacuugaggccaggcguuugagaucagcuugugcaaccugaugagacccccaucugcaaaaaaauaauuuaaaaaauuagcugggugugguggcaccugccuguaguccuagcuacucaggagguucaggcaggaggaucccuugagcccaagggcaguucccuucaacugaccaauaucgagaaaacugaccucucugcuccucaggugcugcagaagcagcugagucagccucuuuccccauccugacccugagugauggagcacagccacgcuuagagcuccgggaaggaccugauauguuggauuuuucucuaugccucccuaaccuagaucauuuuagaaccagggcacugucauagggugggcuuaggggucauggaagagcugugcuuuagagauaagggagccucacacucccuuucaagaggaauugcgccaagcucccucccaacuccuuuagggaauggaaucugccugucuucugggccagggugcaugugagcaggacaggcccuagagcuggaaagccuuccuccacagugggcaggggaaaagaaaacucacuuuugcuggguuccuacuauuugccaagcauaacaauuccguaagguguuuauuauuauuccccuuugguaaaugaaaagauggaggcuuagggaauuuaaagaaccugccugagguccagcuucuagaaugguggacccgaauccagagaucauuacacaccucugccucgccaaagccuugucaccuggcccaaugagagccacuucgacuuaaugccuuguuaaguuccucccuggagguaagauccuacugcaagaaucucacucuaaggcgcacgcgugaaaggaaggcagggccaacagccauaagcccuaaagagaagaguuaguauuggccccacacacagggccagacaagcacacacgcgguagguucauaggaaaucagauaucggcugaaugagaagaggaccaccaggggaauauucucugcccuucugcugucuauuaugagucugacuggcacagacaucugucaaggaagaaggauucuuugagcguauuugugucagucaacugcauauauggaccacaacagaaagcaccauggacgaggaaaucagcucgccucggcagagaagcugugcaacuuuggacuaaucacugaaccucccuggaccuccguuuucaccucuuuccaauaagagaccccauuuucccugccucccucccacaguuguuggggagaucaugacagugggugaagaagggagauauaagugaaauuugaaaaaaauaaauuuagaaguauauuaucauuuugauauauuuuuucuuccagucuuuuuuuccuaggccuguuucugugucauacccucccuucuaauuauagucuaucuccaauucuguauucuauugugaggaggcuccugggaagugacccaaauuuggguaacucuuuguagggaagugugcauguggagacacagggcaguaagcauguguaucucuggguaugugucuguacagaggagagaauccacuauuccaaucucugucuuagcccuuguuaaagcagcagaaugugucaaccuaguccucuucccccaaagucagcaguaguggugcaggugaaaccaugccucuucugugauauguagcugcuuguaagugaacuuacugacaaguaauauccaauauaaaauacaucagugucacagcugcuaagucuuuauuuauuacaguauuguauaguaccauugcugucaaguuuucaggcugcuaauaaugcuucuaacccugcugcuaacaccucauucuuucuucuauucccugcucuccugucuucugucagaaauaaagauuucagacauagguaagccaaccaguggagaauuuccugccucaccccugccuuguugcaugcuguaugguaagcugcacaugucaauuucaaauggcuguauggcaaaagaauccugugugauuggaacugauugggguaaucaguugcaaugggaggaagucauuaauaauggcaagaauggguggcaggagccugaacuccuuggaucuguugcaaagugaggcaguuacuuugauagucugaaaguaauaugggaaagaauuugaaccuuggaauaguaauuugaaugcuacagccugcuuauccuuagaauaaaugaggaugucauccuaacugcauugaacgacuuugauagucaugauaggaaguccugagaacaucuugaucaggugaacaaucuggaagaagacagauuucacauuuacacuucugugggcauucaaggugccucagcuuggggaugccaggcaaccccacccaaaaggcuugccaucagugagaaagcaggcuccaggaaccaacugcagagaucaauccccaaauaggaacuuugucccagaguagguuugucauguagacucacagcgacaugcaguaaacagaaaugggucuagucaggcacaccaagagaagugucugccugucagcaucaccugucacuauggcauucaccugacuccuggauagcagucaccucagaguccccugaccucacacacauuguggugacuuggaaaguaaccaugggcagauagagcugcagcuugcauggccacagaaguggcucucaguuauccaccugcagcucagaucaaaguggcaugaggguggugcuaaguugggaugaaagaaagucuuaggggugguggaaagagucagacagacccagaauccaguaaugauucuaucucuuucaauugaaguagcuucauuauucauguaauaauuguauguguuauuuuaagauaauauauuuauaaguaguaaauauaauuauuuaauaauucacauguauagaacauuuacuauguagcagauagaggguuauguccuuuacauggacuauagcguucuaucgccaaaccacucugugaagcagauauccaugauuacaucaguagacagaugagaaaacugaagcuccccaauuauguggccuugaaaaaauuccuucaucucucuaagcuuuaguuucuaacauaagguuaauaaaaucucccuuggagucuuguuguaaugaucacagaagauauuuguaaacuauucaguacuuuuaggcacagggaggagcuccagaaauaguaguaguaguaauaauaaugauaacauccuauagaguuaacaguauuauaauuuauuaucauaacaauuauuauuauaugauaauuaugaugucuccaucuuccccaaaaaggaauuaaauccucuuacacccaaaggcacauguauuaaaguaaaucaaagagaaauugguaacaaaaaaggaggaaacauauaugugauuauuuauugauuaagcucugagcuuccuggcagccaguguaaauaagaaaacauaauuauuuucauacuuuauggcaucagaaauugaaaacaugcccauuucucagaagagaacauuuuuuuccugacacugaaaucugagauuuucaaugagauuuguauggaugauacugaacuauguaaugacccaugccuucaacuucaguuguacagaaaacacagaaguacauuucacaugcaggucuuggauuaaagccuagcauuuaauguugaaacauucaguuagugguggcggcugcaaaggacacagccaugacccagggggacauagcugggaagagucagaaggccaggugcuguccagcccugcugcacauucaccauauggccuugggcugguuaccuggcguuucugguuuccagucucauguauaaacugaaagaguuugugguuugggaacauuuuguuucugauguucagugaucuuuuuauauauucaugguaugacuuuaaacccuucgucaauuaauuguuuucuucgguacuaaaaacuuucuaagaugaaccaaaguagaaaggaaaaaaugaaucacuuucugccuugcaguuuucuaaagacaaccagaagacagagagccuggguucagcucugauauuaacugccaccuggauauuggcaaaucucuuccucucucugggcuucaguguccccaucaguaaauguuggagauggauuuuaaaaauuauagaguuguaucucuuccuccauuaacugucccagccacucccaguaauaugucuggccccaugacuggcaacuguaggcugugugugugcuuccccggagcagacucaugucugccuuuugcuuuuccagccucagugccagccugcugugucgggcaugcucaguacagaaacccauaauccauggggcaucuuccucuacagacuccuucaggaaauaagcaucuuugccucgucccagagcucuuccccagggucauggaagauguuugaagccuuuucuucagaaguacauuugaacuccaguguccaucaaacccagauacacauauuauauuaacucagagcccuuaauugucccgggaaauagguugagcaggacaaaauaaagucugacauacuuaguguuuccacugugcaccaaaucuucuaguaguuucuaaaggaaccagcuuugcuuaaaagcugccauuuauuggguauuuuauuuuuuaguggaacaggcacuaugcucagagguuuauauucuucaugcaauuuuguccucaaaauaauccuuugaaauaggugugacuauccccauuucucagcuucagaaaacugaggcuauagaagugaugugaccagggucacuuagccaaguggaugguagaacugguauuugaacccuugacuguguggcuccaacacucaaccucuucccacugguucugagaaccagggaaucaaauucugccagggcugccaacugcugucauugaaggacacuccuuugcaugaggcagaccuuacuuagagacaaagagaauucucacucacaaggaagugagccuguaugucccuacagacuccuagguucccagcuccuacugggaaauuccaaacaccauccagaaugagggcagagugaagcuuggcuucagcucauuaacuucaggaaugguacccugaaggccucuugauuuuacaucacuuccagagaaacuaagguuauguuugaggaacuggaagagaauguggguccuuagagacuucuacagcaaacugaaaaugaagcugugaucuuacucuguguccagcccugcucaggauacugggcaucagaauugaaucagaaucagacaugguccguuuccaggaaaugcucccuguccacacagccaggccugaggccuccacugaaggccgucuuccgucucaugcucugagacauuuaugauuuguagaguauucuaaggccuugcugcucaaaauacagacaagcaacacuggccugcucuggggauuguuagaaauguggacucucaaguuccccgccccagagcuacagaauugaaaugugcauuuuagcaagggcuccagguggcacauuaaaguugaaaaagaacugcucgaaggccaugguucccaaaucuggcugugccuccaagucacuuggagagaucucaaagguauagaugcccacacccuucaaucauuauggguagggcuauuuuuaaaucucuccaggccauucugauguguagccauguuugagaaccaucacucuaagauuguuagcagugagcguuuccuauguauacuccagccagggaggcugauucagcagaacuuucuggaguacuuauucugcaucagcccaguucaaagccgcagagacugguaaucagucccuccucuugaggaguucaagguuucauccaaaagacagacaauuaaacagaaaaguuuaauuggugcuacagauacuaaaaguauaaacuuuguaagcucuaguggagacacaaugaaggaagaggccaguucuaccaguggggaagaagaggggguucaggaaugggauuacagauaagcugaaccucagaagaugagcagguacucccaggugaauaugggcagaggaaccuuuuagauccugggcagcaggguggggaaguagaaagaacacagacuuuggagucaagcagaacucgguuggaauuucauccugccacuuaggaaucuguggucccagucaagucacuucaccucuuccagucucaguuuucugaaauauaagggaggaaaguaccuaccuuauaugguaguugugaagaaaaugaggucaugugugcaucaagugcuagcgcagugucugggacagaaugggcaucccuagguggucacagaugcauucuuaucagugguagucaucucugcagcucuguucugcagacagguggcgcugcagccugguggagucuagaugggcaucauagaugcagcugcagcucccagggccagguggcaggaggacgaaaugagcugaauguucagagagcucugcaaacuagaaagggcuguugagauguauaauuucauuugaucccaacgacaagccugugagccuagccgagcagggacuuagucauucgacagcuaagggaccuacgauuugaacuauuuaggugacucaccuaaaugagagccuacaccuucuaagcucaaagcuaguuguuguuuucccuaugcuuaacuuaccagcagaccucagauuuguccuugggcugaaagaugcagccacagcucuuacggacucugggauaauccugccaaugccacccuguccuggaauugacugaucugagaaacuccacaugagugacacuucucuggagcagugcagggagacaggagcuggaaacucagggggcuaaucuaaguggacagggcccccucaccauacccccucagggacccuuuucugccgagguaaauagcaccaguuuaucaugagugaugugcaaagaaaugaaaaaaaucaccccgccucagagcugucaucagaaaagcagaaagaucaaggcugccccaggauuacacaguaggaucuaaggucaccgccuuuuauguagccagaauugaugucaucugggaagcuuaaaucugugcuacauuauaggguaagucucaggggacauuucaaaauagacaggauaccuguccuguuuacugcuaaccccagaagagaaguaaaagaagagcuaaauaaugcgaaugcaaacacuaccuaaguaaucuaaaaauagacaugccaucuacuuaaaacaaguggcugccaugggcuagaaggcacgaagcagaacauuggaaaaacaaaaacgaacaaaauccagucucuucccuucaaguauugacgauuggguuuuggaggcacacacauaaaugaacagucacagcauuauguccuaucguccagcaaugaauggaugcaaaucuccaugcacggggagaaggcuggggaagguuugcagaggagggagcauuugaacugacaggugaagggugaguaggaaagggaggggcggggcacacugcagagcaggagcagcaggugcaggcagacuugaggcaugcugcagggacaggucuguggccagguguagggaggaugggaggggagggaggaugggaggguggagcagcacagcagaaagcugggauuugugcaggggcagggagcucauaccuucucuguaagaauuaaggaauccuugaagggaaagcauugaaauggcagguugguauuuggguuagaucaagaauggcuugaagaggacccaggcuacaggcggagagaccuccccuugguucgagaaggauuaaagaggaaggacaguuggagaaaaucauaucagguuaguugaauucagggagagaaaaccaaagaaggaaagcauuggaucuggaugccuggccccuuucgagguagccaguccccaaggacacuguccaaggcaagagacauuuauaaugacaaaccugccagggccagauuaagaccuucagugacuuacauacugaaaagauuauggugccccagccuucauagggaauucaaaaaacacaaaucuguaaaauaaaauuuugcuuuucaaaaggaccccaaacuuacauaccugauaaaugcaaaauagcuucuuucuagacuuuucaaauucucuugcuuucaucuugaagggggucugcagugcucuggcccugcuggugcucucaucacugcucagucugucccgagucucuuagcacaguuuaugccucacugugcaaugaaaauggccagcaccagaccauccgguccaaacagagcuuccuuugaaucaaaauaccuuccggagacuuggaaggggcugccaauauugagaugcaguuuuagggcccggcaaauguucagaccaugcacaggaacuuaaaauuagcuucucagaagcaccaaguucaacuccgaugugcccuagacuugaaagaaauuguaugucaguaccaggggguaaaaaaauucagucuuaauaagagauaucuacuacguagucaucuccaagugcaagaagagacacaaucauugguaauuaaaauaauaauuauuauugagcaucuacuacacuaugcuacuuugcauuuuuuauuuuaucucugguuuccccaauauacuagcaagguagcuguuaacaccccuauuuugcacauaaggacuauucgaggcucaggaggucggguaacuugcccaaguuucagaaccaggaaauuacggagcuagacuuggaacccagacuguucugauugcaaauccugugccguuuccucacccuguggcuagaggcagugcuuugucuccccaaggcaucucugcagucaagcuucucucucuguuggcacagccugaucuuuauaacuguuuuccagaaacagaaccaucauuagcacugcucuucuguguugcuuauuuuuuuuccuuggguuucacugcaaauuacaaacuaauccugcaguucacuuauaucugacugccagagggagacuccugggcuccugauaaguguaacaugaguauccacugaagacgguguugaugcugcugaccgggagucagagccagccaggguuucauccaucagucccaagauggagaugagggacugcuguaaagauccuguggaaaagggcuuguguuuuugaacucuugaaguguuuuuuuaaagucaagagcauccauccuucuagcuugaaugaacgggacaccagugguaggccucagugaucaucuucuuaagaaaacguguauuuagcaccugauacaaacauggcacugagcuggucaucuuaaucauuucaucuugaagggguuuuugcaagaauagugcaagggguucuugcaagaauugcaagggguuuuugcaagaauagugggugggaaggauaguuaagccaaugacugaggucagaaaaauuggggaaccaucacccaaaauaggggcaucauccccauaagauauuuuugcuuggauucuaaagggccagggguucaucuguacaucuccagcuacucauaggaagaagaaaaugcucaccaguuggccaugucuuuguuuucuagucacaguccagcacacaaauacuaccuggccacagaccccaugaguggggccgucuuccuuucugacagcaacagccggcgggucuuuaaaaucaaguccacugugguggugaaggaccuugucaagaacucugaggugguugcggggacaggugaccagugccuccccuuugaugacacucgcugcggggauggugggaaggccacagaagccacacucaccaaucccagggguaaggccuugccuuagagacauugucaauaacauuuauugggguauuuuccuuuucagaaaaacaugcaugauuaauauugcaaaaauuuuuggaaaauaccaagaaauauauggaggaugguaaaaacugugauaauuccaccugccagaaauacucccaguuaacauuuccugucuucucuccuagucuuuuuucaaaguguuuguguguauguaguguuuacuaaaaacaaacaaaaugagaucacauuaagcaaacugcuuuuuuucccuaaaugcuagaucauuaacauuucuccaugucauuaaauuguuucuguguacucauuuuuaaugacuauauaguuuuccagcaaauggaugucccaguccucuacuauuggacauauaugcugucucucauguuauuguuacacaaaaacauuuuaguguaucguguuuucauauguucauaugcuaucggguggguuaacuguaggucucaauucugagucccucaaaaaguugaaccucuaaaugcccacaaucacaauuuguuauucgcuuauucagcaaauauucaaguacauagagugguugcauagauaaguuuguugcagcagaauaaauaagacuugagugugaaucacugugacaugggugagaggaagaggugcucucugagaggcaagaagaaagagcuguucauggggguuuagagccaagagagaccccugugccuuggagacugggaaagcuuuuuggagaagccaucauuauccacacucaguggaguguucacuguguugcaacccuauagccagugauuuacagugucucagccccaggauccucacugauagaauggggguaauaaugccauccgugucuaccuccuagguuuauucugauggucaaaauuaauauguuuaauaauaaccuguagaaacauucuaagugauuguauuauuaaauaaucccagauuucagggccuaguuucaaaucaaagcaggagauucuagugaaaucaggcauucaaauucagacuuugucaucuacagcugagugacuuugggcaaaucauugaaguucucugagccucauuuuccuuaucuguguaauagggauaugcugcacaguugugguacagauugaauauuaggaauguaaaugcuuagcgcaguaguaccccgcacaugguaaacaucccauaaacgaugauuccuauuauuguuguucuauuauaucacaucacaucauaucaagucacauugucucuaccacauaccuggagugucaggugguaguugugugggguaaauauuguaucaacaaaggcuaaucccgccuaauuaugauuuucaaauacugagagaguagccaggaguggaaagaacacuaggcuugcacuuagaaguccuauaugguuuuccucugcuacuggcuggcccugggaccuccuccucugggccucaguuuccccauuggucaauuaaugaacagguugggcuaaauaauccccaagacccuuugcagccacaacauucuacucucuuagguuuaaaacaguuuuuucuaagaauuuuuauucccuccagggcuuuucaguuguucuccacacauguguguucucuuccccgcccucguggccccccacccucacacagaugaagcggcagugcauuuacccaaaagccuaugauuaacccacauagaaaugacaagggugccacgauaugcaggcacuuugcagcagggaggagaaaagauguccgucuauuuaacacaacaaaaggagaaaaauuagguaauuaaucaggggacagaucacuucuauuagccugugcagccaacucuguaaacaagaaacccaacuauucauggagcacucaucaguccaaacagauggaagagaaagauggggcauagcuaggcagacaagaaaacgccugucuuggcacuuacagaaugaaauuaauguacauucacgacaggaccaugagaaaggcuucccagccuugaggcugccugguccucugugugaaaucacucuccagccugaccagccuaagaaggaacaguuggugcuccagcagguucucagcacucagaggccccugggcaucuuaaagcacccugcuggccagugagagacacguggguccccggagcaaaggccuugaaacucacaaagugccagccacuuucucauuuuuacaauggucauuaauaauuauugagggcuaguuacuacaagucagauguuagaaucccuguuuuaucaaugaggaaaugaagacuucaaagugaaguaauaugcccaaguuaauacgaccagaaaauuuuauaauucaagucucuccaccuuggugaaggcuuccugacccuucuuccacugccuuccccagagaaaacauagugaaacaaaagugaccagaaucuccuguauuuuaccaugacccucuugagucuguccuuucuugugcugcucacaugguacugauucauuccugugccuuuccaucuaaacugggugcugcccagggccaugucucaucuguaucccacgacaguucaugguuaugucugauucuugcgauucugaaccugggauggaaauuacuaucacccauguacacuauuaaagcacccuguuccugguccuagccacccgcugaauucguauuuccaggaguuaggccagcagguguauauugaaaaaccucuucaggugccugugaugcacaucacaggcugagagguacugauacaguggagugguucucagacucugguuugugucauuaucacccaaggugcuugucaaaaaugcagauaguagcucagacuccacuugagauauuuugaagcagcuaccuggggggugcaguuuagcaaacuccccaggggauucccauacacauccaagagugagaaauacagauuuggagcaaucucauuguuugacagcugggaagacaaacacagagaugcucagugacuugcccgaggucacacaaguugggucagggagaaaguuaacagggugagacagucuagugaauggagcaggugauguugaguaaugauucugacuccucuccucagugugcugccuuuagaaauucaauucaacaauauucucuacacaaauccauaggauucuauucagauuccguaguuuuguaaugaucagugagacuaaaauaauaagaauagaaaagcaugaaggacgggccgggcaugguggcucacgccuguaauccuagcacuuugggaggccaaggcggguggaucaccugaggucaguaguucaagaccaacauggugaaaucucaucucuacuaaaaaaaaaaaaaaaaaaauuagccaggcaugguggcgcaugccuguggucccagcuaacugggaggcuaaggcagaagaauugcuugaaccugggaggcagagguugcagugagccgagaucgcgccacugcacuacagccugggugacagaacgagacucuuuuuuuaaaaaaaaaaaaaaagaaagaaaaagaaagaaaagaaaaaugguuaccaaaaaggggaacuaauuauuauaauuacagagcuucagaaauaggugaauuuaaauaauucacaguguuaauauugaaaaagauccuccuuaccacuguaucucuagugcuuaaaaacccccagaaguuaugaauccagguuuaguggauggcuaaggggauagauuaaaaucucaggaggcagcaaggugggaggaccagagcccuggaagaucugaaaaaguucuaaucccugcuuugaacaagucacucaaggccucugagccugagacuccuccucuuugagagaggaaugaagguugugggaggcucaaacccaaucauguagaggaggugcucugucaguuagcaaggcuccaggaaugugcgggucauugucaucucugaugcugaguuccuguuuuggcuucucugcccccaggcauuacaguggacaaguuugggcugaucuacuucguggauggcaccaugaucagacgcaucgaucagaaugggaucaucuccacccugcucggcucuaaugaucucacaucagcccggccacucagcugugauucugucauggauauuucccagguaagauggcuucaucuaccaaagcccugggacugcccacucauccucucaucugccacccagccagccugcuggccauucaucuuugcacugauaagccuuuaaagagcaccuacuuggugccaggcugugaugagcaccaaggacacaaagacaaguaagauacagccauguccugggaguucaccaucaggaguaacaaguggaagcccaggggacagugaagaaaucucccuaaggaaaccucagcagcagcagaguaggauagacagagcuuuacaccacgugacauuaaauccauugccaccugaacuuccucuuugguaacacugauggguauuuguacauugccuguucucuuucuaagcuaugugaggacagaaaugcugucaguaaccagggugccuggcuacccaaauuugggcacagucuauacuugcugauugauuaaucgauugauugaauccuagcuuuugccacucacucacucaguaacuuucuuuugagccucacuuuuuauaucugugaaauggaaauaauucacaucggcccaguaggauuacccugaagauacaugaaacaaugcauccacgacuccuagcauugcuuggcccuucagaggugaugaaugaacaaaaguuagagugccugcuuucacacaagaggugacauuuaugcaaguuuuacagguugaauagaauagggguuugcugaguggcaagaaagaaaaggagacauuucacacaaaggaaacagcaugugcaaaggcacaaagauguuaaugaggcugguacacucaaagaauaguggaaaauugaaaaccauagcauagggugcuuggaagcagguggccgcaguuaaaacaagaagcaugguuuggguccaggaagggacggacccuguuguaccaugccaaagaguuugcacauuugcagguggauaccaggaacccauuauaggucaaaaagagacacaagugacuggcuauccagcauguccuuaguacauccugugaugacuuggcaaggguauguccuuuguugcuggauccuuuggcugggccaggcccaugcugaaucaguggccugugcugaaucuugccaacauuaccaaaaccugggaaaucaggagcauugaguuacaucaaauugcaaauugauuucagcuccagcaacauuuagcuuuuuaaaccccuucauuuuuaggggagccugcacacacaggcccuuuuccacugacugugucaccugcuuccagccuuucuggucaugccuaccucuguuacugacauguaucgcuaaguccuuccacagagccuuguggaugcugcuggaggucccagcacucaugucaccuccccaucgcaugcugggaugguuucccucugcaccagcuaaugugauuauuacacuccagaguggaugcuguucucugccacucgucuuugcaguuuuggcaggcuuacccuugcuggcuagugaguuucccucuccagucugugagcaagcuugaauuacccgucaggaagccauggccuaaggaugugcauacaaguauuuucaauucucaaaaugggcccucaaccagccagcacagggugccgaaaauuuucaguccacacaucggaaaauuguuuaacuuuagauagagguacugccaagcagccggaucaaaggcuuggaagacaacuggcauauggcggagggggaaaaaaaugcuaaaacccacacuuagauucagaaauccuggacugaaaucucuaaaggcccucacuaccuuugucugaaugucagcaugggauuuucuuuaaccaaacucuccaauacuggcaucuauuuuacagacacauuugcgcaggugucacuggcuuucauucucagagcuuccucucuacuccgcugccccauggggagcagggagguaagcaagggagagcacacagcucagaggcaugagugagaaggcgagagccaaggaacuuggaccagcuccuuugggaggagacaaacccaggcccaaaaagaaacuaaagagagaggcacagagcagagaaggaacagaaggaaguuguugcaaccuguuaagaaguggagauggccaccaccgacagagaauaacucuaugcuuaggauccaaaauaagaacuuaguaugggccaggcgcucuguuagaaauggggguacagaauaaguacaacuucucuuuucuuacuuagcuaucacaauagucucauaggguagagcugaucuacccccauuuuauagauaagaauacugaggugugaugaaugcaaaugcauuuauaaauguagagcccuguaccagguuccaucagagauauggaaaugaauuuuuuaaugaaauuauguacacaaauugucuaguacagugcccagcagcuaguaauaggaugugaauacuaguucccuuuaaaauccacaaaaaacuuccuuguacauugucucauuuaagcuuuacaacuacccuauguaauauguguuauccccuuuuagauauagagaaagauguucaguguuuaagaaacuugagguaggugacacauguagcaauuguggaacuggaauaggaagugagguguccugaccccaaucucucacucccucuaugccauuugcugguccuuccuuccuucguucauucauuugacaauccauuuuugcaagaaaaucacucugcaacaaggcagccagcuccaagugcuuuaauaaaggcacagaauguuccgguggacagggaagagggucccauuccacacuggaaccauagaacgugggagcugcaagaccucugaaauuaucaagucuaguccauucauuuuggggaugggaaaucaagucucagcacgaucaucgcuaauaggguggugaaaccagagaggcugagguaguuggucuggugcaggaucaucacacgggcagugugacagagugaggacugacuccaagagcaaugccccuucuccuuucccaggcaccucugugcacauggcauaaggggaaaguguaggaaagcacuugcucuacauuccuuccucucuuuccucuccucucucccuccacugacucugucucccccuagucuucccaucaaggaacgaucuuuucaucauaacgacaggcagaaaggucuccacaagcagguccccaaggugccacaggaccagaaggcauaaaauauuuagcggccagaguugacaagaaguggguuuuaagaaauugaaaauuccccugucacuuuagagcaaacuguguuccugaugcagccaaaagcugccacgacacugcccagagagcgaggggagugugaagcagcagcacuggccggcagcggcccuggcgaguuugcaggcucccuggcucugcagggacagagggagcugggaguaaggggacaagaagacuuuagaaagcaggaccggaagaucaugcucuaaagaacugagaaagggccugcccccuccugagaaugucccugagcugcagggacagauggagguggccucacucguguguauauaauguauugggguuucuuuuuacauugguaaacuaccacauguacauuguagaaaauauaagaaguuagaaaucacaaagaaggaaauuaaaaucaccuuuaaucuuacuaugguuaacauuuugauauauaugccaucccucaagcacuuaaucuccucuuuaucuauaaucuagcuaaacuucuuauauuuuuccccaauugguaucccacugugcuuacaguucuguaaccuguucuuucuacuuaauacauagcaaacauuucuccaugucauuaaauauccaucuauaacaucacuuuuaacaacuacacacaguauuccaauuuaugagcaaacuaaauguacuauuauuuagccaguucucaguuguugggcauuugaguugguucucggucuuugucauuauuaaaaauggcuucaucauuauuaaaaacacucuuauagacgaugguauacaaaaguaaauuccuggaagaaaaacuucuuaucuaaaagcauacacuuaggccaaacacaguggcuuacaccuguaaucccuguacuucggaaggccacgguaggcaaauugcuugagcccaggaguuugauaccagccuggguaauauagcaaagcccugucucuacaaauauauauauauauauauauauauauauauauauagacacacauacauacacauagacauacacguguauauauauauauagacacacacacauacauauguauauguauguauauauuuauauauauauguguguguguguguguguguguguguguguauauauauaugugugugugugugugugugguggcacaugccuguaguaccagcuacucaggaggcugaggugggaggaucgcuuuagccuggaagguggaggcugcagugagucaagauuguaccacuucacuccagcccgggugacagagugagacccagucauacacauacauacauacauaaguaaauuaaaauaaagguauacacuugcuuaagcgcaccccagauuggaccaaauaucaaggguuuguagggggcucaggaagucuaaggcagugaauuuuuaggugggguggaaaaaucagcaguagggugcaccugucggcacuuccagcccacacaaaacauggcuggaccuccuagagacacagguggcaaaggguuccccuuagugccaauaccuccuagugugauagauccaacaauccagccuucaaguccacugaagaaaacacuccuccccucagaccaugccagcuacaauccccugggugcccacuugaagacucaccaugaccuaugccaguuucccagccuggcucagaggagguuccacauggggcccagcacuucugaacuccuaguuccuacaaccagcuucaguaauccuuuccagguggaccuguucucugagguacuagaaccacugucuggagcagggcuucauaaaccuuagugugcacagaaaucgccuggggauuuugcuuaagugcagauacugauucaguagguuuggaggaggccugucauucugcguuuaugcucagcuccuaggugagcugaugcugaugaccacacauaaggagcaaggauccagucaugauucucaagcccacaucaggaucacucaggaagcuuuucaaaauaaugccgaugcccaagcuccaagcccagggaucugauuucacccaccaagggugggguuuucccaccauuauuuucuaaaaucgccacagauaauuugaaugugaggccagauuugagaaucacuggucuagaacuaugacagacagaggccaugguuagcuugucuuuaugucucuagcagcuagccagcuguuaauccaugaacucaaagaauugagaaaucauacauguaucauaucaaccauguaugaagaaucuuucuuaagccucugaacaacuccuacuucagccuccagacuccaucugccuuucccucccaucuuagaacaucagcugccauuauuugguggguuauggugggucagggacucugugcucuugucauucccauuucccauaugugacuauugaagcucagagaggcaaaguaacuugcccacagucauaaguaguggacuaugcucugaacucaggccuauuugacuccaaagucuacccuuuugccuacuauuuuguuguuguuaacuccuucuucauguuuugucagucuaaugagaccaucacaugucucaguggcagcucuuucaugguuucccggugaucagggggcugacgcuucauuguugaugauaggcugcaugaggaucaagcaagacuguauaugaagccacuuuggacacuguuaugggcuacaugggcuaugggauggauuaguggugggcaucuugccagucauuugaguaucggugucuucauugucagguucaccuggaguggcccacagacuuagccaucaacccaauggacaacucacuuuauguccucgacaacaaugugguccugcaaaucucugaaaaccaccaggugcgcauugucgccgggaggcccaugcacugccaggucccuggcauugaccacuuccugcuaagcaagguggccauccacgcaacccuggagucagccaccgcuuuggcuguuucacacaaugggguccuguauauugcugagacugaugagaaaaagaucaaccgcaucaggcaggucaccacuaguggagagaucucacucguugcuggggcccccaguggcugugacuguaaaaaugaugccaacugugauuguuuuucuggagacgaugguuaugccaaggaugcaaaguuaaauaccccaucuuccuuggcugugugugcugauggggagcucuacguggccgaccuugggaacauccgaauucgguuuauccggaagaacaagccuuuccucaacacccagaacauguaugagcugucuucaccaauugaccaggagcucuaucuguuugauaccaccggcaagcaccuguacacccaaagccugcccacaggagacuaccuguacaacuucaccuacacuggggacggcgacaucacacucaucacagacaacaauggcaacaugguaaauguccgccgagacucuacugggaugccccucuggcugguggucccagauggccagguguacugggugaccaugggcaccaacagugcacucaagagugugaccacacaaggacacgaguuggccaugaugacauaccauggcaauuccggccuucuggcaaccaaaagcaaugaaaacggauggacaacauuuuaugaguaaguacuaaaacaaggccauuugaugauuuuguuucauuaauucauuguaggauuggagguaaauugaucgaguauuuuauuuuaauucaggauuugggauaaaaacuauuacuuauaauacauucuacauguucauauuccacaugauuucuccuaggaaggaaauggucuaguggagaaggcauaagcuuuggagucagaggagcugggcaucaguucccacucuaccauggacuuaaucccuauuggccucaguuuccacaucuguagaauggauacaguggauaccugcccagcauaccacagggagaugguguagaugaaaaguacuuaccugaugaagugcuagcaucuucauaugaccacuguccacaaauguggcaaggggagaaggaacaggcacauguggaugaauuuuccacauaauugaagcucuugucuucaaauuccaaaaaaaaacccuuuucauuuuaaccauuuugcaugggacuuuucuuaugaaguguauugcauaccucccuucucaaacacacuacacagacauaaugaaaccuuucuuuuucugauucagggucauuaauaaggaacaacaauugcauauuacgcuguaauaugaagagagcuuucaggaaguagggaaaugaggauauagagcccuuugccccugccugaagugauuuuaaaccauuacuuuauuaggcccuguaucuaaaggguagguuucucugccuccucccucaggguugugcuguggugucacuauuuauuucaguccuagugcccaccucaaguagcucauuucuuuauucuucauccaguggaggacuucuuaagaggugugaucagagaaccagaaguucagcuuauuauaauccuagcaacaauuaaauauauauaucugggguguuccucuaagagauauuuaaugaauggacuaacaucgcucuuucuacuuagauuuuuuuaagcugcuuuuugaggucuuagccaugguucacacgacugagauugcugaauaugucaccauuagauaagcaugugagagguggggaaggaacuagccuuguugaguauuagcugugggcuaggagcuacaccacugcauuuaaucugcacaacagcucugaggaugggugauauuauccauuuuacagacauagaaacugaggcucugaaggcuccuuugcccacuguuugauagugagacauggcagaacagggaucgcaguccaagucugaugccagagcuugggcuuucucagugcugcccugcugcccucccugcauccuacccccgcaccagugccacacugaguuuguuaauuccaaaugaaccugacucuuuaaaguuuuucucaagcuugaucaagcaucaguuucuaacaguccuaggagaauccaaaggaaaaggaucuguaguugauuuuuaaauauaauuugaacagacaugucacagcgauuuguacaaaguucacuggcuaaauuccuuucuccaaacaaggaccuuguuaauuacaaagaaaagacaaagauccaggaaaacagcaauuaucuugauuaacucauuggaauggaaauacgcuaaauaauuccauuuugcccauugcccgauggaaaucucuuauacauuauuuagccaauacagggguuucuuugucagagcaagucugugcacucaauuaguucccaaagucacucccucagaucccaaaccgaaugcucacacaucacugcauccauuacgcuccaccaccccugaaaucuaaaacgguuuccuacacuucuaccaggaaagaucccucccuuucuuuccuugaugaaauauacagcuauaguugauguuuagugaagaaggaaaaguuuuuacaauugcuuuuuuauaaaauggcgucuggaauuccaaagacugcacuucauagcgguacccaagagugguuauccuuguuaacacaaaccagaagugguagauaaaaguccuaaaauagaaagggaaacuaguuuguuuuuguuuuuguuuuuguuuucugagauccuacuaugugccaggcucuuucccauuuaaucuucacagcaaccucagauggcaggaauuaucauccacauuuuuuacauaugaaguacagagagauuagauaacaagccugaaaccacacagugaguauguagcagaaccagaacacaagucccuguucuuucaacugcacuggcuagggucaccuacauucuuugugacuuaucuguacgauagggaugacaauaguuauguauuucauaggaauaguaugagguucaaaauuucagugagauaaaauauggaaagcucagugucugauugauuauaaguacucaaaugauagcugcugcaguuguuguuguuguuguuguuguuguuaaugcaagcaauauuaguggcaguaccaguaauugcagaaguguuguuugggugugaaagguauuucccaggagcaacugcaaguaaacuaaucaaaagaguagacaaaaguuuuaauugagguagguaggaaucagaggucaggugagaagagcagaaucaaauaugagagaucaagaaaugaacuaagaaagaagucagaucccugagaauauccaaagucggcuggaaaauaacacgcagagccacccaaggcaaaaugguccagcucaggcugagaaugaagcaagggugccagacaccuauuuucacuggcugcgagccaugugacucagggacaggcuagcuggccuccagacccaagucucaaccagacagaaauaauccccugcccuaccccauuucugggcuauuaugaggacuaaaaaacuaaauaaauacugaaaguaaaaaaacuuugcaaacuaugaggcugucuagaauuagagguguacagauauuucauuaugguguuucuuaacaaggauuuggacagauuuugccaaugaaccauuaaucuagugaauuuucuaccuuuagcuucaugaggcaguuuaguagauuauaaccgaaauguucuauuuuucuaaaaaaaaaaauugcccaggcuugccugugacauaggcuauuauugaaacaagcuguuuguuuauuuguuuguuuguuugguugguugguugguugguuugguucgguuugguuuuugaaauggagucucgcucuguugcccaggcuggagugcaauggugcgaucucggcucacugcaaccuccacaguucuccugccucagccuccugaauagcugggauuacaggcaucugccacgacgcccggcuaauuuuuguauuuuuaguaaagaugggguuucacuauauuggccaggcuggucucaaacuccugaccucaagugauccgcccaccuaggccucccaaagugcugggauuacaggcaugagccaccgcacccggccugaaacaaguuuuaagucagcuuugccaauucucuuaaaagauuaaauaguacaccuaacauaaacaucacacacuucagagcaccuugauuuacagaguucacaguuuuggagaaucaagguuacuuuccuccccucagcccacaggucugcugguaggaagcucaaaggagucugaaaugcaguccccaccucccauguguggcaucguuacucucagacuuagcuccuggucagauggcauuugguggcugagaaaauggccucauaaguaugaggcagguuccagaauugacuugcuggauggauaugagcaacccccuucccugaauuucauaggggaaggggcucuggccucccacagugcccugugacaacuccuauuauaauuaugcucaccuuaacuacugugagacccuuacaaauuugucuuugcgucaagcuuaggguuugccaacuagucggcugacagauagucaauauuuuauaaugacacguaaauucagaauggaagggaaauagagacaggaagaaaagauaugcuguagugagaagaaugcuagauucacgucugagcaccagcacugccagugcucccaacgggacauagaacucaacugaaaugggucaaaugaagagauuuggccucugguuuuuacuuggggauaggaaagcuggaaagugcaucaugcccaaccuuaucaugaaaauaagccagacaaaagguaaauucgugcguuuccuugaacuccuucucugaggucaaauccaaggagagacagagucuugcagaaagagacaagaugugggcccugcaccacaucuugcugcuugugggcagaugcaccagcuccggggagaaagaguucagcugggauggcuggugaauuuacaaaggcuaaguguguacuggcaagagagucugaagcccuuggaggcuguagcaauugggcagguccaugucuucuuagggacuuuuuucucuacaaaucccaccaggaguuuucccacagaaaagagugaggaaagauuuaagaagaaaguguccuuuguggucgaccugggggaaggucacagcagcugcugagggaggagcauacaccccugaccacucuacccagacccugcucaccucaucuuccaucaggaacaacacccuucaucugugaagagaagggcagcgaacacuguccugccuaggcacuggggaaaauccuuucagcugaaugagggaagaaaagaaauggaaaaaaaaaaaucccacauaccugagagucagaacccuagcaaaggcuuugccaccaccauaguuagcuggaaggcuaaaagcaucagugaagggcagaagacugcugggagggaguuagagaacggcaggaacauggaaagagacccucucugagucagcacaaagggaggacccaagggcugaacuguggaccuugagggaaaaaaacccucuggcaaaccaguuucacauccuaaacacagggaauugcuaagggaauuuaaaaccuaugauaccuagaggcuaaccauaaacagacuucaaauccuagguuaacccaaacccccucacaaaaguccuagcacaaggaaacucacacccauuuccaggcauaaaccuaucacucacucaggcucuaccaugcuacacaagaugucacgcuuucaacugaacguacaaaagggcaagaaaaggcaacacauucccgagaggcaaagaaaucaucagaaucacguucagguaugacacagguguugaaacuaucugucagagaauuuaaaauaacuauaauuauuuuaaaggcucuaauggaaaaggcgaacaaugugcaagaucagauggauaauuuuagcagagagacagaaacgauaagaaagaaucaaauggaauuguuagaaaugaaaaccacgguuauaaggaugagaaaugccuuugaugggcugcucucucuggaggacacagcaugacacagcugaggaaagaagaugguuaauagaaauuacccaaacuaaaauacagagaggaaaaaaaagaguggaaaaugcagaacauggcauucaagaucugugggacaacauccaauagucugauauacauguaauuggaauuccaggagaagagggaaaaaauagggcagaagaaauauuugaggaaauaauggcagagaauuacccauaauuaauaauggacaccaaaccacagauccaaaaagcucagaaaacaccaagcagaauaaguacauacacacacacacacacacauuucuagccauauauucaaauggcugaauuaaaaaggagagacagaaaaccuuaaaagcagccaggaaaaaaaaaaaaagcauuuuauaagaggaacaaagguaagaauuacagcagacuucucaucagaaacugugcaagccagaagacagaagugcugaaagaaaaaaaaaaagaaaaacuguccacagccaggugcaguggcucacaccuguaaucccagcacuuugggaggccgaggcagguggaucaccugaggucaggaguucgagaccagccuggccaacauggugaaaccccaccucuacuaaaaauacaaaauuagcugggcaugguggugcgcaccuguagucccagcuacucgggaggcugaggcaggagaaucacuuaaauccaggaggcggagguugcaaugagcugagaugugccauugcacuccagccugggcagcaagagugaaacucugucucacaaaaacaaacaaaaaaaauuguccacucagauauuauacucaauaaaaauaucuuucaaaugaagacauguuauagagguauagggagggguaagggaaccuagaaaggaugcuaauagccugggcaacauagaaauacccaucucuaccaaaaaaaaauuuaauuagcuggauguaguggcacacaccugcaguccuagcuacucaggagguugaggcaggaagagcacuuuucagcccaggaguucaagggugcagugaucgauaaucacaccacugcacuccagccugggcaacagagugagauccugucccuaagcaaauuaauuaauuaauuaaaaauaaaaauaaaggacgcugaggcacccaggcacuaaaaacagugaauagccauuaccaacccccaggcugcagagcaaggugggaaaguugaaggauaucaugacugaaguccagugggagcuguaaugaugaaggagaagcccccuaguugaagcugaaaucauggauccacgcagccacuguuagagauucggcacuggaggaaagaaggagugaggagugaggaaaaccuucugaauuccagucucuugcccgugccuaccacggacuuagcuuaaccagaagugagccagccagagugccccagugacacagucugcaggggucagcugcucugggcagagagaggacagagaauggaucugggagguagggggaacagagaauaaccagcacagagacugacuggcugugugacauguuagccaugagucgccaagccaggguucagccccagaucugccugaacccuaagcaguucccaccagaggcaccaccucaaauacaguauggcagagugggccagaucuugggaauccugagggcuagaauucauuuuggguacuuaauuuuguaggaaauggacagcaaguacaagguuuuaaugcagaagccacaaagugcucuggcucugauccaguuuuggaguagcuaaugaugucgugaugacaucuauuacagugacaugggccaggggaacuauuggugugccugggccaggaaccauaauuauccacagacaauacagugcccaguucccugacauggugaugguguuguuugaaacaaucagaaaugaaagucauacaaaucaaaucuuauuuuuuaaccgaaaaguuaagaucagcaaaaguuuaguaucagagggcaauucggcguuuuccuugccagccaugcauaguaaguggcucgagaugaaguauugagugugaaaaagaaagccuugcagugugugugaagauguccuuugacaauccucuucugagagccaaguucacagcaacuauaugaaucauuuuuuuugagauggagucucacucugucgcccaggcuggagugcgauggugcgaucucggcucacggcaaccucugucucccggguucaaucaaaucuccugccucagccucccgaguagcugggauuacaggcacccagccaccgugcguagcuaauuuuuauauuucuaguagagacacaguuucaccauguuggccaggcuggucucgaacuccugaccucaagugauccaccccccuuggccucccaaagugcugggauuacaggcgugagucacugcgccuggccuauaugaauguuuuauguguuuucuuucacugugcuccaaagaugcuuuggauaaauggaaugaagaaaaaucagugggaggaaauaaugaaaagccagucaucuggucaucccuaucauacccccaacugggggcuuggcaucgcugcaaagucaauugcagugguagcaagcaaagcguccugaaaauaaaacaacugccagucuucuugacccaccugagacuugggaaaacaguguuuucuauauacugcagugaugaacccaaagauuuuuauuugaaacagcaucauuuuuaugggaagcuugaugaauaaaacacauuauuuaagauuagacagaccugacuuugaauuuauauuccucuacgagcugugugaucuuaggcaaguugcuuauccucucugagccuccucuucaccauuugugaaaugaugauaauaauaaugccuacaucagaagaugaugaugagcaugaugcuugguaccuaaaagguaccacaugaauauuagugaccuuucuccaccucauuuggacaaggaaaggcaaaacaaaugaauuucuucguugcucucagcccaugucuugaaucaacaauaauaucuauuauuuacuuauauauuuauucauuaaguaaacauguacugaguacugucuaccugcuggguacuccucugggcacuaagaauacagacaaggucucuguccucauggagcuuauauuaggaggagacagaaaacaaagaacaaauaaauaauaaguauagugaggucaauaagaaaauaugauacaaagguuggggggacuuaucugucuuagaagcgguggucagggaagaccucacugaagugauaacauuugaucugaaacaugauugaugacaggaacaagccaugccaacacuggagggaagagcauucccgcagagggaacgggaagcaugagcaccccagcaugcacugacuuuggcauguuuggggaccagaagcagauacagggagaagaaggacgugcugagagugacguuccaggugaagucagaaagaaaggcaggaaggagccaacauucagccaacauucauugacacgaggaagcacaugcuauaugccacacacucuaagcuacagggauacagcaggguccaaaugaagucccugcccucagggaguugacauuccacugagggcaaucuccugggguccugggggcccugggaagaaguuucccuuucauuuuaaguagguuaccucuuuuggucuucaugugucucuaugaaacaggauuauuauccccauuuauagaagagaaaacagaggcucaccgagguuauaugauauagccugccugaaauuguaucauuugugguggagacuugauaguuaggaggaacacagagccaagugcccguccucuagaucacauuacuggcaaguguagagccaggaugcaaagccuagacuaucuggcuccagagaccuuuuuaaaaaacuauucauuucauuccucuugguuagaaagaaagaaaauuugccaguacuuuguggguucccauaaugaaaacugucacaaauguaacuaagccauuguccagaugccaccuaaucauggggccgggacuugaggcagccacuuggagcccagggaguucagagaacugccccuuccaggucccugcucuuuguuguggcagcucugugguggagaagaaaggguucuguagagguggcucacagggcaaaggugugcggggcccagaggacuggcaacccuacuucuucccauccacagucagaaggagcaguucuggugggauaauuacagguaucaaucaagcagcaaagagauccaggucauuucccaagcucuggaagguacuacaaugaaugaauaggagacaagaaaauuuuauaaauugguugcucuauaugauguucauuucauuaagacauucaguccuucuaauggaaaaugugaagaguggaaauuacuguuuuuuugacccucucauauaaaaugaaaaccagaucuugaagguauggggccuuuucauuguaucuucuuuaggaucaauguaauuaugccuuacaagcuaccuucaauaauaauugcaauugucugccuuuauacaaagccucuuucugucuucaagacuaaaacucuagugagauaccuagggagauugccaaaguguuauuuaguaagaguuguuuuuuccauauuuuggcauucagcaaguguuuaucauguaccuacuguguguccagcuugugccaaguccuguaggagggaaugugugaaugaaucauggugucuccucucccacaaagcaggaaagaggacuugcacauccaauccugcauucauuuauuuguucagccaacauucccugccgguccucucuaugccaguuccaaugcuggugaagcagagaugaacugagagccaguccuccagggucacgcugcuggcagguggcagaacccagguggugucaauccacagacuccacagaccuguucugaccucaagcacucacaguccaaagagggggacgacuuguacaucaacacugcagugcaggggaggcauucuaggacagagcugugcacaggauaucacugggagaagggacaggaaaaaccagggagggcuuuaggagguggcauuugagcaaggccaugguaggaguggugucaaagugacaucugacuccuaauuaacaaucuaucaauucuuaucuguaaaacuccacaaauggcuuugcagugucuugcaugguauaauaaaaucuuuuucaugugguuaggucaggaaaauagacaguccaagugaauagucuuauuuuaauaaagaguauguacagggauuacagguguucaaagagucagccuagaacagcauccccaucccauuaaacugcuggacugaaauggaucuuccuguugauuuaaaagaugacucaggaucugaccggacccagcuuaaucaugaaucacagauacaguuaagaugaccagggcaaaaccaguuuugggggucuugauuuuuagcucaaaaacuuggaguacccuaguaauauuuugcugaaaaugccuggaaauuguuaucuucaacuugcccuauaagugagacuccuaugcacagccuggaauuuaaggcaucugccuccccagauggccaugcucaugagcucucacgugugguuuuaccuugcuugucacaacacuuuucugauuaugaaaauaauccauguuuauuauuuuuaaagcauggaaauauacauaaauaagcaauucaaaucaccuguaauucuaccucccagagauaaccacugucaauauuuuuguauguuuccuuccuauucaaauuuccaguggccacaaaugguuaaaaagaaucccagccucucucagaguugaagggagcagagcucugagagggucuccaugugagagaagucucuggacaugcaucucagaucuuuacuccaagacacccuccuuccuagccgccgucucucagaacuacugcucacuuagcucugcgaggcaguccaccccuuugaccacccauuccagguuucagccuccccuaggccagacugaccuuuuccuggcagaaccugacuccguacuaagaaagagaaaggagaaaucauggcaggacauggguuuuugaagcccccaaccacccacaggagagccucugauagagccacagccuugccugcagcccugcccagggaguguauucgaggccacagcacugccugccauccugaaaaggccccagccgcagaggcauccaacuuccccaaaggccaccggccccucccccagaauugaucuuaggacaaaaacaggggugauauauucagaagaccucuaccaaugccuccucuguggcagagugugccagggacuguuagauucaguguagagugcugugaucugugccaggcucaggcacggaaacaguuggcaaauggcagagucuguagugcagcacccaagucugaccuugggcagagaauuccugagcaaagaccugccuaaucucacccaccaagucuccccugauaccauaggagcugcagacccaggaaucccagcaagaagccaggcccagcugaaggaagagccuggacagagcugaacucucugaccuuucauugccccauugugaaaacccucacaggaacccaggggccagcuuuaccccagagguaaaaacaaaacaguuuaaaaaaaaaaagccaguagggagaccugaaguacacaggggcaaccguguccagcaagucagucaggaauauugccauguagaggaagaacuguguccccauucacacacaagugcaaaaaggcuauuuaagccugccuuuuuacacuucauccuccccuaauuaaaaacaauaauuaaaauguuaauagcccacuccugccagggaggagcgcauguguugaauacuugcaaauggacgguacagaaauguucauugaagacagagaggcagguggcaguuuggaagcaaauagaucugaguuugaauuuugauucuacccacacuuaauuagcugugugaccuugagcaggugacuucacucuuccaagccucaauuucugauucuccaaaaaagagauaauacauaccuuuuagacaaggauuaaaugaggauuacaugaaaaauguauuaaaugaggauuacaugaaaaugcaugaaaagcaacuagcaccaugccucguauauuggagguguucaaugaugguagguauuucuuuuauuauuaucaggagaauaguaaagagaauuaagauucaauuaugaugcuuuagaaagaccauaccugagcaaagcuguggggguucuaagaguugcaguuacaaaaaugcuuagugccagauguaaaaucuagauggaagggguugcaagaggcaagacaccauuuaucuagcuaaguccugguuugaauucagaauccccuuuucccaggauguguagaaaccuaggaaaccccuggguaauagcucccauuucuaguguuuuucaggaaaaaccuguauaaccaguucuugcggguuuugcagaggguauucaggcaucaagcuugacuacaucauuucuggggagucucccaguucuaagauucugggucagcugucucauuauggccaccaucaucucucccccucacaauugaauucuaguuuauagcuguacuccugggcaguaggcaggucaguguuaucauccccacuggguuagggaagggagacucagagaggucaguuauuuuccugcagcuggauaucagcagguggagucacauccugaaaucuauguaccagguccugugcaagauaugugggagacaugggaauguauccagccagaaagaaaagcagagcacagcaaaaccauggcaugagguagaaugcaccaaguuccagcuagagcaccauuauauuucuacuacucagugccaccccuugguuuccagguacgacagcuuuggccgccugacaaaugugaccuucccuacuggccaggugagcaguuuccgaagugauacagacaguucagugcauguccagguagagaccuccagcaaggaugaugucaccauaaccaccaaccugucugccucaggcgccuucuacacacugcugcaagguaagucaggugggggccaggggacuuugaggcagaggggugggaagaccccuuuggaggaggauggcacaagaaauaggcugcugcuggagcugcccaagaacaggaaagcauugcaacucucuguauuaucaccuaauuugcaaaauauaccagccugagucaaguaaauucccucucagaagcuuaagaauaauauuuuauuguccuauccuguuaucagaacaaaggguagggaauucauuagcugcuaauccaggugaccucgcuauucugccauccuaaugacucccagauuaacagacacacucacacugguguaggugaggacaaaggacaaaaauaauuacgcauaauuaugaaagggauuugauuauggagaaguccuuccugaagcccaggugagaagguuugugccucuucuaggauuucauagaaaagagacccuucuuugcauuugucaaaucauccuguuacggguuggucuuuuagcuucaaguaaaaagauuucacaaugaugaaaucuugcuguuaauuaucugccucaauuguucucaugggauguggugacccaggugggcuugcagcuuugugggauuuaguaaacuugaaaagaaagaagccaucaccagggaaagcucugccugauucuuuccugcccgcuggauggcucuuuguaccuccaaaggcuuucacacgaagcagugaaaggagccucaggguaagagucagaagcccaaguucuaguucugacucugccaccacaucacccaccgugacccuugguuucuucuccaggaaaagaaagcaagcugaagcuguguggaaugggguggagcagugagaagagcagggguucugggugggcgauuuggggcccugugcccaucaugccaguucccaccugugugaacuggcuggggucacucuucuucucugagccuuggucucugggucugggaaagggggcugaauuuuaacaccugccccacagggcugcucagucgaucucuuuagacaguguagugacuagcaugagccaagcacauacuauugcucaauaagcaauacuauuggauuccuuaaguaauuaauuaauuagcaagcaguuuaacuuaccaugagaaaauaaaugucuguauauucuuacaaccacuuuuacucccaaauuuaguccuuugccuuucaaagagcuccaagaacaauaaagguucucaaagaaagagaaaccacacgcuggaauuccuucuucaccaagcaccuuuaaccgugguuuuugaggaaaacucaguguuucgucuguucucacacaauagucaucaacagaagacuucugugaccaaauauaggcagaggugggguucuccccaccaugaagcaagcaaucaacucugcaguggacaccagcuggguguccuucaacucaauuccaacacuaucuaccuggagauggccucaaaucccaccgguugagggcucaguccccaaaacugcccccccaaccccaccccaucuaucauacuucagacaccagucacaagucugggccucuggaacuucuaucugacuggcuucuaguugagauuuucaugacugcuucuuuggguucaguuaauuuacuggaacagcucacaggacuagagaaauacuuacauuuaccaguugaucauaaaggacauuaccaaggguauagacgaagagauguauaugacaagauauaggguaaggggcguggggcuuucacacccuccccaggcacaucaccuucaccccuccauggaccuccguauguucagcuccccaaacucugucuucuugggccuuuuaggaagccuucauuggauaggcaugauugacaaccauguagaaaugugaucggacccagcaaggccugucucuucagauucuucuuggccucucugugcagcacucauuccuuccuccaggguauggagcaggauccccucugaaaguacgucuuaugacccacagucagauuagaguccugccuuggagaggagggcaggagaaggucagagagagaggcagagagauuguuuccuaaggccugcuucugaguccugaagugccucaacauuagaaccaaagacuaugagaagggguauaggaguuaugagcugggaacuguggauauauaaucauaauaucacaaguggguugggacagaccccagggauuuaugcucugacuggauuauugccaagagaagguacaauuucugaggcagccaagaucuugccugaccaaggacugcaggaccaccaauuacucagacaucuuguccuucaggccugucuuguucccugugauuaagaauuauccauccauuccauacugcuaaacuggcugugaguauuuuucucaaagguucaugugggcuuucuuauauuugggcaacuuuuuaaaauuugaaagugccacauuccucaguuuuuaaauguauucaucaauuuaauaacuuuuuaggcagagggaaaaaagucauacugcucaaaaggcauacguggacacauuccaauuucaaaaaaacauuaaaauaugaaaagaaaaaucacuucuuggaauccaggaaacaugguaccuguuuuuccucuuugguagcucugccaagcucuuuccuucuugaguaccaggcucagaugcucaguuuugcagcugccucacuagagucucugugaaaagcucuuucgguuucaucuucuguuuaaacuguggaaaguaauaagaaguagcugcuaaugagcagcggccuugggaagucacagcccacauuaaaugggaucaucugagaugggccucuacagaugcuguucccuccaagucaccauuaauggacauauguggauucagcaaggagcagcuuuaaaggauaaauugacacaggcuuuuucacuguucaaaggcagaaaaauauagauugucagugaauaaugcauagcaaguuugaggcagauuuuagaauuuuugcaugugugagagagaaagauggagagaggagggaguggggggggccuguuugaagccauucuagcagaaaauauucagugaggguuucccaugaaaacuauugcuuaauaacuaucuuuaguucuugacauagccuggaacauaacuaguuucauccagcaaaaauuuacugagcacauauaauccuaacgaugaugauagcuaacauuuuuggagcacuuauuaacugcaaagcauauuuucagcauuuuacauuaagcaguaccucauaagguaccucauauaguaccgcauaugccuaggagguaaguauuauugucucuguuuucugcaugaaggcagugagaagcacucggagguuagguagcuugccccagucacacaccuaauuggguguuuggacccaggcaaacaggcucuauagaaccuauucucuuaacugccaaucuaaagacaaggggcccuauuccaggaccauggucagcacuagagaaguucaccaugaugugugugugugugucuguguguauguguguuugugagagagagagaaaugggaugguggagauagaggagagacaagagacacacaugacagugacuagcacagugccaggcacauaaaaccagugacagcuaacauuuacauaacacuauaugccaaguacaguucucagcucuucauauucaugaucucacucaauccucagagcauccugcaaagcaggguacaauuauuguccuaguguacugaugaaguaccagaggcauggaagguuaagaauuuggccaaggucuuacagcaaggcagccacagagcuggaaccugagcugaaguagccuggcugcaaagccaagcuccuaaucucugugccauagugccucucacagcacgcacucaaauauuggagaauuuguucauuaacggagcagugacucccacaccccucagcugcaagaccacugaggaggcccauagaaaggcugagggguguacaggacagggagucauacauucuggccaguggaacaggggaagcuucuggaaagagaugacauuuuagcagagccuggagggagucuuaagccagcacuuacugaagacgggggcagugcagaggaaacagccaaggaagggccagagacaggagagugcagcacaaauccagagauaguauuuucaucuauagaaagaaacucuauguguauuuuacagcugaaauuugcuuuuuucaccguaaguuucauuuaguuaagaaucuagggaggagccaagauggccgaauaggaacagcuccggucuacagcucccagcgugagcgacgcagaagaugggugauuucugcauuuccaucugagguaccggguucaucucacuagggagugccagacagugggcgcaggccagugugugcgcgcaccgugcgcgagccgaagcagggcgaggcauugccucaccugggaagcgcaaggggucagggaguucccuuuccgagucaaagaaaggggugacggacgcaccuggaaaaucgggucacucccacccgaauauugcgcuuuucagaccggcuuaagaaacggcgcaccacgagacuauaucccacaccuggcucagaggguccuacgcccacggaaucucgcugauugcuagcacagcagucugagaucaaacugcaaggcggcaacgaggcugggggaggggcgcccgccauagcccaggcucgcuuagguaaacaaagcagccgcgaagcucgaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcacgcagcuggagaucugagaacgggcagacugccuccucaagugggucccugaccccugacccccgagcagccuaacugggaggcaccccccagcaggggcacacugacaccucacacggcaggguauuccaacagaccugcagcugaggguccugucuguuagaaggaaaacuaacaaccagaaaggacgucuacaccgaaaacccaucuguacaucaccaucaucaaagaccaaaaguagauaaaaccacaaagauggggaaaaaacagaacagaaaaacuggaaacucuaaaacgcagagcgccucuccuccuccaaaggaacgcaguuccucaccagcaacagaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcgagaagggaaguuuagagaaaaaagaauaaaaagaaaugagcaaagccuccaagaaauaugggacuaugugaaaagaccaaaucuacgucugauugguguaccugaaagugauguggagaauggaaccaaguuggaaaacacucugcaggauauuauccaggagaacuuccccaaucuagcaaggcaggccaacguucagauucaggaaauacagagaacgccacaaagauacuccucgagaagagcaacuccaagacacauaauugucagauucaccaaaguugaaaugaaggaaaaaauguuaagggcagccagagagaaaggucggguuacccucaaaggaaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuauagacaagcaaaugcugagagauuuugucaccaccaggccugcccuaaaagagcuccugaaggaagcgguaaacauggaaaggaacaaccgguaccagccgcugcaaaaucaugccaaaauguaaagaccaucgagacuaggaagaaacugcaucaacuaacgagcaaaaucgccagcuaacaucauaaugacaggaucaaauucacacauaacaauauuaacuuuaaauauaaauggacuaaauucugcaauuaaaagacacagacuggcaaguuggauaaagagucaagacccaucagugugcuguauucaggaaauccaucucacgugcagagacacacauaggcucaaaauaaaaggauggaggaagaucuaccaagccaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauuuaugcacccaauacaggagcacccagauucauaaagcaaguccucagugaccuacaaagagacuuagacucccacacauuaauaaugggagacuuuaacaccccacugucaacauuagacagaucaacgagacagaaagucaacaaggauacccaggaauugaacucagcucugcaccaagcagaccuaauagacaucuacagaacucuccaccccaaaucaacagaauauacauuuuuuucagcaccacaccacaccuauuccaaaauugaccacauaguuggaaguaaagcucuccucagcaaauguaaaagaacagaaauuauaacaaacuaucucucagaccacagugcaaucaaacuagaacucaggauuaagaaucucacucaaagccgcucaacuacauggaaacugaacaaccugcuccugaaugacuacuggguacauaacgaaaugaaggcagaaauaaagauguucuuugaaaccaacgagaacaaagacaccacauaccagaaucucugggacgcauucaaagcaguguguagagggaaauuuauagcacuaaaugccuacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuucgaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagauguagaaaaggccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugggugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuaaaccuaaaaccauaaaaacccuagaagaaaaccuaggcauuaccauucaggacauaggcgugggcaaggacuucauguccaaaacaccaaaagcaauggcaacaaaagacaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacagcaggugcuggagaggaugcggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugaguauaaaucaugcugcuauaaagacacaugcacacguauguuuauugcagcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaagaaucuaaguuagaauguuuuaaaucaaauuuaaaauuucaaaucauauguauauuuaaaucauugucauaugccugugacaaugauuuaaaauauguuuauauuuauguauuuuuuuuugucauucugucagugguuuaagugucaaaguuauuuuucaccuuguuauaaaaaacauuguuaccuuagaguguaucaagagccuuaaaaauguucaaccugccagguaugguggcucacacuuguaaucccauugcuuuuggaggcuaagguggaaggauugcuugagcccaggaguucaagaccugccuggucaaauauugaaaccuggucucuacaaaauauuucaaaaauuagccggguguggugaugcaugccuauaguccuagcuacuugggaggcugagguuggaggauugcuugggccgaggaguaugagguuacagugagcuaugaucacauuguacuacugcacuacagccugggcaacagaacaagacccugucuccaaaaaaaaaaaaaaaaaguucaacccuuuucucuaguaauccuacuuuuaggaaucuauuuugauuugaaaaucuaaaaugaagauauuggauauugauuuaucuaaaaaguauuuuugagguauaauucacauagcauaagauuuacucuuuaaaaacauacaauuguguggcuuuuaguauauuuauaaagcugugcaaucaucacuaugauccgauucuggaacauguuuaucaccgcaaagagaaaucccauacccauucgcagcugcuccacguucccuccugccccucagccuuuggcaaccaccgucucuagagauucuugccuauucuggacauuucauauaaguggagucagacaauauguagccuuuuacaugugacuucuuuuucacuuagaauaauguuuaaacuaaauauauacagugguacuuauaauucugaaaaacuggaaucaaacugaguaucuauuugaggcuugguuaaauaacuuaaaguauuuucauacaguggaauauuguauggucauuaagaaaaauguuuaugaaaaauauucaguaacaugauauaauacaaugaucagugaaaaacuguauaacuguuuuaaaacucuuaccuauuuuaaacuguaauguaagggcauuuggaaauauccuaaaaucuacaaacauacaaaauauuuacaaugguuuucuuuggauauggagaaucuggauggucuucuccauguauuuuccucgcuuucuucagugaugauguauugcuuucauaguuaggaaaagcauccuuuaaaguccccuccaccgccucugcuguccucacaccucccuccaccuucguuccuucugagcagucugugcuuguccucuccugcagaccaaguccggaacagcuacuacaucggggccgauggcuccuugcggcugcugcuggccaacggcauggagguggcgcugcagacugagccccacuugcuggcuggcaccgucaaccccaccgugggcaagaggaaugucacgcugcccaucgacaacggccucaaccugguggaguggcgccagcgcaaagagcaggcucggggccaggucacugucuuugggcgccggcugcgggugagcgaggccucuggagguggcugcguccuggggggaaagaauggggaacgggagaacggggcucuguucuugaaauucccugggaccucaguucacucaucugcaaaaggggagaacuaaaucagggaaccaugugugaucagagacccuugugugucuuuuuaguuuuuacuuguggaaagacuacuggcuuugguguuagacaggucugaguugaauuuccagcuuauauuauucccugagugagcuuggacagaucaguaaucuuagagccucaauuucaucaucuauaaaaugggaaggacaaggccaauuuuacaaguugcuacaaggauuagaaguaauauauuaagcaucuuagagucuggcucauagcaaguggucaauaauagcuacucuuauuguuauuguuaugauuuauuaccauuauugcuauuacuauugcuagcaugucccaaaauucagcucagcuacuuagaaccuaagcuacauucuccaaaaugaccucacccgagccaucacugcuggggcuggcaucauggucugacauucagagugcuuuugaauauguggaugcccugagccagcuccuugucugccucacauccuguguuucuguagaguacagccucugccagggccugagugcccagcuucuuuuuccuccaccuugagaaaggcaggugaugaacagagggaaaguuaaugaacuagccauggcuuucagcacagcaccuugcacaccaugggugcucaggagauaccugcugagaugaaacaaacuacagaacugagcuacauguuccuaacauuccagaagcauccucauagcaacacagcucagacucucuuaaguccccugcccuucagcaaagaaaguucacugaagccccucuuuuacacaugagacaaucgagauccagagaggguaaacgauuuuuccagagucucauagcgagguggugguaaagacuagaaaauaggccaggcacagcagcucauaccuguaaucccagcacuuugggaggcugaggcagguggauugcuugaggucaggaguucgagaccagccuggccaacacggugaaacuucaucucuacuaaaaauacaaaaaauuagcuggguaugaugggggacaccaguaauccuagcuacucaggaggcugaggcaggauaauugcuugaaccugggaggcagagguugcaaugagccgagaucgcgccgcugcacuccagccugggcgacagaguaagacucugucucaaaaaaaaaaaacuagaaaauaggcccacagcagcuacagaaacaguaagugacuuauccaauaucacacaacuggaacccagaaaaccaggcuucguuuguucccucaacagccaagagcucuagugacuaucuacugugggaaacagccuugcacuagcuccccgaggaaggccuagcugucuuuguucucuguggccucacugagcucccccgucugaauucgcagacuccugcaugcgccucugaggcaguguccucaaugggaaguuugaccuggguuugauuccugccugugccauguggagccuugagcagcuccucugagccucaggugccucugcagaaacaagaugauacaaucaacgcaccuagcccagcacagguagacuccaggugcucaauaaauggcagcgauuagcaugauuaggauuuccucucugcugugugaacuggaccaaaaguuucccaggcuuuaauuggucccucucccaaccugagauugggacggguggccacgucuacauguccucccaaauaaauggccacccacagugguggcagguggaauuagaauguuagccgggugugccuccccauaauggaguucauuuuuuauacaacugggaacuuuuuuaauaaagaggugaaauaaucucauugccgccacugccgagcacaggacgcauuaggcggcuccccagugagcuguuuaauuuuauuaauuuugccaaaaagguacagcuccccuucacuagagauccuccagggagaaagggggacagcuggcuggguggcaccacccugaggggagucacagcgggaccuuccaaaagauacuuuaaaaaggccucugucauuguugguggcacagccccuguaucuuccugugcccugucugcaaauaacacagcuucagccuccaaugccucugauuuuucaugggaaucaucugccacacuguuuuugcaucugcaauuguguuugauuaccccagagaagguaaccuuauuauaaccaggucauucacagcuaaagucagcaucgucauuauaaaucguuauuuucaaggccuuagaauuugugugggagaaggaggaaacacacacaucucuccuuccugggauaugaccacgaucguuugcugucauuuaauggaaauaauuccaaccaucuauucaguaccuucuaugugccuagcacuccacugauuuacuaaguuucuucaaccuucacaacaacucuuguuauacagaguaagaaacugagacucggauaggggaaggcacuugcccaagguugauagaaaaguuggucacaaaguugcagcuagaauccuggccuucauuccuagaccugcacccauuuuuuuuuaaccacacagggauccagagggccuuucauugccucgguccacacaugccauuuugcaucacgugaccuaauuaucugcuuuccucuugggucuucuguauuacuugucaaccuuaagcaaugacuaguggaagagacagaaaaugugcccaaaugucccauaaggccagacaccaauuagcggaaaccaguauuuuaguuccagaauaccuggcaauauuucaggggccaccaaugccuacagggcagauccaaauacagaaacaggccccugaaguauauuucuuuauuaaaauauaaaaacccuaaccuaccacuacgucuguaggagcccugucuuucugacucugaaaggaaauugaacugugugcuggccuagcaguccagguggaguuuauacaaggcacucccgauccugaaggcaggagcaaagugccucaaagccaggacuguguccccauucggcccacaggcagaaaagccaucccagugacaaacacucacugccucccagcaccucugggaagaauaugucuuggguacugacuguggcaaucaagaagcccugauuguaguggcaagcaggagacacccgacaggggcugggaaguucagagcccccagaaggccacgaauugcucagagggccacugaguguuugggggcacguuguaugugugagagucaaguccagacuccgucacucaccagccacgagauccaggguaaaucccuucaccucccugagcuuuggucuccgcagugucugguguggaagagaugggucaguuuauuuucugggcucacuuggugggucuccuuucagcagggagucaagaaggaucugccuuuuaaaacguguccucauuagaagaaucacauuagaaaacaugcagauccucuuuggucacagcuacugauuucucaacauagggaucaucuucauccucacaacaacccugugcaauuggcauuauuguccccauuuuacaggugaggaaacuucacagagcugacaaaugacagagccaggauucaaacccaugucuguugcugcgcaggacugugcucccuccucuacucaagagcuucccagcagagcugagagcaacguggcccaucagaccaaaguucucaugguccagauuaauuuucucuuuccuuccaacccuuucuccagguucacaaccgaaaucuccuaucucuggacuuugaucgcguaacacgcacagagaagaucuaugaugaccaccgcaaguucacccuucggauucuguacgaccaggcggggcggcccagccucuggucacccagcagcaggcugaauggugucaacgugacauacuccccuggggguuacauugcuggcauccagaggggcaucaugucugaaagaauggaauacgaccaggcgggccgcaucacauccaggaucuucgcugaugggaagacauggagcuacacauacuuagagaaggcaggugucugucucccugcaucacuggccuugccauacagaaggccaaucauucacggccaagcccagccugguggccucagugggcuguaucugacccaugucaccaaaaggaaauguucaggaaagucugccacagagggcauggggucccaagaggcaucaggauggaucagggagauagcauggcagguggugguccuagggcaggagaacaugaaagaccugccugauagaguagaggcccaaauacucacuggauuugcagagcaggacucgggguucagacccaggccaagggucugcucccaggucuagggcaugugguacaauccaguuguggagaaccaggcagaagccuaggcaucaguacauaggcaggaggcacuuacuccugagcuucaagugcugggcauggccuuaguaaaucuauucugcucuagcaucagaacucaugucaucccagggguaagaaucagaaaugaccuaaaaucaaaaguuggucucaaauaggaaaaaaugguagcuuugcagcauaaagccucuaggccuuuuaucugcugaucuuuuccugagaacaagugcacugcaugccccauuucaaguauccagaucccugcuuuguuuccugacccuggugaccuguccagggcauaggcugugcuugcucugaggugggucuccucuacccacugggugaguacccccaaaagugacauuuugcgcuaguacuaagagagagagagaccuuggaggucauccaacauacugaaaacccaaacccagagaggggaagaacuuucccagggccacacaaggagacuauuguuagaaaccagguucucccauucccaucacagucugcccuaucccagaguaggcuuaugaccugucauugugcaaagccuuaaaugcccuucucaaauauggucuucgugcuguaagccacagggagucagcggaaacuguuuagcagguaaaagaaauugugagacuguguuuggaggagcucacucuugccugaauaggaagauugguuugagaagucuggggcaaggaagccagacugcuguacauacuucaggccaaagcuucuuggccguucucacaccccaccacgcacaaaaguaaccaggucuguccugcacaaaggggcaaacccacgaggcugcucaccauaggacagcaaauggccugaguaccuggaggccuaggccccagguagguuacaggugugcuaagguuaaagcugugcuaagaugaggcugagagaaagccucaucuuggcacaucuguaaccuauuugcaguaucccgugacacuccuguuggagagcucugguuggagcauaacucaagagaaccauggaaacucaggauucuccuuggacauucauuccgucccuuuaagucucggguauguagaccuacccuuucuccucaccacccuccucucaucucuugguuuuccucucccuccaguccauggugcugcuacuacacagccagaggcaguauaucuuugaguucgacaagaaugaccgccucucuucugugacgaugcccaacguggcgcggcagacacuagagaccauccgcucagugggcuacuacagaaacaucuaucagcccccugagggcaaugccucagucauacaggacuucacugaggaugggcaccuccuucacaccuucuaccugggcacuggccgcagggugauauacaaguauggcaaacugucaaagcuggcagagacgcucuaugacaccaccaaggucaguuucaccuaugacgagacggcaggcaugcugaagaccaucaaccuacagaaugagggcuucaccugcaccauccgcuaccgucagauugggccccugauugaccgacagaucuuccgcuucacugaggaaggcauggucaacgcccguuuugacuacaacuaugacaacagcuuccgggugaccagcaugcaggcugugaucaacgagaccccacugcccauugaucucuaucgcuaugaugaugugucaggcaagacagagcaguuugggaaguuuggugucauuuacuaugacauuaaccagaucaucaccacagcugucaugacccacaccaagcauuuugaugcauauggcaggaugaaggaagugcaguaugagaucuuccgcucgcucauguacuggaugaccguccaguaugauaacauggggcgaguagugaagaaggagcugaagguaggacccuacgccaauaccacucgcuacuccuaugaguaugaugcugacggccagcugcagacagucuccaucaaugacaagccacucuggcgcuacagcuacgaccucaaugggaaccugcacuuacugagcccugggaacagugcacggcucacaccacuacgguaugacauccgcgaccgcaucacucggcugggugacgugcaauacaagauggaugaggauggcuuccugaggcagcggggcggugauaucuuugaguacaacucagcuggccugcucaucaaggccuacaaccgggcuggcagcuggagugucagguaccgcuacgauggccuggggcggcgcguguccagcaagagcagccacagccaccaccugcaguucuucuaugcagaccugaccaaccccaccaaggucacccaccuguacaaccacuccagcucugagaucaccucccucuacuacgacuugcaaggacaccucuuugccauggagcugagcaguggugaugaguuuuacauagcuugugacaacaucgggaccccucuugcugucuuuaguggaacagguuugaugaucaagcaaauccuguacacagccuauggggagaucuacauggauaccaaccccaacuuucagaucaucauaggcuaccaugguggccucuaugauccacucaccaagcuuguccacaugggccggcgagauuaugaugugcuggccggacgcuggacuagcccagaccacgagcuguggaagcaccuuaguagcagcaacgucaugccuuuuaaucucuauauguucaaaaacaacaaccccaucagcaacucccaggacaucaagugcuucaugacagguaaggaccacggcucacucaggggcaggaccccauaaagugcucuuacuaccuaacaauacuuagucuucuuugagaaagcuggcauaaggugacaggaaacacugacuuucucuuagagcagcauuuuccaaaguccguuugaagaaacacuaguucagaaaauacucuggaaaaaugguuccagcaucaaauaaauuugucagggucaccaccauuauuacauuuucauaguacauuucaguguaugauaagcucugggaagugcuauaaaagugaacuauuuaauauauuugcccacuauuucucaaacuuauuugaccguaaaagcccuuuuuucaccaugaaauccuaauaucucaugggauacaucccauggauugcacuuuaggaguuucugacacacaaaucaaacugcuaaugaguccuugauuggguuaagguauggcuuuaaaaaaaaauuaguucucaauuugggauaauguaagaauggagugaaggauccaccaguuugaagccaugacauguuacaaaaauuauuuaacugcccugaauuccaguuuccugauacguaaauugaaguuagaacaucuaccuauaauuaaauauguguauuauaaacccuagagaaaccacuaaaaagauaaaaacuaaaaaaagaguccuagcuaauaagucaacaguggagauaaaauggaagacaagaaaauaauccaaagagggcaggaaaagagggaaaaaaaagaauaaggaacacaugcaacaauagaaacuaacaccuaccugguagggugguugcaagggugaagugaaauacauuucaugagguacuuagcgcagugccuggcucguguugguucccuuuccuuuacccccuaacuugaaaagugagcucugccuuccauuaccaugaaaccaacuugaguauaaagugucccagggucccacaggcagggaugucuccagcagccacagcccucccagcaagcagccagucccagguuagccacagaggcccucaaccccacagagaguggguggggguuuggguaaagcccacacuuuuuacauaagagaguuugugauaggcaaaaauugggcacaucccaccuugcaaagccaguagucucuccccucuuuugucgugcgauucaauucuccugcccucuuuuauggcaguuuccuucauucuacaagugcuucuucugugcagccacuguuucaggcauugaggagagaaaaaugaucccugcauuccaggaauucucacuguaaggggagagacaggcaacugcugucaagaggggaggaccaugacaaagguuugcacagaugcccauugaagcacagaggaaaagccaccugcucugcccagagcauucugggaagucuucacaaaguagcugacauuugaggccagcuccugagcugguguucaccagguaaugggggagaaaggcauugcagagagggaaggcagcacauauaauacagaaguguagaggggcaacaugacagcucacaugaaugccccuuacagacguggcuucccagcucccaaacuugguagcccccaccuggacccuguuucugcugacagcaguagaagaauuccuuuuucaagaagaguuccauguugucacacauugagagcaggcaucccaagcauaggaaagaggggagaauagcaucccaagcauagggaagaagggagaacaaggugguggacaggugugaugaaaacagacuuggggccuauggauaaacaugaauaugcuaacaauguuucacagccuucaccaugcucaacuuggcugcuaguucuagagaaacuugacagauugagaugacauuuccauuacaucugucugcauuaagcacacccccugccucacucuccaaugaguuuccugugagaugucuuggcagguuacuguagcugaaaaaaaacauggugcaauaggaaauguacuuuucuaucaaaaaaaacauugcaucuuuccaaaauauuacucccucccccuuuuccuuuguacaccaccauauacauauggucuccuuccagaauagcacuaacaugacuaacucucuaugcuaucuggcacuuggcagauaugcucuccuuuaaacuuugcaacaacugugagaucaccaucauuaucuccuuucugcagaugagacuccaaaugucauucaaggcugcaaugaaggguuugcccagagucacacagauguagaccacagagcuaggacucuaauccagggcucucugacucuagaacaccuuccacuacaaucaugcuggccuccaaauccagcuuuuaacaaagcaaccaaccaucaaggggcaccuaacauuuucaguuuagguucuauauuccagucaguuaaauccagcaaagaguauauuauuuauacuuacuccuugccaaaccuguauuaaggauccagagaggagugagguauaauacccaccuucauagaucacaggguccaaggcagcuuuucucaaauuucuuugacuaggaacccaccauaagaaaaagauuuuacauugcaauaaaacacgaagacaaaagguuugcaaaagaauacuuaagugugaugcacucauuuucuaauguagucuguuccauuucaauaaaaaugcuggucaugauucacaaaauugauuucauugcauagugggucauauccuacaguuugaaaacccauggugugcaaagaagagauuucauauaagcaguuuuuagcaaauuuaaaaagaugugcaaucacgaauaagaaccaagauacuguuacuucucacuaaaccuuaccucuuagcauccagguagacuacaugcaucuucauucccauccagcaacaacaacaaaaaaaaaauucuuuuuuucccaaaaauuucuucaaggguccugagauguauuccagugagauaggcuuaggucacuggacaaucccugaagcacuuacugguggcuagagggaaagaaugcacugauuggcuuagccuaggucacaugccaaccccuuagguggauucaacuucccuauaauuacacuaauacuccagaaaggaaagagaaggcagaauggacugcugggaaggcaaccaaaaaauguccgcuacagauauaucauguacaucauugcacucuaucuucacuugaugcuugugagguaggaucacugaccccauuuacaaaggagaaaagugagguucugagguucagagagcuaaaguaacuggcccacuaagaaguggcaaggcuggauuagaacucugcucugauuccaaaacccucauucuuggauucaaauacauuuuguaaagaacaaaaccacacacaugaaagagauuauuggcugggugcuguggcucaugccugcaaucccaacacuuugggaggccaaggugggcaggucacuugaggucaggaguucaagaccacccuggccaacauggcgaaaucucgucucugcuaaaaauacaaaacuuagcugggcgugguggcgcacaccuguaaucccaacuacuugggaggcugaggcaggaggauugcuucaaccugggaugcggagguugcagugagucaagaucaugccacugcacuccagccugggugacagugagacccugucaaaaaaaggaaagaaagagacagaggaaaaaaaaagaaaaagaaaagaaagagagaaagaaaagaaauaaagaaaaagaaaauaaaaaggaaaagaaagagagaaaaagaaaagaaaagaaagagaaagaaagaaaagaaaagaaagaaggaaggaaggaaggagauuauuguugccuacauuucaucacuccccugugacaacaccaaacucugggauggaugagugaagaggaauuuuuuaacuugagggaaauaucuacuucugauaugguaagaaggaagaguaaaauucccagcucuucagaggagcacugaagaaaaacuuaugaauaaauucauuuucagcauuuuuuccuaaaggcaaaauaggaaaguuuuccaccuuccgucacuuguaauuaaggcccagcccucuucucagcccccuaguuuccugagaauuugcaguauuccuuauagaagcauuccuuugcaacuacaaauucagaugcaaguucuuagccucaggcaaaauggcuuuauagggcauuuuuuccuccuguucuguuuguuuuaauuucccaaagaaccaucugccaugauuuauagaaucaaagacucuuaaaaacucagugagaagagggacuuugaagaaaaguuaguccaagcuccuucuguuagagaggagaaaauggagguccugggauguggaagcauggguugguggaaaauagagaaaaucuucugugaguggguacugagcugcauucuucaaaacacauuaaaucugccaggugcaguggcucacaucuguaaucccaguacuuuggaaggccaagacaggcagauugcuuagccuggggguuccaaaccagccugggcaacacaaugagaccccaucucuacaaaaaauuagcuagggaugauggcacgccugugguccuggcuacuccggaggcugaggugggagaaucucuugaacccaugccacucaacuccagccugggugacagagcaagaucccaucucaaaaaaaaaucaaaauacauuaaauccaguaauuuauauauaagcuuagaauagcuccugccacgcgauaacugccaccaaaugguaacacuuuguauucuucuccauagaaguaugguuaaaaccauuuccauugucaauaugcagauaaggaaacuaaaucucaaagagguuaaguaaacugucggaguucacacaguuuguaaguuggggagccagaauuuggacacuggguuugucuugcuucagcuaccauguucuuuccuaugauuuugccuaguaaggcugaaacaaguagaacugggcuccaaauuucccuuucuaccaccacuccaccucagcaccaccaaguugcacacucgggagagggggccccagacaacccgaaaacaaaacaaaaacaaaggcaaacacgagguucuugaaugggaugguaacauggaacccaguggugacagggacacagucacucacaccaguaggaugaacucaguggguggcaggugacaauuuugccuaaaccuaccuaugucucagucuguuuuaugcugccuuagaggaauaccugagcauggguaauuuauaaggaaaagaggcucauggguaauuuauaaggaacuaagcucacaguucugcaggcucuauaagcauggcagccgcaucugcucagugucaggaagcuuuuacucguagcggaaggcaaggggagccaguguggccauggcaagagagguagcaagagagaagggaggggugccacacgcuuuuaaacagccagcucuugcaugaacuaauagagcaagaauucacucauuaccucgggaggucaccaagccauucaugaaggaucugccaucaugacccaaacuccccccauuaggccaccuccaacaguggggaucaaauuucaccaugagauuuggaggggacaaauauucaaacuauaucauccuagaaccuaaacaggaccucugcgaucaggguucuaucuccacuugaaagaagccauaaucagccuuggcucuaaggcucaaaucaaaauccugccuccccaagaauuuggauucuuagucucugauugacaucugcuuuggcaucuucagcuaugccuuccugaggaaggcugagccugcugggacacaggcugucugucugucugucugucucccucuggccccaguucaccucccccugccaucugaagcucuucuugcuccggccacagucauccuuucuggcucuuucucaaccuugcugagcugcucucugguuaccugaacacucccuguacccacaccuucccucucuaggccuugccuaguauagucaucuuugccugaagggcccacuucaucucuaccagugccugagaaaaauggcacagcuuucaguaacuggcuuaaaugccaccuucugcauguggucuugucagccugucuaaaugaaaggcuuccgccuuccucuaaucuuuuuccuuguaucaauguuauucaugcccaugucucaucucuccuucagaguugugaguaugugagaugagggucucaacggcauaguccugggcacauagaagauacucagcaauagugggccaggugacugguccucuucauuuccucaugucuuggcuuccugauuccauucuccaguaagccagauguucauggcaaaauccuaucuauccccacaccuaauauuuuauaauuaguaaccccaaggaauguuaucaaaucaauuauucccaugccuaugggacuugauccccaagcccaauguaaagacuagaaaaugaagguggccgggcacgguggcucacaccuguaaucccagcacucugggggcugaggcagguggaugacaaggucaggaguucaagaccagccugaccaagaugguaaaaccccgucucuacuaaaaauacaaaaauuagcugggccuggugacgggcaccuauaaucccagcuacucgggaggcugacacagggaauugcuugaacccaggagacagagguugcagugagccaagaucacgccacugcacuccagccucggugacagagcaagacuccaucucaaaaaaaaaaaaaaagaaagaaaaugaaggcacagggagguuguggcauccuugggcugucagaguauaaaagguagaagcagagggaagacucugaucgcagccuaggccaucucuguaacccgugggacuuugacccugaagcucuaauuacugcacaggagggugggagagcaggggaguguguuucuuaagugaauugucucuuugcaagucaaucauuaaaaucuuuucuuuuggugggucuggcuguccuuuguaaguaucuccuauggauguuggggugaaagggagggaucuucaucugucaacagcugccccggguaugaagcuagagguccugggaguugaagugaaaauagaaaaggaaguccggaaaccuggguucuauuucagugucaucacucuuggguauauacuugggauggggauugcugggucccaggaguacauuuggcuuucauagaaugaaaaguguauguagcaguugacucucccaccagcagcaauccacacccucaccacacccugcagcuaacuguaggcugugagauggggauggguugcaaaugagguccacucacuccauggagauguuucugcuucccucccauccagauguuaacagcuggcugcucaccuuuggauuccagcuacacaacgugaucccugguuaucccaaaccagacauggaugccauggaacccuccuacgagcucauccacacacagaugaaaacgcaggagugggacaacagcaagguaauuccugcacaaggcugccacuccucaggccacucagacauuacuggagggggucccuucagcuuuucagaaaagcaugggccagugauagacaccaauguggugccuccacagugccugccagagguuguucaacaacuacuuaguaacccaccacuaggaagcugcuagggacgcagccaugaccacacacagacgcuuacaagcugcaguaaggagcuuuguguguuacacugaguuuggaguuccacaaaaauaauaagccuuggucacuauccagaacaaaagcacagggagagaagguggguucuaaauaaaaaugugacauuuucugaguacuucaaugcaccuggccuuaugugaguuauucuauguaacucacaaagaucccacagccguauuguucucauuuuacagacucgugccugaggcuuucccagugccacacggcaaggaagggguagagcugggauucaaacccagaugugccuguucuguauccucuugcugaguacagugccuggcauacuguaggugcucaaaaagacucacuuucucuugucucgcuuuuauaacccaauuucaaagacucagaauuguauagcuggaaaggucuuuaaaaacagucucaucccacccacucacuucaugcauucauuugcucgcuucuccccucccuacuaccccaauccauucauaaauucucuaugagaacccaacucugugccaagccccaugcugugcccagugaacgcagggaugaaucaggcagagacuaagccuucaagggaugcuugcccaggggaugacagacuaaggaggaaagcagguugccagauggcuugcugcugguggucagaaacuuucauauccauauuucuuacuccagauugauuccuuuaggccucagcauagcuaucuccuaccagaccccggagaaugggauucugcaccccuguacgcugguggcacuucccacacuguacuuuaaugccucuuucuugucucgcuacuagauuaugagccccaagaggguaaguacugggucucauuuaguacccagcauacaggauagcacacaguaggugcaugaagcauuuuugcuaaauaaauaaauggcugaaagaaguaaacagcccagacauuuccccauuuuacaggugaggggaccaggguuugaaagcagcagaauucaauggagaacccaagucugccuggccccagagcccaucgucuuucugcugcccagccucuccaguucccaccaccuccaggccccgcccagauauccuggcauuugcucuucccagggcugagcacugcagcacagcuccuccucccucaccaggcucccuccugcacuccagagagccccggucucugacugccugucugccaaccucgccugucaaugaauuauugauuucugcccuuggcaagcaucggagaucuuuguuguugagcacuccagcuuucgugaaacucuaggaaauaauuguucacagacaggguucuauuaauuauaaagaggacuuaauuucagugagaagccgauaggccuguugcuaaagccauuucccuaacuugcugauaaggcccuggagccuuccugaguguggcuucuccaagcucugugagccacagaagggacagguagaugauacgccaaguuggcagggcccgaccuguccccuaaagcagccaagaguaggggcaccccaggagccccaaggaagcacgguggggcagaggccuuccuuagaaaucagauguaaaugcaguggagagcagugaagcagggugggaggguuaauaacagucacugccucucaccauguuaugccuuccugccaagaaugcauuucuugccaauccuccaucugacggcaucccaccacccccacccauccuucaggucccaacucaagccugagccuguccucaaaccccaccuccuccaccuucaagccaagauucuucucagcuuuguuugcuccuuccuucuccagcagcccuugaaacugaaccucuagaauuggacagaccugggcuugcagguugacuuguuauuaguuguaugacugugagccagugacaaccucuuugagccuugguuuccuuagacaugaaauuggaauaaugacagcaccuaccguauaaggugauugugaagaucacugagauaaugagugguaauuauuuggcugaaacaucaagaaauguuagcuauggcuauuacuaguuccucucuuaggccaccagugaucacauuugauugcaauuauuguugucauaucugucuuucccaacuaaaugaugaguucuuuaagagcaaggaugaugucugauucauuuuucugucaccagugcucacaaaacgaccuggcacagauuagauacccccugaacaguuucuaaauggaaggguggguggauggauggaugaaggucagcagauguucugaccuucuggcgaccaccuggauguucugguggucagcgguagagcuacaugccgcagguuaauaaauaugugugguuuugacuucauuauuuaagcugauucuccagguucucaggguuuuuuccccuuugucuuacucucucucucacucuccucccccaucagucuauccucgggguacagugugaaguacagaagcagcucaaggccuuugucaccuuagaacgguuugaccagcucuauggcuccacaaucaccagcugccagcaggcuccaaagaccaagaaguuugcauccagcggcucagucuuuggcaagggggucaaguuugccuugaaggauggccgagugaccacagacaucaucaguguggccaaugaggaugggcgaaggguugcugccaucuugaaccaugcccacuaccuagagaaccugcacuucaccauugaugggguggauacccauuacuuugugaaaccaggaccuucagaaggugaccuggccauccugggccucaguggggggcggcgaacccuggagaauggggucaacgucacugugucccagaucaacacaguacuuaauggcaggacuagacgcuacacagacauccagcuccaguacggggcacugugcuugaacacacgcuacgggacaacguuggaugaggagaaggcacggguccuggagcuggcccggcagagagccgugcgccaagcgugggcccgcgagcagcagagacugcgggaaggggaggaaggccugcgggccuggacagagggggagaagcagcaggugcugagcacagggcgggugcaaggcuacgacggcuuuuucgugaucucugucgagcaguacccagaacugucagacagcgccaacaacauccacuucaugagacagagcgagaugggccggaggugacagagaggaccaaggacuucuugccaaagacagcuacucuuuuguggccgcauaccugacuguguuguacuuuuaaaaaaaugauuuuuuaacaagugcagaaacaaaaagauacugguugcauuguaacucaugcaacauccuuuuuuuuagaaaagaaaaacacagauuuggccuucgcacauuuuuugcaaagaacagaagguauuuuuuucuguagugugaucacaaugaaaacuuuauugucuuuuguucccuuuuuccuugaggauuuuucccuugucguuugggguauguaucuccucucugagaugcaucuccugggguguguccucgucugucccuagguacccagugugaugugggacaugaaugucugugcuaacuugucucaugugcaacccuuucuucuucgacuggggucgggcaggaguaaagggagugaugggccaguacaacaccccuuccaagggggccugggaggagggucuguaggaccugaggcuccuuggcagggcuccugcagaagagugguggauuucuucucaccuuguucucugccuccagaggaucauagauggcuucaucuugcuccagggaauuucaugguguuguucagcaccuuuuuuaagcugccccaaacuccuguucaagcuuucuauuuugaugcugaaugaaacccccuaccacuuuugcaaauccuguguaguugucggugccacccccaugcugggauagagaaagugucucccagguccuuucccccagaccagugacauaacauccugggcucagagucccauccucccgggagggaaagcacccaggaugccugugauugguugguccuccaugauguuccuguucaucuccuccuuucucccaaagccagaugugagaacgagcacugcacagcaagccuucaaugugggcaccauguccacagaacagaaggccacccauggcaaaggcauggcagugguggcgagggcaccagccugccuuccgaggcaaagcccucucucuaugacuuugaguaucuucccuccaccacucagccgccaccacugagacguaggaauguggagggaggugcuugguggccuuugauucuggaaaaaugcuuaacaaaaaaagccagccaaagagaggaaggcauaagcuaagcauccuucuaaccaguucccaaagucccaucugccuccauguaccagcugaucgcagagcuggacuggggcaggcugggcuuccaggaaauuccugaaguucugaaacagcuuccccucuagagaagcccacccaauguguuuuuuagugacaggaagaaaggagggaagagcugaugugguguggccugcccauaucauacaaccccaccaggagcagggcaguucccaaggugggugcccguagaucugggaggccaggcuggcaugauuccugugaagaacugugccugugucgucagggagaggccugagcccucucagaagcagggacagcccacaccugaagagcacgcccaagcugaggcagcagccagcaggcugggggagcagugagggcagggggagucacagccagagcugggagccccuuguucaaggauuccauuccugguucauccgccuaauuaccauugucauuaccacucacaggaggcucugggagaugggaggggaagccaaaugcuuccuuuuaagcugggcuucuuagaaaauggaacuuuuauggguuacauuuacauuaaguguggaaaaugaauucugagucugagcuauuccccguggaaaccuuguuggacugauaagcucauggcaccucuauagccuuacucacauagucuucagaauauuacacaaguuaaugaaacugagaaggucugacugcaugaggaucggagcagcauguagucuggguucugccuggcagagggaggcaaccaaaacuucuuggggagaggagauuucgccuuaacgucaucccacugggauuagaggauguguuucgcuaagugcucuuccuguuuccaaaaaaaaagccacccugcugcagcagugcgcuuuggccugcuuguccacugguugcccauugccccuggauccagagcucuacugagucagauacagugcucugcaggccugcugugggaggcaugagcuggagaugggggcucccaucuggcaggaucauucuuggaugagauggaaaacaguuuggccugaagaacacaaguuuuguccuccagaagggacuuacgccucucaaaauguacucuucauaccaagggcccuugggcaaagugcuccugcccaguugaucagucccauccuggcugccugacaucagugaagaccugcuggggaugucugcucagaggucaggaacggcaugcgguccacaggaaccagcucccuacgcuucccccacgcccugucccuccuccacagcccccuccccaaaggaauaggguggacuuuuagggaucaaaaacagaauuauuggguguuucauuuauuuuuuucuuucuuucuuuuuuuuuucauagagauggggucucacuauguugcccaggcuguucucaaacuccuggccucaggcgauccaccuuggccuccugaagugcugggguuacaggugugagccacugcgccuggacugaguguuuguuucuuuaaaggaucuuauauuuuuccugugcuacauaccaccacagcagcccagcuucuguggggagagaaguugaaggaucccgaagcuuuagaaaaaggaucucagcuguggcacaggcaguguuaugcgccucacugccacauuggugcuguuguauugaagguggugcuucuggccuuggcccuuuugaguugguuuccauuugggcugcaggugacucagugacucccuccucaagcuguccuccugcuaagaccagcagucacaaacccauggcaagggugagugugaaggccuaacccugugccuauguaauaggcuccaagcaucgacucccauccugagaggaccggcccuuuugacacucaccaaccaaaucuguucauucgauagagugaccaggccucccucaccugcccagguguaugauccuacaguuccugccuucucuccuaccccgcacagcugccaacugguccuacauccucagccccucugccaccaccuuaaauaggacuuuacugauuccccaacuuuguuuuuuuguaggaugagauuuccuuuuuaucccacccccccacaccccaaacagacauugcuggagggcagacuggaggaaggggaaggcaugcagguaaauuacugccuugucagccucugacccucaucucucagaauuguuggcugagaauuaacccaaggaccacaccagugccugauuucuacuuagggagagaggauuggaaacgaucccuaagaaacugacugagggugagaauggccaggagguguguguccaaauaaccaggagggggcacagaagaugauggcaaggcagacugggcaguguuuuguagacacagaacaaagaaucagaauuugaaaaaagaagaaaaacaaaucuucgcagcugcaacuuuaaaguaucaccuuuauagauggcagggauuuccauuaugcaaauggaaucuaagauuucaaugugaaaucuuagaaugcaguuuuaccacuugcagucuuguauuugugguggccauguggugagggcggugaugcugagcuuucugcccaggaggaaugagcuuucaagcucucagcagggugucaggcuuggggauuugagcauccacugcucaaaguccaggcuauucuccaguccucacggcagccacuaagcccaggagccagaccuggcccggggacacaucuccugagggaucccagaaagaacccagucuuuccuuucccuugggguccuuguuagaaugaaaaccucucuauuuaaggcacaucauucccagcuagguuuauacacuugucuauauuuuacuggaggaaagggaauuaaaaaagaacucugcaguucaaggcccuuucauuuaaccuuccaaaaacagcaaacucauuuuaaagacucauugcugaggugauagagagaaaccuuauccucuccaaccuucacauucacaaaaaccauccuuguguacuugacugcccuagacaguggugacucuuagguuucauuacgaauguggaauaucagagugugggaaggcccaggcgagggccaauguuguguuucuuacccccucuggaaugccaaaggcaagguacuaggugaccuccugguccccaagaaaaugugauuuauucugagggcgaacagccaagggaggacuagucuggagcacgcucggccguccuggcaggagcugagccucaggugucuggcggugccccagcagcccuggauucacccaacaccagaaucccacuuuucuaaauccaccuguuguucugagcaccucugaacccgcagcuucggcaaaaggagucuguaccaagcugcuucuggaugaccaacacuggagacucuggccuuaccauguggaaaucauuuuccugaagucuggaacuaauuuugagaaguuuuuuucucaacacuuuuguguuucuaacacuguaucuugacuguguaaauaccaacaaggcuguaaauaaaugcagauguagauaccuucuagaaaaaaaaaagcauaaaaacaaaaccagaagugaucccguguagccuucguugacaaauaaagacuauuuuguguuuacag

SEQ ID NO: 15279 - RNA, 8127 nt, Homo sapiens
aguuuggccuuagagaacugaaguggauaaacauggucauagcaaugcacuguaaauuaggguaguagaggccucuggggauuugcagauugggguccucugcaauggaaauaucacaaacugugcucuuaugagaggcucuggcacuguggaaugucuuacuccaugcuucccaggugggagugauuaaugccuauaccuuccuguggugaugcuuccuaaucauuuauuuaacaaauauuugcugaguaguaacugcggacaaaacuuccaccaauggaggcaauccuguauaaaugagacacacaaaugaguagggcuuacagcauucuuuucaaaggcugcaguuuacaagaccagcuucugaguaaaacccucuuuuuauuuucaaauguagcauaugguggccugaaacagugcauauggcuguucuacagugagggggaauggcucccaauuuaauuuucuuaggcauagaugacaaauuuuagaagauucucauuaaaaggaaaaaaaagcgugcuguagggacagaaauguaauuuuugggauagacuagaaacauauuaauacacaguuugggggauucucugguuuuuggguggcuuggaaacauuuauaguuuccaaauacuucauaucucacuuaauuauauaucauacguaaguugguugacuuauaaauucucuguguuuuguauauuugcuauccccauucagagacccucauuaucacagcagaaaaagaaaucaggaaagcagaggguuugcuucuauguccuucaaauuuucuguaaaacccuccuaaaccccagcuuuugggaaauaacuuuuuucccggaaauuucauuuuuccucauaguucuaaacacacacccccuuuuacauggugacagugaaaagaggcagaagaaaaugucaaaaaggccaggcaggcccuggacgcuagggaugcagccaugcugcacucgaguggccccugauggggaguggagggcaaagaaaagggggaaaaaaagaaggggggccagcaucugggggcacucaaugaaacaauccaaagugguucacauauuccugacccuugaacuugaagcucuguggugcucacaugcugcuggugcauggagggcuggcuucugcuaacguuuucaucuaugugcucuggcuggaggaugaaggcccugccauacucucacugagaucccucuuugaugccugccuugcagguaguugucaaaugacccggagaacgagggaaaggggugugugggagaaagaaauccaagcuagaugccugaagaccuagccucuccccuguaucugccccucucuggccaugagaccuugggcacacccuuccuaugcccgagacgcaauuugcuccugugaaaccaggauacuaggcucugccaaccucucaggauugcugaagggcuccagagucuaaaagagugaacgaguaagucaacaaaagaaauuugagugucuuucccaugcugguagcuguucucuggagcucccucuggagacaggggcugggcucagacauaggccaagugaacaauugcaguccugacuagaaguggcuuccuguuuguugugugaccuuaaugguggccagugacuggugggcccuugggccccucauuucccuuucuugugucugcguccuuaucagggaggccaagaguacauggggcagucucaaggcugugggccugucugauggccaccuccuggccuuuacacaccagagacccauuuucccugguggccagcuugcugugacuuucacaggaaguaaaagguaugcaggagcgugcuauuaaagaugggggcaaggccaaccuucucaccuuuacaaauaaggacacuggggcucagguuauguaauuucccugacaucguaccgcuaguuaaagagcagaacugggaauuugguccauuaucuuucuguacaucgagcuguuaggcacaauuccacaguggacaacucuuuacagcaaugcucuggauuuucuggcuuccaagcccugucgccucuccacguggggcagaaauugacuuguuuauuucuguaucucaaaugcacagcacagugcuuugcacacaguaagcaucacaaugguugaaugaaugaauaaaugcaugcauuuuuuuauguaagaaucucaaauuagacagcuccaucagcuugacagggcccaucaagggccauggggugugguggaagccauucccuacaggaggagcucaucccucuccuuagaaaagagacacagggaacaugccuguuaacguucacuuaguacccauuauguggcuggcaggaccuguguuaggcacuggaugcucaggaauaaaagagucacgccucuaaaggauuugguguaguggggcagacagagacaauugagugcuggagaagaaggaaguagaaggggcuguggaagcccaaaggugggaccccaacucaggcugggggcuggauuauuuccuggaagacagaaugcuuaaacugaaucuggaaggaugggcaaggauaaaaaggagaaugggggugugggcgggggcaagguggggcaauccguggccuaguaaacucuuuguacuguaguuguuugcaugguuccuuaaccucacagccccauggacaguguauagcaagcccaucagucuuuuugcaggcuuaacucuuccuuggcuugacgacccauuagccaaccauaucucgcucuugucugcagucuggccacagaacuguuuuacaauaguaucugaggaggcccuggggguggaagguggaaugugucuccccuucuguacacacuggggagaagauuuugucauuugcuauaauaaauucugugccuucuuucaaaaggcuugcaaagucuuuaucuucccguuagaacacaagauuuuuaaaggucaauuucucucuugucucuuaucaugagaaaugugguuuagagauaguuugaagggugaccaaauucuuuggcuuuaugugaacucucccuuccagcaauaagagaugaggaggaaaagagaagacagagaccuuuguucucaguuuuccugaaauuucuccuucuagguugcauauaucaauuaucuauugcaacccaugauuguuuuuucaugggaacaagagcaccaaaagagauuaucauaccuugaagcugcuuaaagauccuuuaucagaagaggacugguugcuuaaaauccaguggaguuuuuauccuggaggcuuuuuaaaaagcauagguuccaaucuaauccuagcucucccgcugagccacugugugacuuugggcaaaucauuucaguucucugagccuuaguuucccuguauguaaaugugugccuugcaacuuuguuguaaaggcuggagaugauguacgcagagcgucuagcacagugccuggcacucaggaaugugcucaaaaauggcugcuguuuuccuuuauguacguuuggauucuuuucuagcaaagagcguguaacaguuuggaauacagacuuuaacacagaaaaugaaaaagaugaaaacauauuauauagagaaauauaccauaaucuuaaaugaaaaaauagaauguaaaauuuuauagaggacauaauuccaauuuuuaaaaauauuuacaaauacauauuuuauaauaaauaucauguuucugugauugcagguggagagaagcaggagaaacaacugauaucuguaguugauaaacuaagucuuagagaaguuaaguacaucacucaaggucacacagugagcaaaucagggagccaggaguugaauccagauaaucuggguacagaucuuguacuuuuaaucauugugcuauguugccucucagggccuuucaauauauaaccugugauccuuauagcagcccugcaaggugggcauuauuauccucauuuuacagugacuuagcaucuuuggggcauggugucaccaucuuugaaaugggcaugaauaaacaucccuauaagaggauaaaaucagaagaugcaugugucuguaccuaauaaggggcuucucaaagcacacaguaugaaugggguacaccuucuuugucaaguggggcacauagagacuucacuuugaguaggugaguuagggccccucugcuugucuaccuucuggucccucucaggagccagugcccaaggugagagcaucaggagacuggcagucaucgagucacgugagggaucuuguuuccauuuuuaaaucuagccaacaaccauacaugaaaauaaaaacaaacuaauaaagcugcucccuggcucagucauacuguucggcucccccaauuuuuuuuuuuuuuuugacagaguccuccucuguugcccuggcuggagcgcagaggcacaaucucagcucacugaaaccuccgccucccaaauuaaagugauucucgugccucagccuccuagguagcugggauuacaggugcgccccaccaagcccagcuaauuuuuugcauuuuuaguacagaugggguuucgccauguuggccagacuggucucaaacuccuggccucaagugauccacccgccucagccucccaaaguguagcuuuuuucuuuuugucucauaguuuaaaaacacugcuguagcauucuuuaugaaacuugaaauucaaguuuaauuuaaaauauguuguuuuaaacccagcaaauugggaaagaagaguaacccggagaucuuagauaacuugaagggcuacagggaucuacaaugggccauaugucagaggucuggacacagugagaagcucuaaugucgccaagaccucacauacucuggcaguuucugcgaccggccagcugugugacuucugcgaaauaaucgcuaagcuuccuuuuccuuaucaugagggaauaguaaguggauaauaaggccacauuccucacaguguugcuggauggaugcacaauugcuuugcaaacuguaaagugacauacaaguuauuacgcucucguaagccuugugguacugcugcagccuauuuaaaucugaguaaguacucacacuacacuucuagguggaggauaaaucacuaggagaaggcagaagugcucuagguucacaaggccauguggaauggcugaagagucuaguccaggccauguaaugacuuucucugugauuaugaugugugugaugucaccucuccucucugggcuccaguuguccugucuguaaacaugcaggagagggaguuaaagucaauguucucugaugucccuuucaauccuguuacucaacauuaaacucuguuaauuucuucuccaagacuugagucauaucaucuaagaacaaccacuagugagacucuaacacaauuucccuccagccugaaugauuuaucuuggauuaugcuguauacccugucauggcugaaauaaaggcacuuauuuaauucugcuuccauuagauugagucaucuggaugacaauuucuuacaaaugacugugagcuucuugagggagaaagacugggccauguucacuggucuuuaugucuccuuggaaaggagcauggugccuuguagauagcaugagcccuacaaaggugugcuuggcugaacugaaaguagcccaaugcaaauaugguuuacucuugugcuccuuucuuccucucucccuccacuaaaacugcccccguuuggccaaggcacagaguaauagaggccaaugaggauaacccuuacuacccuggcacuuggggacaguccacucucuaugguuguuucaucuaugccauccugcaaagcagggguccucagcaccuuccccuuggcucccgcaguggguggacagcccacugaacugagagggcccugaggugagacguuuccucauuuaauaguugagaacccaaggucaaggacccucaacaauuuggccuucccagcugguucuauuuccaaccaugaugacccacgggaugucuucccggcuguucugaaagucccaugggacagaaaccacaucacaguucccaguagggcacccaggcaucugauaucaguugaaugaguggaugcuccuuuauccuggcaauugucccacugcauugcaauuacuugcuguuucucucucucucuagauugugaccuucacaaggguagggacugugucuuauuuaucgcugaagccccaguacccuggacagggccugauaacaauguagacacuugguuaacauugguugagugagugaauaaacuacgugcaagcucauuucagcccauaacaugcuccaaaaaugcaaguggcauauucucccacaacuggggauuuucugguugaucuuuuccacuuccuacuggcucaucucucagaacagcugaaggaggcucuauuccccuggggucugcaucagccccauuuccuaugacaagaaccucucucuccccccgagcugugggcuuugggcuaugguaugccuaugccccauguuaccacuggugcauucuagugcuaggagggcuggcucugaaguauggcaaacaaaggauacacuugaauugcauuucaugggagagaaucaaugagccuuguucuauaaccuacgcuuguauguauaccgguagggagagagguacgcccuuuccccacauuuccuaaagacaugcagucauuuugcugcccagauguucaacagcuguuuaaaggcuuuggccaagacuuuugacuugugagaagggaaugguggcucuucucuucuuuucuucuauuacaugaguguuauuauuagucauuggaauugugccuacacaggcaaacugaaggggaaugcugaggaaaucaugcagauaauguaggcugacaucucuuuccuacgaagagcaaauauaaauacacuuugccuugucugaagacaugggugcuuagugcccuucccugcuuuguccuggcuuggcccauaaugaugucucugaauagagagcccuuuccuuuccgggaaaccgcuacccauccaagugucaccuucugaugaaugcuuuccuacucccacaacaacuaauauauaacucuacaacagcacuuaucacaguuuauuagcacuuaacuuugggucuuucucccucauuugagguccuggcauauagggagaggacuuccuuaucucuaugccugguauagggcccaacucuaaaauaagaacucuggauauuuauggagcacaaaaauuaaugaacuccacaaguuuuagaucgauuaagggauauuucaauccuccaagaccucaggagaacauaggccuucuguuucugccuagcuacuguggccagccccauaagcucccuguugacaauugcuccacugggcccaggccuggguacaucaggcccaauuaccuccuggauuuaggcagcagguggaagggcugaaagccggcuggcucaaagaacagugcuccgaaacagcccuuucuaggcugcugaaacccacucaaggcaaauaaaccacagaaaucacaacaucacacacuuggccuuuuaauucuuauggugcuuugggguuugagaaucccucuaaauagaaaauucccaaagguuaggaugcugaguuucugaccuauugauuuccuacccugugcaacauauuagaaaguccuuugguauaaauauuagggagccacauagacuuguugggacuaagccaauuguuaggccaucacuaggaagaaaggguuaacuguuuugauguuuuuucauaucuuuaucuuuuuauucuccuaauaaccaccugugagugggagaaucaggaaggauugauguaucuuccaagugggaaaguagaacacauuaugguuguauuuacccaagugaaugcaacagaaaaaugaaggcuaauucuacgacuaagauaaggacugaaaugguacucaugggccagcugccucauuuuauaaauagggagagugaggcucagagccaccaaacagcauguguaaggaugcacagggagucaaagccagaacuagaauuagaacccaggucuucacucucagcuaaugaauguucuaaaagaugagcaccuccuuccuugggcuuugacugucuagcacuuuaaaaaaacccaaagcaaaggcca

SEQ ID NO: 15280 - RNA, 1614 nt, Homo sapiens
uguuaaaaauaauaaacuaggaagagaagggaacuuuuucagccugauuaagagcauuaugaaaaacccaugccuaauauauggaaugcugaaaacuaauuccucccuccuaaggucaggaacaagacaaggauguuugcuauauccacuuacauuuaauauuauacuggagguuguagccagugcaaugugucaagaaaaaaauaaaaggcauccagauuggcauggaagaaguaaaacaagcucuaucuuaaauuacugaucuuguauguaggaaauccuaaagaauccacaaauaaagcuauuagaacaaauaggcaagcacauuugcaggauacaagauaaauacucaaaaauccuguguuauucuguacauuagcaaugaacaauccaaaaaugaaaucagaccaggcacaguggcuccugccuguaaucccagcacuuugggaggcgagguagguggaucacuugaggccaggaguucaauaccagccuggccaacauggugaaacuccaucucuacuaaaaaauacaaaaaacuagcugggcauggugaugcgcaccuguaaucccagcuacuagggaggcugaggcaggagaaucacuugaacuugggaggcagagguugcagugagccaaaauugcaccacugcacuccagccugggugacagagcgcaacucugucucaaaaaaacaaaauacacaaacagcaaaaaaaugauaucaauaacuccauuuacaauagaaucagaaaauauuuagagauuucuuaaaaagaaauacaagaaugaaaauuauagccgggugcgguggcucacaccuguaaucccaguacuuugggaggccgaggcagauggaucacaaggucaggagaucgagaccauccuggcuaacauggugaaaccccaucucuacuaaaaauacaaaaacaaaauuagccgggugggguagugggcgccuguagucccagcuacucgggaggcugcggcggaagaauggcgugaacccgggagguggagcuugcagugagccaagaucgcaccacugcacugcgccugggcaacagagugagacuccaucucgaaaaaaaaaaaaaaaagaaagaaaauuauaaaacauuguucaaggaaauuuuaaaagacguacaugggaagaaaacacauauucauggauuggaagauuuaauauugauaagaugccaauaccuuuaaguugaaguacagauuccacagauucacucuccaucaaaauuccagcuggcuucuuugcagaaauugacaaguugauccuaauacuaauauggaaauucagagaacccagaauauccaaaacaguuuuucagaugaugaacaaaguugaaggacucacacuuccuggcuuccaaaguuacuacacagcuacgguaaucaagauuguguguaguaauggcauaugacagacugugucucccccagauucauauguugaagcccuaaccccuaaugugacuguauuuagagauaaugccuauaggaaggaguuaacuaaaguuaaacaaugucaugaggguggggcccuaaugugauagaacugguaauuuuauaagaacagaaauagagagagagcucuuucuc

SEQ ID NO: 15281 - RNA, 4098 nt, Homo sapiens
acuucuauuaaaauucauuaauagucauacaaccaacauagaguugaaugagaacugccgauguaauuaauaggcaugacauccauuucaaacaucucaacacuuuaaagaaaagcccuuuguuucaagaaaaaaggguuuguaacuaacuaaauaccuaacauguaauugacacuaaaauaugaacuuugucuuauuuaguuucuguuauagcuguaaaauuucaggcagagccauaacauuguacagaguguagcacuugugauuaaaccuagccuguuaaauccugaaaccuucaaccauuacuucugugaauacuuuagcccugggauuuggguuuuucuguuccgguguugugucuguugccggcaauggacacaccauaucugcugcuggcccaaggaacgucauuaauuuuucuuuccaaauuaaguauuaugugcuagucaguguauaguaaagcacuucucuuuuuuauuacuaaaaagcuggcauuagauuugcauuauaaauaccucucuaggaacuuuauacuccuuuuccuucuucaacagguauugcccuuaaaucuuaucuuuuggccuugaaaguuuauagcuauuguuuuucaguuguucguuguuuuguuuuguuucacuuuaguucuguaguaccugcccauuaauauuuuugcuuugauucuagcaauguguauguaucuguauaaaaaauaaaauaaugaaagcaaccuaaaaauaggaugcaccaauagcaugugguuccaaguaaguugugauuuuuauuuugagacaguguuccacuggaagggagggaagggcuuacauucacagacaguaaagcagggcuguguaaggagcuacauuuacuuaacagucuccuuuccagcuagguuuguuuuauuuauuugcaagucagcuaagaauuaaccuuuuaaaccaucuaaaacaggcaagcaauauaaagauuucuacuagugcaagguaagugguuugaauauacaagugcccuuuccugccacccagucucacuaccguuuuaguccugcagcuggguaaagccacuauuguguggaaacucucccaugugcccugucucuaccucuggacacaccagcuccuucuuccaccuauucuauuccucaguuaagccaagugaucagaaguaguauuaaauggguagauaauuuuaacaggaugccuaaugugaaauaaggaguuauuuuuacucuucuacuauagaaagccuaagguaauucuuaccaucucaaagacugaguauuccauuuagguuuggagaccacuugugcugugcugccugauauuuaccaaacuugaauaaguguucgucaacuugauagugaauguaccccuucucaccuuauauuuugauuaaaucaauuaacuauaggucaucuaccaagaauguaauccaagcgguugauaaaacauuauuaggcagauagauuauugauuauuaaauuuugagcagugcaaaaacgguuuugcugcuuggaguucagauucagucccucaaagaguuuaugaucacugaaauacacucugaagguauucugaagaaguuaaaaaauuuuagaaaacgaaauguucuguauacaaagacaauacagucacuacgaacugcagaaaguauaggaaagcaguaauugauguagaguuuagacagucuuggaucuuuuuuagagcacuaaccauggauuuagacucaaaauagcugcuacauaauagagcccuuuaauaauuuaaaccccccuuguugaaauacaaguuggacucccagugucaaacucuagacuguagcuaauguauuaaagggagauguagauuaauauucaguauauuuaguuugcaauuucugaaaagguuugaaaacuagucagcuuuucacacagcagaagcuuugaacugaaauaugugugaaaaggacgcagacugaaaacguuuugguuuuguacaucagugcugaugaaauuaguguaaaacauuuuccaucauuggcacauuacugcaaaaugauggcagagauauuuucaagaauguacaucaaguuauauuuccuugacauccuuuuuucaauuggucaagguuacagauucagaggauaaaggguaguuucauuuagaauaaauucaugucuacuggcaaucuauauauaaaagugaccugcccaagaaccaaaaacuuuaaaugcuaaugaagcuuuugaaaaauaauuuuuaaacaaauuaauuuuaaaaggguguuacacguacccaguuuuuacuuuuuaguugaugaaacccauccuauaauauacauuugagcaaaguacacauauuaagaaaaacauggacauuuacuuguuuaauagucaaaaugaugaggaaauguuagcuguuuuuaagugggacuggugggguguccuuugucacaaggaaugcuuuuuuagcuuguuugugggcauaagagauguuaacccuuugcugauucuaccacacaacuguaaagaaccuaaugaaucuacaaguuuaauauucagaaaaagcuaggaacuccgcucuuuaccaguacaguggaacaggcccguuauucaaggugaugccucacagcuauagaacaacuauucaaagacccagaguuaaaugguacauguguauaugugugugugugugugcacacgcacacacuucagauaaguaucagaaaaaauaaaaaugaauccaucauuaacuugaaagaaauaagauggcugcauugcaacagauacaaauauuaugaacaucauuuaauuacagaaaaucuagacaacaguuucuccugauguuugacauucucaaaauauauuccucauucucgaagaagcagagaaugccaaggcugcauaucugcuguaaucuaccuagcccucuucugcuuaauaugauccauuauugaaucuucucagauuaaaauccauuccuauaucaucuaccuuucccaaagugugugccuguaaaccuaccuuggaaguggcaaguuaacugauuuuuuugugucauuuuuauaccaauccuuaaggucaaagccuuuugcuaucaauguauuuaaacugaguugcuauauguucacuaauuuguuuucaaaauguuuugcuccaacuuaaauuaucuuuuaacaucuuuugagugccaagaauugcuaaguaacuguaauauguugaagagaguaauugccaagcaagcagucauaagccaaaauguaaugagcuuaguauauaaccacuuuagaguauacacucaccacuuuuuguauucauucaugcaaacccuccuggaagucgauuagaagaggauccaauuuguggaccuuuuuuccuccuuuuggacaccugagcacaauuuuuuuuuuccuuucauauuuauaccacuuuggaaaauucaguaaacccaauucuggcacaucauaaugguuucaguuagugaagauguuuauuuuaauaacuuuaaaauaugacuauccuauacauaaguuauauaagagggcauaacaauagaugaguagaaauuuauaaaauuucuuggauauuuugaaugagaaaaaaacauuuuuaaaggaauuuuguuuuuuccuuuuuuggccaaaccgguacaaguuagaaagugugcuaaggacugaauacuugccucgugcuuuuugccacuggaugauguaaguuaagaauggaauuguuaauccuaaguauauauuuucuugacuuucaucaguuucuaaagaaaucuaauuuaaguguuuugcgguuuuguuugaucuguauuuauugaguucuggucauagaccagcagcuugcacgucaugcucaugaacagccagaacauaguuauuggggaacuucauggcucaaaaccuucugaaucauuuaacuuauuuuguauguugcaaaaaaaaaaaaaaaguuuauuuugcuugagagucaccuuuuuuuaaaaaaaauaacuguacagcuuuuaagggaugggaggugggaaaauacccuaaaauaggauguagauuuuuuacaauuguguuuaugcuagaucaucuacaggugcauuauguaauuaaaccuaaaauuguuuaaaaauuu

SEQ ID NO: 15282 - RNA, 4098 nt, Homo sapiens
aaauuuuuaaacaauuuuagguuuaauuacauaaugcaccuguagaugaucuagcauaaacacaauuguaaaaaaucuacauccuauuuuaggguauuuucccaccucccaucccuuaaaagcuguacaguuauuuuuuuuaaaaaaaggugacucucaagcaaaauaaacuuuuuuuuuuuuuuugcaacauacaaaauaaguuaaaugauucagaagguuuugagccaugaaguuccccaauaacuauguucuggcuguucaugagcaugacgugcaagcugcuggucuaugaccagaacucaauaaauacagaucaaacaaaaccgcaaaacacuuaaauuagauuucuuuagaaacugaugaaagucaagaaaauauauacuuaggauuaacaauuccauucuuaacuuacaucauccaguggcaaaaagcacgaggcaaguauucaguccuuagcacacuuucuaacuuguaccgguuuggccaaaaaaggaaaaaacaaaauuccuuuaaaaauguuuuuuucucauucaaaauauccaagaaauuuuauaaauuucuacucaucuauuguuaugcccucuuauauaacuuauguauaggauagucauauuuuaaaguuauuaaaauaaacaucuucacuaacugaaaccauuaugaugugccagaauuggguuuacugaauuuuccaaagugguauaaauaugaaaggaaaaaaaaaauugugcucagguguccaaaaggaggaaaaaagguccacaaauuggauccucuucuaaucgacuuccaggaggguuugcaugaaugaauacaaaaaguggugaguguauacucuaaagugguuauauacuaagcucauuacauuuuggcuuaugacugcuugcuuggcaauuacucucuucaacauauuacaguuacuuagcaauucuuggcacucaaaagauguuaaaagauaauuuaaguuggagcaaaacauuuugaaaacaaauuagugaacauauagcaacucaguuuaaauacauugauagcaaaaggcuuugaccuuaaggauugguauaaaaaugacacaaaaaaaucaguuaacuugccacuuccaagguagguuuacaggcacacacuuugggaaagguagaugauauaggaauggauuuuaaucugagaagauucaauaauggaucauauuaagcagaagagggcuagguagauuacagcagauaugcagccuuggcauucucugcuucuucgagaaugaggaauauauuuugagaaugucaaacaucaggagaaacuguugucuagauuuucuguaauuaaaugauguucauaauauuuguaucuguugcaaugcagccaucuuauuucuuucaaguuaaugauggauucauuuuuauuuuuucugauacuuaucugaagugugugcgugugcacacacacacacacauauacacauguaccauuuaacucugggucuuugaauaguuguucuauagcugugaggcaucaccuugaauaacgggccuguuccacuguacugguaaagagcggaguuccuagcuuuuucugaauauuaaacuuguagauucauuagguucuuuacaguugugugguagaaucagcaaaggguuaacaucucuuaugcccacaaacaagcuaaaaaagcauuccuugugacaaaggacaccccaccagucccacuuaaaaacagcuaacauuuccucaucauuuugacuauuaaacaaguaaauguccauguuuuucuuaauauguguacuuugcucaaauguauauuauaggauggguuucaucaacuaaaaaguaaaaacuggguacguguaacacccuuuuaaaauuaauuuguuuaaaaauuauuuuucaaaagcuucauuagcauuuaaaguuuuugguucuugggcaggucacuuuuauauauagauugccaguagacaugaauuuauucuaaaugaaacuacccuuuauccucugaaucuguaaccuugaccaauugaaaaaaggaugucaaggaaauauaacuugauguacauucuugaaaauaucucugccaucauuuugcaguaaugugccaaugauggaaaauguuuuacacuaauuucaucagcacugauguacaaaaccaaaacguuuucagucugcguccuuuucacacauauuucaguucaaagcuucugcugugugaaaagcugacuaguuuucaaaccuuuucagaaauugcaaacuaaauauacugaauauuaaucuacaucucccuuuaauacauuagcuacagucuagaguuugacacugggaguccaacuuguauuucaacaagggggguuuaaauuauuaaagggcucuauuauguagcagcuauuuugagucuaaauccaugguuagugcucuaaaaaagauccaagacugucuaaacucuacaucaauuacugcuuuccuauacuuucugcaguucguagugacuguauugucuuuguauacagaacauuucguuuucuaaaauuuuuuaacuucuucagaauaccuucagaguguauuucagugaucauaaacucuuugagggacugaaucugaacuccaagcagcaaaaccguuuuugcacugcucaaaauuuaauaaucaauaaucuaucugccuaauaauguuuuaucaaccgcuuggauuacauucuugguagaugaccuauaguuaauugauuuaaucaaaauauaaggugagaagggguacauucacuaucaaguugacgaacacuuauucaaguuugguaaauaucaggcagcacagcacaaguggucuccaaaccuaaauggaauacucagucuuugagaugguaagaauuaccuuaggcuuucuauaguagaagaguaaaaauaacuccuuauuucacauuaggcauccuguuaaaauuaucuacccauuuaauacuacuucugaucacuuggcuuaacugaggaauagaauagguggaagaaggagcugguguguccagagguagagacagggcacaugggagaguuuccacacaauaguggcuuuacccagcugcaggacuaaaacgguagugagacuggguggcaggaaagggcacuuguauauucaaaccacuuaccuugcacuaguagaaaucuuuauauugcuugccuguuuuagaugguuuaaaagguuaauucuuagcugacuugcaaauaaauaaaacaaaccuagcuggaaaggagacuguuaaguaaauguagcuccuuacacagcccugcuuuacugucugugaauguaagcccuucccucccuuccaguggaacacugucucaaaauaaaaaucacaacuuacuuggaaccacaugcuauuggugcauccuauuuuuagguugcuuucauuauuuuauuuuuuauacagauacauacacauugcuagaaucaaagcaaaaauauuaaugggcagguacuacagaacuaaagugaaacaaaacaaaacaacgaacaacugaaaaacaauagcuauaaacuuucaaggccaaaagauaagauuuaagggcaauaccuguugaagaaggaaaaggaguauaaaguuccuagagagguauuuauaaugcaaaucuaaugccagcuuuuuaguaauaaaaaagagaagugcuuuacuauacacugacuagcacauaauacuuaauuuggaaagaaaaauuaaugacguuccuugggccagcagcagauaugguguguccauugccggcaacagacacaacaccggaacagaaaaacccaaaucccagggcuaaaguauucacagaaguaaugguugaagguuucaggauuuaacaggcuagguuuaaucacaagugcuacacucuguacaauguuauggcucugccugaaauuuuacagcuauaacagaaacuaaauaagacaaaguucauauuuuagugucaauuacauguuagguauuuaguuaguuacaaacccuuuuuucuugaaacaaagggcuuuucuuuaaaguguugagauguuugaaauggaugucaugccuauuaauuacaucggcaguucucauucaacucuauguugguuguaugacuauuaaugaauuuuaauagaagu

SEQ ID NO: 15283 - RNA, 2394 nt, Homo sapiens
uuggcguugguggcagcagcacuugggccauggcggaggacaggccgcagcagccgcagcuggacaugccgcugguccuggaccagggccugaccaggcagaugcggcuacgcguggagagccugaagcagcgcggggagaagcgccaggauggggagaagcugcugcagccagcggagucuguguaccgccucaacuucacccagcagcagcggcuacaguucgagcgcuggaaugucgugcuggacaagccgggcaaggucaccaucacaggcaccucgcagaacuggacgccugaccucaccaaccucaugacacgccagcugcuggaccccacugccaucuucuggcgcaaggaggacucggaugccauagauuggaaugaggccgacgcccuggaguuuggggagcgccugucggaccuggccaagauccgcaaggucauguacuuccucgucaccuuuggcgaggguguggagcccgccaaccucaaggccuccgugguuuuuaaccagcucugacagcagcugccagcugcugcucuccucuagcccaccugugcucuccccugccccugccacuuuccccccuguauuuuuggggccauuauucucgcugcucagccuguccucugcuugcccagaggcccccugagucccacaccuuuccuccucugcuucucccuggggccagcacuccagcucacaggaagaagauucugaggcuccauagccuagaagcuggacuggcugcugcauugcuauagacgauagaggccuacuaggggccagugugcauggacagugaggccagggccaucugccuucucucugcuucauugugggagagagagacugagaaagaccaagagagacacagagacagagauugaaaaacccagcauccacuuccuccagagucagggagacagagaugauggggcgucuccacggggaguccagcaagccggcauucacugcucccuggccuuggugcccuuugccggagccugugucugggcugcuggucccauaacacgucgacaacccucaggauauggggcaggguugcugcagggguggauuugggcaguggagaguggcuggcacccuggaggcuguguaggcccagcuguggcucuucugggccugacuucaggguggagaagugaagggggagguuacacagagaucugucucuacgcacacauauccaugagacagagugugcuguauucauauggauguauucuagaggucuauuccuacccuaggaacaagugcaguuuuagauuaucuguucaucauugcugcugguucaaggauggcucuuaacaggggccugguccggaugaccuuggccugggggcuugcugagcuaggagacugcaguucagauagugaaacagggaguggauuaguaaaggggguucccuuugccuugagggaaguuggagcuggagagaguggauucuccagggccucagguauccccugcuggggagucaggcucuuuagagcuugcaggucagggaaggcaagugcuucguccugacauagcaucuguuggcauuucuugggcuucuucaaugcagcugaggggggcagggcgaaggcguggugggcaguuacgacggcugauagucccaagugggcugcaggcggcaguggugugacggcagaaugguaaccucuggggucauuggaugcaacucacucaccaaacagauggggaaacugaggcacaauuuucaucagauucaguucugacucuuagccucauuccccuucgcauugcgcagucccagagagcccccccuuuugggggagugccugaccugcaccuaacaucagccaaguacagcuaagccacuguccccagcacccugacuuaaggccagcccuguguuuuguccucagccagucagggauguguccaagacauuuccccucaugaagcaaagcugucaaggaacuugcggcucuggaacagaugcacugagggccagagggucagggccauccccuguggcuggggcugccgggagggugagccccaccucggaggugugcaggcuggagcagcaugcuggagcugagauucugugggugagagagugggagagugucugugggcugagcacugguccuuucugacucacagcucuggggcccauuccgggacaggcuugaagaagucucggccauugccugcccugcugagcacgaggggaggccagaaccgugugcaguggcccugcccuucugcuugagcucuuccugcagcucuggggacccucuuagucccgacugccugucuccccagccuaucugucccggggccugagucccucugcugugcccgcugcagguccccaauaaagccugugcccug

SEQ ID NO: 15284 - RNA, 14846 nt, Homo sapiens
gcugaguaaagcaaagaacuuuuuauaguguuuauuaaaucaaggaccgguuagauagaugaugggcuaggcaggugggggaagacagagcucacugcccuguggggucucuguggggccagccccugaugcccauguggccacugaugcccagcuucccccaacaccccaacacaggcccaggacaauauuacaaaagugaacaaaugcaaccuuuuucugcuuuuacaaaugacaugucuccauccccggccagcagggguaggggaggccgguugaaagugacacuccguuaaaaaggcaacaacuuuuauaaaaugaagacuaaggaaacagcccaggguucggaagcugagaugcuacccuggggguagagcauagacaugggucgggcagaccuugucuccuuucacggcauuccugggaggguaagaagggcugucgugcucagggccaguggggacugaauccaggaggccccuuggagaucccagccagaugaggcuccagaacugcagcaacuccuuggggcagcaucuagaggaugcucaggggaaaauggguagguuuccagucuggaugcugggggaccccaacccagggugagaaacuggcuaggcuggaaccaaugugcccuaagcuuccagaggcuccgaagggcagagugacuuagcccaugccgcacagcuggucagaggcccagagucccacuugugaggcucuugccuguccugcugcugcuacuccugugcuaauggggaacaggcaagggcagcaaggggagcccaggcggggaggguggggcuuauuagaggagacaagaaagugcauuggguccgggcugggaggcaggaggcugugcuccagucaugccacugcccgcaggaacuuagauuagccuuuuuccuucucaaggccucaguuuccccaucugucacaugagaaggguggacuugauucuuugcaauuccuucuaccauuaagguucuagggaaauagaaaaggaugaagcgggccucauggccucauggcaaagaaagggcuauguuagaaaagaaacucgccccugagugacugggccaugggcccaaggggacacucagcccaguggaccugaacucugcccugcagcagggggucccacccacccucugcccauugcgggucaggccggcccaggcaugagggaaggcacuugggggauaaguggggaagggaagcaggaggggacccgagucugguuuggcaucgaagucccucugcucaugguuuggggaagcaacguagacaaaggggugagacuuugcuccuagguguggcucccagguccaaagccucuccuaggcccacaacuccuguggugacgcugccacauaggccugcgggcuccccacugguguuggcacauugaacauaaguuacucgggaccugaggcagcccaggacagcagucuguuauguggcccugggccacaccauuugucacaagaugguggggccccuggcagcagaaucccgggugucuacgcagugcagggccaccuuggggcuggagccaggccuccggggguaggugcccucccgcaccaggcgccggcaccgcacauccuggcccacgcugacgcucugcagugccgggagguggaggagcagcgccucaggcaggggcaccagguuggugcccgaaagguccagcuccugcagggagcucaggccugaaaacaccucagcuccugcccaguuaagcuugggguugcccgacagguccaggaccugcaggcccgguagcucacggaagccacugggcgccagcucagggagccucugcaggcuggccagagacagguguguaaggccucccagccccgcgaaggcacccggaccaaugacagcuagaggguucccauccaggcucagguagcgcaggggcaagucucggagguugggcacggcauggagccgguuccaggccagguucaggcucugaauggugggcgcaggcaggccggcccucgugggguggggcacgaggcggugaaugagguugugggagagguccacguguagugcccggcccugacugugcgucgugaaggcagacacugagaccucccggagcugguuguggcuaagguucacgucgcucaggggugagcuggugaagcucucggcuggcagggcugucaggccauuguggcugaggucaagcgacuccagguagcgaaggcgggagaaggcagugggugagaugcuggugagcagguuguggcugagauccaggccagccaacgucguguagcccggccccgccaacaccgacucauucaccaucuccagccgguuggaggacagguccaagugggcuguguccagagggaugggcaccggcaugaugugggggcccaggccgcuacaauccacccgagucaggcugaagcugucgaaaaggccgaaggucuccaccucgcauuggcacccggggaagcauggccggguugucugggccccacucacggccagcagcagcagcaggggccacggcauggugggggcuagaaagagagccacaggugaggaaugaaugcaccagauggucuaaagccaccacacaggacaugagcccagucuagacacuguuggaaggugucacagaccccgaccuccuggaaugcuuccuggaacacuccccagaguuccuagucccaguucuucucuggccucugccucuccauuuguaugguaaggggcgugaggccagguggugaauuuucaacuagaagcagcagaucccuuucuuaaacaagagcagcagaugaaggcgggccuggucuggcugaagugagggggaccugaagcccucgacuucugcccaccaucccugccuaggguguuaggaaacccaguuugaaacccaccagacuagacgguuucucgggcuggccucuccagcucugaugguccagagucccugguuuggucuagaccucgggccccgggugaggggcucauccacagggcugaggguagggugugcccagggugccccacucucugcugagcaaguguuacacgucaggcacuguucuggcugccccacagcauggucgcaucugacccucacaaccaccuuccaaggcagaaaauucucuguuuuaccaaaagggaacugggccuuagguuaagacgcuuuuggacagccacacagcagaguggaguggcacuagaggggacacugacagagaaagcaccuguggucuggccggggcuggccuucaagaccaggacucccucccugcaauggggccugcagugacugccccaccgcacccauacuccaccugcccugucccccuagccugucauccaggggcaggaacuucccuucucauugggcauccugguguccaacguggguguccagauucccagauggguuuuggggacaccugucccaagccucuuucccccuuacucugucccuugccaccagcagauuaagcuacuacaccucuuugguucuuccuuuaaccucgggcaggcaguuaggcugcuucccccauuauacagaugaagaaacagaggcucagagaggaauagggccuuaccccaaacuaguaaaaugcagggcaggaaugggacccaggccugguguacuccaauuacuauauucauaugcguugccuccagcaggacuggcagaguagcugguggagaggcagggugcaggaggggcuuuucccacugacacaugcuguggcaugagccagugucccuccucagaucucaguucccucuguacaauuacagugguggcugcuacagaugccaggugcuacauacguguugucacaucuaauggucacaccacccacugcuguuggauucaaagccuguguucacguccacuguagcuccugggaugguggugcucaguggugccagcaugagaaggagaggguugggcagugggagcuucuaacuagaccaauuggauagucugucgucaccccggcccugcacaguggccccucagcagccugggagacagaaggcacuaagcuuccuucuagccaggcucuucaucuggguggcccugcucugggccccugcccuccugcccaucccucccucuggacuucaggaaggaggugagagagggggaggagaugggccagggaccugcccaccuuccagacuggaaggugggugggagggagcagcaggauugcauuaccagcccugcaugaaacuuuaaagggcuagccacuugaucugcacucuggcuuugcccaggggcagggaaaagugggacucuucuccccugccccccuccccaugugggacccuccucucccaccccuuucuuuuguagaggccaauuucaggauuaaauccagcccaggugcauccugggcauggucccagcugaggcaggacagaguguuccaaugucuggaaccaaaaggaaaauauuaaguugcuucaggccccuuuuguuccccugggcgagcuccucaccgcagggcucauuaccaccaaaggccccaccuccccugcuaagcugaucugcucauucauacccacccuuccugggguuuaaacaaacagcacaaaggcccugagauuacccuuugauucccagaggugauuauacaagggguccgugaaaugccaaauggccucauaugagcucccacuuauguaaccagcagcucaaaauacgacccaaaugcuaucccgccagaggggaccucucgcugccccucuuuaagccucagccuuguccucugcacuacaggguggcaauuucugcccugcccucuucaccuaaguugauuaacccuuacugccaacugugaagggcugugcacaggcacagggcagucaucacccagcagccagaagauacagaacugaggcaaugguaguaacagccgauguaaagaggcaucugauguaaaggggcaggaguuaccuagguaacugucugcagaugcucccagggcacugaacuagguuccuugcucagcccugcacaguagacaccucucccgggguuccugcucugugccgggccuaugcccggggcugggcauuugcagugggaagugacgacagugacagucagggccaguccucacucucugcuagugcuggacacacaugcuuucauuuaguccgcacagucacucugugagccagcagucucauccccauuuuagagcagagaaacugaggaucggaaaaggaagguggcugaccaucuuuagcaggagugacuugcuacacugugcaacucugggaaguuguauuagucuguuuucaugcugcugauaaagacauaccuaagacugggcaauuuacaaaagaaagagguuuaauuggacuuacaauuccacguggcuguggaaggucuaacaaucaugguggaaggcaaaaggcacuucuuacauggcggcggcaagagagaaugaggaggaagcaaaagcugaagccccugauaaacccaucagaucuugugagacuuauucacuaucacgagaauagcucgggaaagacuggccccaugauucaauuaccucccacugggucccucccacaacacaugggaauacugggagauacaauucaaguugagauuugggugcgggcacagcuaaaccauaucauuccaccccuggucccucccaaaucucauguucucacauuucaaaaccaaucaugccuucccaacagucccccaaagucuuaacucauuucaguauuaacccaaaaguccacaguccaaugucucaucugagacaagucccuuccaccuacgagccuguaaaaucaaaagcaaguuaguuacuuccuagauacaguggggguacaggcauuggguaaauacagcuguuccacauggaagaaauuagccaaaacaaaggggcuacaggccccaggcaaguucaaaauccagcagggcagucaaaucuuauuaaaguuccaaaaugaucuccuuugacuccaugucccgcauaucugagucaugcugaugcaagagguggguucccacagucuugggcagcuccacccccguggcuuugcagggugcagccuccuuucuggcugcuuucacggacuggcguugagugucugcagcuuuuccaggugcacagugcaagcuguuaguggaucugccauucugcggucuagaggauggugccccucuucucacagcuccacuaggcggugccccaguagggacucuacuccaaccccacauuuccuuucugcacugcccuagcagagguucuccaugagggucccaccccugcagcaaacuuuugccugggcauccagguguuuccauacaucuucugaaaucuaggcagagguucccaaaccucaauucuugacuucuguguacccacaggcucaacaccacauggaagcugccaagugguguugagcuuugguuuggguuuuguaaaaugaacaauuauccccuucuguggaugcucagagagauugggucaccugcccaaggucagugaaugauggugguucuggaaccugcgaagucuuggggcuugcacccucugaagccauggcugaguuguaccuuggccccuuuuagucauggcuggagugucugggacacaggacaccaagucccuaggcugcacacagcauggagauccugggccuggccugagaaaccauuuuuuuccuccuacgccuccaggccugugaugagaagggcugccuugaagaacucugacaugcccuggagacauuuuccccauugucuugggaguuaacauucagcugcaaguuaugcaaauuucugcagccggcuuaaaugucuccucagaaaauggcauuuucuuuucuuuucuaaugcauugucaagcuacaaauuuuccaaacuucuaugcucugcuucccuuauaaaacggaaugccuuuaacagcacccaggucaccucuugaaugcuuuccugcuuagaaauuucuucugccagauacccuaaaucauugcucucaaguucaaaguuccacaaaucucuagggcaggagcaaauugcugccaucucuuugcuaaaacauaacaacagucaccuuugcuccaguucccaacaaguuccucauuuccaucugagaccaccucagccuguacuuuauuguccauauugccaucaggauuuugggcaaagccauucaauaagucucuaggaaguuccaaacuuucccacauuuuccugucuucuucugaacccuccaaacuguuccaaccucugcuuguuacccagguccaaaguugcuuccauguuuuuggguaucuuuucagcaaugcccccacucuacugguaccaauuuacuguauuaguccuuuuucaugcugcugauaaagacaaaccugagacugggcaacauauaaaagaaaguggcuuaauugaacuuaacaauuccacguggccggggaaggucucacaaucauggcggagggcaaaacgcacuucuuacauggcaguggcaagauacaaugaggaggaagcaaaagcuuccugcauucaauuaccucccacugggucccucccacaacacaugggaauucugggagauacaauucaaguucagauuuggguggggcacagccaaaccauaucagaagucauggggaguuaaaauggaguuaacacucccuuccucaaggaguugccgcaagggcuagagaucguucgugugaaacacccagcacagcaccaggacgcugacaaaugugcagccaaugguagaugaagcccccugagacacagucaccgacuacuucccuccccacacucuggggcacugacagggaggugacagggcaacugugccuggugacaagagaaguccugcaggauggucaggagcccuaggucucagugccugcucugccauggacuguccucaucucaucucugaacaagucucuucccccuucugugccucaguuucuccagcuucacaguaagagguucaguuuagauaauccaacuccagaguuucaggauuuuaaaguuuaacaaaagcauauccuaaauuucuacuaaguauauacaaagcacugggcuaggccaggagggaguggggggcgggggguggguggugaugggauagauacuagggucccuguccucauggggcuuacagaccagcaaugagaacagaagaccaacuuauaacaagaucacuaacaccagcuuuggacccaggagacuggggcucuagucccaggugugccacuaucugugugaccuucccuguuuucuuugggccuugguuuucuuaucuguguaacaguauucacacugccucccucugggacccguacucuacccccaggaaaaagagaaaugaagacugguagccaccaaagaaggcugagggagaaagggaucuuucagucaagauucaacauuuuuuuccaaaucuugaccugcagauacaagauauccacugauugaccagauuauaaaacacaagaacaggaggacaagggcuuagaaaccacauccaucugugauuugggggauauaccguaaggccuuccagugcaggggccaugaaucaugcauuguugggcccacagggccagguccacagugacucuaaguuugcugauggccugcaaggacaaagaguaaaugguacggccccaacaggcuccaggcaggucuccccaggugacaccgcacacacugcuaugagacaccucuaaaacagcuuuggccacaucacucuccuuaucagaaaccucuuggguucugcuuuuuaccuacagaaaucaaguucucccaugcacgaggcaccuguaaguugucaccaccuucuucuccccucccaccuguccccagccccucaucuggauuugaacccuccuugacagccaaagugggaacagccuucccuugauggacuuugaacaacucucagccucugcuaauacaucuccaaacuuggagaauuccagggcuugggagcuggaaggccccuuggggaucaugggcaacuggggcccagagaggggcagugacagcaaggaauggcagagcagggcccaggaccugggaccugaugccucaugugacugccagaacugcaugcauccaucccgccugccccuggccugcucccagcaaaacaaagccuguucuguccacucaggcccucgggccaccccucccuccuggccucucaccccacaggcuacccacaggccuccuucaguaaauucucugccgugaguuaccugcuguuuuccuacuugauguguaagcagcuuggggcggugcccugccuacuuuaccuguguguucuuucccccaccugggaucagagccaggccuagaggguguguggaggaagagcaggaugaacgggucaaccgcaagacccagaccaggugugaaccuagcucuguaccuaccagccuuggguaagucuugggacccgcuccgaggguccucaacagggcuaagaacacagguuuguugaaaggauuaaaugacagaauggcaggcauuccacucacuaucugcuacacaaauacucaaugugugguagacaaugacggugauuugcuaagccuucugaaggcagucaccaugugauccuucauguuccuccccacccaaguucccaguguggcgccaggagcacagcagguccgagacuggcugugaugacauucuucagucacuucccuggugucugcugauaaggacagcucucuggguguuggguuccagcuugaaccuaccuggccccagcugccugacccuggugcugcacuacagcaucucuggucuguaaaguuuuccagcuccccccaccgcccucgacaacuuccacagggcacuguuggcacagggccccacugguacagggccccagcacccccgagaccggccuuugucucgaucagcuguuccucaacacagagcugccucccacccugcuccccucagucaugaguucacucaagcugaugccgaggaaauccccagguggaugguucagaaacguccugcccuccaaccacuuugucagcucuggaaacgcaaggcagaaagaauuucaaggccagacucccggagcccugagggccagcucuugcaacagacccaccaaugcagcacaucuggacaaacacagcagcccaccaugugcucuccaccagcaucucacuucugccucaccagagccuugacccuggggauacugucccuauuuugcagacacagaaauggauguuacucagcugggaaggagaggaccccggacuuaaccccagaugucuuagcuccaaauccacucugccucagcuuacaaaugagcacaugugcuuagaccuggucaugcugaacuguacuuacauguuuaacugucuauccuacugugggcagggaugcgauuagguuccuuuuuaugcccuugaagcugagcacugagccugguacagagcagacaccacgugaagaugcaccaagcaucuagaauaccgcuaccucaccaaaggacaccucucaaccucucccaugcuuccucaacuaccaucuguucagucacccugcaggaucagcagguuagauggcgucauaucuacuuuacagcuguguuaagaaguccagagagguucugugaucuguccagagucacacagccagagaggacaggggcuggacccaggacccagguauucugacauccaguaccuggccuccuccaugacaugaucgcagggaccuguaagccuagcaacuuacccaaggaggauaaucuacagggagaugggcaaggcucccaguaagauuuucuccuuucaauaugucuucuucuugaagauuuucaaguucccaucaaccugaggcagcguacauggacacaugaggaggcgcuauggggcagagggcaaggguuuuguagccaggcagucuggguuccaacccaacagggccuucacugcucugaggcuugcucgugcccucaccccucugaguccucgucuguaauauggugauaaucccagugcugguccuaacgggucacugugaugauuacaugaggcaaagugaagacccagaccuggccuggcacauguugguauucacugaauguugguuccuguccccagugagugauuucagggaccagggaagaaaaaggugcugugacaccagcaaauccugagggaaggcaggggcugaagauggagaagaauccacaauucaucccagaggccuuggauccucucuccacauaccauccaggaucccaguguggcuacaagaugcugacaaggcacucccaggagacugggaagggugagcuggaaaggucucagagaccaaagcaggcaaaagcugcuguguugccugugacagaaugagggcucagcaucaaauucgcagaucccccugggcaguuggggucacugucuucccuuucccucaucccuaagcugggcagucaccucccccuguccaggucaggcucaagagaccugcugcaacagccucgcuccuggccugacuccaacugccagccaugcuggcaccagaacgcacuucccaacagaagucugggacccuacuacagcucccucuuuaaaacccaucccacagagacagcuuucuagucuagaggccugugacucuucuagagccaccugccuuuuugcacacguuguucccucugaugcaaagauacccuucuuugucuaccagcaaacucucacacauuucauucaaaaagccaccuccucugugaggcuuucccagucuaaccugccgcucauccaggaaaggccacccauccugugagcgcccauggcccuugggcugcccccgacaagguacuggcccacuucuguggccaucuacgaaucugugucuaccuccuugccugcacgagccuggccacaugaaggugauaaaucagaugaaugaaaugucauggacagaaagcucccuucugcuuuguggggaacauaacaauuggugcaacccugcaggaugcuuagggcucugcccgcuggugagaucagguuuaggaccagagucaaugcugucucugccuucuauugucagugcaauccaaugaaugucugcacaauguaauacacacuacaaaccacuuuuuauuuauuugcacauguaauucauuaucuuauuuaauacaccaaaucaguggagcaagaauuaguauccucacauuuuaaauaaguuacuugucccaggccacagagguaggaagcaauggggugggaguaaaaucugggucccuuugacucuaagaggcuggaucacucgcccuccagauuggucucucggccuccagcaccacccacaagccagagacggguuucauagaauuaccaaccgcacccugcugugccuguuuaaauccuccaggagcucuccauugccuacaggcucaaaucccccuucucggccugacauucaaggccuuggugauuuggucccugccuucccagccucaaguucacuuccaauucaccacccucaagaccuugcgucugcugguccaccaugcugaccaccugugcuguuuucaugcacagguccugcacaugcugauccuuuugugggagauucuuccugccuccccuguguacccacugacuucaaaaccaugagcaggaggaaucuccugucaggccccuucuccggguuauucccacagaaccccucuuaggacuuguuuuggccagguggcuuucagggaggacccaacccucuuuaggaaguguccucagugcccaggccagccuugcucugaaaacugaagcaugaacucuuaacugcauccccuguguugacccaggaguuaugauuaagaagaagacugaucuggacuuuaccaccacaaacugucauuuaaaaaguaagaggagaaaaggucaaucccccucccuucccucuccauuuuugacucauuuaucagcuuuugccuuuccugguguuggaggaaggguagguggaagcccgguggcgguugcauugcagccuuccuggggagcaaaguagugccucggaauaggucaggucagaauggagguguagguuaaacaucaaaguguuucuggguucugggaucugaagcagucagccagaacagaagaggcuaucaauaccuccccuuccagaagggaaacugaggccggagagggaaaggaaaaugcccacaguuguuucuuucccagguuagcggccugugcccuuccaucaugucugcagcauccgacaaaguucuagguuaaagacuggagugagcaguggggaggaggguguuuacgguuaucuuugcgacuuaggcucaaaagcccagcaggcuccugcagcucugagcacccccccccccccaccuccggucagccccaggcacugcaagucuagacuuauccgaagggcagggcgcacaaagaugaaagaagaaucgaaggucuugagucaccuccucgccaggccaagugugggcuggcgcugcucuccgcccggcuccagaggcgcggguuauucccaccgcacgccccgagccgcgagggaguucucgcccuguccgugccagagugaccgcgacuccgcgaagcugagcaacuugccagcgccgcacaggggccaguggccgucccaguugaaaccuguguaugugaggcucccacggcccccagcccagcuccggguccugugagccggcgccucgggcaugcccagaucuggacuggcagucccccucuccccuaccggguccgaggguuggcccccuaccccgggggcgggcugcaaacggagagugggucucaaagcggagccugucucccuaccaaacagacgcaacucuggaucacacucuuuccaagaagcgcggggagggcaacgccagccgcccugucccuuccucuccccagcccagggccggagccugggacccaccgcucgccucuuccucccagccggggucugagggggaguccgcacgcuccgcccagccccugcccagccaguccccaggcgcugccgaucccccgaccaccaaucccgucgcagccccuugcuguccugggaccucaggagggggagggggagggcugucugcgcccccggccggguagcgguggggaggacuggggcuguugcccgaggaaccgggagaaaaguuuggagccaagucgugggcccgaggggacggcgggggagcggggggguggggcggcguugggcucucggugcgcacacccucugcggacacccagcccagacacgucggcaggcaccgaccacguacgcggagacacgcgaugcgcccaccgacgcccacagccaagcgcaggcccgcaaacguggacacgggcgcaaagcagccgcgcaaagccacggacacacaaaggcaccgacagcggcgcguccccgaccgcaaauccacaaagacccacaaacgugagaugcacguguccgcacaaagacccacacggccccugggcguagccuuugucucccgcaagaccucuccccugggucggcguuccccacucccgcccagcccuaggcguccgacgaaaguugaggggccucggcgggacccagccccgccccugcgcccggcguccccagcccgcccuccgaaggggccgcgaggcuaggaucggggacuugggaucuucaaccgcagcgcggacucucgccccgcccggggaacugcacucaccuggaagccugcgccacagccgccucggcacgcucaccccggcggcccggccgcgggcccuccggccagcgcuuuucuccgcgcggcgcg

SEQ ID NO: 15285 - RNA, 14846 nt, Homo sapiens
cgcgccgcgcggagaaaagcgcuggccggagggcccgcggccgggccgccggggugagcgugccgaggcggcuguggcgcaggcuuccaggugagugcaguuccccgggcggggcgagaguccgcgcugcgguugaagaucccaaguccccgauccuagccucgcggccccuucggagggcgggcuggggacgccgggcgcaggggcggggcugggucccgccgaggccccucaacuuucgucggacgccuagggcugggcgggaguggggaacgccgacccaggggagaggucuugcgggagacaaaggcuacgcccaggggccgugugggucuuugugcggacacgugcaucucacguuugugggucuuuguggauuugcggucggggacgcgccgcugucggugccuuuguguguccguggcuuugcgcggcugcuuugcgcccguguccacguuugcgggccugcgcuuggcugugggcgucggugggcgcaucgcgugucuccgcguacguggucggugccugccgacgugucugggcuggguguccgcagagggugugcgcaccgagagcccaacgccgccccacccccccgcucccccgccguccccucgggcccacgacuuggcuccaaacuuuucucccgguuccucgggcaacagccccaguccuccccaccgcuacccggccgggggcgcagacagcccucccccucccccuccugaggucccaggacagcaaggggcugcgacgggauugguggucgggggaucggcagcgccuggggacuggcugggcaggggcugggcggagcgugcggacucccccucagaccccggcugggaggaagaggcgagcggugggucccaggcuccggcccugggcuggggagaggaagggacagggcggcuggcguugcccuccccgcgcuucuuggaaagagugugauccagaguugcgucuguuugguagggagacaggcuccgcuuugagacccacucuccguuugcagcccgcccccgggguagggggccaacccucggacccgguaggggagagggggacugccaguccagaucugggcaugcccgaggcgccggcucacaggacccggagcugggcugggggccgugggagccucacauacacagguuucaacugggacggccacuggccccugugcggcgcuggcaaguugcucagcuucgcggagucgcggucacucuggcacggacagggcgagaacucccucgcggcucggggcgugcggugggaauaacccgcgccucuggagccgggcggagagcagcgccagcccacacuuggccuggcgaggaggugacucaagaccuucgauucuucuuucaucuuugugcgcccugcccuucggauaagucuagacuugcagugccuggggcugaccggaggugggggggggggggugcucagagcugcaggagccugcugggcuuuugagccuaagucgcaaagauaaccguaaacacccuccuccccacugcucacuccagucuuuaaccuagaacuuugucggaugcugcagacaugauggaagggcacaggccgcuaaccugggaaagaaacaacugugggcauuuuccuuucccucuccggccucaguuucccuucuggaaggggagguauugauagccucuucuguucuggcugacugcuucagaucccagaacccagaaacacuuugauguuuaaccuacaccuccauucugaccugaccuauuccgaggcacuacuuugcuccccaggaaggcugcaaugcaaccgccaccgggcuuccaccuacccuuccuccaacaccaggaaaggcaaaagcugauaaaugagucaaaaauggagagggaagggagggggauugaccuuuucuccucuuacuuuuuaaaugacaguuuguggugguaaaguccagaucagucuucuucuuaaucauaacuccugggucaacacaggggaugcaguuaagaguucaugcuucaguuuucagagcaaggcuggccugggcacugaggacacuuccuaaagaggguuggguccucccugaaagccaccuggccaaaacaaguccuaagagggguucugugggaauaacccggagaaggggccugacaggagauuccuccugcucaugguuuugaagucaguggguacacaggggaggcaggaagaaucucccacaaaaggaucagcaugugcaggaccugugcaugaaaacagcacagguggucagcaugguggaccagcagacgcaaggucuugaggguggugaauuggaagugaacuugaggcugggaaggcagggaccaaaucaccaaggccuugaaugucaggccgagaagggggauuugagccuguaggcaauggagagcuccuggaggauuuaaacaggcacagcagggugcgguugguaauucuaugaaacccgucucuggcuuguggguggugcuggaggccgagagaccaaucuggagggcgagugauccagccucuuagagucaaagggacccagauuuuacucccaccccauugcuuccuaccucuguggccugggacaaguaacuuauuuaaaaugugaggauacuaauucuugcuccacugauuugguguauuaaauaagauaaugaauuacaugugcaaauaaauaaaaagugguuuguaguguguauuacauugugcagacauucauuggauugcacugacaauagaaggcagagacagcauugacucugguccuaaaccugaucucaccagcgggcagagcccuaagcauccugcaggguugcaccaauuguuauguuccccacaaagcagaagggagcuuucuguccaugacauuucauucaucugauuuaucaccuucauguggccaggcucgugcaggcaaggagguagacacagauucguagauggccacagaagugggccaguaccuugucgggggcagcccaagggccaugggcgcucacaggauggguggccuuuccuggaugagcggcagguuagacugggaaagccucacagaggagguggcuuuuugaaugaaaugugugagaguuugcugguagacaaagaaggguaucuuugcaucagagggaacaacgugugcaaaaaggcagguggcucuagaagagucacaggccucuagacuagaaagcugucucugugggauggguuuuaaagagggagcuguaguagggucccagacuucuguugggaagugcguucuggugccagcauggcuggcaguuggagucaggccaggagcgaggcuguugcagcaggucucuugagccugaccuggacagggggaggugacugcccagcuuagggaugagggaaagggaagacagugaccccaacugcccagggggaucugcgaauuugaugcugagcccucauucugucacaggcaacacagcagcuuuugccugcuuuggucucugagaccuuuccagcucacccuucccagucuccugggagugccuugucagcaucuuguagccacacugggauccuggaugguauguggagagaggauccaaggccucugggaugaauuguggauucuucuccaucuucagccccugccuucccucaggauuugcuggugucacagcaccuuuuucuucccuggucccugaaaucacucacuggggacaggaaccaacauucagugaauaccaacaugugccaggccaggucugggucuucacuuugccucauguaaucaucacagugacccguuaggaccagcacugggauuaucaccauauuacagacgaggacucagaggggugagggcacgagcaagccucagagcagugaaggcccuguuggguuggaacccagacugccuggcuacaaaacccuugcccucugccccauagcgccuccucauguguccauguacgcugccucagguugaugggaacuugaaaaucuucaagaagaagacauauugaaaggagaaaaucuuacugggagccuugcccaucucccuguagauuauccuccuuggguaaguugcuaggcuuacaggucccugcgaucaugucauggaggaggccagguacuggaugucagaauaccuggguccuggguccagccccuguccucucuggcugugugacucuggacagaucacagaaccucucuggacuucuuaacacagcuguaaaguagauaugacgccaucuaaccugcugauccugcagggugacugaacagaugguaguugaggaagcaugggagagguugagagguguccuuuggugagguagcgguauucuagaugcuuggugcaucuucacguggugucugcucuguaccaggcucagugcucagcuucaagggcauaaaaaggaaccuaaucgcaucccugcccacaguaggauagacaguuaaacauguaaguacaguucagcaugaccaggucuaagcacaugugcucauuuguaagcugaggcagaguggauuuggagcuaagacaucugggguuaaguccgggguccucuccuucccagcugaguaacauccauuucugugucugcaaaauagggacaguauccccagggucaaggcucuggugaggcagaagugagaugcugguggagagcacauggugggcugcuguguuuguccagaugugcugcauuggugggucuguugcaagagcuggcccucagggcuccgggagucuggccuugaaauucuuucugccuugcguuuccagagcugacaaagugguuggagggcaggacguuucugaaccauccaccuggggauuuccucggcaucagcuugagugaacucaugacugaggggagcagggugggaggcagcucuguguugaggaacagcugaucgagacaaaggccggucucgggggugcuggggcccuguaccaguggggcccugugccaacagugcccuguggaaguugucgagggcgguggggggagcuggaaaacuuuacagaccagagaugcuguagugcagcaccagggucaggcagcuggggccagguagguucaagcuggaacccaacacccagagagcuguccuuaucagcagacaccagggaagugacugaagaaugucaucacagccagucucggaccugcugugcuccuggcgccacacugggaacuuggguggggaggaacaugaaggaucacauggugacugccuucagaaggcuuagcaaaucaccgucauugucuaccacacauugaguauuuguguagcagauagugaguggaaugccugccauucugucauuuaauccuuucaacaaaccuguguucuuagcccuguugaggacccucggagcgggucccaagacuuacccaaggcugguagguacagagcuagguucacaccuggucugggucuugcgguugacccguucauccugcucuuccuccacacacccucuaggccuggcucugaucccaggugggggaaagaacacacagguaaaguaggcagggcaccgccccaagcugcuuacacaucaaguaggaaaacagcagguaacucacggcagagaauuuacugaaggaggccuguggguagccuguggggugagaggccaggagggagggguggcccgagggccugaguggacagaacaggcuuuguuuugcugggagcaggccaggggcaggcgggauggaugcaugcaguucuggcagucacaugaggcaucaggucccagguccugggcccugcucugccauuccuugcugucacugccccucucugggccccaguugcccaugauccccaaggggccuuccagcucccaagcccuggaauucuccaaguuuggagauguauuagcagaggcugagaguuguucaaaguccaucaagggaaggcuguucccacuuuggcugucaaggaggguucaaauccagaugaggggcuggggacaggugggaggggagaagaagguggugacaacuuacaggugccucgugcaugggagaacuugauuucuguagguaaaaagcagaacccaagagguuucugauaaggagagugauguggccaaagcuguuuuagaggugucucauagcagugugugcggugucaccuggggagaccugccuggagccuguuggggccguaccauuuacucuuuguccuugcaggccaucagcaaacuuagagucacuguggaccuggcccugugggcccaacaaugcaugauucauggccccugcacuggaaggccuuacgguauaucccccaaaucacagauggaugugguuucuaagcccuuguccuccuguucuuguguuuuauaaucuggucaaucaguggauaucuuguaucugcaggucaagauuuggaaaaaaauguugaaucuugacugaaagaucccuuucucccucagccuucuuugguggcuaccagucuucauuucucuuuuuccuggggguagaguacgggucccagagggaggcagugugaauacuguuacacagauaagaaaaccaaggcccaaagaaaacagggaaggucacacagauaguggcacaccugggacuagagccccagucuccuggguccaaagcugguguuagugaucuuguuauaaguuggucuucuguucucauugcuggucuguaagccccaugaggacagggacccuaguaucuaucccaucaccacccaccccccgccccccacucccuccuggccuagcccagugcuuuguauauacuuaguagaaauuuaggauaugcuuuuguuaaacuuuaaaauccugaaacucuggaguuggauuaucuaaacugaaccucuuacugugaagcuggagaaacugaggcacagaagggggaagagacuuguucagagaugagaugaggacaguccauggcagagcaggcacugagaccuagggcuccugaccauccugcaggacuucucuugucaccaggcacaguugcccugucaccucccugucagugccccagaguguggggagggaaguagucggugacugugucucagggggcuucaucuaccauuggcugcacauuugucagcguccuggugcugugcuggguguuucacacgaacgaucucuagcccuugcggcaacuccuugaggaagggaguguuaacuccauuuuaacuccccaugacuucugauaugguuuggcugugccccacccaaaucugaacuugaauuguaucucccagaauucccauguguugugggagggacccagugggagguaauugaaugcaggaagcuuuugcuuccuccucauuguaucuugccacugccauguaagaagugcguuuugcccuccgccaugauugugagaccuuccccggccacguggaauuguuaaguucaauuaagccacuuucuuuuauauguugcccagucucagguuugucuuuaucagcagcaugaaaaaggacuaauacaguaaauugguaccaguagagugggggcauugcugaaaagauacccaaaaacauggaagcaacuuuggaccuggguaacaagcagagguuggaacaguuuggaggguucagaagaagacaggaaaaugugggaaaguuuggaacuuccuagagacuuauugaauggcuuugcccaaaauccugauggcaauauggacaauaaaguacaggcugagguggucucagauggaaaugaggaacuuguugggaacuggagcaaaggugacuguuguuauguuuuagcaaagagauggcagcaauuugcuccugcccuagagauuuguggaacuuugaacuugagagcaaugauuuaggguaucuggcagaagaaauuucuaagcaggaaagcauucaagaggugaccugggugcuguuaaaggcauuccguuuuauaagggaagcagagcauagaaguuuggaaaauuuguagcuugacaaugcauuagaaaagaaaagaaaaugccauuuucugaggagacauuuaagccggcugcagaaauuugcauaacuugcagcugaauguuaacucccaagacaauggggaaaaugucuccagggcaugucagaguucuucaaggcagcccuucucaucacaggccuggaggcguaggaggaaaaaaaugguuucucaggccaggcccaggaucuccaugcugugugcagccuagggacuugguguccugugucccagacacuccagccaugacuaaaaggggccaagguacaacucagccauggcuucagagggugcaagccccaagacuucgcagguuccagaaccaccaucauucacugaccuugggcaggugacccaaucucucugagcauccacagaaggggauaauuguucauuuuacaaaacccaaaccaaagcucaacaccacuuggcagcuuccaugugguguugagccuguggguacacagaagucaagaauugagguuugggaaccucugccuagauuucagaagauguauggaaacaccuggaugcccaggcaaaaguuugcugcaggggugggacccucauggagaaccucugcuagggcagugcagaaaggaaaugugggguuggaguagagucccuacuggggcaccgccuaguggagcugugagaagaggggcaccauccucuagaccgcagaauggcagauccacuaacagcuugcacugugcaccuggaaaagcugcagacacucaacgccaguccgugaaagcagccagaaaggaggcugcacccugcaaagccacggggguggagcugcccaagacugugggaacccaccucuugcaucagcaugacucagauaugcgggacauggagucaaaggagaucauuuuggaacuuuaauaagauuugacugcccugcuggauuuugaacuugccuggggccuguagccccuuuguuuuggcuaauuucuuccauguggaacagcuguauuuacccaaugccuguacccccacuguaucuaggaaguaacuaacuugcuuuugauuuuacaggcucguagguggaagggacuugucucagaugagacauuggacuguggacuuuuggguuaauacugaaaugaguuaagacuuugggggacuguugggaaggcaugauugguuuugaaaugugagaacaugagauuugggagggaccagggguggaaugauaugguuuagcugugcccgcacccaaaucucaacuugaauuguaucucccaguauucccauguguugugggagggacccagugggagguaauugaaucauggggccagucuuucccgagcuauucucgugauagugaauaagucucacaagaucugauggguuuaucaggggcuucagcuuuugcuuccuccucauucucucuugccgccgccauguaagaagugccuuuugccuuccaccaugauuguuagaccuuccacagccacguggaauuguaaguccaauuaaaccucuuucuuuuguaaauugcccagucuuagguaugucuuuaucagcagcaugaaaacagacuaauacaacuucccagaguugcacaguguagcaagucacuccugcuaaagauggucagccaccuuccuuuuccgauccucaguuucucugcucuaaaauggggaugagacugcuggcucacagagugacugugcggacuaaaugaaagcauguguguccagcacuagcagagagugaggacuggcccugacugucacugucgucacuucccacugcaaaugcccagccccgggcauaggcccggcacagagcaggaaccccgggagaggugucuacugugcagggcugagcaaggaaccuaguucagugcccugggagcaucugcagacaguuaccuagguaacuccugccccuuuacaucagaugccucuuuacaucggcuguuacuaccauugccucaguucuguaucuucuggcugcugggugaugacugcccugugccugugcacagcccuucacaguuggcaguaaggguuaaucaacuuaggugaagagggcagggcagaaauugccacccuguagugcagaggacaaggcugaggcuuaaagaggggcagcgagagguccccucuggcgggauagcauuugggucguauuuugagcugcugguuacauaagugggagcucauaugaggccauuuggcauuucacggaccccuuguauaaucaccucugggaaucaaaggguaaucucagggccuuugugcuguuuguuuaaaccccaggaaggguggguaugaaugagcagaucagcuuagcaggggagguggggccuuuggugguaaugagcccugcggugaggagcucgcccaggggaacaaaaggggccugaagcaacuuaauauuuuccuuuugguuccagacauuggaacacucuguccugccucagcugggaccaugcccaggaugcaccugggcuggauuuaauccugaaauuggccucuacaaaagaaaggggugggagaggagggucccacauggggaggggggcaggggagaagagucccacuuuucccugccccugggcaaagccagagugcagaucaaguggcuagcccuuuaaaguuucaugcagggcugguaaugcaauccugcugcucccucccacccaccuuccagucuggaaggugggcaggucccuggcccaucuccucccccucucucaccuccuuccugaaguccagagggagggaugggcaggagggcaggggcccagagcagggccacccagaugaagagccuggcuagaaggaagcuuagugccuucugucucccaggcugcugaggggccacugugcagggccggggugacgacagacuauccaauuggucuaguuagaagcucccacugcccaacccucuccuucucaugcuggcaccacugagcaccaccaucccaggagcuacaguggacgugaacacaggcuuugaauccaacagcaguggguggugugaccauuagaugugacaacacguauguagcaccuggcaucuguagcagccaccacuguaauuguacagagggaacugagaucugaggagggacacuggcucaugccacagcaugugucagugggaaaagccccuccugcacccugccucuccaccagcuacucugccaguccugcuggaggcaacgcauaugaauauaguaauuggaguacaccaggccugggucccauuccugcccugcauuuuacuaguuugggguaaggcccuauuccucucugagccucuguuucuucaucuguauaaugggggaagcagccuaacugccugcccgagguuaaaggaagaaccaaagagguguaguagcuuaaucugcugguggcaagggacagaguaagggggaaagaggcuugggacagguguccccaaaacccaucugggaaucuggacacccacguuggacaccaggaugcccaaugagaagggaaguuccugccccuggaugacaggcuagggggacagggcagguggaguaugggugcgguggggcagucacugcaggccccauugcagggagggaguccuggucuugaaggccagccccggccagaccacaggugcuuucucugucaguguccccucuagugccacuccacucugcuguguggcuguccaaaagcgucuuaaccuaaggcccaguucccuuuugguaaaacagagaauuuucugccuuggaaggugguugugagggucagaugcgaccaugcuguggggcagccagaacagugccugacguguaacacuugcucagcagagaguggggcacccugggcacacccuacccucagcccuguggaugagccccucacccggggcccgaggucuagaccaaaccagggacucuggaccaucagagcuggagaggccagcccgagaaaccgucuagucugguggguuucaaacuggguuuccuaacacccuaggcagggauggugggcagaagucgagggcuucaggucccccucacuucagccagaccaggcccgccuucaucugcugcucuuguuuaagaaagggaucugcugcuucuaguugaaaauucaccaccuggccucacgccccuuaccauacaaauggagaggcagaggccagagaagaacugggacuaggaacucuggggaguguuccaggaagcauuccaggaggucggggucugugacaccuuccaacagugucuagacugggcucauguccugugugguggcuuuagaccaucuggugcauucauuccucaccuguggcucucuuucuagcccccaccaugccguggccccugcugcugcugcuggccgugaguggggcccagacaacccggccaugcuuccccgggugccaaugcgagguggagaccuucggccuuuucgacagcuucagccugacucggguggauuguagcggccugggcccccacaucaugccggugcccaucccucuggacacagcccacuuggaccuguccuccaaccggcuggagauggugaaugagucgguguuggcggggccgggcuacacgacguuggcuggccuggaucucagccacaaccugcucaccagcaucucacccacugccuucucccgccuucgcuaccuggagucgcuugaccucagccacaauggccugacagcccugccagccgagagcuucaccagcucaccccugagcgacgugaaccuuagccacaaccagcuccgggaggucucagugucugccuucacgacgcacagucagggccgggcacuacacguggaccucucccacaaccucauucaccgccucgugccccaccccacgagggccggccugccugcgcccaccauucagagccugaaccuggccuggaaccggcuccaugccgugcccaaccuccgagacuugccccugcgcuaccugagccuggaugggaacccucuagcugucauugguccgggugccuucgcggggcugggaggccuuacacaccugucucuggccagccugcagaggcucccugagcuggcgcccaguggcuuccgugagcuaccgggccugcagguccuggaccugucgggcaaccccaagcuuaacugggcaggagcugagguguuuucaggccugagcucccugcaggagcuggaccuuucgggcaccaaccuggugccccugccugaggcgcugcuccuccaccucccggcacugcagagcgucagcgugggccaggaugugcggugccggcgccuggugcgggagggcaccuacccccggaggccuggcuccagccccaagguggcccugcacugcguagacacccgggauucugcugccaggggccccaccaucuugugacaaaugguguggcccagggccacauaacagacugcuguccugggcugccucaggucccgaguaacuuauguucaaugugccaacaccaguggggagcccgcaggccuauguggcagcgucaccacaggaguugugggccuaggagaggcuuuggaccugggagccacaccuaggagcaaagucucaccccuuugucuacguugcuuccccaaaccaugagcagagggacuucgaugccaaaccagacucggguccccuccugcuucccuuccccacuuaucccccaagugccuucccucaugccugggccggccugacccgcaaugggcagagggugggugggacccccugcugcagggcagaguucagguccacugggcugaguguccccuugggcccauggcccagucacucaggggcgaguuucuuuucuaacauagcccuuucuuugccaugaggccaugaggcccgcuucauccuuuucuauuucccuagaaccuuaaugguagaaggaauugcaaagaaucaaguccacccuucucaugugacagauggggaaacugaggccuugagaaggaaaaaggcuaaucuaaguuccugcgggcaguggcaugacuggagcacagccuccugccucccagcccggacccaaugcacuuucuugucuccucuaauaagccccacccuccccgccugggcuccccuugcugcccuugccuguuccccauuagcacaggaguagcagcagcaggacaggcaagagccucacaagugggacucugggccucugaccagcugugcggcaugggcuaagucacucugcccuucggagccucuggaagcuuagggcacauugguuccagccuagccaguuucucacccuggguuggggucccccagcauccagacuggaaaccuacccauuuuccccugagcauccucuagaugcugccccaaggaguugcugcaguucuggagccucaucuggcugggaucuccaaggggccuccuggauucaguccccacuggcccugagcacgacagcccuucuuacccucccaggaaugccgugaaaggagacaaggucugcccgacccaugucuaugcucuacccccaggguagcaucucagcuuccgaacccugggcuguuuccuuagucuucauuuuauaaaaguuguugccuuuuuaacggagugucacuuucaaccggccuccccuaccccugcuggccggggauggagacaugucauuuguaaaagcagaaaaagguugcauuuguucacuuuuguaauauuguccugggccuguguugggguguugggggaagcugggcaucaguggccacaugggcaucaggggcuggccccacagagaccccacagggcagugagcucugucuucccccaccugccuagcccaucaucuaucuaaccgguccuugauuuaauaaacacuauaaaaaguucuuugcuuuacucagc

SEQ ID NO: 15286 - RNA, 8431 nt, Homo sapiens
caugagaccccagauccugcugcuccuggcccugcugacccuaggccuggcugcacaacaccaagacaaagugcccuguaagaugguaagaugcucugcccagacagggugaggaccacccccaccucccugcccuagggugugcuagugccccagccccagaagccagaaguuagaagagucaggagaggaaagggaauguaccuugcauuuaaugagcaccuacuagaauguuuaaacaccuuauuuacccacaguccugccagguaagcaccauuauucucauuuugcaaaggaggagacugaggcuuggagagauugggccuuguccaaggucauucagcugggaacagugaggcugauauuacacuguauucccccaagcuguccccacagagcaguaggcccagcuaggggaucuagaauauauauauauguguggggaauuugggguaggccagcugggaggggcuccucugugcucaucccucuuggagacaaauccccuuccaagcugggcuccuugacuugggacugcccgcuggagugccucucacuucuuagugcccagaucaaaugcugccaucuccaggaagccuccccagccccucccaggcuggccuagucugaucacaccuuccucuggguuccugcgguccccaggcuucccccuaucucaauacugagaagacugaacauguggggugguuggugaaaggguccaagccugucucaccugccagaccaugaacuucccuagggcaaggaccaaguuugauuugcuucuauuccuuuuuccugucccaagccagggaaacuagcccuaaaguucuugugacucuaugagauacagggcaaagagaacaccuagauccacuuguaaggccgggcagucacugaggccagagccuggcuggggaaagggcagggccuccggaagccccucuuggaccugagacucgaagaagcuuaugacacagaaccggcagcugcuucaggaggcaggaagugcaggcagcugccugcccgcagcccuucccugggggugcaaugucuccuguugccaccaccuuucuugcucuucagagcccuucuaagauucccggagcccagaauugcgggcagagaaggccucagaugucaccaaauacaaacgcacauucuaccucagggagacgaggcucagaggggaaaguccuugacuacccaacaggcagaggggaagcgggugaauuuuggagucuggggaaaugagauaagagauaggaaagcacuuucugaaccagcaugggaauaauacacacgggaaguaaggagaagaugugugacccaccagggaccuacaggauucgaacccagcugccuuugccacuguucacugccuggugccucucccuacucugcuuuccucccaugaucagguggugaaauggaguuggauggcaagucuuugcuucugaaaaggaagcugggcaguggguguccugauagcccaggacagugggugggagcucuaaacucuggucaagggccaauuccuccaauucccuccgacgguaagucaggcaaugcugggagcucagagcugaaggaggcaugaagacccuggaaguggagcucugagcaccgcccuggacuucaagcuucuuccuggacuggacuggagaucugggcaucccagugcagcccugcccaccaucaggcccccaggcuucuagagcaggggucuugggccccugaauggaaagccagucuugggcugugggcuuggcaaacuuuguguccuggaucaagucucaggggcuggugccccagggagccuuugccuauccagaggcaguaugccucugcacuugcccggggguaacacgcggggcacagcacggugccccccacacuguaacagucaguaaguggguccaugaugcucuuugcugugcugaccagcugagggcccaguggucagaacuuggcuggcaccaauaggaaaaggaauuugcaaaugggaguuuugagccccugacugucugaucuugggcagcccacuccccuuagccucaguuucguuagggguacaauaggaacagggugaacaaugccugggaagauuuaaugggguagggggucucugcacucagcacgcagccugacacagcuggggcuccaucacaggucauuuuguuguuucugcuuuaaguaaggaaugccccaggggguaagggcugugaggaggaggcuauguuuaguggccccugcagacagagagguugugagggaggaagggcaaggaugggcaaggcagcugggcagguuucagguucacacaggugcccaacugacggggcaucccugggccuccugaggccccugugaagcugccucccuuggaggcuacauggagucacugugcugcauggaguaagaagagccacacggaggccugaggcugggcaggucucuuccucccccuacucaccuuggggcucucaggaggaagcgcagagcuggaccaggggaggaacacaccggcuuguguucccucccuaccagcucagccacuggcucacugugaauucacgcaagucacugccaucuucaggccucaguguucacaucugggaagugggucagcugaacucuucuugcucuacccgucuuugacuauauuuugaaaauaucaauuaugcauuuucuuuccuccuagagaagugauugauucagugccucagaccuuuacuaaacugaugaugucugggacucauucauuaggaaaaauugacuugcuagucagguccaaggcaugcacauccaccaaaccagucccuguuugcucugagcucgcugucuagcagguccucacacacacagccacaauucagcggggcaaagcucugagaggaagcacagucagggagggcucccugguggaggaggcccugaagcucagugugaagaguucauguguggaucugguuggggauggcauaaccagcucagggagcaggccccagcagugggugugggagcgcaugaugggcaguggucagcuguggucacugcaugugggcuggggugggaggugggggacagguuggcaggggcuacaaacagccucgaaggcccugcuggggauccuggacuucaccguggagaaguuuaagccaagcugccucauugucagaguagagcuuuugagcaguugucaggcauuuagcagugagugggucagaacggguuggcggagacagaagcugggggcggugagccugagcccggugauuguggaagucagaccuuuuucugggaaaggcugggguuccuggaggccuggaagagaagagggagaccugcauuugcacaggaagaauuuuggucccagaaggcacaucuguggaagaacaagaguucggccuuuuguuguuaaaaaaccuggguucaaaucccagcucugcuccucaccagcugggcaauccuggcaccucccuuccccucccugagccuagauuucuguaaauaggggugaucguaucagaugggcaggcugugguaaagaccaaugggaccaugggccugaaaguauuaaccaagaugucaaaugcugaguggcugcuggggaagaacguaagaaaacagagugguuaugugacuuccuggaggucgcacagcacaaacacagucucaucaccaaagacuguggauuuggcucuggccaucuuuucccuggcccuucccaccuccaggggcccgguccccugacccagccugggaagaaagccaccuccuaggagguaacagcaacagagaggaagccacaucucggaagcauccacaaggaaggcaggccccaggacccaggcucugcccaugacacgagagccugaaugaggucugaggcagggaggccaagauaaaaacugaugacagagcacaaauuacaguuuucccuuuuggaaacauuucucccaaaguggagaaauucccaucuaccaccagaaauuuaacuaucugugcccauagaagggaccuaggacauagaaucaggagcccugggucccagcucugcccugcugcucacuggcuuggggucacucugugggauauauggcuguuuccuguaagagggguaauaauaaguacaggguuucucuuuguuaguuuauuuguccuucuaucugucuaucaucucuccaucuguccacccauggaaccuucaucgaguuccuuccuuaaugcccauuacugcgcugggugcccgagauggggcagggagccggaugggucauccaggcauggggugaucaggcugcggugggggaaaguugagcauucugggaguccaugggagaaggguuccccagccaggcaggguuccuggauaaacaugucugguuucauccccuaccgugcccacuuaugccagcugucuccccacccuaccccuccccagguggacaagaaggucucgugccagguucugggccugcuccagguccccucggugcucccgccagacacugagacccuugaucuaucugggaaccagcugcggaguauccuggccucaccccugggcuucuacacagcacuucgucaccuggaccugagcaccaaugagaucagcuuccuccagccaggagccuuccaggcccugacccaccuggagcaccucagccuggcucacaaccggcuggcgauggccacugcgcugagugcugguggccugggcccccugccacgcgugaccucccuggaccugucugggaacagccuguacagcggccugcuggagcggcugcugggggaggcacccagccugcauacccucucacuggcggagaacagucugacucgccucacccgccacaccuuccgggacaugccugcgcuggagcagcuugaccugcauagcaacgugcugauggacaucgaggauggcgccuucgagggucugccccgccugacccaucucaaccucuccaggaauucccucaccugcaucuccgacuucagccuccagcagcugcgggugcuagaccugagcugcaacagcaucgaggccuuucagacggccucccagccccaggcugaguuccagcucaccuggcuugaccugcgggagaacaaacugcuccauuuccccgaccuggccgcgcucccgagacucaucuaccugaacuuguccaacaaccucauccggcuccccacagggccaccccaggacagcaagggcauccacgcaccuuccgagggcuggucagcccugccccucucagcccccagcgggaaugccagcggccgcccccuuucccagcucuugaaucuggauuugagcuacaaugagauugagcucauccccgacagcuuucuugagcaccugaccucccugugcuuccugaaccucagcagaaacugcuugcggaccuuugaggcccggcgcuuaggcucccugcccugccugaugcuccuugacuuaagccacaaugcccuggagacacuggaacugggcgccagagcccuggggucucugcggacgcugcuccuacagggcaaugcccugcgggaccugcccccauacaccuuugccaaucuggccagccugcagcggcucaaccugcaggggaaccgagucagccccuguggggggccagaugagccuggccccuccggcuguguggccuucuccggcaucaccucccuccgcagccugagccugguggauaaugagauagagcugcucagggcaggggccuuccuccacaccccacugacugagcuggaccuuucuuccaauccugggcuggagguggccacgggggccuugggaggccuggaggccuccuuggagguccuggcacugcagggcaacgggcugaugguccugcagguggaccugcccugcuucaucugccucaagcggcucaaucuugccgagaaccgccugagccaccuucccgccuggacacaggcugugucacuggaggugcuggaccugcgaaacaacagcuucagccuccugccaggcagugccauggguggccuggagaccagccuccggcgccucuaccugcaggggaauccacucagcugcugcggcaauggcuggcuggcagcccagcugcaccagggccguguggacguggacgccacccaggaccugaucugccgcuucagcucccaggaggaggugucccugagccacgugcguccugaggacugugagaaggggggacugaagaacaucaaccucaucaucauccucaccuucauacuggucucugccauccuccucaccacgcuggccgccugcugcugcguccgccggcagaaguuuaaccaacaguauaaagccuaaagaagccgggagacacucuaggucagugggggagccugagguacagagaagagugaggacugacucaaggucacacagugauccgggaucccagaacucuggucuccaaauuacagcccaggacaccuuucucugccgccugcugcaucagugggugacccccuucccgggcugcacuuuggguccagcuguggaagccagaaguugggcgguuucagggacagccgagaauaauguugaccugucagaucaacaaaucuucacugagcauguauuuugugccacacccugcucugggcacugggaaugcugggaaaugagauacauucccgcccucaagaaucucccagucugguaggagagagugcugcagagccacguggccgccacgcagugugcuuagggccugaggugugaaagcccagggcuccagagcucggcaggccccgcugguuuggugcggugaguccugccccggcugugccagggugagggagggccaagcccaggaggauuugucugagacauuuccaagcagacuguuugucacgucuucugagaaugacuuucagucucucugaaaaugaaaagcuuaggaccagaagagagaauuggagcuguacgagugugucucggaucugguguuguuaggugggccacggcggcuccagcagggucugguuaagggguccagcccagcacuggaccauuccgucuccugcucuggacuugcccucucccuuccuggcacucucauguugcauacccugaccccagugcugcucuaagcaccgucccugcccagccccacuucuccaucgcagccccaccuuggcugcugagccaggagcuaaaaccuuagauaucugguucuguuuugcacccagcuuggcagauguggauuugaauccaagccuugugucugccccuaugugacagcucuauauuuuauccccguuuuauaaaagaggaaacugaaguucugaaaaucuccuuccagggccccagcuaacuaaugccauaggugagauucaaaccuucauccuucugucuccagggccugaucuuuaccacugcaggggcugcaggccguuaaguggacaggaaguggccccacauagcccgagcagggucuggaagcauccugugcugugcacaccugcucucuccucucucccaggcaggcagcugcaggcgcucuccuccuucucugccuguuucccuccucccuuccuuuccacccugguguggguucuccuguucucucugugcucuugcauucucucauucccuuuuccucuauugagcagagccuggaguuugagacuauggaauccaaccuccccauugcacagauggggaaacugaggcuuaggaagagaaugaaacuuguggagagcuuauacagagccucugggggaaaaaagagcccuuauuuguggggugagauuggggguuggaccagagugauguccucucucagcuaucacaucacaagauaaugcuggcuccaaacuuccuuucugugccucaucaugcaaggaucuuuuuucccucuuacaaaaacagguaaaaagccucacccagaugacccccaucccucauaccauggagucaugagcugucugggaagaauggacgugcugggaccaacucaagaccuuguuuugcugucuucaucaucuuaccugugcuuggcccacagucuggcucaugaugugggcucaguaaugugcgagaaagugaaaaugccacucucuccaccccauuuuacagaggagaacaccaaggcccagaggaaguuaagggagagucaaugggcagagccagggcuaggcccuggugguguguggagcacccaggcagacccaguccugguugggaucacacccacgggugcuacugcacguaacacuccuccuuaggccuggaggccaagguguggguccccacgccugaucuuugaaaacacuacacagggcugcugucacuucccagggcccaggccucagcccaggccucgggaccaacucuuuguauaaccuaccugaauguauuaaaaacuaauuuuggagaagc

SEQ ID NO: 15287 - RNA, 8431 nt, Homo sapiens
gcuucuccaaaauuaguuuuuaauacauucagguagguuauacaaagaguuggucccgaggccugggcugaggccugggcccugggaagugacagcagcccuguguaguguuuucaaagaucaggcguggggacccacaccuuggccuccaggccuaaggaggaguguuacgugcaguagcacccgugggugugaucccaaccaggacugggucugccugggugcuccacacaccaccagggccuagcccuggcucugcccauugacucucccuuaacuuccucugggccuugguguucuccucuguaaaaugggguggagagaguggcauuuucacuuucucgcacauuacugagcccacaucaugagccagacugugggccaagcacagguaagaugaugaagacagcaaaacaaggucuugaguuggucccagcacguccauucuucccagacagcucaugacuccaugguaugagggaugggggucaucugggugaggcuuuuuaccuguuuuuguaagagggaaaaaagauccuugcaugaugaggcacagaaaggaaguuuggagccagcauuaucuugugaugugauagcugagagaggacaucacucugguccaacccccaaucucaccccacaaauaagggcucuuuuuucccccagaggcucuguauaagcucuccacaaguuucauucucuuccuaagccucaguuuccccaucugugcaauggggagguuggauuccauagucucaaacuccaggcucugcucaauagaggaaaagggaaugagagaaugcaagagcacagagagaacaggagaacccacaccaggguggaaaggaagggaggagggaaacaggcagagaaggaggagagcgccugcagcugccugccugggagagaggagagagcaggugugcacagcacaggaugcuuccagacccugcucgggcuauguggggccacuuccuguccacuuaacggccugcagccccugcagugguaaagaucaggcccuggagacagaaggaugaagguuugaaucucaccuauggcauuaguuagcuggggcccuggaaggagauuuucagaacuucaguuuccucuuuuauaaaacggggauaaaauauagagcugucacauaggggcagacacaaggcuuggauucaaauccacaucugccaagcugggugcaaaacagaaccagauaucuaagguuuuagcuccuggcucagcagccaagguggggcugcgauggagaaguggggcugggcagggacggugcuuagagcagcacuggggucaggguaugcaacaugagagugccaggaagggagagggcaaguccagagcaggagacggaaugguccagugcugggcuggaccccuuaaccagacccugcuggagccgccguggcccaccuaacaacaccagauccgagacacacucguacagcuccaauucucucuucugguccuaagcuuuucauuuucagagagacugaaagucauucucagaagacgugacaaacagucugcuuggaaaugucucagacaaauccuccugggcuuggcccucccucacccuggcacagccggggcaggacucaccgcaccaaaccagcggggccugccgagcucuggagcccugggcuuucacaccucaggcccuaagcacacugcguggcggccacguggcucugcagcacucucuccuaccagacugggagauucuugagggcgggaauguaucucauuucccagcauucccagugcccagagcaggguguggcacaaaauacaugcucagugaagauuuguugaucugacaggucaacauuauucucggcugucccugaaaccgcccaacuucuggcuuccacagcuggacccaaagugcagcccgggaagggggucacccacugaugcagcaggcggcagagaaagguguccugggcuguaauuuggagaccagaguucugggaucccggaucacugugugaccuugagucaguccucacucuucucuguaccucaggcucccccacugaccuagagugucucccggcuucuuuaggcuuuauacuguugguuaaacuucugccggcggacgcagcagcaggcggccagcguggugaggaggauggcagagaccaguaugaaggugaggaugaugaugagguugauguucuucaguccccccuucucacaguccucaggacgcacguggcucagggacaccuccuccugggagcugaagcggcagaucagguccuggguggcguccacguccacacggcccuggugcagcugggcugccagccagccauugccgcagcagcugaguggauuccccugcagguagaggcgccggaggcuggucuccaggccacccauggcacugccuggcaggaggcugaagcuguuguuucgcagguccagcaccuccagugacacagccuguguccaggcgggaagguggcucaggcgguucucggcaagauugagccgcuugaggcagaugaagcagggcagguccaccugcaggaccaucagcccguugcccugcagugccaggaccuccaaggaggccuccaggccucccaaggcccccguggccaccuccagcccaggauuggaagaaagguccagcucagucagugggguguggaggaaggccccugcccugagcagcucuaucucauuauccaccaggcucaggcugcggagggaggugaugccggagaaggccacacagccggaggggccaggcucaucuggccccccacaggggcugacucgguuccccugcagguugagccgcugcaggcuggccagauuggcaaagguguaugggggcaggucccgcagggcauugcccuguaggagcagcguccgcagagaccccagggcucuggcgcccaguuccagugucuccagggcauuguggcuuaagucaaggagcaucaggcagggcagggagccuaagcgccgggccucaaagguccgcaagcaguuucugcugagguucaggaagcacagggaggucaggugcucaagaaagcugucggggaugagcucaaucucauuguagcucaaauccagauucaagagcugggaaagggggcggccgcuggcauucccgcugggggcugagaggggcagggcugaccagcccucggaaggugcguggaugcccuugcuguccugggguggcccuguggggagccggaugagguuguuggacaaguucagguagaugagucucgggagcgcggccaggucggggaaauggagcaguuuguucucccgcaggucaagccaggugagcuggaacucagccuggggcugggaggccgucugaaaggccucgaugcuguugcagcucaggucuagcacccgcagcugcuggaggcugaagucggagaugcaggugagggaauuccuggagagguugagaugggucaggcggggcagacccucgaaggcgccauccucgauguccaucagcacguugcuaugcaggucaagcugcuccagcgcaggcaugucccggaagguguggcgggugaggcgagucagacuguucuccgccagugagaggguaugcaggcugggugccucccccagcagccgcuccagcaggccgcuguacaggcuguucccagacagguccagggaggucacgcguggcagggggcccaggccaccagcacucagcgcaguggccaucgccagccgguugugagccaggcugaggugcuccaggugggucagggccuggaaggcuccuggcuggaggaagcugaucucauuggugcucagguccaggugacgaagugcuguguagaagcccaggggugaggccaggauacuccgcagcugguucccagauagaucaagggucucagugucuggcgggagcaccgaggggaccuggagcaggcccagaaccuggcacgagaccuucuuguccaccuggggagggguaggguggggagacagcuggcauaagugggcacgguaggggaugaaaccagacauguuuauccaggaacccugccuggcuggggaacccuucucccauggacucccagaaugcucaacuuucccccaccgcagccugaucaccccaugccuggaugacccauccggcucccugccccaucucgggcacccagcgcaguaaugggcauuaaggaaggaacucgaugaagguuccauggguggacagauggagagaugauagacagauagaaggacaaauaaacuaacaaagagaaacccuguacuuauuauuaccccucuuacaggaaacagccauauaucccacagagugaccccaagccagugagcagcagggcagagcugggacccagggcuccugauucuauguccuaggucccuucuaugggcacagauaguuaaauuucuggugguagaugggaauuucuccacuuugggagaaauguuuccaaaagggaaaacuguaauuugugcucugucaucaguuuuuaucuuggccucccugccucagaccucauucaggcucucgugucaugggcagagccuggguccuggggccugccuuccuuguggaugcuuccgagauguggcuuccucucuguugcuguuaccuccuaggagguggcuuucuucccaggcugggucaggggaccgggccccuggaggugggaagggccagggaaaagauggccagagccaaauccacagucuuuggugaugagacuguguuugugcugugcgaccuccaggaagucacauaaccacucuguuuucuuacguucuuccccagcagccacucagcauuugacaucuugguuaauacuuucaggcccauggucccauuggucuuuaccacagccugcccaucugauacgaucaccccuauuuacagaaaucuaggcucagggaggggaagggaggugccaggauugcccagcuggugaggagcagagcugggauuugaacccagguuuuuuaacaacaaaaggccgaacucuuguucuuccacagaugugccuucugggaccaaaauucuuccugugcaaaugcaggucucccucuucucuuccaggccuccaggaaccccagccuuucccagaaaaaggucugacuuccacaaucaccgggcucaggcucaccgcccccagcuucugucuccgccaacccguucugacccacucacugcuaaaugccugacaacugcucaaaagcucuacucugacaaugaggcagcuuggcuuaaacuucuccacggugaaguccaggauccccagcagggccuucgaggcuguuuguagccccugccaaccugucccccaccucccaccccagcccacaugcagugaccacagcugaccacugcccaucaugcgcucccacacccacugcuggggccugcucccugagcugguuaugccauccccaaccagauccacacaugaacucuucacacugagcuucagggccuccuccaccagggagcccucccugacugugcuuccucucagagcuuugccccgcugaauuguggcugugugugugaggaccugcuagacagcgagcucagagcaaacagggacugguuugguggaugugcaugccuuggaccugacuagcaagucaauuuuuccuaaugaaugagucccagacaucaucaguuuaguaaaggucugaggcacugaaucaaucacuucucuaggaggaaagaaaaugcauaauugauauuuucaaaauauagucaaagacggguagagcaagaagaguucagcugacccacuucccagaugugaacacugaggccugaagauggcagugacuugcgugaauucacagugagccaguggcugagcugguagggagggaacacaagccgguguguuccuccccugguccagcucugcgcuuccuccugagagccccaaggugaguagggggaggaagagaccugcccagccucaggccuccguguggcucuucuuacuccaugcagcacagugacuccauguagccuccaagggaggcagcuucacaggggccucaggaggcccagggaugccccgucaguugggcaccugugugaaccugaaaccugcccagcugccuugcccauccuugcccuuccucccucacaaccucucugucugcaggggccacuaaacauagccuccuccucacagcccuuacccccuggggcauuccuuacuuaaagcagaaacaacaaaaugaccugugauggagccccagcugugucaggcugcgugcugagugcagagacccccuaccccauuaaaucuucccaggcauuguucacccuguuccuauuguaccccuaacgaaacugaggcuaaggggagugggcugcccaagaucagacagucaggggcucaaaacucccauuugcaaauuccuuuuccuauuggugccagccaaguucugaccacugggcccucagcuggucagcacagcaaagagcaucauggacccacuuacugacuguuacaguguggggggcaccgugcugugccccgcguguuacccccgggcaagugcagaggcauacugccucuggauaggcaaaggcucccuggggcaccagccccugagacuugauccaggacacaaaguuugccaagcccacagcccaagacuggcuuuccauucaggggcccaagaccccugcucuagaagccugggggccugauggugggcagggcugcacugggaugcccagaucuccaguccaguccaggaagaagcuugaaguccagggcggugcucagagcuccacuuccagggucuucaugccuccuucagcucugagcucccagcauugccugacuuaccgucggagggaauuggaggaauuggcccuugaccagaguuuagagcucccacccacuguccugggcuaucaggacacccacugcccagcuuccuuuucagaagcaaagacuugccauccaacuccauuucaccaccugaucaugggaggaaagcagaguagggagaggcaccaggcagugaacaguggcaaaggcagcuggguucgaauccuguaggucccuggugggucacacaucuucuccuuacuucccguguguauuauucccaugcugguucagaaagugcuuuccuaucucuuaucucauuuccccagacuccaaaauucacccgcuuccccucugccuguuggguagucaaggacuuuccccucugagccucgucucccugagguagaaugugcguuuguauuuggugacaucugaggccuucucugcccgcaauucugggcuccgggaaucuuagaagggcucugaagagcaagaaaggugguggcaacaggagacauugcacccccagggaagggcugcgggcaggcagcugccugcacuuccugccuccugaagcagcugccgguucugugucauaagcuucuucgagucucagguccaagaggggcuuccggaggcccugcccuuuccccagccaggcucuggccucagugacugcccggccuuacaaguggaucuagguguucucuuugcccuguaucucauagagucacaagaacuuuagggcuaguuucccuggcuugggacaggaaaaaggaauagaagcaaaucaaacuugguccuugcccuagggaaguucauggucuggcaggugagacaggcuuggacccuuucaccaaccaccccacauguucagucuucucaguauugagauagggggaagccuggggaccgcaggaacccagaggaaggugugaucagacuaggccagccugggaggggcuggggaggcuuccuggagauggcagcauuugaucugggcacuaagaagugagaggcacuccagcgggcagucccaagucaaggagcccagcuuggaaggggauuugucuccaagagggaugagcacagaggagccccucccagcuggccuaccccaaauuccccacacauauauauauauucuagauccccuagcugggccuacugcucuguggggacagcuugggggaauacaguguaauaucagccucacuguucccagcugaaugaccuuggacaaggcccaaucucuccaagccucagucuccuccuuugcaaaaugagaauaauggugcuuaccuggcaggacuguggguaaauaagguguuuaaacauucuaguaggugcucauuaaaugcaagguacauucccuuuccucuccugacucuucuaacuucuggcuucuggggcuggggcacuagcacacccuagggcagggaggugggggugguccucacccugucugggcagagcaucuuaccaucuuacagggcacuuugucuugguguugugcagccaggccuagggucagcagggccaggagcagcaggaucuggggucucaug

SEQ ID NO: 15288 - RNA, 31317 nt, Homo sapiens
ugugggaaggaggcggcagcgucucgggcgggcgggaggugcaccagcggcggcggcggcgguaaauccucccggccgcucacagcacuguggagccgcguccccagcccggccucggaccgcggcaccccuccuggcccucgcggcuucuagcccgcccgccccucccccgcgcgucggcccugccgagccggccggccggccuggcuccccuccccggccccgacgggcgggcggacugcccugaggaggcggggaggggagggcugggccggccggcgggcgggcgacgaugccgaacuucugcgcugcccccaacugcacgcggaagagcacgcaguccgacuuggccuucuucagguucccgcgggacccugccagguaagcggcgggcgcagagcgggcggcccgggcccaccuucgcggugagcgcugccagccgccggccccuggcgggcucccgggcuggcugagaggggcgcaggaggcgggcgcagcgcacugccgucgaccccagcguuggaccgagauggggagccggccccgagccgugggcgggcgggcguccggggaccucggagcacgugcgcuggugggggcucugcgcggaggacaccaccccaaacgcgagggagcuggggcggcgcgcggacgcgggaugcuguggguucucgccguggcucacuugcugugugaccucgggggagucgcuuuccucucugggcguuaguuuccuuagcugucaaaagagagcaggacucuaugguuguggccacuggggccuuucccucuccuugccaccacccccgggacaguguuucuguuuugagucccgcuaccuucuuucaucucaucgcaacugcuuucuccuucggacuugucauugcacgguucaggauucauuuucuggcugucaccguuacucauuuucucgcuuggguauuguagggauaacagaggguguacgcgugagggcguggaaauugguauuggaaccucuuccuucggauaacccccacacacugacauauuuagggaaugauagcauagggacuguguuugaaaggcugagauguuucauaggccugucuuguugguucauucauuuaaaaucaaugccuacuaugugccgagcgcaaauguuaggugcugggaguucaugggugaauaagggugucacugcuugcagaaagcucucaguccaguaagggaacaggugcagcaacgggcgacuauaauuuauguuauuuauuaauuaguucaauuaauuauugaaggucuacuuguguuggcauuguugugagcaguggggguuacagaugaacaaaucgaaguccuugcuuucaugaagauuacauucuaauggggggggaauaaacaaguaaaauacguagugugucggaugaugauaaauacuguggagaaaaauaaacaaagguuagaggguaggggaauaaguaguaucaagggacgcacaauugcuauuuuaaauacagugauuagagaaggccucacuaagaaggugaauuugagcaaagaccaggugaaggggccagccauggagauaccuugggcagcagcauuccaaagaaggcaaagacagggcaaccaggaguccagggagagggacugggagagaggugagaugagaccagaaagguguguguaugguaggggcaaauucuuuagguaggaccuuguaggucuuggaaggcacuaugguuuuuauuaugagugaaauaggaagucauugaaggguuuagagcagagacuuaaauuuuaacaggaucaguggcugcucauuagauuguggggaggcaaaggugaaagccggaagaccaguuaaaaggcuguuguaauaauccagauuaauagaggaggagaugguaaauuugagauaugguuugaaggugaagccaacaucauuugcuaaugguuuggagguagauuguaaaagaaaaagagaacuuaaggacgacuucaagauuuuaaaaaucuauguuggccagguuggucuugaacuccuggcuucaagcaguccuccugugucggucucccaaagugcuagaacaggcucugagccaccgcgcccagccgacuucaagauuuuuaacgugagcauuugcugagauagggaagacugggaagagcagguuugguagaggaauacuagaaguuuggguuugagagaccugauagacauucaagaauagaugucuaggccgggcaugguggcucacaccuguaaucccagcacuuugggaggccuaagcaggcggaucacuugaggucaggaguucgagaccagccuggccaacauagggaaacccugucucuauuaaaaaauacaaaaauuagcugagcccaguggugcgugccuguccagcuacucaggaggccaagacgugagaaucgcuugaacccaggaggcagagguugcagugagccgagaucgugccacugcacuccagucagggugacagaacaagacuccgucucaagaaagaaagaauagaugaaaaaaaaaaaagaauagaugucuuucuucauaccauauacagaaaugaacuccaaauggccuauacuuuuauugagaucaaaggccuaaauauaagagcuaugucauuaaacuuuuaggaaaaaaauacagauaaaucuucaugacuuuagauuuggcagcacauucuuguuuguuuuuuguuuuuuuugagagucucacucuguugcccaggcugcagugcaguggcacagucucagcucacugcaaccucugccaccgauguucacaaacuauucuacucacucagccucccagguagcugggauugcaggcauccgccaccaugccuggcuaauuuuuguauuuuuuuuuagucaagacgggguuucgccauguuggccaggcuggucucgaacuccugaucucaggugaucugcccgccuuggccucccaaagugcugggauuacagguguaagccaccgugcuuggcuggcaccacauucuuagauaugacaccaaaauacaugcaguaaaaagaaaaauagacuaauuggacuucaucaaaauuaaacuuuuguguaucaaagaacauuaccaagaaagugaaaagaauggaagaagguacuugcaaauaauacauuugaucuggguccaguauccagaauauauaaagaacucuuacaauucagcaacaaaaagacaacccaauuuuaaaauaggcaaaggacuucuuucuuuaaacagaagauauaaauggcuaaaaagcacaugaaaagaugcugagcaucacucguuauuagagaaguucaaaucaaaaccacaaguggcaguuagauguagaauuacugugugucccagcaauuccauuccuaggcguauauccaaagaauugcaaacugauauucaaaaaaaccaaauguacacacauucauagcagcacuauucgcaauagucaaaagguagaaacaagccacguuuaucagugcuugaauggauaaacaaaauguauaucaauacaaugaaauauuagccaugaaaaggaaugaagugccaguacauacuacaguaugggugaaccucagaaacauuaugcuaagugaaagaagucagauacaaaagcuuauauguuguaugauucuauuauauuaaauauccagaauaaguaaauccauagagauagaaagcauaucagugguugccuggggcugggcgaaagggagaguggggagcaacugauuaaugguuacaagguuuccuuuugaggugaugaaaauguuuuagaauuagguaguggugaugguugcagaacaugaugaauguguuaauugccauuaguuuuuuacuuuaaaaugguuaguuuuauguuaugagaauuucaccucaaagaaaauagaugucuugaagagagaauaggauauacaagucugaaauucagagacuuucaaaccggaaauuguaaauauggguguucucaguuuauagaggguauuuaaaaccgugguacggguuaagguuaucuaaggagugagcaaagaacagaucugaggauugaguccuggggcauucccaguguuuuaaguuccgagacaugggaaagaacucgcucaguacagugaggaguagcaguugggaacagaggagaggagcaucuuagucugacuuggccuugccccauuaugcguuaucuuccuuuuacccaaauuuuagcccaaagacauucuuacagguuuauuucacuuccauaaugagggcaccccuagucaguucuggaccacaggucauuuguauuaauauguagugaauccuguuuugacuacacuccuuaaggggaguauagucuauagggguuuacaguuucagauuugaaagaaguguuuagaucuagugaaaucucacuugaaauacuggaauuuucucaauaauagugacuuuuaucauuuuuaggguuauuaucccuuuugagaaucuagcauaaggacucuuaccugaaaaaaaaaaaaaaacaaaaaaaacauagacacaauuuagcauucgaagacaaagauguuuaugggccuuuauaggcccugugcauuccugacagaugggcaucuuugcccuugcuaaaacaccucuaaugauaguccuccccuuugugagaagacacgugaugauucuggacgcuuuggcuguuguuucuuccuuguauugaguggacaucugccuccuguaauugaggccuuggagguccuaguuuuguucccaggaucacacgaagucucugcccuuuucaacguuagacuccuuugaaugcuucaagaccaaaucaugaauuucuuuuuaaaaagauguuuauugagaugcaauucacauauaauucacccauguaaaguguacgauuugggguauauacauuaauuuuuaaaauuuugguaaaauacaacagaauuugcuaauuuaaccuuuaagugugcaauucaguggcguuaauuacauucacaguguugugcaaccuucuccacuauuuucaaaacuuuuucauuuaucccaaacaaaaacuguaaccauuaggcaauaaccucccauuccccugcccuuccagccuuugguaaccucgaauccacuuucggucuuuauaaauuugccuguucuagauuccucauauugguggaaucauacaauauuucuccuuuuaugucuggcuuguuuaacuuaauauguucaaggucuuuuuauccaaaucaaaccuccucguacuacaugauuuuaaguucuacuguauuugauaguuuccauuucacugugcccaguguuauuuauaacaaagaaguaguuuccagagguguuauugaauuaauaacaguauuuuuaggguuauuaguucuaacccaccccccccccaccuuuucuucuauaaacagguuguagggaagguugauaaaaggugacauugccagucuagucuucaaaugcuaacauuguuaacaaacaauaaagaugaauauauuuaaugcuauuaaaacaguacauuucccagucaucaguuauaaauuccaugcaugcuuuuagaaacagcuauuuagaaauaauuuaaacuucaagaguguaauuaauaaaguguaugguguggaaucacauaccauaauaguucuuauuguuuuagaaaacguggcauuaauaugcuucuuuuuuaaaaaagugaaauaaucaacccagcuuaggucagugacacgguuuaaguaaaaaaaaaaaaaaaaagccuaagucuugauugccccaggguggcuugccuaaugccaaggcuugccacugugaggcagcucacaguggagcucuuccuaaaccaggagaugguacagguagagcuaaugaauugcucugauuagagugagaugggcguugaagcucucuucuuccuccucaggcagcuaguacuaacucacccaagaugggugagggcuuccaagguucuucuggcaauuuaaugaaggcugauugagagcuggugugcucuacuuugugaaauguaaaacagugguuuucuggggacucgugagggugccuguuugggcuguuauaacaaaauaccuuagacuaggugauuuuuaaacaacagaaauuuauuucucauaguucuggaagcugggaaguccaagauaaagucaccagcagauuuggcaucuggugagggcucacucuuggcuucuuagauggugccuucuuguuguguucucacauggcggaaggggcaaauaaggcuuccccgucaugaccuaagucaucucccagaugccccaccucccaacaccacugcacuggggauuguuucaauaugaauuuugaggggaugcagacauucagaccauagcaauccccaagauccuuucagggaguccacaaugucagaacuauuuucauaauaacacugauauuauuugcauuuuucauauuuggucucucaggaguggacaguggaauuuuuggguugcuacauaacaugauggcaucauugcuuugauaaauuuuguguuguguuuucuagaauuuucuaaauauuauucagaucugaguguucaguagacauuuucucagaaauaaacaagccugccacuucaaggagaacaacugauaauuugagcauucaaguugaaaauuagaauuuuggaaaauuuaugugccacugugagcuugacagcucucuaauacuuaaagacuuuucuggugagaucacugaugauacugauguguuuuuuuuuuuuuuuguauaaugaauugcauuaacauuuauaugguauguauaacucacugaacuaauauuuuccaaaugaccaauuuaugguuuuacagagacauacauggauaaaagugcaagauagacuaugggauuuuuuauguacuagggcaugaaaaagcucauuggucuggucucagaugucacauuucaacuaaucuugaagaaacuaccacuuguggagaauucacaauuauauggaaaaaagaggaguauuguaauaaccuuuuuaacugcauaucguuaugaggcuagauuuucuucauauauuucaaccaaaacaacauauagcaauagauuaaauacagaagcagaugugagaaucuagcugucuucuguuaagcuggacguuaaagagauuugcaaaaaugaagaagugucauuuuucucacuaaauauuuuuguuuuggaaaaugcaauuuuuuauuaaaacguuauuuguguuaacauaagguugguauuuuaaugaauuaauaaauauuuuuaaaauuuuucugauaaauguuguuagguaaaauccacauaaaagaucuuuggaguccucaauaauguaauagugcaaaggaauccugggacuaugaaguuugagaauugcugcucuaaaaugugagcagcaaauuucaaacuuuuuuuuuuuuugaggggucuuacucugucacucaggcuggagugcaguggcaggagcauggcucacugcagccucaaccaccugggcucaagcaaucuuccagccucagccacccaaauaccugggacuauaggugcccaucacaacccccggcuaauuuuugaaaaaaauuuuuuuuagagacagggucucaccauguugcccaggcuggucuuggacuccugagcugaagcauuccccccuuguucagccucccaaagucuuaggauugcagaugugagacaccacgcccagccugaaguacuuucauaucaacucauuuaaucuuccaaacaauggggugaguuguaauaauaguacuucuuuuuccuuuuuuuuuuuuuuuugagacagugucucacugucacccaggcuaaagugcaaugacacgaucuccagucauugcaaccucugccuccugcgcucaaguaauucuccugccuuauccucccaaguagcugggacugcagguacauaccaccaugccuggcuaauuuuuauauuuuuuguagagacaggguuucgccauguugcccaggcuggaacaguacuuacguaguguauucuuugugacaggcacugcucuguuauauacuucucuguuauauauacauuauuucauguuacccuugcaguaaauuuugagguaguccuugcuuuacagaugaccaaaguagguacagagagguuagcuaacuuuuuuaaaggcccugcagaaaugucuaaaaccuuaagagcagguaggacaggauaaaauagguauuacccgaacuuuuuugaccguggaacccuguuuuuuuuuuggagacagguucuuauucugucacccaggcuggagugcaggagcacaaucauugcucacugcagucuccaucucccaggcucaaacaauccucccaucucugccucccaaguagcuggggaccauaggcgcacgccaccacacuugacuaauuuuuuaauuuuuuauagagacaaggucucccuauauuguccaggcuggucuugaacuccuagccucaagugauccucuugccuuggccucucaaagugcugguauuaugagccaccaugcccggucccuuuuuuuuuuuuuuuuuuaaauguaacaguucugacugggcauagucacucaggccuguaaucccagcacuuugagaggcugaggcaggaggauggcuuaaacccaggaguuugaacuuagaaugagcuaugauugcaccagugugcuacagccugggcgacagauugaggcccugucucucucucucuuuuuuuuuuuuagaagcaauucuuugaacaggauuccuuggaauacacuuuuagaaaugcugcauuaguaagaaaccaaugagggaaaaacaucaaaaacaaaacaaagaaguaaucagugaugguugacuagugcugaagguguuuaagguguguacagaaaguggcugcacgcaguggcucacgccuguaaucccagcacuuugugagguuuaggcgggaggaucgcuugagcccgggaguuugagacccaccugggcaacauaaugacaccucuucucauuacuuuaaaaaugaaauaaaagauaggccaggcacgauggcucacgccuguaaucccagcacuuugggaggccgaggcggguggaucaccuggucagggguucgagaccagccuggccaacauagcgaaaccccaucucuacuaaaaguacaaaaauuaaccgggcaugguggggggugccuguaaucccagcuacucaggaggcugaggcaguagaguagcuugaacccaggaggcagagguugcagggagccaagauugugccacugcacuccagccugagcgacaagagcaagacuccaccaaaaaaaaaaaaaaaaaaaaagaaaaguuaaaaaugaaauaaaaucuguacaggaaagugaccguuggauuuggcaggauagggucguuaguaauuuucuugagcaguuucaguggaaaagggauagaguaggagccuccuuggcauugauuaaggagacaguacaacaagauaaguggaugcaguccaaauggaugcuuuaacaaguuuugcuauaaagaggaucaggauuaagagaguuuuaaagaugggagacauuagggcauguuuacacugugggaauaauauaguaagauaaauguagggaguugagauauuauacauggagagguggaaagucuuaaaugccuggaguuuucugugugcauacauauucauacacauacacccacauauauguacacaugugagucaggaaaacuuucccucaagaaaugacauuugcgcuaagaucugaaggcugagucauaguuaacugugcauaggaaguguauaaaaagcagcaagaagaguguaguaggcugaguaaacagcgcagggaaggccccaggauagaagugaacacaguuguuuauccugagaguaaugagaagccacuaaaagcuuaagcaugggagagacauucucaaauuggcuuuaaaaaaugcucugcagcacggagaagggguuagagaagggcagaugaccaguuuggaagagauacuaguagaccagguaaaaaauuaugguagcuuggaccaggguguuauugauggagagaagcagauggauuuggggagucauuccacugugcuaagggaaaagucuacaaaaucuggaguacagggaacagaacaaugacagggagagcugggaaaggggaggcauugguaaaaauuugagacgaguauguaaguggguauguauguauauaaauauauauacauauucauaauacacauaugaauacacaugugaaaacacuuauuguggucauauauauauauauuuuuuuuuuuuuucuuuuuuuuugagacggagucucgcucucuugccaggcuggagugcaguggugcgaucuuggccuacugcaaccuccaccucccggauucaagugauucuccuaccucagccucccggucauauauaauuuuuauaauuuuauucauguaaaaacguauacauagaagagcuacgugcgguggcucaugccuguaauccuagcaccuugggaggccgaggcaggacgaucacuucacccaggcguuucagacuaaccuggggaacauggugaaaccccgucucuacaaaaaauacaaaaaguuagccaggcaugguggcgugugccuguagucccagcuacaugggagacugaggugggagaaucgcuugaacccaggagauggaggcugcagugagccgagauugcaccacugcacuccagccugugcaacagagugagauccucucucucaaaaaaaaaccccaaaaaacauaugcacagaagaucacaaaugauaacuguacaucauguuggauuuucagaguaacauauccaugaaaauuucaccgggauuuuuaaaaaauagaguaucacuagcgucccaaacuuccucugcuucaugguucucccagccauuaucccauucuccccagugguagccacugugacuucacauaccuuggauuaguuagguuuuggggggaagagggagaaugaauggaagcuuuauuauuguuugagauauagaacauuagcagcaccucaguagccucuuuugugcccacucccaguuguuacccuccccaaauguaucugcuauuccaucacuguguugaggcggagccagaccaccccauauuuaaagauucacuagaagggcuugcaggacucaguauaugguuguacucacagugaagauuuauugcauuguaguaaggauacacaucuggaucaugagggaaaaagacaggcacagucugaaggaauccauguauaggcuucccuaugcuccgucuuucccaugagggggucacccagagcccguuuuuccccagugguggaaauguggcaacacgugccguguuucuguggagagaagaccguuagagacguaguguccgagguuuuuacuggguccugaucacauaggcagccucugccuggcauauaauaaaauuccaaauucccagaagggauggcagguguucagcaggugugcuuguuugcacaagcagucuaggcacauugagcugcauuaucaguuaggaaaaauuuuauuucuguguauggaacuguuuaccaaccaaguucccggauaccagcccaagguccuuaacaaacaggccuuucuaaggacagcagccugaggucugcuguguuaacucuuuuucugaacaaucacuaugaaugaguuuugccuguucuagaauuucauaucaaaggaaucauguaguauguacuccuggcuucuucugcuuaacauuacguuugugagauuguagauaguuuguucauuucauagccaaguaguauuccauugaaugaauauaccacaauuuauccauccugcuguugaugggcaaaguuacuucaccuucuccccaauauuugguauuaccucuuuuacauuguagucauucuuguggguauguaguaauuuguuuuggcuuuaauuagcauuucccugauggcaaaugagaucgagcauuuuuuuuucaucuauguauugccauuuuuauaaccuuuuuauuauaaagugccuguucaaggccccuugccuauuuuuauguuggguuauuuauuuguaggaguucuucauauauauuuugaaugugaguccauuguuagauauauguauugcaaauaucugacauuuuguggucugccauuucacucuuaaauggcuucuuuuaaugaagaaaaguuauuaacuuuaaaguagccuaauuuauauaucuuuuccucuagcauuugugcuguugccuuaagagaucuuuauuccaaggucaugaagauaaucuccuguguuaucuuuuaguggcuuuauuguuuuaccuuucauauuuagaucuccaaucacuuggaacuuauuuuuguguaugguguacaaguaggaguuaagauuuauuuuuuucauguagauauucagcugacucggcccuauuuauuggaaaagaaaaauccauauuugcugcuguucagagcuaccuuuaaguaucugcagugcucuauuuuguuucacuguucuguccuucugccaguacuugucuuaauaagcuuuacaguaagucuuaauaucugguaguguaauucuuucaaccuccuuuuuccucucucucucucaagauuaucuugguuaucccugguucuuuaauguuguguauaaaaaguuuuagaauaauuugucauuucuuucucuugcucucucucacaaacuuacugggcuugugauuauauugaauuaguaaauggguuuggggagaauugacaucuuuggaauuuagugugccaguucauaaacuuguguauuuauuuaaguuugcuuuaaaaagauuauuagaggucuugcacuucuuucacuagauuuauucuuaaguaguucauauagaaagucagguguauuugauuaggcucucugccugaugcccauucuguucuugauugucugaauaagaguugcuguugauaucagaaagcuguuucaacuuaguucggagguaauauguacaguauugcucuguguggaaggucuccagagauuuaagaauuuaaaaaacaaacaacuguagcaguauggcaaauuauuuuauagugagaucguuuuuauacuuaauauuuggauuuugaaacaugaaauguuuauaaucauaauguacaacuguguaaaagugugauuaaauugugaacaucuuaggcaucguuacugugagcaguaauacuuguuggucaaaugaaaugcuguacaauuuagguguaguuuuuuaaaaaucauagcauuuuaccuugauuugacauuuuuagaguagagagaauuaagugucaggggcauguauguuggggggagguggacaauaguguuaaaacauaaaaaaaaaauacugugauuuaauuauaaaggaauauguugggccgggcgcaguggcucgcgccuguaauccuagcacuuugggaggccaaggugggcagaucaccugcgaucuggaguucgagaccaagcuagccaacgugcugaaaccccaucuguacuauaaauacaaaacuuagcugagugucguggugcacgccuauaaucucagcuccuuggguggcugaggcaggagaauugcuugaaccugggaggcagagguugcagugagcugagaucacaccacugcacuccacccugggcuaaagagcaagacaccaucucaaaaaaauaauuugugauacuguuuauccacggcagaacuuuuauucuuagaaauuugaggaaugggccgggcgcgguggcucacgccuguaaucccagcacuuugggaggccgaggcgggcagaucaccugaggucgggaguucgagaccagccugaccaacauggagaaacccagucucuacuaaaaauacaaaauuagccaggcgugguaacgcaugccuguaauccuagcuacuugggaggcugagacaggagaaucgcuugaacccgggaagcagagguugcagugagccaagaucauggcauugcacuccaaccugggcaacaagagcaaaacucugucucaaaaaaaaaaaagaaaagaaaagaaauuugaggaaagaucuaguugugacuuuagcaaguuacuuaauauuucugugccuucaucugcacaagggggauauuaauaguacccaucuuuggaaaggacuuagaacgugucuggcucauaauaagugcuuauuauuagcuuuucugaaaauauuuaagcaccgagagggcauggacuuugucuuguucucugucuucaacacuuuuuguguacuagauuguguagucacagucccugcauucauggagcuugcaaucuagucagcacguauuacuguagauaauaauuuguguucauaggaagauaaacgaauacagccuuuaugcuucccuuagaaacuaguuauuuaaagaacaucuaguugcugauuuuuuuuuuuuuuuccgagacggagucuggcucugucacccaggcuggagugcaguggcgcaaucucggcucacugcaagcuccgccucccggguucacgccauucuccugccucagccucccgaguagcugggacuacaggcgcucgccgcuucgcccagcuaauuuuuuguauuuuuaguagagacgggguuucaccggguuagccaggauggucucgaucuccugaccuccugaucugccugccuuggccucccaaagugcugggauuacaggcgugacaacacgcccggccuaauugcugauuuucuacagugacaguguuguuuuguaugcuuguugaaguugaaauccugaagggaauguuaagcugugagccuuguggcugugcaugcagcuuucugcuuguucugcugaugguugaaucuucucugauguuuugggaguuggaagaugcagguuucaguucuaguucugcugaugauuuuguacuucccuccaaacaaguuacuucuuaaccuugucuguaauugaaauguugguacuaaaugacuucuaagguuuuuuccaacuguuauuuuguuauuaaucaaauucuccaaauuauguucucagggaggggagcaggaauccguuguuauuaauguauguuugccuuaaaacugaaggcugaaauuuaaaugcugagcucauuuucauaauuguauuuugguuuuauuuauagaugccagaaguggguggagaacuguaggagagcagacuuagaagauaaaacaccugaucagcuaaauaaacauuaucgauuaugugccaaacauuuugagaccucuaugaucuguagaacugugaguaauagaagagcuuggugucucucuguuugacuugauuucucucucucacugugucugguuggaaauguaaguauuuaccaauguuggaagguauuccuauauccugccacuuuaagaugaagacagauuuggagcugaaaaguaucuguuuuguucuuaaaauccugauuuugccgggggccuauaaucccagcacuuugggaggccgaggcaggaagaccacuugagcucaggaguuugagaccagccugggcaacauggccagaugccgucgcuacagaaaauaccaaaaaaacuagcgagguguggugacguaugccuguagucccagcuacuugggaagcugagaugggaggauacuugagcccaugacgucggggcugcagagaguuguguucaugccacuacacuccacucugggcgacagagugagcgcuugucuggaaaaaaaacucaaaaugauuaaaacaaaacaaaacaaaacaaaacucuucgguuccuggugccccauuucuacucacccaagguaacuacuuuuuuuuuuuuuuuuuuuaaagacagucuugcucugucacccaggcuggagugcaguggcgcuaucuuagcucacugcaacuucugccaccucccccaccuccugggcucaagcgauucucucuccucagccucccaaguagcugagauuacaggcauugugccaccacgcccagcuaauuuuuguacuuuuaguagaggugggauuucuccauguuggccaggcuagucucaaucuccugaccucaagugacccgcccaccucggccucccaaagugcugggauuacauguaugagccuccacacccggcugagguaaccacuuuuaaauauuauuuagucuucaggaaaauuuuagaugauuauaaaaguauauguuuauuuaagguaaaguugguguuuuuauuuggagcucuuuagagcuuuuuuaugaguaaaauuuucaucucggaauggagcucuuguuuucauguuuuuguauguacuauuagaaccaacuuuuaauuuuuaugugguagauauaaugguaaacaaauuauccagguaauguggaaaaacauuuucaucaauaauauguaauuucauaucaggaccuacuguuaacugugugagcuuggccaagucacuuccccucuuugggccccaguuccuaauaaggagauuaggccagguaauuccugaguucuaagauuuuuaacccucugugauucucuugcugugauuuauaaaaggcacaaauaaggcaaauuugauugaaaugaagcagacuuguuucaguguaacuaauguaacaccucagauauugggauagacauaaacuugauucaaagguacacuauauguuguuaugcagcaauuuauuuugauauuuuuuucagauacauuuugcagaggcaucagaaaacuaaagaaugauuggguuauuuuauuucucaaaauuaauugaagcagauacuugugaagucauugggaggugagccaauuccgguucaacaguuuaaucacaaauauuugaggaauauuuuugccuugauuuguuaaaaggguaauaaugaucaaccaaaauaaaagguuucauauguuuaaaaggcaaacuacuuuuauguucuugacaugaaguaaaaauaucccaaauuauuuuaaauacauuugccauaugcauuuuugcauuuuuauuuuaguaauaaauauggucucuuaauuagauaauucuaaccagauugugagaaauuuaaaggauaguucauucuuacauucuuuaguuagagaauagaacagaaagaugagccagguuugcuuuuuuaauuucuaaaugauucuucaaucuugaauaaaugaacgcaaaugugagaaaauguucuuucuauacgucuaggagauguuguuauuaaaaacuggauuucugggcuggauaugguagcucacaccuguaaucccagcacuuugggaggcugaggcgggcagaucauuugcggucaggaguuugagaccagccuggccaacggggaaaccccuucucuacuaaaaauaccaaacaaaacaaaacaaaaaaaauuuugcugggcauggcggugcacacguguaaucccagcugcucaggaggcugaaacaggagaaucgcuugaaccaaggaggccgagguugcagugagccaagauugugccacugcacuucagccuuggugacagagugagacugugucucaaaaacaaacaaacaaaaaccccuggauuuucugauaucuguaucuaaauguuuaagaguuuuggcuuuauuaguuuggcauugaagaucucaucaguagcaaggcacaguggcacgugucuguagucccagcuacucaggaguccaaggcugaaggauugcuugagccuaggaauucagagccagccugggcaacaugguggugagacccugucuuuaaacagacaaaaaaaaaaagauuucaucaguaaacauucaugacuacugaauuuggccggagccaaauauuuuauuauuuugaugcuagaguaagauuauucuuuuaugcucaaaccuuaauucagcaguuaaagauuaaaucuugauacugagauacuugguaucauacguaguauuugaauauugucuuuuuuggcauguguccuuauagauauuuauauuuuuuauuauuauuauuuuuuuuugaaauagggucucacucuguugccuaagcuggggugcaguggcgcagccauggcucacugcagccccgaccucccaggcucaagcaauccuccccgcugagccucccaaguagcuggaacuacaggcacaugccaccauaccucgcuaauuuuuguauuuuuuguagagauggaguuuugccguguuaccuaagcuggucuugaacuccuggggucaagccgucuacccggccaaggccucccaaaguguuggaauuacaggugugagccaacauuccuggccaaaauaaauauuuguaaaaugucauuuuuuucauucauacauucuguuuucugaucuauaauaucuuugcuuuauuugcaaauagaaaaucaauuugauuugacuuuuaaaaauuuguuaaaauguuuuauuccuccccuccuuauuuaauaauuaguaagauaucaagaauugacuguguauguguuuuugcuuauuuuggggacauuugcucggugugaaagaugggggagcuuugaauauaauaacuuguacucccuucagugauugugucccuaaccaauuccucauucagccucccuaguagacucaggaucacgagcccagcacuagaaguugaguguuacuaggaagucagagaaucaucuuuguguuuucuauuauggcauggaauugaacuagaaaauauugacucugaauagaaauucaucccaaauguguuuaacaacucuuuggguacaacccaagauaguguguuccauuuagauacauguuuucccuucaugucuucccaaccucccuuccuugggugaacaaauuuagaaguuguuauuuuuguuuggcauguucuuugagcaugcuuagauauuuugaaauaaucacugcuucaaagaaagcuuauuuaaaugaaguaugucuuaucuuuaucauuccaaauucaggaagaaauuaaaggcacuauucuuuggacugucugaggggaguguaauagcaguuauuuauuacugucccucuuaauaagcuucuugucuuuuacucagccuccucagggcuggcaguaggaccguuaccaucuaaguaugcauccagcuucuagccaaguuggaugaaauuaacaggaaguaggguagaguaugaucauucuuucauaagaugauuaggacuugaaagagauacagaaauaccuagauuagcauuugcaaaaaugugauuauguauaucaguaucacuuguggcgugagaguugguuucauguggcagaugaaucaauuuuuauuuuagaaguuuuguaguauguguuaaaaacauguuuaaaaacuuuuuuaaaaacauaagauaacaucagaucauucuuccuacaguuuuauuacuuaagacaguguuaacuaaaaaaugaguagauuguguaaaaauacagaugguaauauaacugaaauggcaagcauugugaucauuaguaugugaauaauuucauuuuaggaaauguugaucuaguucaauaccagaauuuuauucagaaaaagaaacuggggcccaaaaagggaaaguaauuuagccagggugucuuagugagucacucacugguagaguuuggacuaguuccuaggucuccugggucccaguccaauauuuucacugugccuugaugcuucucaguaauauuagcaaaaguggaacauuagguaaaauagggaugcauuauuauggaacauacaagagugcagauuauuuugggagacuuguaccuccuguagauuuggugggcucauggaaggacaguacagauaaaguagcugggaugcugaauuagaaacagauaugcaaaaugcaaguacauuuuauauuuuaugccuaccuucaauucaguuucuuaauuuauaauagauugccagaagggcaaaugcaggcacaguuggaaauaguagacugaccugaacugacaucaaauucuguaagucucuauacuuuagagcuggaguugaaggaauauuguggaggucauuaacauagaauuuuauugauguguaauauauuuauaaggaccaucucugaauuaacacaauuuucuuuuucagaguccuuauaggacaguucuucgagauaaugcaauaccaacaauauuugaucuuaccagucauuugaacaacccacauaguagacacagaaaacgaauaaaagaacugguaugucuauguacuuucagcuuucccaccuucccccauaauacuaugaaaucaaauacagaugcauuuauguuaaaauuaauccaaauuacucucuauuucagagguaauguaacgggaaauaaauguuaugguuguuaaauagccuagaugugagaugaugaguuuuaguauuuaaauuggaaaaucucccucagaguuagccaguugauacuuguugacuugguccagagugugcuguuaauuacaggccacuagcucauucccuucuggagaagaaggaaaaagcuaccuuuucuuucauaguaaggaaaauagagcugagguguuuccagaguucagcacaaaggaauaaagaaagggaaaguguaaaaguggagacauggaauguuuuaaagauaagguuucuaucacuauuaaauauguacaggguuuagaaaaaaacacugaaauuucuguauauggcauaauuuacacauauucuuauguuccuuggauauccuucaguucugaggauugacaccuaucuguauuuuguugaccuuaggugaacagaaguacaguaacuccuuaguccauggcuuuuugucaucauugccacuagcaaggcccuuauuuugcuuuauuauuuuuccuucuucacccacuauuaccauuaccauuccuuucccuaccaguugguguccaugcuaguguauuuaauauauguccuaucaguccaccuacugugugcuuuuuaaagauagcauuuaucuaauuuuccuuauucuaugcuuaccuuucuauuuagauauuuuauccauuuggaguuaguauguaugauguacaguagggaucuauaauaacuuuuucuccuuauagagaaacuguuuucccaacauggucuguuaguucuuccuuucguccacugguauaaaaugccaccucuguuauauaacaaguuuacaugaggcuguuuuggggaguucuguuccauuucacuguauuauuuguuugcaacuauaccacacuguuuuauuaccauggcauuguaauauaucuuacuuucaaauaaggugauuguuuaacucuucuuuuucuuaacuauuuguggaccuuuauucuucccuauggauuuuuuuuuucccccccgagacagagucucacucucacccaggcuggagugcaguggcaugaucuuggcucacugcaaccuccaccucccgguuuccagcaauucuccugccucagccuuccaaguagcugagacuacaggcgcucaccaccacgccugacuaauuuuguauuuuuaguagagacgcgguuuugccaugucagccaggcuggucuccaacuccugaccucaagugauccgcccaccucggccucccaaagugcugggauuauagacgugagccaccggccuccuccauaugaauuugaaaguccuuuugucaaguucuccuagaacuucuuuugggauuuucauuauaauugcuuugaauugacaucuuuacaauauuagcuauuguaaauuuauuacuaguuuaguauuacuguuaguaaacgaauauuacuaguuuacuguuacaguauaaacuauuguaaaguauuaacuaguucuauccaugaagagaaaaaaaaucccauaaaauaccuaucaaauaacagcaaucauugacaaaacuaaauacuaguuuuuugaaaagaauauuagaauacuuuuaggaguacagaaaacgaaaaauuuugagagcuuuuguuacaguuguuuaaaugagaauguaugcauucuuagaucacuucuuaaauacauuaugguucuuacugguauagaugauauauucugguugaaauuguuuccagcacuuuugaagaacuucuuuuuaaguuaauccuaguaagucuucugaguuuuuccucuguuacugauuguaucaucugcaaauaaggagaaauuugucucuuucaguucuuauuauuuuaauuuuuucuguugccugucuuguuuagucaagaucccugguacuauguugaacaauucuaguaaugucauacuugccuugccccauuaaguauaauguuugcuguugguauuguuagauaguuuuuaucaaguuaaggaaauucccuucuacucccauauucagaguuuuguuguuuuuuuuuaagauggggucucacucugucacccaagccagagugcaguggggcagacacugcucacugcagccuccaccuccugggcugaagcaauccucuuaccucagccucccaaguagcugggaccacaggugugugccaccaugccuggcuuauuuuuuuguauuuuuuuuuauagauggagucaugccauguugcccaguuuggucucaaacuccugggcucaagcaguccucuuaccucagcuccccaaagugcugggauuacaauagugagccaccacgccugaccuauauucuguuuuuauauuuaacuuaucacaugcuuucauugcauguauuuaauagacaaguucauuuuuuucauucuuuaaugcaauaaguaauacuaauggauuuucugugaaccaucugcauuucuguaaugaacucuaguugacugcaauaugucuauuugcuuuuauauaccauuggauucaauuggucaauauuuuauuuaggauuuuacauuugugaaucuuggucuguagccuucuuuucauguacucuuauuacccaguuauaauaucaagguucuauuggccucauaaaauaaguuggguaucuuuuuuuuuuuuuucuccuagaaaaauuuguguagguagauguuaucugcucuugaaaguaagguagaacuugguaaaaccauuagauggcuugcgguggaugagggaaaguuuugauugccauucugcuaucuuuauugguuuucuuucuuucuuguguuuuguuaauguuucuaaaaguuuaugaaacuuuaauaaucuuuucaaagaaccaguaguuuugucagugauuguuguacuuaugaacuauuuuauugguuuuucuuugauuagggugauuuauuuuuugacucuuuuucuagcuucuugaauguuuagcucauauuuauguguauucaaagcuauaaaagucucucuuagguccauuuuagcuauacccuacaacuuuagacauauaguguugucaugucuggcuguagguauuuuguaauuucucuauuuuguuaacauaggauuguuuuucuuaguuuccagauguggaauuauuuuuaauugcuauaugauauuuuaaauuuuaaauguuauuaagagauacguagaggauacauauagucuaugugauguugauucuuucugauuuuuuugcauccauuauugcuauucaagucugugccagccugauucuuguuccuuuuuagguaaucuucuuuucucccucaaagcuuuuuagaagguuucuuuauauuugacauuuuaaaauuugcuaaccuguaucuagaugugaguuuuuuuuuuauguaccuuaauuugucaucuuacaacugaggacuuacaccuuaaauucugagaaauccuuaguuuuuauuuuucuuuaugcauuuuccccucuauuuguuuauuucuauuuuccugggacuuagaugaauacugacacuuacauuacaguccuccauaucagcuuucuucuugguguccauggaggacugauuccaggagcuucccucagagagcaaaauccacagauacuugauucccuuauauacagugguguaguauuugcauauaacuuacacacauccucccgugacuuuaaaucauuuauaauaccuaauacaauguagugcuauguaaauaguuguucuguuacauuguuuagagaauaaugacaagaacaaaaaucuguguguucaguauagacacaaccauccuuuucuuuuuuuuuuuuuugagacagagucucgcucuuguugcccaggcuggagugcaagggugcgaucucagcucaccgcaaccuccgccucccggguucaagcaauucuccugccucagccccccgaguagcugggaucacaggcaugugccaccacgcccggcucuuuuuguauuuuuaguagagacgaggguucuccauguuggucaggcuggucuugaacucccgaccucaggugauccucccgccucagcuucccaaagugcugggauuacagacgugagccaccaugcccggcacaaccauccauuuucaaauaauaccuagauuauuuaugauacuuaauacauuuauguguuuguaacaccuacuacaauguaaaugcuauguaaauaguuaugcuacguuauguaggggaagaaugagaaaaaaagucuguacauguucaagauagauacaaccauccauuuuuuccccagcauuuucaaugcaugguugguuaaauccauagauaugaaguguaauauguaucaggaugaggagcucaaucacuugcuguccuguagcuaucauuucccuguagucugucccucagagagccucacauaucucacagcaggcauacucuuccugacccaccauccuuauaaacgugcaguccguaggauaaggaggggauguccagguugaccagccugcugauguuucuuguuaucagcaccauguccagugcugcccaacaggcauccugcugucuucagcugucacuggcauugcugcuuuucugccacagaaaguaacagguggcucaugauuuaagcauuguagaggguuggaaggaaaguaaaggaugcagcuggaaaguucuuccuuugucuaacccuauuggugccacuuggccuacuaugcucuguguaugcucuguguaucucuuccaugcugguacuuucaccuucugcuucucagggauuucucaucacuuuuguguugaguccugagauucagcaaccuccuucuuaugggacaucuccaggguuaaauugggaaguaagaugauuuguguccucuugaauuuaacuccaagugccaugguguauuuuugugccuuucauuagccaguaaacacuuauaacccaaaguuacgaugauuuagguagaaaauaagcaaaaugauguauucuuuuuucccuaagacuuuguuauaaccuuggagucauuaacagcuuauucugguuuucucauugucuguuuguuugaagaauguguacuauauaaagaauuuaugcucuugaaagaauuaaauugacucagaauaggcauuuguauuugugagucuaagaugauacacuagaggucaguuuuuuaaagaugauuuguuuuuuucuuuuuuuuucuugacauuuagagugaagaugaaaucaggacacugaaacagaaaaaaaguaagugauaguguuaaugacucaacuucugaaugccuuuuaaaaaggccuugaccugguaaggacaaauaaauauguucuguguugaaaaccuaccuugagaaugaauguaggagugugcucaauuuuguccuguguuuuggaauuaucuaugagacuaaagucuaauuuuaguuugucuuuauugagugcugcaaugccacacacuaugcuauaugcaggccucauggaggugacgccuccucucucagugugguagggguggcaggcacacagugcuccauuguagggaaggaagggcaacaguagaggcaugcacugaaucucuuuuucuguccacccaguugugguauguaauaaauucuuuguaaauguuuaaggacuaaaugcugugggggcacauagugccauugugaguaguggucacaacagccuuucuggaggugcugauguccgaauuaugucaccaaaggacgagggcuagaagcuguuuuucuucuugucaguuauuaguuacuccuccuccucuguuucuuccuccuauugcuguuauuauuaacguagcauuuuauugagugcuuacugaugccaaaucauuguucuaagugcuuuacuuguauuaauuaauuuaauucucacaauagccgugagauaaguacuguuauuucccucuuuauggaugaggagauauggacuugggcaaagagagggaaagguauucugugcacgaaacagggugcuguuuuggggaacuacacucauuuuaguguuguuaaaguuugugauaacccauuaugguuagaaaauagccuagagaggaccccagaggccagaacuugcagacuugugggcuauuagcaauagggaaccacugagggguuuauaaguaggugauaacagggaccugauuuccaugguacauagaguacucuguuggauuagaaaagguaacacuggaggcauggaggcuaguuagacugucaacugaccaaauaaaaguugaaaggccuugaauuaaggcaaugguagagagaguaaagggaauagauucaaggaacuuaagaaauuuguauaccuaugacaccuaaaaagauguccaaaagaagagggacuugacuuuucaguuugaacucuuugcucuuuaaugaacuucuuuuugaaaaaaauaaaagcaagagaauuaguacuuguuaauuggaaguggagaaauaauggaggagagagggagggagccagacaggcaggcguccaggauaaccucuugcuuucuggcuugggaagccucccuaguauagaaccacugcugugucacauauaaugaauagcagugucaucugauuugaggaggggugaaggaaggaugcucccugcauuuuucugaacccuuaugaagcucugaagcauggcucacacaggcuccggucagacuagauuucccuuuguacuugggcagccugcuucccucuucuaccuuagugcuugugcuagaauaauucucaccaacugaaaugcccuccuuguucaugucccccuuauuuauccuugucaucaaaugcaacuucugaauuuuuguuucuccccaccgcccuccauagucuuuuuucuuuuugagacggagucucacucuguugcccaggcuggagugcaguggcacgaucucggcuaacuauaaccucugccuccuggguucaggcaauuguccugccucagccucccgaguagcugggacuacaggcaugugccaccacgcccagcuaauuuuuguauuuuuaguagagaugggguuucaccauauuggccaggcuggucucaaacuccugaccucgugauccacccaccucagccucccaaagugcugggauuacaggcguaagccacugcacccccggcccuagucuuauguucuaagaacuagguuuuaacugugccuccucagauuuggauuauuuuccugcagacaccacugaccuguaugacuaugggcagggcauuuagccuguagggccucaguuuuccuauccccugugaagagauuaggcuaagaugugugauauucuaauacuagcccuaagaguuacauuaaucuccuuuauauuauacugguuuguacagcugucccaucucccauauaaauguguggcauaaugguuugauaaaaacagcaucagcauggaucuuggagccagacgcacuuggauuucaacuuuacuuccauucuucuaacuguauuugugaucuugggcaaguuacuuaguguccuuguuugucaaguggggccgauaccaccugccugaacagagaguaaugugaugcauauaaaauacuaagcacaguaccuuaguaauuaguucugucccacuuuguuuuucugagggcauggacugucauucauuacauauguggaaagucuuguuaaguguauuuuaaaaauuaggccggaugugguaucucacaccuuuaauccuuguacuuuggagcugaggugggaggaucacuugaggccaggaguucaagaccagccugggcaacauagugagacuccccgcucuacuucuuaaaaaaaaaaaauuauuccuaucuuguaacagcauuuacaucuaggauuaaaauauaucucuuuacacuguuugucucucccacuaggaugugucuuaucuuagugucuuauuuuaaucucuguccuagucuguggucuaguaaauacccuaugaauauugaaugaaugaguuuguggauuuuaaauauuuaaccaaagauguaauauuuuuuguuguguaugguuuuucaugagccuguuuguaaaauuaauucuuuguuuuccaguugaugaaacuucugagcaggaacaaaaacauaaagaaaccaacaauagcaaugcucagaaccccagcgaagaagagggugaagggcaagaugaggacauuuuaccucuaacccuugaagagaaggaaaacaaagaauaccuaaaaucucuauuugaaaucuugauucugaugggaaagcaaaacauaccucuggauggacaugaggcugaugaaaucccagaaggucucuuuacuccagauaacuuucaggcacugcuggagugucggauaaauucuggugaagagguucugagaaagcgguuugagacaacagcaguuaacacguuguuuuguucaaaaacacagcagaggcagaugcuagagaucugugagagcuguauucgagaagaaacucucagggaagugagagacucacacuucuuuuccauuaucacugacgauguaguggacauagcaggggaagagcaccuaccuguguuggugagguuuguugaugaaucucauaaccuaagagaggaauuuauaggcuuccugccuuaugaagccgaugcagaaauuuuggcugugaaauuucacacuaugauaacugagaaguggggauuaaauauggaguauugucguggccaggcuuacauugucucuaguggauuuucuuccaaaaugaaaguuguugcuucuagacuuuuagagaaauauccccaagcuaucuacacacucugcucuuccugugccuuaaauaugugguuggcaaaaucaguaccuguuaugggaguaucuguugcauuaggaacaauugaggaaguuuguucuuuuuuccaucgaucaccacaacugcuuuuagaacuugacaacguaauuucuguucuuuuucagaacaguaaagaaagggguaaagaacugaaggaaaucugccauucucaguggacaggcaggcaugaugcuuuugaaauuuuaguggaacuccugcaagcacuuguuuuauguuuagaugguauaaauagugacacaaauauuagauggaauaacuauauagcuggccgagcauuuguacucugcagugcagugucagauuuugauuucauuguuacuauuguuguucuuaaaaauguccuaucuuuuacaagagccuuugggaaaaaccuccaggggcaaaccucugaugucuucuuugcggccgguagcuugacugcaguacugcauucacucaacgaagugauggaaaauauugaaguuuaucaugaauuuugguuugaggaagccacaaauuuggcaaccaaacuugauauucaaaugaaacucccugggaaauuccgcagagcucaccaggguaacuuggaaucucagcuaaccucugagaguuacuauaaagaaacccuaagugucccaacaguggagcacauuauucaggaacuuaaagauauauucucagaacagcaccucaaagcucuuaaaugcuuaucucugguacccucagucaugggacaacucaaauucaauacgucggaggaacaccaugcugacauguauagaagugacuuacccaauccugacacgcugucagcugagcuucauuguuggagaaucaaauggaaacacagggggaaagauauagagcuuccguccaccaucuaugaagcccuccaccugccugacaucaaguuuuuuccuaauguguaugcauugcugaagguccuguguauucuuccugugaugaagguugagaaugagcgguaugaaaauggacgaaagcgucuuaaagcauauuugaggaacacuuugacagaccaaaggucaaguaacuuggcuuugcuuaacauaaauuuugauauaaaacacgaccuggauuuaaugguggacacauauauuaaacucuauacaaguaagucagagcuuccuacagauaauuccgaaacuguggaaaauaccuaagagacuuuuaaaaauaggcuuucuuauauuugauauuuggaagaaaaagccguaagguguauguagaccacuuaaucacuaaauaucuuugccuauaggacuccauugaauacauuagccauugauaaucuaccuguuuaaauggccccuguuugaacucucaagcuuugaagaccuaccuguucuuccagaagagaacguugaaagugccauguuuccuuuugcgugaucucuguugauggcacucuggaauuguuucaguuaagucauuuuagacauagcauuuauuaucacuguggaucucuacuuguuggguguuaugaauucuuugaagaaauauauuuugaagaggugugggaggaaggaauacauuuuauaaaauguuguagugaagcccacaauugaccuuugacuaauaggaguuuuaaguauguuaaaaaucuauacuggacaguuacaagaaauuaccggagaaaagcuugugagcucaccaaacaaggauuucaguguagauuuugucuuucuugaacuuaaagaaacaaaugacaaaguuugaauggaaaagccugcuguuguuccacaucucguugcuguuuacauuccuuuguggagccuacaucuuccuaagcuuuuuagcagguauauguugaacacuucuguuucaugguugagacagaaucagaggccauggauacugacaacugauuugucuguuuuuuuucucugucuuuuuccaugacucuuauauacugccucaucuugauuuauaagcaaaaccuggaaaaccuacaaaauaaguguugugguuuaucuagaaaaauauggaaaauauugcuguuauuuuuggugaagaaaaucaauuuuguauaguuuauuucaaucuaaauaaaaugugaauuuuguuuaaagcuuaggcacauuauuuuuuguggggucaaaacauucuuguguaaauucucuuaaacauuugauaaacagcuucacaauucaaggugagucuuuuguaugugguuuacuacuuggguuacagaaaaaaaacaauuaagaaagug

SEQ ID NO: 15289 - RNA, 82162 nt, Homo sapiens
ugcugagcagcauaaaaggguggggccgcuucccugcagcagaggcagaggcggcggcggcagcggcugcagcaucauucgcgggcagcggcggagaccgagagcugcagaaaaggguggggucgcuucccaggagaagaggcgguggcggcggcggcugcggcauccucgcgggcagcggcggaggcagcaaugcucggucuccgcuggaggugauggccucccagcccugcuagguggccggcugcacuaggacgccggcaggaaggagacucgagcccgguccgcggacccugcggccacaccgcccggccccuccucugcgccauggcuuaagccuguagccaccucuccucacgucgccucgcucgaccgaggucugugcgccgccgcagccgcagggaggggcgcgucccagacacccucgccggggacucgggaacgccgugcgucucacccuucggcgcucgcagcagacugcgcucccaaaggcguuugcgaccgguaaucgagggacucuacagacucuccuaggacagcucuccccgggugcucgcugagggaggagggcgaacuagcuccggcugaucggggguagaaaacggugggaaccacauuggccggucaggaucggaggcugaaggaagauuauagagacuugcuuuagaaccacaagaagaaagaggaggccggcuuuucagcuagcaucauggcguggccgugcaucacgagggccugcugcaucgcccgcuucuggaaccaguuggacaaagcggacaucgcugugccgcugguuuucaccaaguacucggaggccaccgagcacccgggcgccccgccgcagccaccgccgccgcagcagcaggcgcagccggcgcucgcgccccccucggcgcgcgcgguugccauagagacgcagccagcccagggcgaguuggaugcaguugcccgggcaacggggccagcgccugggccuaccggcgagcgcgagccggcggcgggccccggccggagcgggccgggcccgggccugggcuccggcuccaccuccggccccgcggacucggugaugcggcaggauuaccgagccuggaaggugcagcggcccgagcccagcugccggccgcgcagcgaauaccagcccuccgacgcucccuucgagcgcgagacccaguaccagaaggacuuccgcgccuggccgcugccgcgccgcggggaccacccguggauccccaagcccgugcagaucucugcggccucccaggcgucggcgcccauucucggggcgcccaagcgccggccgcagagccaggagcgcuggccagugcaggccgccgcugaggcccgggagcaggaggcggcccccggcggagcggguggccuggcggccggaaaggcguccggggcggacgagcgcgacacgcgcaggaaggccgggccugccuggauugugcgccgcgccgagggccuggggcacgagcagacgccgcugcccgcggcccaggcccagguccaggccaccggccccgaggcuggcagggggcgcgccgcggcggacgcccucaaccggcaaauccgcgaggagguggcgagugcagugagcagcuccuacaggugagacgcggccgcugcuagcgcgggggagucaccacgcagacccuccccgcgggcugcccggggcccaggauccccagcgcaggccuagcgugcagccucccuccagucccaggccacacccucuccccagccgccucccaggccaccuccugucgaagccuucucuucugcccugucccaugcgcaagcuguuaguauauuccaucucagccugccuggcucuuucacuuuaccgcuguagcccuuuucuccaucccucccaccucagaucccugccuucccacagagacccuuugcaaugucagcagaggcugugcuuccgucgugcccccauccaacucaccugcugcguuagccuggauguugcccuuugcaggguccccauucuuccagaagaagaauucuuuccaaguggccucucgcccuccucccuagcccaguucccuuggcccuucauucuuuccucccuuucucagucucugggcaacacccaagcaccauaccuuuuucuagauuacccacaggaucuuuacaaauuaccccccaccuuccaccgcuggaacuuugaagucauuguccuuccaccucucccuagcugugacauauugggcaaguuuccuaaccuuucugggccucauguucuuaucuguaagauguaauugguaauagacaucucuuaggauuguucacacuuuuauugauuuaauauuaaacauuuuauuuuuauuuaguuaauauuaaauauucaacauauuuuugagugccuacuauaugccaggcagugugccggacauugugaggauuaaaugagauaaucaggagaacagcucgugccuagcacauagugguaauuaguacaucuugguuccauuccuaccuuccacaugauaccuuaugauccuacuuccuaggugccuccagccuucucugcuauugaggcaucuucuuucucucuccuuucccuacauguucuccagaugucucucauucucuugccaccaaaaaccccuuucuccagcacacucaauuccuugcaaaugaaugcuuucaagcaugaaaaucucucucucucuuuccuucuagaauuuucccucugcugcagcuucagccauuccagucugcuuucuugcccuucauccauccgguauauauuucugaaggcuuagcuuucaauucuccccuuauguuucaaccaacaucaauuagcuaacagaacacaguugacucuggacaugcaacauugcauuuggggucucucggggaagaucuguaugaaaguaauugagcuagagguguucaaaaugcagcuuaugggguccuuuaucaaugccacagcuuucugcugccuccuuccugcaagaggguguggggggcggggaggacuagagaguuaguccuuugccaagacucuguauauagguuagacuaauauccuucuccagugaacauuaccaauacucucucauaggcugaggaaagaauagcauauccagacauccuucauguuaagagaaaaucugucccccaacuccuaccccugcauuucucaucuuccugaauuccaccucccacuuggcaucucucucuugguuuauugcuaucacaacaaccacacugggaacccaggaguacagcacuuccuuugagcucuuggucaaacaaggacauaaauccuuuuccuugaauagccaugagaugguagaauguucacuauguuuuuaugcugcuaccaagcggggagcaaaagaaaagaggggaaacaaauaagcaggagacauaaaaaacaaaggcaggauguaguuuucuaguucugcuauggcuugcuugcuucaagacccuacuucauuucuugaucuuccuacccugagaagcccacgucuggcccaacaucauagauuacuggcuuggccucuucaucuucccacucucauucuagcacccuguggcagguggaaccuuacuacccacuagcaggagcugucucuucucaccaccaugcagucaaugccaaucaagagagauuccagauucuuaagccuccuugggugauccuacucaguuuaugauuucaaguuggcaggacuugcuuuguuuauggaugaguggccugucagucaaggaaugaccacauccuuugaauauaacgcacuccagauuugggguuguaccuuguuccauauagccuuuuuccucaaaacaacagcuuagcugugcaguaagcaugucgugcuucacaugccaugcuucacauuacacacauacuggaaaugacuggauuuggugggggaaggcuaugcccucggagcuggugagaaugauuauuuuuagcaccuaucaauucuauuaaccugucaaaaaaaucuuugaacaccucaaaaaaauuuuuaaauuuaggucuuuuguaaaauuuaauuauaccuauggcuuucgggccaggaguacuauuuugcuauauaaucaaaaggguuuugaaauauuaagggaaugauuauugcuaagaaacaucaauuucuucaaugaacaauuuaagugcaugacaaauuugaugugaaauuuaacggguuuuuuuuuuguuccagaauaaaaauuaacaaauaauugagaaauucacuuugauugaaaguagauauaaagaaauaagcuauucaauacauuaaauacacuguaaagaaaaaaugguuggcaauuauaagcuuaucuagaacauugauuuuccuucccuauugucucacauucuuuuccuugcuauguuucuaggauaucuucugaauuuaaguaaguaccauguccacugacauaagaugggccuuauguugccuuagaaggcuuagaagccaagcugugcuccacuucaaugauaauuugauuuacaaacccuuuucuucugccauucuacauaaauuaugguguauucacaccauggugacugguucgucucauggacuuuacaaaugacaccugccacaugacaucaaugugaacagucugcuuaaacagaaagggacacacaguccaucauguaaaauauacauucaaaauucagaaucauauacaugcucauuguuuuacuuuacaauuuacagucauaaauaacauuagauacccuuugacauuaugguuuugagaaaccuucccuauucaauagcucaucuaauucccaauccauucauaucagccugagauuuuugcauucaaguaguauccaggauagcuuugggauuauucacaaacaugaguuugauuaauuuuuaauacauucauuuuacauagaugauauuguaaaacugagaagcaugucuuuauuaccauuuuuaauguuaaggauggguuucacugggaagccauuugugacuuuagaccugacguucucaauuagaaaauagaugagucauaaggaggggauuaaaauuccucucccagucaaccccauugcccuggccaucagauaauagggguagauaggguagcagcugcucccuauagaaaugcuaaugagaaacuuuuccuagaagaaaccagcugaggcaccaggagguagaauuaauaaaccagggugaaauacuugaaaaauaagagcaguaacaaggaaguuagaaagaaaaggagccuuuaaugucugcccuccagccuuguaugaagguuacaggaagacccaucugacuuaguuuaugcugugcagaacugccccauucccuaacugcccauuucccuaauuuccuuuugggucaaucccagcaaugccucgaggccaaucuuggauacugagucuacagcgaugccuuccuagagccagccauucugaaucaauuguucuucuauucccuuuuuacuuucugaacccuuaucauugucugcuugauuguaaaauacucuuguccaugucugucucccccaccacgucaugaacaccugaagagaaggcuguauuuuguucacucuguaccucucacagccuaggugccauauagauuuguugaaucuaauggacuuuuuagggcuuguugaaaauuuuauuuuucuacauauugauagagucaauuucauuuaguugaauuuuuuucagaaaaugaucaccaagccccugccauguaccagacaaggagcugggaauaccaaauaaaugagucauaauuuuaauguaagaaaauugugucuuccucaaucaaguuaaaguccaaauccuggucaagcgcgguggcucacgccuguaaucccagcacaucaggaggcugaggcgggcagaucacgaggucaggaguuugagacaagccugaccaacauggugaaaccccguuucuaaaaauacaaaaaauuguacuaaaaauacaaaaaauuagccgggcgugguggggugcgccuguaaucccagcuacucaggaggcugaggcaggagaauuucuugaaccugggaggcggagguugcagugagccaagaucaugccacuguccuccagccugggugacagagugagaguccaucucaaaaaaaaaaaaaaaaaguacaaauccuaccagguuagcacuagaaguaaauguucaaacggagaagggcagcaaacuuuacagaccugacucuacauggaccuucaccuagggcagcaguccucaaccuuggcuacacauuggaaucaguggagaacuuucaaaagacugaugcauaggugccuugccuagaaaaucugauuucauuggucugggguguagccugggcaaccaaguuuuuaaaaacuacuucaagugauucuaaugugcaacucacguuaugaucuacuuuuauaaggcaucauucucaaaauuuaguacacaaaagaaucaccuggagagcuuucugaaaugcagauuccugggccacauccucauacauucuaauucaaugggcuuaaaauggagccuaaguaucuaauuuuuagcaagcacucuagauaauuuuaaugcagaugaaugcaagcuuuacuugggaaaaaauuacuuggugagguuugccaucuuuaagcuauugaguuuucccacaugcaaacauggcaaagguugccauuuauuuaagucuuuuauguucuucacuuauauuuuguaauuuucuccacaaaaucacauacacauauauacucauauauauacacauauauacaguuuuaaaguuuuauuucuguauuuaaauuguuaauaaucuaacuagauuuuaucuuuaugaauggagugagguaaguauugaauuuuuccguauauggaaagucauuuauccuuacacuguuuucuaaagcuuugcuuuuccccacuaacuuaugauaucuccucuaucacauaagggucacauaucuuuagauauuauaucuggguucucuguucuauuccaucagucugagcuaauacuauauuaucuuauuuuauuuuauucugagcuagcuuuuaauuauuguuccuaucaugaagaguucauuaccuuuucuaauuuauuauugcccauaugcauuaaguuuuguauguuaaucuuguauucaggaaacuuaucacacucucuaauuaguuuuguuuguagacuuuccuggauugucuguggagauaauguauguuuuuagcaaauaacaauuuauuaucuuccuuuccaagauuuauauaucuuguuuuuuuguguguguugcucuguugguuaggacaucugguaugguuucaaauaguaggugauaacaaacauccuugccuugggaugugggaaaguuucuaaaguuuuaucauuaaguaugagguuugcuuuauguuuuuauaagauaagguuaagaaauuucuauuuaucuuaguuugcuagggguuucuaaaaauuaguuuggcuguugaaucuuauugaaugcuuuuucucuuauugaaggcucagcaucagcugagaugaucugugauuuuucuuuuuuaaucuguuaauagauuuuuuuucucauauugaaccaucuuugcauuucugggauaaaucuuguuuagauaaaaauauauuuuauuaugcugaauuugguuugcuauuuuuuaucugaaaugcuugcguauauauucauaaguaagauuggccuauaauuuuuccuuuuuuauauuagucuuauguacuguuggaaucaagguuauaccuauaaaauuaaauggguagauuccccuccuuuuuaguuauuugaaaaaguuuauauaagaagggcuccuccucaaauaucugauaaaauucuccuguaaaacuugcuggaccuguugucuuuuucauggauuuuuuuuaaacugucaauuugaugucuuuaauacugauucacuuauucagguguuauauuucuucuugagccaguguugauaauuuauuuuuuucuggaaaaauguacauuucuucuaauuuuauaauuuauugacauaaaauugaucauagcauuaucuuguggauuuaaaaauaaucucuacuuaccuguaguuaugucuccuuuuucauaccuaauauuuauuuguaccuucucgcuuuuuuuuuucaggauuagucuuguucagauuuguuuuguuuuuuagucuuuccaaagaauaaauuuuuuauuuuguugagcaucucuuuuuucaguaaauuuuacucuuauuuuuauuauucgcuuucuuuuugugcucugagagguaggcauaggucagcuuaucaacagccuuguauuccuggcuaagaaguuuggauuugcuucuauagacaauaaugagucacugaaaaaaucuaagcagagggacaacauaguuugauucaaauuuuauaaaguucccacuggcuggcugaccugggaagauuagagaagggaaggccaauaaggaggcuauugagauaauuuggagaaaaugacaaagccuuaaccaugguugugagauuggagauuuauaacauaauacggguacaaaacaacagaucuaaaugaccaauugagaugcaaagaagaggauauggcccaggaugacccuuguguuucugguuuugguaacugguagugaugcuagucacuggaacagggaaaauagagggggaaaaaagucagaagugaaaguugagguacuuuucaauauauagaauuuggguugucuaugggauaucuaacaagagguguuugagggucgguugaguaaauggaucugaaaguuuagggagaggccugggcuguaaauauagauuuggaaacaaucaucuuguggauguuucacuuccugugaaagucauaggaagaggcaaaauuacccuuggaaaaggaguagagaaaauuaaccaacagaaaauggagccaugggggauacacauauuuggaguacugacagcagaagggauauccaugaaaaaguugaaggaggagugaugugaggagggaagaaagccaggagagaaacuugucauggaaaccucauaugaacucagcaguguuuuaugucuguuuggacauuuuuacugaggcauuuuguuagaucauugguuaacuuugugcaauuaacucucagaaauacaaugcugaccaagacuaacccacaaagaagguaagauauauacgauuaauucuuuguugcucucauagggaaggauuguaucuaaugcauauaugaacuucaaaaaaaugucaagccagugauaguucuaaaucaacaaucacuaagaaucauucaaugucccaaauauaaaacuaaaauaaaucaacaaauguucauuaagauuaaggagcuaucucuacaaugcugcuuuggcuuuaugaauugugucaacuguauuaauguaaauaggugagcuucucauucucugcugaaugaagauaacuucaacaugggccugaaccagcaaacuaaaaacuucuaguuucaccaugagaaauaauaauacuaauaguagcuaauuuagugccuagcaugugccuggcagaaggcuagaaaccuuagauacauuuucucccugaaaucuuugcagucacucuucaggaaccaugcuguuacuucccuguuagagcuuaugauuccccuuccucuaucgcccaggcuggaguacaguggcaccaucuuggcucacugcaaccucugccucccggguucacgcgauucuccugccucagccuuccgaguagcugggacuacaggcacgcaccaccacgccuggguaauuuuuguauuuuuaguagagacgggguuucaccauguuggucaggcuggucucgaacuccugaccucgggugaucccccugcuucagccucccaaagugcugggauuacaggcaugagccaccgcgcucagccccuuuagguuuuaagacuguuaaaaucacagacuuugucuacgcuugucuuucucuacacucagcacuuccugcaugucauauuaauauguacuuucuucauucaguuuccauucaguaaauguuuauuuguaucuacuaugucagguccuggaccaagucccuggaugacaaaguggucccugcucucaggagucuuaugguuauuggacagagacaagugugcugaaaaguuacaggugcccugauaaaauaucugugcagggcaugguggagcacagagaagagagggguuaagucugccugauuugaggguuguugggaaaauucaguagagagggugacuaguagccugagucuugaaagaugaguuggcgguaaaugggagaauggaucaauuugaguaaaaguacaagaagagaaauuauaaagaguucugugugggcagaacuuggaaguaucauugcauaaggauagaauggcaagggacagaagagggagguaggcuggggcuagcuccuuugucuuauaagcaacaggagaaucaggauucaguuuuagauuuuagaaaaggugacuuugacagcagugggaagaauggacuggagagauuagacugggaacagaguccagggaagaaacuacagucuaggugagagaugcugaucuccagcaagaauagaauguaagcaagugcugauaagaauaaaauuauaguggcuaaaugaaaguaggcagaaagggagagggaagagccuaggauguuucuaggguucauguuuuggcugucuggggcgggggggguggagaaaugguauacacugagcuagauagcacaguuuuggguaaguugaguuuggggugucuuuggaaggucuacauggagauguucgguacagaaugaaaauggaaacucauacugcugcuaaggguguaaauugguacaaccacauuauaaaacucuuuagcauuaucuauucaagcuaaacauacauuuaccaugacccagaaauuccauucuugaguaucuaccuaacagaaaugaaugcagaagacuuauauaagaauguuuauagcagcauuauuaauagcuaagaacuaaaacagcccaaauguccaucaacaguaggauacauaaauugugguauauucauacagcagaauauuauauagcaggguauggaaggcagaauaauccccccugcaaagauguccaaauccuaauucuaggaauuugugaauauguuaucuuacauggcaaaggggauuuuacaggugucauuaaguuaugggccuuggaauggggaguauagccuggauucacuuggguucaguguaaucacaagaguccuuauaagugaaagagaaagacagaagugucaauauuagggugaugcagugugaccaagacuugacuggcgguuguuggcuuugaagauggaaggacacgucccaaggaauguaagccgccucuagaagcuggcaaaggcaaagaaaguauucuccccuagagcuuccagugagacccauuuuggacuucugaaugacagaacugugagaugauaaaucuguguugcuuuaagccauucuguuugugguaauuuguugcaguagcuauaggagauugauacacaggguuuaucaauuauuggccagauaauucuuuguugugggccuguccugugcauugcaggaugucuagcagcaucccuggccucgaugcacuacacaccaguaauauuucccagcccucccuacccugaguuguggcaaucaaaagugucuccaaaggcugggcaugguggcucacgccuguaaucccagcacuuugggacaccaaggcgggcggaucacgaggucaggaaaucgagaccauccuggcuaacacggugaaacccccgucucuacuaaaaauauaaaaaauuagcugggcgugguggugggcgccuguagucccagcuacucaggaggcugaggcaggagaauggugugaaccugggaggugaagcuugcagugaaccaagaucgugccacugcacuccagccuggcgacagagcgagacuccgucucaaaaaaaaaaaaaaaaaaauagugucuccacacauugccaaaagcuuccuaguggaugagaaaauugaucccagauacaaguauauuuacugaaugauuccauuuauacgaaguucaaaaacaggcaaaguaauugauggugacaguuguuggaauaaugguaaucucugggauuuagguggguaauuggcugagaaggagcacaggagaaacuucugagguguuggaaauguucuauaucuugaucugagugguggugacauggguuuauacacacaaacaauugagacuuauggacguuauucucuguguguuauaccucaacaaaaaauaagaaacaaaauacaaaagaacuaaauggagauagagcuugaagcucaggagaaaggguagaacagaaaagaagaucaggacaacaucagccuguuggugagaaucaaacccauagguauuaggguggguagggaagagagagggugagaagaaaagaaugcugaggucaacgcccagcaagcaucgauaucucugguaugugagggaggagucagcaaaggaugagcucuuggugucugugcuugccucuccuguccaaaagagagcaggagcauaggccucacuguggucucaaccuccaaccucuggugcugcuggccuuguacauuacacacaggaacuacccgugcuguguauuacauaauacacaucguuauuaucuuugcuauccuucccuuaucuuagcauaguccacugucaguggguauuuguuuucaaacugaaugaagaggcuuuugcaggauuaggccugguguaaccucuuuuagugggaaaauugugcccaaaccucaagccacaaaacccacugcaagugcaucccugaaacaaugcguccuccacugagcuguccccuuguggucacuguccauuuugugcagugucuuugaaacacuggccuacauuguggcauauccuagagugcauagugcauuuuugcaagccuccuagcccuuaaggauuguuccguauuaaaccauaauaauuaggcaaaagguagaucaaggcagaaugcaaaagagcagaauauuagaaagaacagagacauaauugaguuucaggcucaucugcugaguguuuacucugugccaacugcuuuaacauaucuuuuucuguagacuucauaaugaccuuuuaagguaaacaucucuaucuuuaaagaugcagaauagagucagagagguauggggacugagguuauagaaacaguuaguggcugagcuggcucaggaaucuaauucuccucauuccagccacagcugugucuugcuugugcagcuccagcaggccccugccaaguccccucauguuccccuaguccaacaugccauucuugggagggcugcugccaacuucaaccuuuaugcugucuuucuggccccaacucugcuaagcccauaccaucucccuccacuaaucuuguuucuacaguggaggagggguggguggucucacuucuuuuccuaaacucucaacagauucccuucuccuccagggcaaggcccaggcaucugggugugcagucagugccuuccauuaucugaccaaucugaugcuucuagccuucuugcccacugcucccugcacacacucgaugccuuuucuuggguauucucagcccuggcugcacguuaaaaucauauggaccucagcaggugcucugaccgaaucacagccuaaacugggucucacaagccccacauucaaacuacugcuggauuuugcucacaguuuuccccccugcccuccucccaucuucuuucuaaauccuuucuauccuucagggcuuuuaguccauugagaaagaggcuuauacuauaaaagcagggaauuagguuggauuuauuugauccuaauuccauaauaauaaugcagugggccuaauauuauuuuuacucagaguucaauguaacaucuuaagagcaugccaaggcugggacuauaggcuaugaagauucaaggugaagagcacaugaccccuguuugcaggagauugcugucuuuugagggagauaauauggauguaaguaguguaucuaaaaguaccaggcgggcccuggugagaguaaaaauugggagccagaguucucuaggggcgcaacaguggcuaguuaacacuaucagaagauuguuggaaggaaugguuuuaugaguccugggaggugcccuuguguccugugaagaauuuaguguccaucaaagcuggguuugaaucaugcaucuuaacuuaaagucugugugaccuugggaaagucuuuauuuuucucaucaauaaaauggggguaacuacacaguugugacuucacagagucaugaugaaguuggggggagauaauguuuguccacagugcauacucaucauaguaagugcuggcuacuuuuauuauuaucacugaaauaaugaaguagaguauguuaccaaugaaaguuuuucauuuacucauucaggaaacauuuauugcaucucagaugaaucacuacgcuaggguagagagauaaauuacaccuagcaacuguccuaaaggagcuccuggucuagugggaggaaggcauauuuuucgaaaguauagucauagugguaagugcaagaauagaaaugugcacaggcuauugaggaguuguagaggaaaggggguuucuggccugagucaugaaccacuuccugaagggguguaccuguacggugugucaaaagcuuaggaguuaguuccacugggaaggaaaaagauuaggaacuauaaauuccuuccuagagguuuuuaucaaugagauaaaaauucagaagggcacuuaaaaguacaauacauucuuguaauuccugcuuuccucugaugucuggcuuuauuugggacuugguuucaaguccugcuuaccauguauuaacuauaugauuuagagcaaguuacuuaaucacucuuuucugauuuuguuuccuuagugguaaaacagaaucacuaauaucuaccuuacaaguuguugaaagacuuaacauuccauuaagucuguuacuaucuuaccuaucuuauuuacuauuguaccuccagcaccuagcuuagugcaugguguuuaauagaugcuuaauagauaugaauuaauugaacaaaugaaugaaagauguguacauacagugcucagcacagugccucgcccguaguaagcacucaauaaauggcaacuauccucaucaucauugucccugguggguugaguacuacuuggcuaauauacagagguccuuugcccuucucauugcacacauucugaauuucuggguaaagaaccauuaaaugcucaggucaaagauuuucuauguguauuuuuuuaguccagcaagcaucucugagucaccauguucuaaucuaccugugcaaauaugaauuauuuggagaggccuggcuuuugccacuuugcauacacaaaaauuauuuauuuuauugcaugaguaaaauaagaaucauaaaauuagaacuguaauaaaagcaauuagaaaagaaugauuuuuagcaaguuuaaauuugcucugaaaaugaauucagaaauguuucugugcuuugauguuaucuaauuuuugccaaagucuggauuuggguggcaucuaagugccacaggucagagaauggguuaauuguguacaaacucgaggucgaauuuuccuucuuggauugugaugacuugcuagccaaguaucugugccacucugacagcauuaugccugcaucuccucaaaaagcccaggggccccaaggacuccucccgaggauuugguauauuucacaugauuuuucagggauguacaagaaaguccauucagcuugcuuuccuugcagacagagccugggccuuguccuuuuaucccuuucuugggccuggcacagaagagaguucaaccaguguuggaagaaugacucucggcgagugaauugguccauugccguucuucucagagcuuccugaugaccacauucucccuuguggauugagugagccaccggauuaaauaugcaauucagaugcugagauucuguuuagaggguacagggagagaaaaaaaugaggcaucauggauguaauaugggugggagagaaguaagaggaggaaaaggaguagggauggcagucggaguguuccuguccauaaacagaacugugccccaagccugaugacuugagaagacagcauugucaagguuucuaaagauggauucacaguauuuuucuuuuuucuucuuuuuuuuuuuuuuucugagauggagucucaaucgcccaggcuagagugcaguggcaugaucucagcucacugcaaccuccgccuccuggauucaagcgauccuccugccucacccucccuaguagcugggauuacaggcacgugccaccaugccuggcuaauuuuuuguauuuuuaguagagaugggguuucaccauguuggccaggauggucucgauauccugaccucaggugauccacccaccucggccucuuaaagugcugggauuacagucaugagccaccaugcauggcccagaugucacaugcuuuuugagcagaggaacuuaucaauucuaacuugaaaagucagagaagacuucagaaaugaggauggcaucugagcuggaccuagaaagauuagucugauaucagcaggcaaaacaaucaggcaggcagcaagggagguggcaggucccaacagaagggacagcuggggcauggagagcuagacaugccuauggagaaccacagauauucccauauaacaaguguuccaaguauaagaagugacauggugggagacaagcuuuauagccuuagucuagaccaguggugggcaaacuuccuauagagggacagauaguaaauauuguaggcuuugcaggcuaagaugcaaaauuaagguuauuaaguagguacuuauauaacaagagagaaaacaaauuuccaccaaaauuuuauugcuaaaauucaaaauauaauaauaauuauugaauagaaucuuuuauaauacagcucugcuaaugagaauaauuuuuuuggguaauaauauuugcugaauugggguucaaaguugguguucccuuucaucagguugauugcaaacauucaucuacaaaaaccuuucuuagcucacagcugaaaaacaggcagagggcuguaucuggcugguaggcaauaguuugccaauuucugaucuagguuauugaggacagaauacuguguuaccaaguuucagacucuguauuuaaguagcaaguaacccccugaacagagugcauaagaauacuugguucggcugugccuuauuaagcacaucacucauucuucgaaagugacauagucauucucuuguuuccuuacaacugaauagcaaugggaagcugauguacauguaagagucucuuugucuuuauauauaauggauaaccagccaaucucucauagcaaccaagaacgcaagguacaggagucaccauugugaaauacuauuagucucuggcuacuaugaccauuuuugugugggguucccuucggggcuacaacauggaauuuuuuaaaaaauggacgagggauaaaugguauuaaaagguauacagugagaucaucaacaugccaggaucuagcacccaaaaauagcacagaagagagcucuaccaugagggacuguuaugacgccucaccgaagcccugguccagcauuccuccagagugggccaaaggcaggcugugaauuggagagaggcuuggugauucuaaaaaucuacuauaacaccauucuguggggagccuuuuagcacagcauaguagucccaguccagacugcauuugugagaaugagauucuuugcaagcccuugguagaaugcauuacuuuagucacuuguucauucaauucauauuuguugagcucuuccuacaaacaagacucugagcuaggcucuggggauaugacuaugaagucauauccccagauuggggucauauccccagggauugggacaugcugauuuacucugugucagcuccuacuucaauaguagggagaaaugugaugaugaagaugaugauaaugauggggauuguggugcugaugggugaggaggagaggacagagcagcagaagcaugaaugcucuuaaauaaggaaggucuuuagggcuaggagugugugauggaagggagaaguguucugaagaaaagguaaggaacacaagagaaauuaguaaucacagcuacucaucugguagccauggugcaauggaccgaucaaauggcuugggaucagaaaaccucagcuuaaauuccagccuuuccauuuacuauuucugugaccuugguaaaguuauuucaagucucugagccucaauuuccuccuucagaaaauagggcaguaugauacaugccauaggauauaggauacgaacauguguaaacucuuagguccuugcaguuauaauuccuaaauauuaauacucagaggugagcauggaaucugaaugcacaccagucuagacaccaagagagcagucacucagggaacagacucugaacuauguucuuggauuacagccaugaacaagacaaaauucaucauggaaugagcaguguaaugacagauaaggugucaagcgugcauuucaauaacuaauuauuaaauuuagcugugauaaaugcuuggcagggaaaguacaaggugcuaacagagcauuuaaugggagcugacaggcuaaccuaggugaggaguuggaucugucaucugaggaagugguguuggagcagagccuaagguuaaagaugaaccuugaggccagcuuugccuccuaugugacccuagacaagucucuccuuccugcuucauuguccucaucuguuacuagggguuggcccaauuuuuuggggaguccuucccagcacuacggugccacacucagagaucccuguaaaggccugggugcgugaugucaaagcauggucucacguuggaguggggaacacaggaaggagcacgacggaucugaaaauccgaugacauugaagagggagggagcucauggccaaagaaucaauuccauccauucgauacugcucucauucccgcuuaagugucugauggugccugcuccaauaaauccucaaagcauuuucuggguuuuuuuggagaacuuaacaaaaauacaucacuaagaaggguaaaacacacauauuuucacuauccauaauuuuaaaaauuaacguuuuauuauauuugaggcugggugcgguggcucacaccuguaaucccagcacuuugggaggccuagauggguggaucacgagggcaggaguucaagaccagccuggccaagaugcugaaacccugucucuacuaaaaacacaaaaauuagcugugugugguggugcgcgugacuguaaucccagcuacuugggaggcugaggcaggagaaucgcuugaacgugggcggcagagguugcagugagccgagauugcaccacugcacuccagccugggcaacagagcaagacuccaucucaaaaauaaauaaauaaauaaauaaaucauauuuucuucuagucuuuuauuguauuaaaaaauauuuuuucagguaaaguuguuauuuuucccccccacuaggcccagacccauucugcuucuucccuugcccccugggcagucaucacuguuauaaagagguauacuuucauguauaccucuucauccaugagcuguguaaggccuugcauuuaugugugcuuucugacauggcauccuacacuguguaucauucugucacuuuguuuuuuucacccaacaucacauaucuugagaaaaugcaaacacacacauauacguaaauacccauacauauacagaucguucuuuuuaauggcuguauaaaucugccaucauaugacaauaucacauauuauuuauuucccuauuuauguuuagguuuuuguacauuuuuacuaucacaagcaauguugcagugaauauccuuauacaugucuagcugugaauauauuaaaggguuagaagagaaauuguuggguguuggguuaugcacauuuuguauuuuauuaaauguugaaaaaauguucuuuuuacuggcuggacccauuuauacuucaacuaauaguauauaaaaguacccccuuugucuuauaaugucagacuuaaaaauuuuugccaacuucauaauauggaaauguuuuguuuacuucauauuucccugauuuugagucaaauuaagaaacuuuccauguguuuauacacaauuugcauuucuucuucugugaauugcauauuccuacccuuucccauuguccuauucagguguuaucuuuuucuuacuugccugcauugauucugauuacuaaucuuuuuucugugguuugucuuuuaccuuuguuuauaguaucuuucgucaugcagaaauuuuucauuuuaguguauucaguggacuuaguccuugccuuuaucauuuauuuuuuauugcuaauguaagaaaugcuucacuaucccaaaguuauaaaggcacuauuuucuuccaauaauuuucuguuuguuuguuuguuuguuuguuuguuuuuagacagggucucacucuguugcccaggcuggaguacaguggcucaaucacagcucauuuguguuucgaccuuccagggucaagcaauccucccgccucagccuccugaguagcugggaccacaggcaugcaccacuccaccuggcuaguuuuuaaaauuauuuuugguagagacgaggucucacuauguugcucaggcuggucuugaacuccugggcucaagcuauccaccugccuuggccucccaaaguguugggauuacaagcuugagccacugcacccaaccucuucuaauaguuuuaaauuuuguuuuucacaucuagauguguaauacaucuggaguucaauuuuguguauagugugagauagaguacaauuuccuguguuucuuguaugugggaagucaaguaucccaaauccguuauuugucugacagguaauucuuuuuuccuugauuaaaaaaguucccacuauuauauagcaaguucccucauuuguuucuggaucuguuucugggcucuguauuuuguuggauuggucuguuugucuuuuucuaaaaaaaaugccacacuuauuugucauagcuuuguaauacgcuuugauuuuuaacaggacagaucucuuuugguuguucuuuuucagaauugucuuggccuuucucagacauuuauccuuucguauuuauguuggacucaguucucaaguacugcaaaaaaauacuguugggauuucgauuggccucagguuaaauuuauagauuaaucugaggauuaacaucucuauaauacugcgucuuucuaugcauaaacaagaugucauucccuuuccucaagucuucuuuuauauucuucaaaaaggucucuuuuccuugggauuuuuccuauacguuuucuagauuuuguugcuauuaugaaugaguuuuuuucuguuaucauuucuacuugguuguugcgguauguaggaacagcguuguuaugucuuuuaccuuugaacuugcuaauucuuuuauuaauucuaauauuuucuccuuugauucuuuuucuuuacuccuuuucgaugcauuucugucuucuauugaacauuuuucuguauucccuucuacguggaaguuacacauucauuuuuguggguuuuuuuuuuuuuuuuuuuugaucagguggguuuuuuuuuuaguagcuauucuuauuuuuauuuaagaauuaaaaaguaaguuucagccgggcacaguggcucaugccuguaauccuaacacuuugggaggccaaggcggggaucacuuugaggucaggaguuugaguccagccuggccaacaugguaaaaaaaaaucgucucuacuaaaaauacaaaaauuagcugggccuggugguacaugccuguaaucccagcuacuugggaggcugaggcagaagaaucacuugaaccugggaggcggagggugcagugagcugagaucaugucacugcacuccagccugggugacagagcaagacucugucucaaaaaaaaaaaaaguuucaaauuaaucaagcucuacugcucccaauuuccauguuuuucuugucuuauauuuuaccucaucuuugcuuuauaaauccucaauuuagaaauaauuaguaauacaauuuuuauacccaaugcuuauuuagauuugcccccauaucuacuaauauuuuacucaccauugcuucuuuuuuuugagauggaguuuugcucuuguugcgcacgcuggagugcaguggugccaucucggcucaccucaaccuccacuuccuggguucaagugauucuccugccucagccucccgauuagcugggauuacaggcgugugccaccacacccagcuaauuuuguguuuuuaguagagaugggauuucuccaugucaggcuggccucgaacucccaaccucaggugauccgcccaccucggccucccagagugcugagauuacaggcauuagcuacugcucuugccuuuuuuuuuuuuuuuuuuuuuuuuaauagagauggguuuucaccauguugcucaggcuggucuugaacuccugggcucaagugacccgccugccucggccucccaaagugcugggauuacaggcgugaaccaccaagcccagccagccguugcuucuugaaucccacucuuuucugcugaaaauauggccuuugccugaaggaucuuuaucucacucuccugcuuuagagauaguaucacugagagaagaauucuagaaagacaauaauguuuucuuagcacuuugaagauaccauucuaugguaugcuggccucugcuguugccugugagaagucugcuaucacuguaauuguccuuccuuccuauggaaucuuuccucuuuguuuuaagauuucucucuguguuugcuguuuugcaguucacuauuaugcaucuaaguauggacuugcuuuuauggaucaugcuugagacuaguuauuuuccugaauuugaagacauguaacuuuuuccauuccaugaauuucucaucuaguaucccugaauaaugccucucuuuauuucucuauucuuuccccuagaacuuguauuacacauauuuuauuucuucucaauauauccuccucgucuuuaaaccacuccuuauuuuucauauaucuuaucuauuugugcuucauucugggaaauuuucucagucuuucacuaauuuucucaaauaggauauguaccucauucaguaaaauuguaauuucuaugauacuucauuucuagaaguucuguuugauuuuucaaauauguguauucuucaucauguccuauuguuucacuauguuuucuuuuuuguuuaagucuuuaagcuuuuuaaacacauuuauuuuguagucuaaguuagauguuuucucaaguucuuuggauguuaauccucauggcagaucauuuccucauaugguuuuaaguuuuuauuguggauugugaaaauggcccucuggagcaauugugcuuucauuccugagaaauauuucaggguuucacuggucugggguucauuuuuaccuuaauuccucagcuuggaaauucuguacucugugggugcugcaaauagggauuccacacccaugcaugacucucacuuaggguuuugauggauaguggcagguuccccgacuccaucccacccccacccagaacccuaaacagaaagggacauccuuagacuucccugggccagugacuccauuacaccguggggcaaccuuuguggcccugcuucaugcaugaguuucaguucccacuccccauucuacagagggccaggucucuucuccuugccuugccguuagagcugauacugggguccaaaguguccucucggcagcagugcagucacuucucacguuuacugcucugacucagaggugccuucauugaaauccuugagaugaacuggaugcugcaacagcugcccucuuggguuuagguguuguuccuguauggaauccaugccuaggucuguggcguacaauuuuuaggugucucauucgaccaguuccagagguauuucagcuuuuagcugccuuuacugcucugauucaggguuuccugcaucugaagauucucuuucuuuggagcucaucuaugaauauaaaaaagacuuauuauauuuuacuauauuuuauguagcauuucuaugcauuuugugggggagaggggagcuuaacucagucaaccaaauuuucuuucuuagauuuucuauauaaaucauuguauuaucugcaaaugaugacaauauugucucugccuuuacaaucuuucuuccucuuauuucuucaauuuugucuuauaucacugucuaggaauaccaguacaauauugcaaaguuuuugucauagucuauuguaguggaugaauaaauacuguguacugguaaacuuugguaucaggcacaucuggauugaauccaggcucugugacuuaauaccucugguauuaagagauaauaaagauaauaauggcauuuaccaugaaaaauuauuuuuaggauuaagugaauuacuauauaaacugcuuggauuaguaccugacacauaacaaaauuaauaccauaaauauuaacuauuagcagcaguaguugugguaguaaaaauaaugguaacagcuuuguguacauuauaucuagucgucacaacucugucagauagauagauucagagagguugaauaccuuacccaguaucacacagcuaauaacuaaaggcuuaauuuuccugaauugguacucugaagccuaugucuuccccucccuagaucaugugcccuuuaugguagugauuuauacacuauugcaaaaucaggcccugggaagaguauuugccaaauccaucaguagaaaacuggagaagaggggcccuggaaccaauguuuagcacucccgagcagauugggagaauucugcccugucccaagccuugagaaagaccucaaaaaaugaaaaauaaguuuguaaccaugcaccucuaagaauagaauuguuuucuaagauguugaaaugcaaauugguauauauagaaucagaaacugccuaagagacgggcugcuuuucaaaucauccaucuauucauccauucacucauugagggcuagagcuggacuaccuggguucuaaucccagcucuccuccuuaauaacuugggggagcucuuuaccuucucugagccucaccuuccucaucuguaaagugagaaguaucauaacagcaccuaccucauagggguggggauuaaaugaguuaauguguguaaagcacauagaaaagugccuggcaacauaacaugugcucaggaaaugcuagcauuuauucuuaucacuguguucaauauacagucaagagccuuuucugaguuccauuucugggacugccaggauggaguugugagauguguggaaacugcuguggaugugcaguaguggcuaguucuaucaauugugagugucagaaaagacuucacaguugaagugagguuugucuucuacauuuacaaagguuuuccucuuugccaagcaccuuacuaaucuuugggguuguaaagcuagaaaauccaggaucccugcugucaaggagccuucauucuggaugaagaaacaaauauguaaaucaaggauuuauaguauaggcucauaagcauacaaaacaaggcaagauuggguugcuauaaaacacaaaggagggacaucugcaguagugugcuggcaaaugugaauaaccagcucugcaagaaaaaaaauuuauauauuuauauauauauauauaaaacacauacauaauaauaaauuuuaguaacauaguggaugugaacacgcaauuuacaaauaauaauaaaauacacaguauucuuuacaguaaauuccaaauaccuauuacuacauuaugucuuucuauuuccugcaaagucuaccaucaguuuuuauauuucuacugccaauaauaguaucacaaaauagacuaugaauacaggcuugauuacuauuugauuuagcaaggaagucacucacauuauugacaaacaaguguauucugacaugaauuuuuuuuaaccagaacauuuauugugcugacuaaucauugaaaugcuugagaugaacuggaugcugcaacagcugcccucuuggauuuagguguguuguuccuuuauagaauccaugccuaggucugcggugacaauuuuuaggugucucauucgacuaguugcaguaguauuucagcuuuuagccuuggcauuccagcuauacuuucuguuguggcugguaggguagcaacauuugccacaggucaccuucugaaaguggaaggccuaagugccaccacagaagcacaaugugugucuuauggcaagguuuccaaacaaugaugaaugggauguucucuucauugucuugcuucugugccaagaccagagagccugguguguauguuggcugauauuuuuguuuguauuaaggagaagguaagagagaaacaaugaaguuguauaaagacauauaccagaacuaguuagucaauguuguggguaucuuuguucaaucagauaauaguuuugaaucuuggaaauguaguuccucaauuuuuuaugcuauuuacaauguaacaacuacagauacaacccauuuuuaagccuaaucugcauuauuaacauuuacuccauuacuuucuuaaaucuacucagucaacagagugauagacuuagugcugauuuguaacauuugcugauuuccagggugucaauaugcccacuauggcaaauuucagucagccaacaugacacugaagaccacagaguugggaagagcugcgcagaagcacaucauuguguagcauuucuacccuaaggcuacaguagauggacaucaccucaaaagcguagcuaauaguaaaugugcuaaaagaauuaggaaaugaugaguuuugagcuuuuguuacuuuaauuuuaguguaauuuauuuaauuguauauuuauauaaauuuuguauaaugguugugcuuaauaacuggcucauaaaauuccagaaaauuuagcuguggcucucuucagccauugugaacuggcuucaggacacuacugaccucuaaaauagacuugcagaccagaggaagcuuccugaaauacuaacauuugagugggacucuggggguugaguagaauucugcuagaugaaguagagcguggcaucucaggcagaggaaaugaacagaacgaggaaagauaccucccaggguuacagcauuagcuucaccuggaagcuuaacagaaaugcagaauccccaaguccugcccuggaaauacuggaucagacugcauuuuagccagacccucaucagcauuuuaaagucugagaaucccugagccagagcaggcuuucucucaggugguccagaccacuuacauuggaaucacacgaagugguuguuuacagugcagauccugggccccacucaggcuccuggguucuaccccagaccuucuaaauuggaauuucuuuuuuuuuuuauuauacuuuaaguuuuaggguacaugugcacaacaugcagguuuguuacauauguauacaugugucgaguuggugugcugcacccauuaacucgucauuuaauauuagguauaucuccuaaugcuaucccucccccuccccccaccccacaacaggcccuggugugugauguuccccuuccugaguccauguguucucauuguucaauucccaccuaugagugagaacaugcaguguucaguuuuuugucuuugcaauaguuugcugagaaugaugguuuccagcuucauccaugucccuacaaaggacaugaacucaucauuuuuuauggcugcauaguguuccaugguguauaugugccacauuuucuuaauccagucuaucauugcuggacauuuggguugguuccaagucuuugcuauugugaauagugcugcaauaaacauacgugugcaugugucuuuauagcagcauguuuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaucuguuguuuccugacuuuuuaaugaucgccauucuaacuggugugagaugguaucucauugcgguuuugauuugcauuucucugauggccagugaugaugagcauuuuuucaugugucuuuugacugcaugaaugucuucuuuugagaagcgucuguucauauccuucgcccacuuuuugaugugguuguuuguuuuuuucuuguaaauuuguuugaguucauuguagauucuggauauuagcccuuugucagaugaguagauugcaaaaauuuucucccauuuaaauuggaauuucuaagguugggcccaggaaccuggaauuucaauaugcuucugagauuguuauuaugcaugucagcaguccacacuaaaagacuuggccccaaacagucauguuugaauugggucagaaaaaugaaacuccuuaagcccuccuaguaaacuauucccuucccuuuguaugcaaagcauauaggucauugucuggcagacaguaggugcugcaccaaugguagcaauuguucuugcaguauuugugauauuugaaacaucaugaguuccuugucaaggccagaauuaagcaugaucuagggaaagacgugugagagaguguguguguaugugugugaguguguguguggggggguggggguugguuggggagggguguaugcaagggacuggauaacucagauugucccuucagccuguuccccacccccagugcugacaaccaucugcucuaggagccgccugucugggaguggaggguauccaugguuaccaguguggagguugccaagaggacucuguggccgccagccagaggggagaguggaaauuaaguggaacugaaagugacagacucguguguguucaauggagugggaggcagucagcugugagagccaugguggggcaugggcacagccaagcuagcgcuugggcacccagaggaagccucuagacaacagugacugcacagcugugcccaggaggaucacuuuagacaaucugaacaguaaucucucugugugugugucugucucucucuccugcacacaaaccaccucccucccuuguuuucucccuccacuccuaagcagaugcuuuaauuguaauguugggucaucugucuuucuauacauauuuuuauaggguugaaaucaugcacuuccaauucuggauucuucuuuacaaaaaguuccuuucagucggguuuagcuuugaaaagaaaguacagaauuuagagugagaugucuccuguguuugcaccccgcaucagccuggucaaaaauuagugcuugaggccaaaaugacaaguuggcccacaauggauauuccuaagugaaugcuauuguacaucucaaccagcggcauccguuuuacucauuucaccaguuuucaaguugggguuuuuuuguguuuguauucagcagcuuugauaaagccuucugcauaaagaaaaaaacacuuccaacaggaagaaagggaugugggauuguuuugcuuagauauauauuuuuuaacuuuuguuuuuauagauuuaggggguacaaguguggcuugguuacauggauauauuagguaguggugaagucuaggcuuuuaguguacccaucacccaaauagcguauauuguagccauuaaguaauucuucauccuuuacccgccucccacccugccacccuucugaauuuccaaaguuguuauuccacucucuguguccauguguacacauuauuuagcucccacuuacaagugagaacaugugguauuugacuuucuguuugaguuauuucauuuaagauaauggcuuccaguucuaucuguguuacugcaaaagacaugauuucauugucuuuuguggcugaauaguauuccguaguguauauaccauauuuucuuuauccgcucaucuguugauggacacagauugauucuauaucuuugcuauugugaacagagcugugauaaacagcagcagcugucuuuuuuauaucaugguuucuuuucuuuugggguagauacccaguagugggauugcuggauugcgugauaguucuauuuuuaguuauuugagaaaucuccauacuguuuuccauagagauuguacuaauuuacauuuccagcaacaauauauaaguguucccuuuucucugcaucuuugccagcaucuguuauuuuuugacucuucaguaaauaaccauucugacugguguguggugguaucucauuguuuuguuucagauauuuuugaaaagagcauucagauguaaaaugcuguauugacccuggagcgugacauuaauagagugagaaacauguaaguggaucguuucuccccauuuagugguacaacaaccagaggccucauuauuccuguuacuccaagagcacuagaggugacagcuggggaaguuggcaggagcaccccaagggcagugcggaguccuuagugaccaaccauguuucaggggaaaaugggcauuaccugccagggagaucaagauaccauuucaagcagaauguuucucagauucauccauugucuagaugaguucuguuucuaaucaauucauuuaguuguauauuaucuugaguaggacacuuccugggagugguaacagccaccaggauugcuguaagccaggccugaggggccugugaggagagcacugggcagauccaggcccagucaagccacccugguguucuugaauuuuccccaaggcaaugaaacucuuuauuuacaucauuuaaaugauuacauacuauccuagcauguagauguagcacaucuuauuuaaccauuccccuauuauuggacauuucacuuguuuucaguuuuucaccccuguuaauucaaaacauuacagugaaugucauuuuguccauccuuccuucuuuccuucuuucccucccuccuucccucccucccucccucaguccuuccuuccuuccuucccucccuccuuccuuccuucccucccuccuuccuacuucccucccucccucccucccucucucccuuucuuccuaucuuuccuucuuccuuccuuaagaaacagcuccauuucaaggcaauaauuuugauccacuuauaguuucuugaccagaaggaguuuuauaaguaaucuguccugcccucccauuuuagagaugugacaucugaggcugacagcaggguuugugauuuauucaguggcaaauccacggugggguucagaguagagaauuggauccaagucuuuuuggacuccugcucuagugcucucuucucucucaccaagcagccuccagcuccaccuuuucauuuugccugaucacauauuucacaccccaucacccagaaauacuacaaaauuagcccauucaagacccuauaaauagcuggguuuauuucauuagauguguuucugcccuuuuaaauguuuauuuaugagucaauacuguuuucacagcaaacuagaaagcagggacuguaucuuuuucaacuuagagucaguaaaugcuuuucuugcaugauugaaaggagccugugaauaauucaaccgcuccauauauauggucugccauuaacuuuuacauuuuugcuugagaaaaacaucaguuuggcagcagcuugaaaauugauuuaaaauucuaaccccaaagaugagcaaaaucacuaauagaaggcuuugcuuaagcuuccugacucuuuaaauucacuuaacaaauaguuuuggaacaucuucagugaacaaaacaccaaguuaaucuaauuaauagcuguugaaaagggagaagggcuuuguccucagguugcuuccaguuuaguaugggaagcuauuuucaaaugcaagcuucauuauuacucauacaccgugaggccagcggaucaggagacaacugccauugaaagagauauuucgcucccagaaggaauauugugccaugcagggccacacaaggaagcaccaaguugggucaggaggcaagaaggauugagggagaauauggaugaaaggcuucuuugugauuuuugcaggaaguaauggauaagcuggggcaagcaggcuaagugggcuuaggauuggcuaauuugaauaguuuuggugggcucuggggcacaggggcuguccacaguggucugguaccuggcccuggagugauuagggcagggaaauagugguccaagugugagagccugcuaaaggaggugguuggggaaugguuauuggguugguuugcauauaaaagguacccucauagacaaguuguuuacuaucucuaaaaauuggcuaguccugggguguaugugggggcugaagagcgagggacaguuuccagagcaucacuaaggccccagaugccaaaacaucagaguaaaaaagaugcccuuaauacagaggcaaagcaggugcuucaugcuagcauuguauaagaugaaaagcuguaacaaaagagaagcacucuuugguuaagaggaagagauuauuucaaguauucuuguucuggcauaggcuuaauagaagaaauagcuuuucagaagggcaggugaggggaaggagcccagcucucaucacucauuggcaaguugcccacuguaaauuacuuaaacccucugaaccauguuuauucuguuuauaucccaagguuguugggcagauucaguaaauaucuuagaguuucucucaugugcaccaucuguggaccugcaucggaaucaucuggaguggucauuucaagugcagcuuccugggacccagaagcagacuauggggguggggcccaggacccugcauucugacaaaccccucacucccacccaaggugauucuuaggaacacuaaaguugggaaccaguguggagaaaauaaugcuaggugcauucuaggaucuaaaggguaaaacauuacacuuggguaaagagguuuuguguacuuauuauaaaacaacuguagccuuucucgugcuucaguaucucaugccuggcagcuccuuacacgggcguagcauccucugagcuagauguuaaacacacagacacaaugaagauaccuccccaaagcccugccuccugcagcucuggucggcuugggccagcugcauggggaggcuaacauuacagauguucugauauggcucacgaaggaaugaagccaaggaaccgaguccucagacugugagaaggcucgagucacagcuuggcugcuguugcagcugugugguuucaaacgccauguuuauccccaugaguuucuauuuuuaccucaaaaauuuaaaaauaugaacugacaaacuaauugaaaguguuuuagcaguuucaaguaaacuugaguaaaaauuauugaaaaauugcuaagucuuuuggccuugccuaauugggcuuuuggcagcgagacgccgccuggccuggugcugauggaaggggcuuaaggagacgaacacuuuguaagcaccagaugccacucguuuucucuugguguugauguguuuaacccucauggcagauguaggagguacauuuuucccuuuucacuuuaauaaaaugaggcucagacacguucuguccugucacaagcccaagauuucacaggaagugaggugugaacgaggacuucaggccggcucuguuuacuuucagaggcuccuuuauaucccaggcaggcugccuccaagaagagcagaguccccaggggaacccagaggcugcuccugcaccuccuacuaauugcuuuacaauacccgggugccaaugcucccauuuuaugagccuuaaacuuucgguucaccgacuuucacagagaucauuauuaucaaaucucugacagaacaaccaaaauccuggccgccuauuuugcuccacauuuuccuucccacuccccuaguaauuauacaauaauuacaauguugguaauuaccucauuaguaauuuggugugagaaagcucaaugaaagaauaauaaaagggcaucucuuuauagcugccagauuauagaugacaaacacaguuuuaauagcccuuaaacacucauuaauagaaaaauaaauuuuccugcacaauauuuugaaaagugucagcaucucucuuaacccgugcaugguuuucuaaagaggccaaggcuuucucaucugaagagcccguuuccaagcaagcgaagguacucugaaaguucuaauaagagccaucucugugggauuugcuuuugccauccuuuggccaugaaaagcccugugucucccaucuuuggugaauuuguaucauaaagauuagacuuggcugggugccguggcucacacuuguaaucucagcacuuugggaggcugagguggguggaucacuugaggucaagaccagccuggccaacauggugaaacccugucucuaccaaaaauauaaaaauuagcuggaugugguggcacaugccugcagucccagcuacucagaaggcugaggcaggagaaucacuugaacccaggaggcgaagguugcagugagccaagaucacgcccuggcacuccagccugggugacagagacuuugucucaaaaacaaaaaagaauaaaaagauuagacucgugucuucuuugacauuuuugucaugcuuccacuuccauaaaguagaauaaaucuucucauuuaugugcucuuaacgcucuuuacauacuuucuguguaagauucuucacucauucagcaaguuucagcaaguaucucuacucaagagucucuucugcccagccuggggauggggacgcagcuacugucgcccaccccgucauaaucuuuuaucuggacuaucgaaggagucuccuaacaggucucucugcuucuuccuugcccagcuagugucuguucugaaugcagcagcugaaguaaacauaaaccaagagucaaaucgugccacucggagcuacaucaggucugcucaaauccuccagccgcuccccaucgcacagaagauuaaaccaaaucccucucucuguuauccaaggcccuccccacucugcucgcccuucucugaucucuucuccuacuccucguuagcucccauucagccucacuggccucuucagcauuccucagacacauccuccggccuuagggucuuugcacucucccugcagaagcccacaaggcucacuuccuccaggucucuguucaacucucacuugaucagagaggcuguuguugacccuagguaagcacacauacacacacacagcacaugugacucucugucaccuuuauuauucuuguuggaacuucccaccaccugacauaccagcuuauuggcuuauggucccucucccuucauuggaauguaagucacugcucuccaagagggcagggacuuuguauccucuguccucuguuguaucccaaugucuucccacagcaccuaaguuaauauauguuaaacaaauuaaugagugaauuuuuuagcaucucucacuagcauguccucaugaaauacuuacuugacagaaaaauccuaaguuugcccagaguauccgucagaggagugagauuuauuuucaaguuauaugaggauuagccuaaagaacaaaaggcacauggaccuuuugggaagaucauuugccuucguaaguccugugggauugggauuuaugagcaaacccaagcaauucagagcauauacuuaauggaauaauuucuaaugcccuguacauggugacucacaugaaauacuuaagugaagauauguuacaagcaguuagguuuuguggagacauugucuacuguuguuuuuaauaacaauaugcuauuaguaccuuuaaaauacugucucuucugaugccaaaaaaaaaaaaagaaaaaagaaaaaaagaaaagaaacaacagcaacaacaacaaaacuggaccaggaaaugagaagcuggaaugcugguuccagcucugccaucaguugcuaugugacuuuaauggaguuauuuccucucucuccaucuaauuuuuuuccaucuguaaaaauuaacauauugaauuaaauuaucucuaugauugucugccaguucuaaaauucuaggguucuaugaauuacuggcuggcuggcuggauggauagaugacucuaauuuccacauuacgcagucauaacaauagugguuaguucuaaucuguucuuaucaugcucuucccacaauucccuaguccagagaauacuacccuuuaucugagguuauguacaucccuuacccuuagguccuuguaucuaucuucuuugaacagugaacaguuagaagccaguagauuauagaaucacgcaaaacaaaaguggugguaacugaaggguauuuauucugugagaaaggaaagaggaagauggauguauuaacuuacaaccaagcaucaggaaggcauacaaaguaguucaugcaguccacuucaccaugccugucuguuugugagagaccuuauacagacauugaaucuucccuuugguggauuauaaacucugauggcugaacauggaaagacccagaauaacaucugaaaaagugaucuuggcccccuaauuugcugucccugggcaaguccccagaguuggaauggaacacagaggaagccugcccugggcuuggucuacuucuuacuagcugggugaccuucgguaaggcacccucuacccccauguuccuggaaauagaauagagcuaauaggguugaagugaggauuaagcaagaaggcucggugagguaaaguaacuugccucuaaugucacagagcuaaucauuugaaucccaaagccauaguaggaaaugaauaugaaaggaaucaaaagagacuccuauaauuuuacacucuccguugauuaaauugauggauuuaaaguaaggaaugucuguauggggcucgcagagauaauuucaccauugcuagaaauucacuuacucacaaacuugguguccauucagcaaaauauaccagaaauguguucacaggugguauuugcuggaugaaauuggaucauuccaucuacgugaaauauuuguacacccagugccuaucuccugcgacagcagaaauuaucacuuuucauugaucuccuuuuagaccugaccuugauauucccucauuuccuccuaaauauaucaaagcacccgaggauauaagugugcucugcuucaauugaauuucacuggucucauguugagauuuguguucugaagcaagcacuugaucaucucaucaccagccuuugaaucugcuuccuuuucuucccuuuucauguuugaguuuccuuagcugagacagccacuugacagccauccaucacuguagcugugcaagugcauuuguaccgucuccugcuggcccuguguuacaugagcccaucuggaggaggggagugggagaggguugggcaaagggcaaagggcaauuaagaaaaaaaaagucuacuguauuucauuaaaucugcacaccaccacagcaagguagaugacauuaucccuguuuacagaugaggaagcugaggcuuagggaggguaguucuugaaguuacacaacugauacacagcauaauugggauuccaaacauaagcccuuucucauaguccaugcuuuguuauugcugagaaugaguggagacugugggagagugaccaaaaauaccuagauaugccugcaguccuaucaacaauuaaguuuuuacccagcuguaacccucuuuaagguaauuugaauuaugcuucuuaaaccagucacauuggcacccacagcaugccaccuugagccaaguggugugcccggcacuuuauuauagacacaauuuacuuuauucaucaccuuuauccacaaagucaugauaacuuuaaagugguguuuuucaaaguaugcuccucugaccaacugcauuagaaucacccaaggaacuuguuaaaauacagauuccagggcuucaccacaaggguaagaacaguggaauuuucauuauuaacaaauucuaugauacauuuggacaauuguucuuaaaagguaauaaguccuuguuauuaacaaaacacuugaaucauuaccuuuuaacgagccuuuguaaguuaagcauuuuguauuuaaaauguagcuauggcuuccuuuaauuaguaaugaguuuagggagauacagauaggaagcuggaacucaguucagggcuuaguugaaugaauauuaccugguacccagagaaauuugaaggaaucuauuuuuaggagugacuaguaggucacaccuauaaaauucaagaucugguauaaauagucugaaauuuggacuucagucuggacuuuuguaguauucuaugauauaucagauagaagccucuuuuaaaauuuuaaguuaaauauucaucauuaaauuauaucagguaagauacaacauuauagaaacagauucauuucaaugcagaaccuuuaaugaauaucaacugugaacuaggugcaaugguuuacaaaaacaauuaagcuggugauuccugccaaacaugcaaagaaaaauuaauaccaauuuucacaaacucuuccaaaaaauagaaaaagagagaacacuucauagcucauucuauaaggucaauauuacccugacaccaaaaccagacaaagacacaagaguucaccagugaagaugggaggaguuuaagcccaggagucccaugcugguucucuaacugggcuggguggauuucugggagaggguagagucggaaaguucggaagaccacgaugaagacaauggugugaaggugguggugaugauaguuacagcagcacaugcacacacacucgcaucacucauaugaacacagauuugaaauccaguaguguguuuuaucaagcauucuucucuaagguagguccuagccuugucuuugcuguaguuacuuauugugguggauauuagaagacaugagaauucaguguguagcugaugaacaagaaccgagacuuuuguuccucugucaacaagacuuccucucacugccuucuuauuuucucuucuccucuucauuccccucagcccacuccccucccggcaaugcccucacuguccuucaguaacagcucccuccaaauaccaccaucccugucaguauaucuauagcccuguuuacaaacuugcauucagaccuagaucuaauuauuugguuaugacacugcaguuuauauuaacccuuugacaaacaagcaagugauagcagcuguggaauaaacuuuuuccaaucccuuugaccucaaaauaaaagaauauaagaauauaaagucagucuuuugagcaaagucuuuugcccuuuauagugaaagcuuuauugaaugcaugaggacagaauuaauucagggaaaaaaauguacuucauaugcaggaugccagaaaagcucccacccugagcaccacuuuuauuggcacaaguugaccugcagaagucccaagcagagacacgauagaaagacccaggcuuggcagggggugguggcucaugccuguaaucccagcacuuugggaggccgaguuaggaggaucacuugagaccaggaguuggagaccagccugaccaacauggugaaaccccaucucuacuaaaaauacaaaaauuagccaggcauuguggcacaugcauguaaucccagcuacuucggaggcuaaggcaggaaaaucacuugaacucaggaggcggaauuugcagugagccgagaucgcaccacugcacuccagccugaguaaagagcaagacuuugucucaaaaaauaaaaauaaaaaaaugaaagacgcaggcuuuucgucuuugugagccugagucccagcacugccacuugccagcucugugacuuugggcagaucucuuuaccucacagagccucuguguuccaacauguaaaauaggaguaguaacuucuaucuugcaggguuaauuugagauuaaauuagaucaagcaaaucuauuauuaaagcuucuggcacacaguaaguuuucauucauuguaaauguaacuuuuacguucaacaaaugcagcucaucagacauaauugcaaggugauuuuauuuuugccucccacuaucccuuuaaauuuauucuccaggucaaguucuuccccuccccuuucacaaaauuuuggaugggucucauaacuuguacaauauuuagggaagucuuguaacuuggcaaaugucaggaaauaaaaguccuccaguaauuuaaauguucaguccuauguaauagucaaaguagucagucuauuuaaagugaauguuuuucucccuccugccgcucuggccugcugcagaggagaugccuacagugggcuucuacugcccuguccuccccucccccagcuccucaccuuuccaggguugguauucggggagcaagggcggggaggaggcaagcucucgcuuggacccguguggccauggugacugaugucccccagcagguguuuaagcugggaucuuugucuugcgggugcuuugcuggguucuuuggaggcccccacccaucacuuugaaucucauaccacagucccuugauaaaugugaaucucucuggcugcucccauacuccuuccucacccccagcauccugcagucccuccagcuucuuucuggugggaucuguuugccacuucagcuggcccucuugaccccaucugcuccaggaaaacagcaccgugcauucuuugcuccagcaaacagaguacaggccacccccaacacaaccauuucucucucccucugcuccaagaccagcuagccagcugucuccugggccuugucucucagaugagucagcuauggcuccagcacagccccugagauccggguguccuugagccucucucuugauuucagucgaagggagaaguagccccgucacagcacacagagcucuugccaacguccucucccuccaccauucucagccuuuccuuugaggauccugcauugugaccuugugccugcuuugguauugucucagugccucagcugaauguuccauuucaguucugggacauggcuccuaauuguaguauuuuuguuuaauucuaacaucucuacuuauugcuguccaaggucaagacacggaacccccugagcuccuguuuccucaucuguaaaacgaggaugauaauaacagugucuacuccauaggaucuccaugacgauugaaugagguagugaaaaagugugccucauacaguuucuggaaccaagaagcuucucugucaucuaccuucacgaucaucaccauuaccaucauuagucugaaagcaaaucaguuucucacugugacgguccccuuguuuucagguccuuuuguuuccaacccucccuccuccuacuguuuggccagagcacacacacacaaagacacauacagacauggacguacgugcaagcacagccacaugugcagagcagaggccguuuaggcgugucuuugaugcugacacuuccacacccagcacucuggugccccuuacuaacugguuuaucucugcacacugcccucccaggaaccuaauuaaguuguaggccugugugaggccagcugcugcuggaccaucagcaucucucuuccaggaccccuaggucucuccaaauggcacagaguucccuggggcagaaagacgggcuaaucccauuguugggaagucaggugcggagugucuguguugaaugauuacaagcaugaagaugauuuuugaaucucacagagggaugcucugcauauuuccucucugcuuucagccauuuccuagguuauacacaguuuggcucugcuccaaaaagagaaaacauaaguaauaggacaguaggccuguuuucaauuuguaaugcauuuuuuucugccacccgucacaauuagauuucacucaucgccuccugccagugguuacagggcccacucugggccuccucaccucccucuguuucuauggguuauagcaccucugauaucaaaugacucaaaucauuuauuuuccucuucugcccuucacuagauugugggcuccuugucuuuucuucccagggccuggaucguagucucucugaggcccuagaugaguaaccucaccucucugagcuuaguuuccucauccauaaaacagaaaguaauagugccuaacucaaaagguggcucugagauuuaaauuaaguaaugaaugcaaagcaccugauacacagugggcccucaguaaaggguaccgauauuauaauugcugcaggcacucaauaaaugccuuaaauaauuuauuagcagaagugacacuaaguuuguaauuuagauuauuauuaaauaaaacauacuugaaucugcagccuccagucucucccuaucccagccucuuauugccccaaaguggucugagucaccaaaacaaaauaccucccgggccacaucaucacgucacuccucugcucuuaggucuugaguggcuccugcugcuuccagggucaagccugagcuccaguguguggucccuccuuaccgcuccaccuucuuugccucuacuggccuucauauaauucuuagcuauaaaaugaaaguguucagaugucuguccagcucugcuacuccaugauucuuaugcagucauauucacucagcaagccuuuucucagugccugcucugugcugggcuaggcucagauacgcuccuguccucuagggcauccaguucagagaggauauaugcuugucaagagaugacugcagcagacugggaugccguguggaagcuggagugagaguuuucauccugucuuaggggucagugauggcucacagaggugauacgugugaggucaagcaaagagcauggggccugggagagcauucuagaaagagagcaauauaagcaaagaccagggauguagauaagcuacucagaggacgagagugggaggcaaugggccuacagaagugggcugugcuggacuggacccguggucuggcuggggagucuggccuugauccuccagaugaggaauuaacagaggucuuuuaaucaggccaagccuauuuucaaccauggcagaagugugccucccuucugguacuguaauuugugcaugugauugguaccaaauuuuauuuugauauuuaaguaagagaaaaaaguugugggauucuuuuuguuuguuuguuuuuuguuuucuguacagaaacugauugcuguagaacaguaggaaagugucagaucugaaguuaaugguucacucuugaauuugaguucugguccuccuguuuguuagcugugugcccuugagcaaaucgcucaccucucugggcuuugguuuucucauuagaaugaggggaggucccugccugguggcacuguguggggauugagggcauguuugugcagcaucuggugcacacuguaggccccaacauccucuucucuucucucccccucagucucaggaugccagccugaccaccugcauagcugacagauaaagaaugcagggugcugaugcgaaggaggcuuccuuugaaauauuaauugcuucccccaaagacuagguguuuucaagggcuuuguuugcucagcugaaugcacaugacaugaugggcuuggaccugccaucccaggcugccuggaaaaugccucuaaagaugacuccaagcgcuguggcugugcuaaugaguuuguggggaugaucuucuuaugaaugcugggagggaaggauugcagaaaugucagugccucuccuucccugccugaaaaucccuacucuucuaaaacugcccugagauuccucggcgaggcccuugaacucccagagcaccugcucuccccaggcucugguguguacuuuuguuuucuuuguguugagugaggcuuacugccccacucagcugaacauuguuagaggccaguucacaucuuuuuguuacucuaggaugcauccucaaugcguguugaacagaaucgccagcagaggcccagcggcaugaaacaaugcuuacuauguaggcugagcaccugcugugugcaaaguguguucaguaggcacuuguuguccauuggaauaugagccuggagccagguagggacgugcugugaaggugaucaugccuuucgaaagaacaugacuauucuccugaugggucuaugcauuaugcugacuugugcccuuagccuuuuucuaucuacucccuuuuuuggccuauauuuaaguugcaucucggguagaaaagagaagcagaaaauucaaggcagggauaguucaugcagacacaggcuaaugaacaugcuucaggcaucuacagggcagcucguggagcuugagauacggaguuggaugggccuggguuccagucaggcccugacuggccaugacacuucagggaagaccuugaaccucucugggagccagggggccuccagccuuacugggcugugcugauggugagagagugagugcauguaagugccgcccaccccucuggcauagagaggaauuaaggaaguggugcagccacccugagcaauuggccucugaggugcuggccacagcacaucacugucacccugggucccagcccaggcaaguuuugugcuacagcuucaugaugaaauuccacaucccauuucugaggaagccucucuggauuucauggccugaaaaacaagucucacauuuucucagacacugacaccucugagcaugucuauuacuucuccuagaguuagcagguugcugaaaagcuugccgaaaguaaaauuacaaugugaaaagaaagagagauaucgaagccagagaagguuaguugggccuggguaaaugaaguccaugauucacucaccagacugcccacccgcugcuggccuggcugcacaucccugaugcaccccagagcucuggccaccgcaggugagacagugugggcagccaagggucucagugugggcagccgggcuucaucagcaucacuuccagggaaucaguagcaacaagaaucaaaagcagcacaaaaugcaauagaagugguauuucaugccacuuucaucauggaugaauugcuugaacccgggaggcagaaguugcagugagccgagauagcgccacugcacuccagccugggcgacagagcgagacuccaucucaaaaaaaacguaagacaaagguguuuauucguugguucaguaacacugacuugagugcaugcugaaacaugccagccuccaaaccaggcaccagggacgcagagaugggucagaugccaccucugcucuccuaggccccacagaugagcuuggaaacaaauaacaaagaucacaguauaagucagacaaagaaggugagcaucagaggaggcagggaucaccuccuugcaaagggaggggugucaggaaaggagauguuccagcuggauuuuuaaacagcuuuauugagguaucauucacauaacauaaaaugcaccccuuuuaaguguauauuuucaugagauuuaguaaaauuauacauuggugcagccgucucugaaagacaguuuuagcauccucccucucacucacaagccucggcaaccacugaucuuucuguuucuacaguuugccuuuucuagaauuuucauauaguuggaaucauacaauaugugguauauucuguuagccuucuuucauuuagcaugcuuuuuaagagucauccauauugguucauuucuuuuuguugcuaaguaguauuccauuauauggauacacucauuuugucuauucauuaguugauggacauuuaagcuauuuccaucuuuuugucaaaaauaaauugaccauauaugugagccaaugguaugaugauaaauguuuaauaacuuuuucccacuaucuggaaaaaaaaagggccuuauuuguccuauuuacaguguuagccaauuuccugauaugaauacugucacauggaugcuuucaagcuaccaauaauuuaacaaucgguucauuaaauuccugaaaauuuaacaauuauuucuguaagccagugugagccagcuuuagcacacuucuguaugcaaagaucuauuucugaacacucuauuccguucauagaucuauaugucuauccuuaugugaguaacacacugacugauuacaguagcuucauaaguuuugaaaucagguaguguaaauccucauacuuuguuucuccuauucaaaauuguuuuggcaauucuagaucuuuugcauuucccuauaaauuuuaagaucagcuugucauuuucuacaaagaguccugcugggauuuugauauuaguugcuucgaauuuauagaucaauuucuagagaguugccaucuuaacaauguugacucuugcaguauaugaauaugguguaucucuuuauuuauaauauuucuucaaucucucucagcagcauuauguaguuuucaguguacagccauugcacuucuuuuuuuacauuuauuacuggcugagugcaguggcucauacauguaaucucagaacuuugggaggccaaggugggaggauugcuugagcccaggaguuugaggcugcaaugagccaugaucacaccccugcacuccagccuggcugacagagugagaccuugucucuuuaaauuaaaaaauaaauuaaaaaucaaaaaaaacuuauuccuauuguauucugcuugauauuauugugaaugaacuuuuaaaauuuuauauucccauugucuguuacuaguauguagauguacaauuaauuuuuauguauugaucuagcauccagcaaucuugcuaaacucacucauuuuuucuaguagccuuuauuggguuuuuuuguuguuguuguuuuguuuuuuugguuuuuuugagauggagucuugcucuguggcccaugcuggagugcaguggcaugaucucagaucacuacaaccuccacuucccggguucaagcgauucuccugccucagccuccugaguagcugggauuacaggcacccaccacaacaccuggcuaauuuuuguauuuuuaguagagacgagguuuccccguguuggccaggcuggucucgaacuccugaccucaagugauccacccaccuuggccuuccaaagugcagggauuacucggucaauuccugaguauuuucuaaaugcaagauuauguuauaugcaaauaaugacaguuugugucuucuuuucuaaucuguaugccuuuaacuucuuuucuuguuuuauuauggauuacccggccaauuccugaguauuuucuaaaugcaagguuauguuauaugcaaauaaugacagcuuugugucuucuuuucuaaucuguaugccuuuaacuucuuuucuuguuuuauuauacugacuaugacugucacagaauguugaauagaaguguugaaagugggcauccuuacuuuguuccugaucuuagggggaaagcauuuggucuuuuaccauugaguauuauguuuguuguaggguuuuuguagauauccucuaguaaguugagggaguuccccucuauugcuagauugaugauguuucuuuuucuuucuuucuuucuuuuuuuuuaaguaaagauaggguuucauuauguuggcaagguuggucuugaacuccuggccucaacugaucugccugccuuggccuuccaacaugcuggaauuacaagagugagccaccacucccagcaauauuucuuuuuaucaugaaaggguguuagauuuugucacaugcuuuuucuuuuuuuuuuuuugagauggagucucacucugucacccaggcuggagugcaguggcacaaccuuggcucacugcaagcuccgccuccuggguucacgccauucuccugccucagccucccaaguagcugggacuacaggcacccaccaccacgcccggcuaauuuuuuguauuuuuuaguagagacgggguuucaccguguuagccaggauggucucuaucuccugaccucaugauccacccgccucagccucccagagugccgggauuacaggcgugagccaccgugcccggucugucacaugcuuuuucuaagaauauugagaugaucauaugguuuuuguucuuuauucuguuacuguaugauguauuauccuaauugauuuggaauguuaaacugagcuuguacuccugggauaaacuuuacuuuguccugguguuuaaaucuuuuuauguugcuggauuugauuugcaaauauuuuuuuaagaguuuccacaucuguauucaugaggaauauuagccuguaguuuucuuuucuugcagugucuuugacuggcuugguaucagggcaucagggaaaugcuguccucuuaaaaugaguugagaagcauucucuuuucuucuauuuucuuuuuucuuucuuucuuuuuuuuuuuuuuucucucuuuugagucagucagaaucuugcucugucacacaggcuggagugcaguggcaccaucucugcucacugcaaacuccaccuccugggcuuaagccauccucccacuuuagccucccaaguagcugugacuacaggcaugagccacaacacccagcuaauuuauauauauuuucauagagaugggauuucaccauguuggccgggcuggucucaaacuccugggcucaagcgauccaccuaccucggccucccaaaguacugggauuacaagcuugagccaccaugcccagccucuuuuucucuauuuucuaaaagaaguuguuaggauugauguucauuuuuuccuuaauguuugauagaauucaccagugaagccaucaagcaucagacuuucuuuguguaaagauuuuaaauuacuaagagaaaugcacaucaauaccaaaaugagauaccaucucauggcagucagaauggcaguuauuaaaaggucaaaaaauaacagaugcuggugagguagaggagaaaaaggaaugcccauacacuguuggugggaaugugaauuagcucaaccauuguggaagacaauuccuuagagaccuaaagacagaaauaccauucaacccagcaaucccauuacuggauauauacccaaaggaauauaaaucauucuguuauaaagacgcaugccuguauauguucaccgcagcacuauucacaauagcaaagacauggaaccaaccuaaaugcccaucaaugauugacuggauaaagaaaaugugauacauauuucuuuuuuuauguccuuugcagggacauggauggagcuggaggccauuauccuuagcaaacuaacucacaaacagaaaaccaaauacugcauguucucacuuauaaguggaagcuaaauaaugagaacacaugaacacauagagggguacagcacacacuggggccuaucagaagguggaaggugggaagagggagaggaucaggaaaaauaaccagugaguacuagacuuaauacgugggugaugaaauaaucuguacaacaaaccccugugacaaacuguacauguacccuugaacuuaaaaguuaaaaaauaaauaaauaacaaauaaaaaagauauguacagauuuuaaaaaaagauuuaaaauugugaauucaauuucuguaccugauauagguuuauucagguuuucuauuucuucuugagucaauuuuuuuuaaagcaaauaaaacauuuuuucagauuuuucucuuuuuuacaaaaacauccauacauacacaggguaugguguguccuaggaaagacacacacuaacaugcaugccucacucacacacucacacauacuccuugcacacacgccucaugcacacacucacacacacuuuccugcuuggccccaggccuggaccuccaaaagccuuaaagacuuuuccagagcagccuccccuccccaugucuguaucuucccucccacccacucccccucagccggccuaguccuuuguggggcaggagucagagcuguggugggggaggccccagaaacagagaaggcucacgaaucgggcaguggccgaggggucccagggauaugcugugcuucugggggagacaaaggguuuggcacuauuggaucaggaagcacaggacucccagagcaccugucggcucuaccagggcaucgacaggaggucaauuuaggggggccucuggccagggcagggaccagauggaggucugccggucucgacugucagggagcuuucucucaguacccggugguguggggaagcuuccagagucaucugaggaagcaggugagagggacucccccugcacucagggauaagagucaauuuuuuuuuuuuuaagucucacuuuguugcccaggcuggagugcaauggcaugaucuuggcucacugcaacucuacuucccagcuucaagcaacucuccugccucagccucccaaguaccugggauuacaggcgcccaccaccaugccuggcuaauuuuuguauuuuuaguagagaugggguuucaccauguuggucaggcuggucucaaacuccugaucucaagugauccucccaccucagccucccaaagugcugggauuacaggcgugagccaccacgcccagccaagagucaauuuuauaauuuucaucuuucuaagaauuugccuacuucaugcauauugucaaauuuauugacaucgaguuguucccaguauucccuuauaaaauauuuuaaagaguaaauuagcaugguucucaagaagucauaaaaugauguuauuuuuagugccagcuuuguuuaaaacacauuaagcacuuuuuucaaaaaaaaaaaaaaaaaaagcagaaacuuagguuuauggaguacuucacuagauguaccguacuguguccuucgcaguuuuuacagaguauacugucagaacucuagguuacccccgaaggagcaacacucccucccaccuuucagggcuuuucugccuucaacauuuccauuuccagucuagggaaccaucuuucugcaaggacagacacagaucguuggggacccagcuaaccaaaagagcguagccuucucuccucaaucucaacugagaacucuauggccuuguggcacaaccaccccagcauuccuaggacugguaaacccugacagugacggggaaaugguuauggggaaguuuucuuacaaccuaucacuucucaucuaucucuuauuucuuucuacuugagguauauuuguaaguguacuugucuuaacucucacacucccccacucuuauccuccaccucggccaaccguaaguuuucuuauuuugcaccauuuuucuuccuacaguuucuaauaaauacugcaauugaaauuaauuuguguagaaucaaacugacuccuaguuugaguuuuuggguuuuuuuuuuuuuuuuuuuuuuuuuuuggagacagucuugcucuguugcccagacugcagcacagaggcaugaucuuggcucacuguaaccuccgccucccagguucaagccauucuccugccucagccuccugaguagcugggauuacaagcacccgccaccacaccuggcuaauuuuuguauuuugguagagaggggguuuuaccauguuggccaggcuggucucgaacuccuggccucaagagaucugccggccuuggccucccagggugcugggaucauaggcuugagccacggugcccagccuaguuugagcaguuuucauuuuuaacuauccauccucaugguuuuauacacauugugccuguggacuuucuuugaaugagacauuguuucccagaugcacaagggccucuaagcuguaggccacccauaacuagacuuagauagcagcuauaugcagaaugagccauuuaccuaguacaggggcccaaaccuugacaccuaucauugccagauguuacccauacaaaucuuucuauguaagagagagggagcauucuuuucuauuaauuaucuacucacauuagcuucaaacuuuucuuuauauacuugaccauuuuucguccaaguaugugcuuuccucauuuuauaaaaucaucauccgugguauacauguacuuacuggauauuaacggaggagaaaaaugauccuaaauaauuagaauacuggcauucucuaugcaauacuuuuuucucccucucacacaaaagaaacugagagcugcgcacaagcauguacacauacauagaucuucaagcuccucucucggcccagucauuucuggccaggagaaagcaaucuuccacuaccuucuaaaaggagacagaagcucucuaugccacuugcaacccucuaggccccagguuguucuuucuuuuuaaucuauagauccuacuuccauuaaccaccuccugacaauagcuuggcaaccgacagcauucagugacugccuccaucagagugcacgaaggagaugguuucccuucuucagaaacauuuuacaauaacaaauguagacaagauuuuugaacggagacuuaacauguuuccauggcaacauaaaucaccuacgaaaaucuguaggaagacuuuagacccuuaagacuuaaaagcacugucuucuuccuuuguaaagcagucgaggaaugucaaaaaaauuuuauaaagaagaugggaaaagaauuuuauuuucccaggauuuagacacauaauaaauaauaaauacuuagauacauaauaaauaaauuccucuucccuuaugaacagaaaaauugaauuuuuguaugaucauaguuggcagcaauccauuauccuaagucucugcucuuaucaagaaacgauuuguaccaauuaacauaugcagauguucuucacagcaguaaaacuuguuccuuauauaauucuauuuccuuguuucuuguaaaugucagcguuuuucaaauuagcaaugaaagcacagccuccccucuguucuuuuacaacacuuuccagggccaaaccccaccccccgcccccugccgccccgcgcacuccuguuggcucccucccucccucuucuggggccuggccucaucagugacaggcugucuucaggcucucccucuauaauugcucuuucaguaucucccguugaaugacugcaagcaacugugcuuaaguggaacaaggucuuaaaaaaggaacaucuguuuauaguggguacucaguauuggagauucaauuaaucaggcauucauugaaugcuacuuuguccaagucuaacuugaaaugcgcucagaaagaagccuggcgcuggaagcugcugcccaaauuuugcccacucugggcaccagaauguugacuucagcauucagaaguauaacaauagcuaucacagauauuugauuaucuguguaauuguugaucucuccccaccugacaacaaggucuguggagggaagaucuucaucucucuguacauacugcauuucuagcuccgugucuggagcacagaagaaaugcaauaauuuuucuugaauaaacgacucuguaaugaaagucaaauacauuuauuaugcacgugucuaccaugggcuuuguaauucuucugauaugaauguccagguccucuucaacuaaagaaacugcuuuacauucuuucuuauuuaacccccacaucaauucuaugaguaggccguauguaaauccuuuacaaaugaguucaccaguguucagagcaggcaagaccuggcccauggguuagagcuaggauggauguaucucacuccagagccaguucucuuucuaguaacucaucaucaucaucuggcccagguuccauguuuucucucacccuguuaaccucugucugcacuuccgaaaggcuugcaugugcugugugcucugagacaucauuuucuucugugauggccuguguuucuuuuuucugcuuaugaccuggauccaaggcaggugcaucuuuaucagcuuugcugcacuggagguuuugcuaccuucuaaagaaggcugcagaccauucacccuguuucuuacaacagaguaugacuucucuccauuaaggucaugcugcagcucugcuggaaacuugaacuucugugcucugcuuacaccaguauuuucugucuugcugagaugacacaaguauuuuaaacccuuuuugaugagaagagaaaauuuucugauugggguuuguauuagaauuuguugcuuguaacaaauuacuccaaaacuuagccauguaaauggcaauaaauauuuuugaucucauaaaguuucugagggucaguaauccaggaauggcuuagcuggaugguucgagcucagggucucucaggaaaucaugugaagggugguuugggucuucuaggccuuuucacccccauggcuuuugggaggaagccucaguuccucccgacaugggccucuccacaagggcuacuugaauguccuuaugacauggcagcuugcugccccagagagaguaaucccagagagaguacaaggaggaggcuacaaagccuuuaauaagccacucucagaagucaugcaccaccacucccaccaucuucuguuuguuagaagugaguccucaaguccaaccacacugaagaggaaggaauuaagcucuacguaagguagaaguaucaaagaacuugugggcauauuguaggaaguuauauggaugccaugagauguugcauagcaacuuuacaccccgucccuggcuggagcagccgcagggaggugggagcugcauuccacaucccugucguagacaugaugagacuuacauggaugcaaaaggacagccuuuacucucagggauggcacagucuggaagggaagaaagucaucuacacagguagcuugagguaaaauauagcacagugcaugcuacagagagguacaggucagagaaggaacagagagaccagaaaggaggaguugaagguagaguguuuguugacuccucugaaaacuuugccugaucagcaagaucccaaaguccugcuuuggcagcugcugugaaugugacuauauggcuguucaaagguucuggaggagcagcccagaaaagucuugcccacuaagucuccaugagauggcucaaacugggccuggcucugccaucccuuaguaggggguugaaggcuggcccagccuucucuccauaaauuuuccuagcacaaguaagccaucaaagagucauuuaaacccagaucugaauauauugauugagcccauucaucugcaguucacccacccaccgggggauaucauagccccagacucucuuucugccccugcaggauuguguaugagauaggucaugcaucaaggcucaaauaacaggguccaccagaggcucuguuguggaggggacagcgggccuuuggugaugcaguuagagagcacccugucccugugauuucuacacaucacaauacaagagaagcuguggcaugaggagcaucucugggaugucaggaguagaaacucacggauaugggacccucccaaugugccccgggccucacugugguguacacccaggcugacugaagggaagggcuuucuugugauuacuuccaggagccaaagugaccaugagcuugaaggaaacgaagacaagcuuggguuacacauccauccccaggugugagcuuuggagucaggcauuccuaugccaccgagaagcaagugugugccccauguagggcagggaaggaagggcucaggaggaggugacaucagcugaccagaaauaaaucuaacaauagcuacuuccguuaacugcccacugaaugucaagccuuuaaauccugugaagaauguaaagaagauauggaguguggcccuggguggcagcacagggugugggagacaggcagggauuggaguccuagccuagcuugacccuaaccugcagccugacauaggaugccccuuugcagccaugcaaaugagacuggacucaagaguaggauucugucauaaauuuugucuuaucuuauccuuuaagagagacagaauggacucaugaaagaauugaagaauggcaugaaacugccugcuaaccacaaagauggccaguaaaguaaaugggccaggagcugagagaugggaaauuuuggguugaguaacccaggagagguuccuggaagaggagaacccugagcugggccuuaaagaauagcuaguauuggggcagacugauaggaggagagcaccaucaauggagaaacagugcugcuucgcucagaaacuuucagcaucuucccaggcacagcacaugcuuccaaacauggcaugcaggcucugugucaccuggccccagcuccuauccagccugggcaccuugcacagccuccaagaccccagccugcacccugagcagccacccugaucaguucaccugcucucucugaaccugccauacagacucagacuggugccugaauucccuucauccgcuuuucuguugacauccuucaauaacccuuuccccaguccucacuccccuucagaguuaagcauuccuuucccucuugcccucugaucccugucccauuugauucaucuugucuuuucuuaggaucagacauggucaggucuaaauaccugaacucuagacaccucauccauggcuuacacaucccugugggguacauuccaugcccuuggcuauuguguggcagaugccaaaugaauggaugagugaauggaugaaugaaugaaugaaugaucaagaaaaaauguaguugcacaggaaggggagaccauguuacaggggaccaugaauuucugucaagaggcacugggcaugacagggcaagaguguggcccauacugcucucagucuagcaucucagggcuggaggagcuuaggugccaucuagcccggucugugucauguaaguccucuacagcauugcaggcagcaggccaggcccugcacaggcaccuccagugagggcaggccgagcacacugcagcucuggcacauugccgaaguguagugggaaggcugugggcuguggagccugacugaccugagcucagaccccaacucugcuauuugcugguugcauugccuuaugcaagccacuuaaccucucugagccuugguuaccuccuuuauaaaaggggcauaauaguaccuguucucaaaguuguuuuaagaacuauagagaauauacaaaauaaaacaaaauccuccagcuuauaaaaggcaacuaaugaaugguagcuaauuuucuuucuaugacguaauauuaguuguuguaugugauuagagaagguuuuauggagaguucaaagaaaguucuuuuucuuuuauuuuuuauuuuuucauuuuuuauuauuuggcucauuuucacaccuugacgaaguuucuaagaaauggaauuugggcuuaaaccuaaccaucugucauaauuacagugaaccuauccugcagcucauuaacaaggucucaugugaagaugauguaccagaguuguucaagaucaggaguuaccaaacuuucccacagggacaugucccacuguuagugcucacaggugagacgcuccccagcccacaggggccacugcagggaugcaggaggcugcagagguuggucugcaagaggugacccagaaacagcacuuaggaauaggguacaccuaucucagugcuaguucugaaagugggcaggggugcgacagagaauccaaguuucugccaucaugugucugggagccagguugucacugauuggguccuggaggcccaggcccaaauaccaggagcccaucuaacaggcaaggcuucgacucugaaggauagagggaaggagggagggacuguagccucuggcagguaacgguggccacagccccaaauguucccugggccagcccuaggccuguguguagggccaaaaugguucagaagucaggucaggaaggaggauugaaccuaaagaaaguggagaagugaggaggaggggugaggaagggauccaagaacagccuuguugcuggggugugugggaugccgugaacagaaucaggagagcuucaaccucuuuccaaagccuauuuucuucccaauuuccacgucucagugggggacuaccgccccccagccagaguccuggagucuccccagaugcccccuugaccucaccucaugaguuuccaaguccugcccauucucccucuugacccagcacccucuucuccgcccccugcuuccccuacuuccuaacagcagucuccugccuggccucuugccuccacuauucccuucuguccaccauucacacugcucucaaaauucucuuuccaaaacuaaccuggccacacucauccuuggcuugaaaucauuuggcaacccuuagcuacaguggagacuguccccuuaacauggcuggcauggccuccauggccugucuagccucuuaugcccuuccccacuaaaugugagcccagccacccacacugccugcagguugguccccacagggccuuuuccuacucacuuggguuccauagcacccagcauccuguuaggcagaccauaagcacucaguacauauuucgugaaugaaugaaugacugaaugaaugggugaaaaugaaugaugagggaguccaggaggagaaaauaauuuuuggcagggaaaacaagacgauuugguucuagggacauugagucugaguuguugguaggugucuuuuuccauuuucuguugccuauaacagaauaucugaaacuggguaauuuauaagaaauaaaauauauuccuuacaguucuggaggcugggaaguccaaggccaaggagacguaucuggugagggccuuuuuguugguggggacccugcagaguccugaggcagcacagggugucacauggcgagggggccaaguaugcuaguugaggucucucuuccucuucuuauaaaagccaccagucccacucccauggcaacucaucaaucaauugccuauuaauacacuaauccaggaauugguuaaaucauucaugagggcagagcccucauuacccagucaccuuuuacaggccccaccuuucaaugcugccacacuggggaugaaguuucaacgugaguuuuagaggggacaaacauucgaaccauaacaauggggcaucuagguggggacccaggcugcacuggaaaggagagucugaagcucagggaagggucucuuaaaagccaguagucucucuucacauaugagccaguuccccuaaagaaauacggagaacaggaggucaaauaaccggcaaguggcucaguguuaccaaaucagcuuuaucaacuaagacagccucagagcuagaaggacauuauaaggaccuuguuuggccuaauucuuucauuuuacaaaugagaaaacgaaugcucagagcagggaaaggccugccagcauaaggcagugcuagcacgagagccugcgugucuccgucgcaguccaagcucuuucuccugccuccugcggccuccuuguuccuggcacuccucucugagccccgaaggagggagucaucagugagggagacagugggacuuggaagaaccuaacuccacagauauucaugcccuaacuccuccuuucccacagugcagcuuuuugugcccccaaaggagaacagacccaauaaagaccccagaagccacagaguucaugcauugacucucgugcacuuaacaaacagaauagacccucguggccugugucaacagcuacauuuuuuaacucuguuuugaacauugucagccaucuacucuccagcccuauaacagaucauaaacagcugauuagaaaccacgagauggauugcagagaacaagaaaacugacacauugacucaaaaaagcagcagaugaggaucauuuaggauaaggaccaauagccauuuacaccaaagcacacgaagaugcuccuacacacacacagcccaacacaagucguaguugugaucuccaaauuauguucagucuguguugcuuacuaacgaucugcaaauauuuagacauuucacgaggauguucaucuaaagugauuaagauuguuaaaguucuggcccuccaagaagcaagcccucugcuauucaaaugggggaauuauccucaaggaaucugggcaacaaaaguucuucauuaugaaaaaggggggaagggaacuggcauucauugauaugccacaauauaucagacagugugccuaauacauugucucauuuaauuucacaacucuucaacuuugcacauagcaggcacucaauauuuuuugacuucaugaaugacugaauggguuggguuuuuucagucucauuuucaagauugggaaaaagagcccugaagauuagaauugccugcccauggucacacaguguggagcugggaaccugaucucuuucuccaaggcacaacugcuauugccacaacccaaccugggucaacuuugcaagaagggagacuugcacucuuccuuaugaaagagugaggcuaacccuccagccacacuucagucaaugcugcaagcacugauggagagcuugcuguguuugcagcccugugucaggagcucugcuuccaggcagaugaugcuucauaucacauaugcuuucuuugacuaacaggaaugaauucagggcauggacggacaucaagccugugaaaccaauaaaggccaagccccaguacaagcccccagaugauaagaugguucaugagaccagcuacagugcucaguucaaaggagaggccagcaagccaacaacagcugacaauaaggucauugaucgcagaagaauacgcagccucuacagcgaacccuucaaggaacccccaaaggugagacagaccuugugggaacccaucagcacagccuggaccauaaggguuaacugcagcagagcauggggugggcugcugucaaaucuggcccagccuccacgggcaccuuuaaaaucccugcuuccucuaaagcacacugagacccagggccaucuucaauaggaaccuuuguuaaacucaaagggaauauuaaagaggaacaucaccuaaaauaaagacagcuuaaaggcuggcagauuuccagggaauuagcuucugauuuugagaaauccagauaaacaauggcagaaaaccucaccugagcccuaaauccccuugucuuaaaauagaugugcuugggccccagaagggcuggcccaguauuguaggcccccaugcccggcuccccucccaccagacccugccuugccucauccuuggcuccaaucacuggacccuuucuucccucccuagucccugaaaagcaccugcccucucucaucuucucgggcuaaacaccauccacuaugacuucucggucugucacaacacaccugucacaucagcuauaauauauguucccagcauuuguuaccaaaaugaacaguuugugaaaguggacucaaggauuuuccuaagguaacauuccuccaccuuacauaggaguucgugaucaggagaagcauguuggagauauagcuggugaagcaggaaucauauaagccaugcaaucuagcaucuucugaugucaggccccauggaauuguacaaauauccacuguccucucuauaauagcagaaaaugccugagaacuuaaauaacucuggaaccuaauuauccuuuucucugcuuuuguccuaaagucuugcacuucaguggaguuuccuauuuggcccaggaccaguuuauggguaagguaacuaaccgacccaguuugccugggauucuuccauuuuagcacugaaaguucuguguuccaggaaaccucucaguuccaggcaaaccaggacgauugguuccuuuccuuacaggucaggagugacugaaagccgcugcaccucagugagugaaugauccagccugcaaggcccagcaucagcucuguccauccagagaugguguggcacccggggcaugggguuagcauuggacaaaagaggacguagagaaggaaggagggaaaaugagggaaacuaaaucuagagauagaugagggggguggccuauugaggggucacuuucagugacuccgaaguuuccugagaaagagcaggcaaggccaucuucuccagaugaaggggacagagcuagaggagggagguuggggagaguggagugagcuuagaacugcugcucuggggaaaaugguggaggagccaggcagagaggaggagcagagugcuggcaguggaaagccuagcugagacuggagaugccccccugcccaaagcaucucagcgaggaugcuucuccauaugggugagccagccuagagacagaacaggggaagccagcgggugcugcagcgacccaccgccccagaacaucugcaucuuacaucaacaaagguuuauuucucauuaauauccauuguggguuggcugccacucuaacccucguugccucuccaucugggucuuggguggcagagcagccugucucuguggcagaggaaaagagagcacugggcagcacaggcugacucucaaauuuuccgccugaaggugacccaagucacugcucacauuucauugacuaaagcaaaauccuaugccugugggugaguugagcaacgugaugagguguuaacuuccuacagggaggggcucaaauauugcccaacagugguauggcccacugccugggguggucgguggaaggcuggcaggacaagggagaccacguggccagugggugcugccaaagugacggaacagggaguucagacgggagaugccgaaugcccuaauguccuugggaacaccuuaugcacugugcuccaccugagccaaccucugucauuaccgucauuccuuaauuaaccauaucuuuucucucuaaauuccuucccacgccccaccuuuuuguguuucuguauuugcggucugucucuccguacagguggaaaaaccuaguguucagaguuccaaaccaaaaaagaccucagcgagccauaagcccacgaggaaggccaaagacaagcaggcggugucaggccaggcugccaagaaaaagagcgcggagggcccgaguaccaccaagccagacgacaaggagcaaagcaaagagaugaacaauaaacuggcugaggcgaaagaguaaauuucccugcacuuuccuuuuacucuucucucucucucccuccccccaacuuuuuuuuuuuaaaccaacaaaccaaaaaaggccacaaaauuaauuagaggcuucucaucugccuugguccugaguguuccaggagcucuuugguuuggcuucuuuugauggaagaauccugcuucacagacugaguggcaggccuccuccugagggcagccccuggagcaccaggaagcguugccgcuggcugugcccuccccuggcacucugacugcaugcugaugagcaaggcaggcaggucugagaggcgaaacgaaucucccggcagugcuuggaagugucuguggggucuccuccucccagauccccaagaucugugucacuggucgauuuugaacuuuagguacauguguucuuuucaaaaauucagagaaucgucaugugccacagaagcucagccugggcuucagcaauugacaaaauuugaagaaauauuaaacaaaaauaacaaaaaaagaaacaaccuuggccuuaaugucaauaaaagggaguugugucuguuaaguggucuuuucauagaaucguccauuagaaaugugugccuguguuuagcuuccuaucagugggcuuuaaauuguauaccgagucauagauacgccacugauaacuaaaacuagaucagggcuggugaagaagguuagguguuuuagguacauuccagcugucauaggaagaucacagaaaugaggaggcuguuuuccucugauucuccucggccgaccaccuguccaaugcugcugguuucgcagagcgaccgguuggagaugucugaggaagaaaguucaagguguagggauaguguguuuggaauuugacuuuccauuucugagacccaagggggcguagauguaguggcaaguguggcgauguuuacucucccuuccugaaccgcucuggucugcuccucagagagggcagcggugccaggccucaggucagggagaaugucugugacuuagcugcagacuaggagacugcccugcuaacuaauuagcaagcagcuuugaccucauuaauauauaaaagcagcucucaguauauuccgugucguguguguguguggccaaagcccccaaggguggcaagugccaccuucgcugugcuagaguuguguuguaggaauuagucagggaguuguugugaaaaaaaaaaccccagugcuugugagggaacucaaaauaguuaccagaaaaauaauauuugccaauaugacguguauauugcucagcacacucuguaucuccuguccuuaaaauccucuuguccccggcauucugacacacugggcugccguccggugucaagccccggcgcaggcuugcucuucuuuuacaaugaaaggggugaagagugagggucucacaguuccuuaccucaaagucccuuuagguccuucugguuuggaggaaguggagccuccacgaacucucucuuacuccgaccauucaggcagcaaagucucugcuuacaucauuuugguugucaccuuggggcugagugagaagucuuuuguaaauuaauucggcgugugcuacaugagccauaauuauuaacagaacaggaauaucagaaacgaaguuguugaucaggcccacugcgaccuuccuuucuaucucaggguuuaaaacugugaggaaggagaaguaugaaggaagguagaaaaugcuggugggucuccguguuuaugagucacagauuuugaaagcuaucaggaaaugacuagaguggauccuggcacugauuccaacucuuugccagcuaaucuuaacauuuagcagaaagcucuagcaacaugaucuuaauuguauccagaggauuugccaauguauguucagucucucaagauuuggcauuagucagacauguugaugcuagccacaauuuggauuucuccauagaauaaucauuuauuuuugcagaucaaauaaaucagaguuuacaaugcacaggggaucauuuauuuagcauucccuugcuagaagcccgugugccaggcacugugcuaggcguggugggcaguauaaagaaaucugucuccacagccacacaaccagagggugcacaugacuugaucccuaugaccaagucaaguugguguugcccaaaucgcaguuugacauaagggucccacaggcuuccccaccccccgcccccacucacugccccagggaccaacuuccuacccucacccaaggcuuuagaggaccuguagcaugucuuuuucaaccugucaguauccccuucugcuuaacacacccacugagaaaacccuguuuguaguucacuuugacucuugaaugugucacuuuacuggcaagagacuuccuuugauuucuacuguuuacaaauaaaacucagccagucucauucuauaucccaaacguacugaaugaaacugauuuugguuccacaagcaguguuuggguguugccuuccugaaggugaccaagcuuccaaagcucgucccacuggccucuguacauuucccugugguucuccguccuucccuggcgagggagcugggacugaagcuuucccgcuguuucccugccugcaaaagcagccccaagagcugcgcauuggcuucccucagcaaucuguccugucugugcucccauucgguccacauagcuuucuuugccucucugaggcagacaggaagugucuaauuacgauuuuguggccuggguuuuguugcauaccacagauugucuauguaacauguagcgcacaccucucuuggugcuauuucauuccugcuguaagagaaugacaaaaauauucauguauagccaauugauugugacgugcuuguggucugugcuugcucagaaaaacaaacaaacaaacaguuuuuccaauuauaaauaaaugcuaaagacgaacaccacuuucuugaucuuauuuccuuggugaggcccaccugaguaggugaaggaaugaaccuuuugcauuugagccauucucugcaagaugagcugugcccugcagucuuccuggggcucuccauaaugcagcuugacucuuuuagauugccucucagauacuauuggcaagcagucagagcuaaguuuugggaaagcgaagauggaccgggagacgcacuggccaaaaagguaguguaacauuuugauccaauguugccgggaagagcgaccgccugcaccgagcaccaccuugccacacugggaggcugggcucugacucucugccuccuuccugucgacuggcaggacugucauuucuggcuuuuucuccucccaagggauggcagagaugccuucacuugcucaguuaaucuauggucacuguggauguuccacccauagggggcuggcucacuguggguugugggggugacagucgugugugugccuuaugugggggugcugaaacagccaccagacaggccaccaagcaacaacagaucagguaguugggaacucagaugaaggacaggcuucuuccaacuagggcuggggaguugcggaaggcucuguggcagagggagcccuggaaagcagcugggguguggauauguaagggcaaggccacugcagggagcaagucuagaaauggaaaacuggggggcugggugggaaccugaaagcuaggaccaaguuugcccacuuuguuauccuucugguaaaguggaagacaaaagauuuuauacucuucauuuuuccaacauauguugauugaauaccuauuaugugccaggcacugugcugggcacuagggaaaccaggaugacugagaccccgccucugaucacaguggggcacgaaggaggaggccauucuagcugguuccauggaucagggaggacuucagcaauggguagguguugaccaggugaacagagccggggguggccaaggcaugcuagauagaggggucugcccaagcaaaggucggaggggggccaucaaacaccaggugaacuucaguucuggggggguagcucccuugggagggucauggcacaggcuggagagugacagagcucggugguggagaggccuggugcacgugagugggcgguugcuaacugggaucuccauuuccauaugcccaaagcguaccuacacccugcaugcucccuugucaugcuucucuugcuugcuuaugcgucaggcaacacuacagauccucucuugcucuaagcuaggagcccuaggguggacuuuuauugcuggaccugauugcugaguuuugggggaggcagggguagaaaucauucaagggugguauaaaugaaaagccguauguauuuguuuuccagaugaauagaaaacaucccacccaccugucuacuuuuguaugaggcagaaaacacaaaagcugcucaagaaauaaaacaaauacauaaaagcauauuauuaagcucucuuuugaugaguuaagggagagagacaaaacggggauugagagaggugguaagaaagacaggcgagaaguagagagguagaaauagcggcacagagagaaaaagacacaggaaagcacacauaugaagacaccuagaguaaccuaagagagugcgagaaggugagacacacucagagucagagaaagggcaagcguugggcaauggagaaggcaggaaggcaggggccuugccagcuuugucagugcugcccacgugcucagggcucccccaggggcucuuccgccugugguucccaccaugcuccccucugcugcccagagccccaggaggcaaaucuauaacccaucacucacauuaccucccugaaacagcaaacaaacaaaauucaaaccagcccccuauuuucaaaauaggucauuguugcuaaguuagcuauaaauguauuucaauucuuccuuagaguuuuuguguucuucaugaaauucuucccucuuuuguuucacuaggguuuaagaauuuacaaccugcuucucacuucucauagauuugaggagcgucaagucccauuucacaaaggcuauggacuccuuuagugugucacugugguuuaaggcuccuuuuacugcuaaaaugucucaaagcaguucacauuuucaggaccauagguacagaaguuucuuucaggauauaaccugugaaccaucugcguuaaagcaaggcuucaccccuagcaccaccugagaccagcaggguuaggaaagcggcuagggcagccaaggccacuggaacaggaaagacagcuguuucaaacaaagggagcccaaacuccacucucacagaaccgggcauguguuucaaccccuacuuccaccccacugccauuugaugcauauauccucauaacaccuagaccauccuagaauuccuacaacagggagaacuagaauuaacaccauuauguauuuuguuauuuacccuaugaauacugguuaacauggacagugcacuuaggcauuuacaaaguucgugaguggaaaccagugcugccgugcaacgcugugucucucacuaaccuccuggagcauuaguguccuccucugaaaauggggacacuaauacccccccucagaggagcagaaugaggaugaaaugacaugagggcuguagggaaccccuggaggacacuaaacaugucacuucacgcccuuccccucccuuuagaguacuugaaaguacuuguccacuuucugacagauauauacuuagcuguuaguaauacacgaaguugauugaggcaaacauucuuaagaagauugcuuuuaaagaauuacagcuauugaauuaccuugaguccacagaccuaaaugguaauauucuaacaauuuauauguaugcguugcuuaugaagcguuucuuucugugccauuccacugaacccucccaauguuauggggcagguguuggccccauguaacagaggagaaagggaagcucaaagaggaggggacaccugccagcuuggucaggcuuagaagauggagaaagcacuggaauccaggcuuccagcuccauagccugcugucuaucccucucaccugaaggaggcucagcuggccugaaaagaaucagguuucagacaagugggaccccccaauaaaaacuaagcccauaccccacagugccacacucuggcugggccauuccagguccuccagcaagcuugccuaguacccucuuuaaaucuugggacccggauacaaacugagggaaaauaagaauggggucagaucuauauacaucuggcucagacguccuggcuauacugaccaauuaucacagccaauacacaguuuuucuccuucugguacuagcuugccugggugacugcaauguagguuacuaaaugcagaauuguccagcagauucuucauucacaaaaaauauacucaguccuggagguaccaagauaaaacugguauccauuauuaucugcaguauauaaguauuggaucugagacugccauuuugagcauuuuauuucagccaguggaauugagcuuaaauuucugucccuuguccucauguaaugggccucaauuacuuguuaaccuggcauuguauauagugaucucgacagauggccccagaacucuuaucuggggccaagagagcuucagaugcugagcuuuaaaaguuacugccacugcuugcuacugguuuaagcugcuagagggaucuuuaugcaaaucugaccacgucaccccgugcuuuaaaccauccgugggcuccucguggugcagaagcuucuuguucccucggugcaccaugcugcuucucaccuccaugccuuuacccuugcuguccaccugccuggaaugcccuucuccugcuucuccaccuggcuaacucauccuucaagacucugcucaggggacagcuccaggaagccuuucccgcaccucccaagcuggguaagcugcucccugugugucuucaugauggaacuugccacauguacugugucauccgcucauguguguaucccccuuaccagaccgugcucccccagggcaagggccagaucucuguucaccuuuguagcccuagcuucuggcccaaagccuaccauagacagugucuucuaaagugcucauugaaugaaaaaugagugagugaaugaaugaugagauucacugucugccuccacauucaccauggugcuuccacaaggcucuucucugacuauuaacugucucugcucccaugaaaggggcaguuuugugagaggucacagcaacugcagaccagagagcagucaauggcugguuuuauacuggcuggccucuguucaggccugcauaccucuguacuuuagauagccacuuuuucuaaacagucuugauugcauaaaaucaugggcccuugguuacaggguaaucuaagagguuggccaaucucacucccugcucaguucagggcuccuaacucuagggugacaggacccuccccaccaccacacauuucacaggcaugucuaauuccaagcaaggauuauaaccaacaggccugguucuaaauccaagcucuacuauuuacuagcugugugaccuuaacugagucucuuaauuucuuuaagccuccaauagauaacaauaauacaaauaucgaucacucuucgaauauauuugguucccaauucaggaagcaagaauuuggccagcaagggauaauuuuauuuauuucgaccuguuuguuuucagaguucaggauagcagguggcaagagcucugaaagcaagggauaccugauucccaggccugcggugagggccccauggggaggcaugcaaaaguccucugcaaacuggagugugcaaugcccucgccaauagcucauguuauggguaguuuugcugaccacagcuucccaguuaauuacugccccuggucccuaacaguauggcagcuggagcuacacaaggugaauccacuccugccacacaauggccugagauuaacgccaucuaguguuggcucuugcugccucuucccgucccccagccuuucaucuggccccugcucucuaagcacacccuauaaaucagcuggugcagauccaucucugcaauuccacauucauuuggagugauccccucuggaugcaggaaaccaauuuugauuaauugcucaagauccgauccuuugcuuuagauggggguugggggaagacaaugaugauuugcaaguucccaggagcauaguguuagacaagaauugagcgcugccuuaguccaacacuuuacauuuuaaaaagggucauuagcagaauuauuagauuccuggcagcccacugggacaaucugcugugccuuugacuuugccuucuuggugcuaaaacaaucgagaaugccuuuaaaaauauuucucauacaauuggaaauuuauuuaguucucccuagcaggccaaaucuagaaaaaguauuuaacauuggcaaaaauaaauagguaaauaaccacaaagaaaacauaaccaccuagccacuuacccaccuaagugcaaccauuucccuguauuucagaagaacaugucugccuggagggaacccagaguggcagggaaagaccugaacuaggggcuggccccagaucuugauucgacuuuuguaaaaugcagaguugccacagccuagggggagggaaugaaccuuuacuuggccuuuacacacuucgucucauuuaauccucacaguaagguuagagucugcaggugucacucccauuuacagauaaacaaaucagaacucggugauuaaggaacaaagucacacaacuuguaaguggugagccaggaugugaacccagguuugggugacccuaaaacccauuccuuguccagcacuugggacuaucuguaggauuccuguugcagagaugugcaucgccugaaacagcagccuccuccucugucccucgcuugcucugaaacguucaaugacucuccauacucucgucuauggaaaaugagucacaagaaggucagagaagcugaguuugaucuacacaguucacucccuccaccccugacccagaauuaagucuuguggaggcagcauuucuccuaacugugguccuagcugguguuucugugugaugagccacaucuggcggacucaguguggcccugggcugguagacugauuggcagcugcacagguagggcuuccaggugugaauguggaugggcacucuuaggcaggaugccacugcuuucuggggcuaaggucuucuuuuucagggucggcugaaugcuaggaaguaaaccugguggguagggggagcugugcagugggaguagccagccagguuguugggggccugggcccagaggggcaacucucuaaggagaugcaguugggagcucugagcuggaaccugcagaagucauuggcuccagccagagccagucagagucaucucaagccgagcccaguccaggcaucuacagacaaauuuggaaucucuauaucuguauauuccacaaggagggauacuauagagaggaaagagcuccuccauuaagguccugacuuugcccgaacucacugugugacuuugggcaacuuacuucagcuuucugcaccgcguuuucgcuucuggaaggugaggagagggcuuucugucugccuggcugacaccauuguugugagaaucaaaugccuuguauguaaaguuaucucagaaaccuuaaagagauguuaucauuuggagggccaaaaaaggugcuaaguuaaaaauaggaaaacauuuucaugucauguaaaugcgguuguuagaauuugaucuuguaugagcuauuuuaaaacuccucauugagaaaguaggccuccuaccaugugccagcccuaugcuagugaucccuauggccuggcacauaguaggcauuuaguaaauguuuguggaaguacggaaggaggcaagaggcagggaagagagagaggagaggaggggagggagagagggaaagagagaugaagcaggcauggucccuggccugaaagugcccagucuagagaggcagauacaaaacuauugaagcugaucugauagggcugcugccaaggugggggugggggugggggcacugugggaacacagaaaaaggaaguagaggcucagagguuuuuucacugaggaagauucuucaguuacggaguagagguugcuaaguggauggcgaggggugguguuugggcagccagcacugauaaagcuagagcugcuugggcugaucauuggagguauagacuccagggcagaggagguguguccuguguggagaccaaccuacaauguggccuuuaguucuggaguuacacuguccaagggacagagccaacugagacacauuguaaggagggcaguuggaaugugagggcucugggaaccaagucugaacuguuguggggcuuguguuacuuggagaagccagggauacagacccaguugcugcccccuucaaauaccugaaagacuguccuggggcagccagcagggcauucacuaaaaggguggcccuggagugcaaaacagggaucagugcagagauaggaaggaguggagcugacugcaaugcaagcuucugcucaggucuaaccaguggccacugaggaggaggcugccucaccgggcaugugcagcccaccccaggcagugcgagcagcggcugggcagccaccugccagggagauugcagcagaggcucaggagacccauggcccagcagucuauccuuccagcccugggcaccuuugauuuggcuucuggaguuuugcuuuuauggaauagagagggaagacuucuccaacaaagugacagcuuggccccuaauaagaucuuugagccucucugguuugaagagacacaggccgauaaggcuuagggcccagcuuggagguggugccuguacccaggugguggcgucauguuugugguguguguuuacaggucugucuccugccucacucuaggagcuccuucccccaagucagggcuuggcucucauucacuucuguguccccagugagggccugacacagagcagggucucaguagauuuguucagugaauggauaaaagagaaaaaaauuaaaagugaauaaagagaagaagcuacaccagccauguguuuuucccaccaauaucugccagguacuacaaugagccagacccugugcuagauacucaugaugcaaagaugaagaaaacacagucccacaggcuagcaggagaggcagauaauuaccaaagaacaggauaauuacuaaaagagacacucccacagaguccgguugaggauagaggcggagcgagaguuguuuugagaacuccugucuccugcagauucuucauaagaauaaugagccuuucaaagaugguuuccuuggcaaucccccuuggcagcugcauuuccaucacuguguugggagcuuuguuugugucuaagaaucaugagcacauguacggggcccauggaggcagcagcaagggaacagagcccuggaaucacacugucucuguccauguucugccaggggcccuguggugccguuggccugggcuucgcuguuccccuccugcccaucuuugcuccaagugaguuugcuccaucucuuccaccugccugcugagauguugagaggcccauguuuuaguccuggaccuggagaaucacuuguccauucugggucaaguuuccaucuguggagcaagacaaauggaccagaucagcaagccccgcuuuggaauuaacauuugcuaaacaucacuuguauuccaggggccaugccaugagcauucacauaagcuaauccucccuagaagguggaccuucuaaucuuccuuuuguagauaaggaaacugaggccuggagaugugugccccagugccauccuauggcuaggaggggguugaauucacauucaaacccagcucucugggccucaagcccagucagugcacugucucuauagcagguugcuuuuuacaucaugagaaauaauagaucuuaaaacgucuggcaccaagccuggcccauaguuauugcucagugucuuucuuccucaaggcuuuuccacacugccccacacucccacacuuucccuggaaggcaggagauucaaggacaggguccauaggcuccccacucucugaauuaugcccuaugccaggagcauugccacagcuguuggcugcuuugauggugcaacaggagacaaucugggaagaaaaaaaccacguggauggacuauaggacuggaauugugugcaagggcaggaaucagugggagggagugaaguccuuucaccauccaguggaggacagggcucaguaauccugcugcuagacucuggaaaguauggauccaaugucagugugugugcacucaggaggcauuaccuugucuccauggaaacaggaagaaggauagaaaaugaagugucuaagacaagaugucucauauaaccuuggaacauuaaguuuugcaaauaggacagagccuggcacagaacagucuguuguuuauucauucacucaaguauuaagucagaacccaccugggcucagguacuguucauuuaagguacagaggauacaaugaugugcaaaacugacauggucccugcccucuggacacuucagucuagugggagaaacauuaauccaaaagaauacaaggaauuagcugagauaagagaggaaagcaagugccagggacuaggagagccuguagcagggggcuggccaugacuguggggucagggaagccuucccagggcagugcuucagugagcugagagaugacagcugaguaaacacuagccaggugaagagggaacaagagaauauuccaggagcagacagcugcaugugcaaaagcuguaaaaugggaaggagcagggcgugccgaaggaacagaaugcugggcacagaaagccaggaaaggcaggaaggagaggggugaagggguaaggaaguggguagauuggccagcuagguggggcuguguaacacauuuucuucuuuguucuugguacaaggagaagguauugaaagguugugagcaaagaagggacaagauaggguuugcucucuuaaaagaucauucugauuucuguaugaagaauggguuggaggagagcaagaauacauggaacaggggacagcagucaggaggcugugacagugguccagguagaugauggcauagcaggugguaggggaagggagggagggaaagaagugggaauauucaagagauaaauguuaggagcugaaaucaaugggaccugauggauggggugaggguuuugagggagagggagguaucaaggaugaaucugaguuucuggcaggggcuaaggaauagaggaugaaccagcuuucagcaacaauaacuuuuaaaucuuuccauuuugccuucuuuguuucagauacugugcugggcauuggggcugcaggcaaggagguuggccccugucuucagggagcucucugucuagcagggggagccuggccugcaguggggauaugugagaaagcggagagagagacugugagacggugcugcagcagggaugcaaacgaaacuaaucuggagagacacaggcaggaagaccagggaggaggugggagcugagcggagccuucaaggacaggcagggccuugacaaagaaaagugggugaagcagaaacagacagcccgggcuggcagugugcaaaacagcaugagaggaugaugcagggaaaaugggguucccccaggacugcugugaggguugaaugacauaaggcaacagacgcaugagcauuuuaguaaacugcuaucacaguuauuacagaaguggacuuauuugugcacuauccaagcacucugaaaauaucaagaauuguuauuccagacgcccaccuagcaaaauuuucuguuguaauaaucccugacauuuauaucguuauccccacuugauagguggggaaacugaggucuauggugguuaaacaauugcccaagaccuuucaggcaauaagcagcacagaaaccaaggucagcccagcaggucauuguacuuucugagagguuagugcuuucggggugcacaggcugggagaaggcgcccguggcauaugcugucuugagaacauaugcugcugacccagggcaccagauuugguugugcagguugggccaugcccaaggacagcuggccuguggccugagugggcugaaugcagccugcuucugcuccccaagccacgaaccagcuuccacccugaggggguggcuuugccucauucauaccagccucacggaggagguggggcacuuuacagaugggagacuggcaggcaacuggaaccaugugaggaccagucagugucagugaggauuucacggugcccuugcgugcaguuucgugcauagaaaaacuguccaggcugcuuggauuuuaaagaugaaugcuuaauaaaaaguaacaaaaauaaaauuaguaaaauguaacaaucucuuuuaaggaggauguuauagcuuaauucaauuacccuaaauauaaauuaaauuaugaauaauuuuaaauaaauuaagauuaaaaauauggugaccauuggcuugucauaaaaguuccaucguuguuuaaaaauguguaaaacugucauaucuuucagcuuuagguuauacaucuaauuuaauuauuccguuacacauuuuauauugggauuacaaagcuaaucuguuagacauucuaauacgcuaaauuaucuuaaacauuacaaauaccuuugaacuaaaucuaugcacauuuuuccuaaacuuuuuucuuuuuuuuuuuccuggagccagugucucacugugucacccagguuagagugcaguggugugaucucagcucacugccaccuccaccuccugggcuaaaacgauucucccaccucaaccuccugaguagcugggacuacaggcaccugccaccacacccagcuaauuuuuguauuuuuaguagagaugggguuucaccauguuagccaggcugaucucgaacuccugaccacaagugaucugcccgccucggccucccaaagugcugggauuacaggguuuuucuuaaacuuaauauuaaaaaaguaauauuggggacuugauuuaauucaucauuuuaaucuuaauuauaaccuucccaugauuaaagauacccacuaaagaaaaaaguuuucuaaccuaagcaauaugggguuauguauccaugcaaaguugaggcuagcucacaacuggcucauuaaacagaagagcccauuaaacagaaauuugguagguggcacaggagccaaugcuguagauauccaaggaaauguacuuccuggcccaggcugcagggcuggccuucuuugugaccuccaggccagcaggagacuccaggcccauguccuacccuugggauagguucugcagcccaagccccugagauggaguuaagcucccuuuuuuuucuuuugucccuucucagcuuccucacccuguugggaggacaccacccaggucgcuucacaaucuaagagaauacaccuaaucaauuuccugcuuggcucuguucugaauucgguuuuucuuuuuuccucucugaccagccaccagugacuggagguauuuuaaugccauuuuuggauuccacaugcuucucacagccuugccuggcucucuucucaaacacuaagguccuacugauagcagccaacugugucuaucuggccagagcagcuguguuccauaucaugcugagccagagagcugcccuggccccuuccacugugaugcucagggacagccaggggaacuagauggagagguugccugugcuguguggacucugcugagaaauaccagucccuggguggcucaggaugcuaaauacaguaaaaagcuucugcaucaggacaacacagaagaauaaaagcaguccaaauacacauaauuuuacuucuaaguaaacagaaaaacaaccauaauacuacccaauaauaccauaguacaaggugcucuaggugcugaccucuaaucauuauagauuucugaguaaauaucauuauacccaauaaauagaguaauaguaauagucaccuugcauugagcaccuacuaugugccaggcacacuaagggaaagagcacaggauccaggagcggaaggauccagaugcuaguccguggggguccccucacuuuccccaucacuuguccucucaugaccucauuuucuucaucagacaaguaaggguaagaaaauccuuccugugugcuucacagggcugcucuguugcugaaaugagcuauaaaagggagccauucggaaagcuggauguguuguaggcgugcaagggccugugaugcuugcugagcaaugccacucucucgacuuccaacauggccugcaaggaaggagugugcacucuaaaccagagggcuccaggcuggccgggucuaaguguggcaaugcuugccuuugaguguuaguguugucacacgcucuccacagugugggugggccaggggaugaggcagacggccacagugaggcgagggaacagugccugaggauucugaugaaagacugggacucuuggcuauagggaaauaagcccaagagccuggaaguuggugagggcaaaggucucaggagagcagagagagccagaagugggaauggaguuaggggaucagggccucaucccuaccugaaagcggagucccauugagucaccuagcaaagguuggggguagugggaguggugcaugcaaucacagggcgcacugucuauggagaauuuaaagcaauaaagcuaaaagcugccuguaguccagcuauucaggaggcugaggugggaggaucacuugaggucaggagcuggagaacagccuaggugacauagugaggccccgucucuacaaaaacaaauaacaaaaaacuaauagcuggccugcuuuuuauuaucacuauaugcugcucauucuauacaaugucagugauaaaauacuuuuccccuugcaggagagggagagaggggcauucccacugcuuccuuuccugguaugccauggaccccuugccccuucuugcagccagcacuuaacaagggggucagggagucagggaggcaaaagaacuuugaaggcccugagaacaagaaaagagcacccuggccugugggggcaucuggugggcagcugagauggggcucccaggaugggcccaacgauccuagaagaaaaaguagggaccuggauggaaugugggguggacgggcugcugggaugccuacuggaugacuccgaguccagcuacaguacugccauugucaccagcgugccacccccugugccacgugcagguuauaaucaauuggcaagcacauugaaugacugauuccugagccuucaccucaccccccucccucacccccgcccacauucuguacuaagaacacagaaaucauauucuccuggcucuccagcaagagcugcccggcccaggcuccacuaggccaagacuuauuaggcaaucuguacucugcccugucccugccugagcucuacucucacagugaucaccucucucuccuuugcaggagccuggcucaacccgucagugauucaaguaagacucaagguccuguagccacagagccagacaaggaucaagguucuguggucccaggccuucugaaaggucaagguccuauggugcaagagccucugaagaagcaagguucuguggucccagggccuccaaaggaucuaggucccaugaucccauuaccagucaaggaucaagaucacacggucccugagccuuuaaagaaugaaagcccuguuaucucagcaccagucaaggaccaaggucccucggucccaguuccuccaaagaaucaaaguccuaugguuccagcaaaaguuaaggaucaaggcucugugguaccagagucucuaaaggaucaagguccuaggauuccugagccugugaagaaucaagcuccuauggucccagcaccugucaaggaugaaggucccauggucucagcaucugucaaggaucaaggucccauggucucagcaccugucaaggaucaaggucccauagucccagcaccugucaagggugaaggucccauagucccagcaccugucaaggaugaaggucccauggucucagcaccuaucaaggaucaagaucccauggucccagagcauccgaaggaugaaagugccauggccacagcacccauaaagaaucaagguuccauggucucugagccuguaaagaaucaagguuuaguggucucagggccagucaaggaucaagauguuguagucccagagcaugcaaagguucacgauucugcaguuguggcaccuguaaagaaucaagguccugugguccccgaguccgugaagaaucaagaccccauucucccaguacuaguuaaggaucaaggccccacaguccuacagccuccaaagaaucaaggucguauagucccugaaccucugaagaaucaaguuccuauagucccagugccucugaaggaucaagauccucuggugccaguaccagcaaaggaccaagguccugcagucccugaaccucugaagacucaaggucccagggacccucagcuaccuacugucucaccucuaccccgagucaugaucccaacugccccccauacggaauacauugagagcuccccuugacacucaccccuugacacaccaaugaaggagcugacagugagagugcuccccucccaggggcagugaagacacauauuuaaucugcaugaaacauguacaguagucuugcuggaaucuaauaaaaauggucccucuggcucag

SEQ ID NO: 15290 - RNA, 10713 nt, Homo sapiens
cuuuuuuuggcggagcuggggcgcccuccggaagcguuuccaacuuuccagaaguuucucgggacgggcaggaggggguggggacugccauauauagaucccgggagcaggggagcgggcuaagaguagaaucgugucgcggcucgagagcgagagucacgucccggcgcuagcccagcccgacccaggugaggggcgggagacgccugcgugcgugcggcccgggggagcgccgagcaaucugggggugcgcgagggaguaagaggggcgaggggacccugcgaagcguugggugccgagccagagccuacaaauuggaguccucggcacuuugggggccgcuggaggguuuggaaucgagagcccagggcuagccagugauggugccagcugagggcuagggcggagaucggagccggguugggaguccgugcacucggaggacugggaaaaagugcagggaccccuaaaagguggugguggcagauacgagacuaggugcuguguaaagggggcugggggcagagagcagagccucugcggaaagaaacagaggaggaaggagaugggucuggugccucuucccgcaaggguagggaggauaggccggccucgcaguuccaggucacuuccguucugggguugaggcucaggggcagcggugauugguggcccagccuccucacaggcuugcugagggaauuugagcuuccgguggugggaaaggaggugaaaucgucucgacuccugggguccgugugcucugguagaagugggcgacaguggcucaauuucugaucagcagcuugcagccuagaugauggcagccaaaggaaagacuuggccagcgaggcucccuaccacuccgaaaaaagagagugggggucagcagggucugcucugcucuggggauuaaggggcugacuagaaggauuugagucuuuccuucuguccacugccacaggguucuuggaguaacugcaggguuuaaacugcagggucuaacuuccagaggcugggguucccugccccccagcuuagagacauuccugagguggcugaagagcaggaaggagaaugaaugcacuuccagacuggcccagagucucagccccuccucuuccuuguuucccgcuggucccucugggcuguacggcccggauggaggccugaggaaaaugagggggcuuugguucuccggaauuccggccggggccacacccuccugucuucagaugguucauguacccauccccccuucccguccucuccuuugucuccucugucaccgggacucccagcagagauuuuuuuuuuguacuggcuguguaacaggacaccgcaugcagcccucaggaggggcucugugcuucugugaggaaggaccccugugcugggaaggcagaccccuguuuaucccgagggaccuggggugacccccugcccuggccuuguuucucccauuuuacagugagguggucgaucuccaaggucccuguagauuggggacugguugugcccucugcgccaggggccuccucaccaucucuccuuugccggcucccgcccucuucacucuucuguuuucuuucagaaugaaaaaggcaggcauugaccucccucugaggcaguuuccagguacuuuagaccucucaaguguuugggacccucugguggggucccaucaucuccuccccuucccuuccagacccugcucaguccagcuagcugugggcacagcccuggcuaggugaucuuguauuuucuuugugggacuguaacucagcuaaccuuggccugagggcuggcauuucucuguggcaagaugggcugggcugugggaggcuggccugcuugcaguaacuugccuucccccauuccugcugcuggguucaguggggcugcccuucuccccaguagcgcauuucccuucagagauucaugugcggaugggaagggaacuaaggccaagaaggcuccuggaguccccuggcaaauauguggcacccccugggaccugagucaggccugcuucccaggcuggaagccccccucugccggccgguggagauaguucagccuccugccugccacgucaccaccaggagcaggcgcuaagcugcugcgggccuagcgggcugccugaggaaucccaaaccaguuauuuggagcuugcuugagaagccccucccaguccuuugagguucuggcuggugggggugggggcugucaagaugguaccugccacguggcauggcugggagugggcucuucagcugccuccucagggaaggaaggcuguuggccucugcuguggucugagcuccagcaucacuggucuggaucagagguggcuuuugaguaggguggccauaugccuauuguccuggcauaauaauuaguagugcccauuuuacucuuauaaguguccuuguuugugcaauaaauuauaugguugcucugccuuugaggcuccaguucuggcagggaaggagccagagcugggagggaggugucuugggguuuauucuaggccccaagauauccccuucauuuuagggugagacucagaucuccccgcuccuuccagacauuuuuagaucucugggccuucccuccucuccccaccucccuccccuuggacccuuugcuuaucuuauacugcaccuucaaggcuccgaggagggaggcagucccgggagauggggagccuguccagguuuuugggauggcagcaguagaaucuucccagaaauacagugguccccaggcagccagaguccugagggucuuccaccaggauuucaaauguucggucuucuucaaggaugacuacaaguugggaucuaccagagcagugggaucgcagccuccaccaggauuccuucuauccuucccuuugcccugucaucucuccugugcuguugcaugauguagaggaggauaauggcccgaagggagagagggaguguggaaguaucccaggaacagagacuguccaaauuggaggccccagagagggaacuggggcuuguccuuggggccacugcuacugcuggggcuuggggaggaggccugagggcaacccugaagccguggagcagauggccuguguggcaguggcugucagauuggagggcagaauggaaucugauguggcuccagcuucuuugaaggcugagugcacaucuggccagcugcuggugauggggaagggggucacugcucuauugagcuaugugugacucacccuuuucccuaguauccuguccuugugcuaugucaggaagccuccuccccagccccaccgagucuucaaaggaguuggucccccaggagcuuuuguccuggggauuucccauccgcacugggagcacuguggguagaugggcauuccaaguuccugcccagacagaagccaugggcauggagaccuggaccuuucagcuuggaaaagggagacugaggcugaguggacacaggacacacacacacacacucucagggucacccuuggggcagcaaaguggagcaucuuggcuccccauuuaaugagugacccaacuggugacucauuaacaucccagagcagaaugaaaggcaugggggcggggcagcccuccggcucugucccucaucccuugcccaggcaucuggguuuccugcagauucucagcucagcugcugcuuuuucucacuggaaaagggcucccagggcuaugugagaucagggcugaccacucuauaaacugaugaggaccccaggucuggccaagugacccuguuuuaccuucguucaggaagagcugaggccuacuguguacuaggcacgggagauauaguggcaaccagauuggcuagcuuuucuguccuggaggccacagccuacuuaggagcagaaauaguuaugaaauaaacacacaaauaaguggaaguguuggcuggccgaugcaggaaaucaauaagguggucugguggugacuugcugggaaugcuucuuugaguagggagguaacagaggccucugagaggcuggcagcucugagucaagucugggauuccuggacugugggcucucuugcccccaucuccaggggacuuguggcagccagagagcugagggugguuguuggggaggaaggccuugggcuucaagaccacccugucugugcaauccucacaggcccaccguggugcacgcaaaccacuuccuggccaugcgcucccuccugcuucucagcgccuucugccuccuggaggcggcccuggccgccgaggugaagaaaccugcagccgcagcagcuccuggcacugcggagaaguugagccccaaggcggccacgcuugccgagcgcagcgccggccuggccuucagcuuguaccaggccauggccaaggaccaggcaguggagaacauccuggugucacccguggugguggccucgucgcuagggcucgugucgcugggcggcaaggcgaccacggcgucgcaggccaaggcagugcugagcgccgagcagcugcgcgacgaggaggugcacgccggccugggcgagcugcugcgcucacucagcaacuccacggcgcgcaacgugaccuggaagcugggcagccgacuguacggacccagcucagugagcuucgcugaugacuucgugcgcagcagcaagcagcacuacaacugcgagcacuccaagaucaacuuccgcgacaagcgcagcgcgcugcaguccaucaacgagugggccgcgcagaccaccgacggcaagcugcccgaggucaccaaggacguggagcgcacggacggcgcccugcuagucaacgccauguucuucaagcgugagucgggggcgcguucagggguccuccuccuccucccaggacccccugcaagaguuaggacgacauuccgugcgcuccauucuucacugccucucauuuaugcugugacaacccagggaggcaggacugucacucagcuuuuuguacagacuggaaacuagauucagagacagguagcagcguguaaaggaaugguucagggagcggaggccccagagggacuccauggaauguauuccgaccgaauuucgucaaagugcucguccuuguguaucuuggaaugaauaacauuuaauaauccauucugccucaguagugagcuagagaaagaacucaaauccuuuuuuuaaaauuauuuuuauuuugagauggagucucacucugucacccaggcuggagugcaauggcacgaucucagcucacugcagccuuggccuccgggcuucaagcaauucuccugccucagccuccugaguagcugggguuacaggugccuaccaccacacccagcuaauuuuuguauuuuuacuagagacgggguuuugccauguuggccaggcuggucucaaacuuuuggucucaagugaucugcccgccucggccucccaaagugcugggauuacaggugcgagccaccaugugcggccaagacccagaauccuuaaagcaaccuugggggcaggcaguguuaccuucauuucacagugaggaaacugaggcucagcaaggaggaagcagagccaggccucaggcccagaugccucugucuucaguugaagauuagauguaggguuaauaaauauuuuugaguaccuccauagacaacacuauucucacaguuugcugugagaaugaaguaacccucguuuuacaaaugaggccaagcuaggagagcugaggucuccccgagucaguggcugagcuuggauuggaacacaggucuggcugugagcaagggcaggguucaggccacucucagacauuuuuuguuguuauuuucuggucauggagacagaacuugcagaggaaaacgaagggugggcugagcacaguagcucaugccuguaauccuagcacuuugggaggccaagguggguggaucacaugagcccaggaauuugagaccagccuggguaagauggcgaaaccccaugucuacaaaaaauuagccaggcgugguggcgcaugcugguagucccagcuacucuggaggcugaggugggaggaucgcuggagccugggaauucaagacugcagugugucaugauuguaccacugcacuccagcuguaggauggagugggacggaccuugucucaaaaagaaaaagauaaaaaaaaaauuaaggguggucauggggcacucccugcccagggcacagcugucccccagguaccagggaggguagaaagcccaccucagagcauguuuccaaaauaucugacaagugcuagagccggggguggccauagagguggcugaccugagggcggaauuaauucucuaucauaugggagcagcaggcacugacuguagggaaccgcauccucagauggcauguccuggggccaagaccccuucccaaagcugggaacauagacucugugggcugggugcucuauagcugggcccugaagaauggagcaaagaccuguggcaaggauaaaucaaggucugcagccggggguggcugugggcugugauuguguuugggggcggccaugugucucugacccuguguuuugccccaacuacagcacacugggaugagaaauuccaccacaagaugguggacaaccguggcuucauggugacucgguccuauaccgugggugucaugaugaugcaccggacagguaggugcugugaggagcagggugucaagguggguggggguccaaggguaguuggucugacccaccccugcacacagggugcccaguguccuuuccgcuccucucccaggccucuacaacuacuacgacgacgagaaggaaaagcugcaaaucguggagaugccccuggcccacaagcucuccagccucaucauccucaugccccaucacguggagccucucgagcgccuugaaaagcugcuaaccaaagagcagcugaagaucuggauggggaagaugcagaagaaggcuguugccaucuccuugcccaagggugugguggaggugacccaugaccugcagguaagggguggcccagccuaggggccugcaggccuuggagccagggggaggugcuugggggacccacucaccaauucagcaggucugucccaagacccccuggauguccaggcagugcugggcucugugaugggggaagcuggggcaggaggugugggccaugcccuugggaagaugaugauaauaccagcagcuaaauauaacggaacauuccuguaugcuaggcguucuucuaagcacuuuauauguauuauuauuauuuuuuuuuugagauggagucucacucuguugcccaggcuggagugcaauggugccaucucgacucacugcaaccuccacuuccuggguucaagcgauucuccugccucagccucccgaguagcugggauuacaggcaugugccaccacccccagcuaauuuuuguauuuuuaauagagacgggauuucaccauguuggccaggcuggucucaaacuccugacaucaagugauccuccugccucagccucccaaagugcugggauuacaggugugagccaccgugcccagccuuuauacguauuaaacucuuuuaauccucaaaacgacuuuauuagguaggacuauaaguuucaucuuagagaugaggaaacugaggcucagaaagguuaaguaaccugugcaaagucacacagcuaguaauucagacaucuugcaccagagcuaacccucggucacugcacugccucugaggucugaagugcccccaguuauagauuguuuaagcuagaggauuaucuaccauccaauaaucagacugguagcuaugggucaucuaggauggccagaaacuuaacacacauucucaagauucucccuugcaaccacccuggguagugggcagaggcucagagagaagcaaugacucccuaagguuccccaggcucauaagugguggaguugcaauuagaccucaagguaaaaacauaauagccgccuuuuugucaaucgagagauauuuuugacuuacccaaaaaaggaaacuuucgugucauucuuuccuuggaugccacaaaugguucucaccugcagaaucgauccagacuugcugcccagagagcuuggagagauaaagcuggagaugaaguggggcuuaggcuccaaaccagggacaaguggagcucguacuggucugugcuguagacccugggaguuccuggagaggggucacugucucucuccugguccuggcccugauccuuccccagccccuucuccaguggcuguugucccacccccuucuccccuuguuccucuggugucuuccuggaacccucaguggagaccccaccccccagauaugggguagauugaguuaggaaauuugaggcggaugacgugugcaaggucauccgggugggaagagcugggccuaccucgaaugccugucucaugacccccugacucucaggaccucaggccuaguuccuguguggccuugccagggagguggauguuauccugaagaauccuggacccggaugcugccauucacucagcccacagccauuuacuguccucucuccugcauugagagccagggagagcgcuggacaugggccccgcccucagggagcuccaagccaggugggagagacaggcagcaccagacugauaacaggaagguccagggaggcaccacucauccugugggcucgggaaggcuuccugaaagaagugguuucuaaagagcccuaaugggagacaggauggccauccaggauauaagcuguucugugaggcugucuggagagugggguggggcgugccaagggauguggcuggaggcugccacguaggcacaggucauauguuaaagagcuuaugguuggcuuccaagagcugugcagggccauggaaagauguuuguguguguguguguguguauguguguauauguguuuuaacuuuuuacuaucgaacauuggaaaaauaaaaguagauuaguguaaugaaaccucaagugucugucgcccagcuucaagcauuaucagcucauggccaauagugauccauuuauacccacuaauuccccccugcaucugauuauucugaagcaaauuccaggcauccuaucacucuggacagguuuucagccccagagugauguggacauaguuguccuuagaucagucuuucucaaacuugaguaugcuaagaaagcacuuggggaguuugugaaaaggaauccaugcccacucccagagauucugauucagggggucugggcuggggucaggacaugagcauuugagauaagcuccuggguggugcccaugcugucugucccugaacugcagcugggcagugccgggauacguucucacuuguuuuucugagucucagcuuccucaucugugaaguggcaauuagaagcccuuguaggguugcagugagaauugagaaagcugugauuugaagugccagugccaugccuggcauacagaaggugaccagggggugguucucuccucucugaggagcggucaggguaguaugggguggaggguuugaggguggaggagccuggcagccauggccucaccuggcacaccuccuuguucccacagaaacaccuggcugggcugggccugacugaggccauugacaagaacaaggccgacuugucacgcaugucaggcaagaaggaccuguaccuggccagcguguuccacgccaccgccuuugaguuggacacagauggcaaccccuuugaccaggacaucuacgggcgcgaggagcugcgcagccccaagcuguucuacgccgaccaccccuucaucuuccuagugcgggacacccaaagcggcucccugcuauucauugggcgccugguccggccuaagggugacaagaugcgagacgaguuauagggccucagggugcacacaggauggcaggaggcauccaaaggcuccugagacacaugggugcuauugggguugggggggaggugagguaccagccuuggauacuccaugggguggggguggaaaaacagaccgggguucccgugugccugagcggaccuucccagcuagaauucacuccacuuggacaugggccccagauaccaugaugcugagcccggaaacuccacauccugugggaccugggccauagucauucugccugcccugaaagucccagaucaagccugccucaaucaguauucauauuuauagccagguaccuucucaccugugagaccaaauugagcuaggggggucagccagcccucuucugacacuaaaacaccucagcugccuccccagcucuaucccaaccucucccaacuauaaaacuaggugcugcagccccugggaccaggcacccccagaaugaccuggccgcagugaggcggauugagaaggagcucccaggaggggcuucugggcagacucuggucaagaagcaucgugucuggcguuguggggaugaacuuuuuguuuuguuucuuccuuuuuuaguucuucaaagauagggagggaagggggaacaugagccuuuguugcuaucaauccaagaacuuauuuguacauuuuuuuuuucaauaaaacuuuuccaaugacauuuuguuggagcguggaagaagauuggaucaggagauucuuacaccauucuucccagggga

SEQ ID NO: 15291 - RNA, 50025 nt, Homo sapiens
uuuuccaauucaaauucaguuuuagucgagaccccagcauaauuuuuagaaaaaagauuggauuguugcuuuucuuuuaauuuuccauuccuauuuagacaaaugaccagaggcaaugacaaaaguaacuguuuaaaagggauuucucuccagaaguuuuuucuaaagguuuaaguccaggcuuuccauccuucucuccauccuuuuuccuuuuaaaaagaaggguuuuggaauaugucaaccuuuacucagcuugcuauacaaagccacugcuuuaguccuagacauaaugccaggacucaucucccaaacuucuggucuuaaucaaguucaugcuugguugcuaaagaagcucauguuaaucccaaagucagcacaaucccaaccuuaaaaagcagacagcugauugcaucacuuacgacauacaccaucuugaggcaaaagaagccagucagacaccccuugucugcuacgugugagacacaucagcaguugagccugaccccuuccgcagagcucacugugcaaaaucaccagcacaccacugcaauccacugagcucaccgccuguccagccauaauggaagucacuugaagguuaucauuguaauagaugauuuuccauaaguaacuaauaaaaauguuuucuuugauguuuagaccuacuaacaauucagucucucccucuccauccucucuuagggagccuguacuuuuaagcaaauagggaagcuaaaaauacaaaggagcaacauccauuuauaaauaaaugugugccuuaucuuccucacuaacuuccuggaaaagugcuguuuuugaauauucuguuuucuuaaggagaaauuuuuuguaaauguagcacacuguauauaggaagggauuucucuuuuuagucuuuaucucauuguacggguuucacucucuagguauugagagugggggaggaggggaucaacaaaccgcaaagagcagcauaaagcacaccccguaucagcagcacggcagcuccuccaauaucgucaaugcugacucgagguaauuucugguggaguugaacacaucauuaaauuucuauuuguguucugccugaggcuuuucccuaaccacuaauugcaagugaaggucccagagagcuuuugugaaaggaacagaacacaagccacguccuggucuguagccagguguccguguacugcauaauggaggaagaggauuacagggagauuuucacuucagccuuuaguccaaccaaaacuuaaaagacuuacagagaacagccucaggagguuaggggacagaagugugguacugcaggaagacaagagggguaaacguauccagcagaauguaaggauaagaaacacccacaugaauucuuagaauacagaggaacaagaaggaauaauuccugugccauaugcggaccagggcauagggugaguggagcacaguggguuagccacuaaauggcuucagugagaauucugaaaacuguuccaguauaauuuuggaguaaauccuucuccuggacaggucaaagacugugcuuuuuaaaugucauuagaagguaacagcuuuuugccuccugcuuccagaugauuuccuuuugguuaaaaaccagaaauaguauaaaccucacaggaugaaagaacagucuuuugauacaggugagguggagaucuagaugaacuuacauaguaagugaggaguacauuucuuggucuucucccuugaccacuccaagucucugaucuaccagagauggcaguuuauuuccucuggaagaagccaguaauggacaccugucuguuggcuuugcccagagcagcagucccuuucuuggggcccuuucguuccucucuggguucuuuuuucacagucauggcagggggucuguguacugaggaugucuucauguuaagcuccucuucacuaucugugcaggauucacucucguagacuuuuucagucacugguaggaugagaaaaaaauggaacaugggugggcugaaucauuuacucuaugaagaaaaugggaugucuugcuaaccccaaucauuucagacucugaucaaggcaaauaugcuuacuuaggacucaaucuuucucccacugggagaucagaucuagccuaagguaggaacuaugugggauccugagcucacacagucucuauuugaugcuuagaauuaacguucacuuuucucccucacagcuauaucccaugccuuuaaauggcccuuuaucagugaauugccuaaauccuuuauuuggguccuggccuaugcuggcuaacuuccugaacucuauauccgaauugucuauaucuuaaacacuuacuucuaacuccaugcuuugacuggcuucuuaaguaucaccucucugaccuacaaugccugccuauucccguuacuggucuuaaacugcuggccuauuugccugccuccauucuguuuaaccaaggucaccauggacccuccugucuagcucuaaccugaugccacccacucucugcacauccuagguacagagaauugaagauuaguuacucaacuguucgguucuuaguucuuaauggcugcaaauuaacccaaaauuuaguaguagucuguaucaugaagguuaacuaucucaagcaaaugcuaucggaugacacacguguuaaaggaaugacagugauaaauugagaaacaaaguuaccaguuuucuuacucccuaucagccgaaggcauaaauugcuuuuccccugcuauuaaaacucacugaacccuucccaagggaaacuuggaaaagaacuguaacaguaagcagucauuaugagcaagccccaaaggacacaggcacagauaguggcuuccagccaugacgucacauaaccgaggaggaucuacacuacugcaacacauauaccaaccacaagaaacagcaugccaccuuucuguaauuuuagagagcuguggcagcuguauaaccaaugcuaucuaaauucuuucucagccuuccugguugcagcaagcgauagagaaacauugaaggaaaagagcuuguucuuagcugaaaagcguaaccuaauaugcauaauaaaugcucaaaugauuaaaguaaaagguuuuuuuuuccauuaaagaacaaugacagucuugagcuuuuauugauaauucuuucuaauaaaauauaucaaauuguucuagaggcauaagcuuuggaaucaaauguaugugugucccaauaccuacucugcuacuuaagauaucaucucaaacuuuacugugcaucagaaccaccuggagggcuuguuaaaacauagauugccagauucuguuucucaaguuucagacucagcagaucuggggugggaccugagaauuugcuucucuaacaugcucccagauaaugcugaugcugcuggucuggggaccacacucugggaauuaauguucucuccuucccuguuuuaaauguugaagugcaauugccacuggagcauuccgucccucuuauccagcuaaucccauuaaggcugcauaaucaacaaucccuucccagagaguucccagaguuugucuuuaauuuuguaagagcccagaauucacuuugauguucacuuagaggcuaaaaaauacugauaaauuuuagauauauauuaaguauucugaaaggccuuacuacucaaauugugcuccgcacaccagaggcaacagaaucucccaugagcuuauuaggaaugcacucucaguucccacuccuggccuacugaugcagaauuucaauuuuagcaagaucuucaaguaaugcacauagccggcaaaguuugagaaauguugcucuaagauaauuagagaauucccauggcauaccuauucguucagcaauuagaccccagaacaccaccuccaucucacaugcaucuucaaaagcauuauguaacugaauuaaugggacaaaauuacgagcuguuauuuauucaauaucuuaaauuagaaaagucugaagagccaucuacagauacagaaaggaaauuacuuucuacuaguuggugguauaagacuuugcuccuucauaagcuauauucuguacucaaauggcagcaugucuacauuauacuucagcaucaauuagcucauuauuucauuacuuauuaaugaaaucaauggcugucucauugccaauuuugugugagacauugcucaggggaguuaaaaaacagucagggcagcaccaacaaaauuucuuuagcagcauauucaguauacuguaagaacuaaaaggaauauuucuauauucaaagcuguagcuaccgcaaaccccagaaaaaaggaggucuccauuaaaaauauagggccuuuauuuuagcugaacaacaugccacuuuucuggguugccauuaaaaaaaggcaaacaaaccugguuuucguggguaacaucagauuucuuuuccacuuaacugcuuugcucuuagaaacccauucccuuguccagaagucuacuccaaacuuaucucaggggcccaacuacccaauuucugcugcaaagucacaaagagagaaagaugagcuuucuaaacccauagaacaaaucugauccagcacaggacagggcaagcccccuaugcugguacauuuggaacagucugagcagagagaggaaagcagaacuccuuuguugguaaccaaagccaagauucauuagguugagcuuggaccaaaaaccuuuaaaaaaaaaaaaaaaagugcaaugugagcacaguuuucacugcugcauccaaggcucuuaacaguccugucuggagacaggagugcaaaaaaguccacaucacacaccuggccaaaacucgaguacuauauuuuaaacaaagcaauaaauaauuacccacaaauucccaaugaacucucacucucacaaagacguuugacuuuuuucuuuuggggcagaaagaggaggaaaaaacuggcaccaauguuuuuguccucuuaaauuuaaaaaaugcacuguugaauuaagaaauucaacaguaaacacauauauuaucacccauggccaaaccaagaggcuugaaaauggcaacuauuaaaagacugaaagccaaaaaaaaaaaaaaaaggaagaaaaagaaaaaaaaaaacccauucaaaguccagaauucacagguucacaagaaauuuggcacugaaaagacagaauuuccacacguaaagaauuuuacuccccaaucacauguuacaauuaaaauggcagaggccuuuucagaggacugggagguggggaauagugggacagggagcacagaugacaaaaugucuucacuaguuuuaagaaccuggaaagguugauucuucagagccaaucuuuucaaaacaagucugaacuaggaaaaaaaaaaaucaguaacagggaaaauaaucuucucugaagauccaagcuguagcaggugccacaaaaggcaaaaugacaaccaugggcuauccaacuaacaaagguaagagccuaaacccacaacucuuuucaaacacaaaaauacaguaccaggaucugagcaucccaucaaaccucaagugcuaaaucuuaaaagcuccacagaagucuagugugauuauggaaaggguagaagaagcuaaaacauggcugaagaacuagccaaugacucaaagccugaacucuaauuccucccuaggccuucauaacaagcacaugcuuuuaccuaacauggcuuacaaauaggaaacauaaaggaagcaaucucgaugagucauacccuucugaagaacaaauggaaccaaauaccaaagaugacucuugauuacagucuaaucaucuguagcuucuuuuccacuguucaaauuuauaaaaacaaauauucuagaaaaaaaaaagcuucucaaugucuaugauaacaucuuaagcccauacugugguuuccaucuuguuuuuggauauauuuaugccaccugaaucuucauaacugcacauuuaggcaaaauagauauuccauagauaagaaacucuucaccagggacgacauaacuuuuagccaagaucucagugcuuauuuuuauagucuaugaccuaaacaagaaccuagguguucugacuuacacucugcuacacaaaguguaugccauagacaaacagcaucaguaccacuugggcaugauucacauguaaauuaaaguuugagauguaccuguucuaaaagggauuauggugccucugugguaauaagagauucuaucucuggauuuggagccaaauauuugucuuaccuaugcagccuuccccauccagguaaguuuuagauuuuaguacgcguuuucguuuucuuuuguuuucuccacuugagcucuaaaaggucagaggauacaauguuaagcuggaucaauuauguuauacagaaaaauaacaaaagcuuuuaaaucuauacuaaucacucuccaauacuccauuaugauaaaaaguugaaagagaaacucuacauuaguuuuagagaaccaaccccaucacacagacaaguuacgcccacuauauacacaggcuugauacuucauuguucauaagaaggaaaguagcaugcugaagaaagaacuguguucuguucauucagucaauaaacuauuguuggguagugcaggcagcaugguuaaaaagacauauaggauaaggaccuuaguggaggagagagagaaggaaagcagaccacugcaauacaguguagugagggcugagacagauauuaugggaguacacagggauggccccuaaaccacaccagggauuucuguggcauaugcccuugcuguagauacuugcuaugucagccuucacauuucuugucuucuuuuuuuguuuguuuguuuuuuagagacaaguucuggcucuguugcccaggcuggaaugcagaagugcaaucauaacucacugcaacaguccaacuccugggcucaaaugaucauccuaccucagccucccaaguagcugaaacuaaaaggcaugugccaccaugcccagauauuuuuaaaguagagacaaagucucccuguguugcccaggucucaaacuccuggacucaggcauucugcccaccucagccuuccaaagugcugggauuacaggugugagccaacacgccuggccagccuugacacuucaacauuauagcuaucuaauuuagucucaaaauagguauuacuaguaucaacuuccuuuuaucuccacuggucucuuucgucccauuuucucuucagcuaaugaggaaaucagcguaagauuuaaaugauggucuuaacacaaugaauuaagaaaaacuaacagccacaaaggaaaaaaaaauugucagcgacuauuuuuucaacucuucauuaucuacacuaauagguguagauaagaugcagcugaagagcguucaaagcuauauuuccccuuugguugacaguuuucccauccagcccuuuuccagaauugcuucugaagagcaacaaacguguguuaaguuguuuguuccccucugucuuucacguguugcucugaugcaggggggaucucuuuuuacaccauucuaacaggagcuguacagcacagcagagaugcugaaggucaugaaaacagaacagcucccagguuccaccucugcaacguuccugagacuauacccacuagcaaaaucucccuucagguaagaauggagggaacgcccauucuguacaaccuguaggacagcagaaugagacaagagccaucuacuggcauuugugaaguauacagcaagggaacuaauuuagcauagugguuguagguccuuaagacacaaaggaugcauggacaugcaagaaucccaguauaauuuuaccuugacagaaggagguucaggcucagucuuuggcacugguucaagagguggagacggaggaggagguggggauggugacucagcuucauaagccccaggagagucuggaaagacugaaauaaugaaacggacuuagaucagagaacuacaagcacuaucugguauaaagccuucuccauugguucucuaaauugacauguccagcaaaggggauuuagcaagcaguaauucaugacaaccaagaacucuguaguuauauaguuaucuuuaaaauacauauuuuauuaauuuuauacaaauaaaaucagagaaucaagaauuauuacagccggaaguaucuuagcuaaauauuuucuuuuauagcuagucagguuaugaaguugguuuacaaauauccacuuaucgccuuucauaugccauguauuucacuuuauucuuacaacaacucuaagagacagauuuucuuauuugcacauuacaguaaauagagguucagagggguuccuaaacuugccaaggucacacagcuuauaacugagacaggagguuuuaagccuaagucaauccaauucuacagccuugcuauuccaacuaucccaugccgccuuaccauugaggacaagacauuaucucucaagaucuauguggagauaauccucagguuauaacaaauguuccaugccagagucuuucacugugaccuaaggguuacuuuuaaucaccugagauguuucuuagacugaaaauuuccagcugauguuaacaguauaaacuuggaggugggugaagucaucuuuuaaacaauuaucauuauuuaagcucugacaacuaggaccuacuuaauauuuugcauauuucuagugacugcuucacugauaagguuuguucugcuacagugagguuaacaggaaagaacacuuuuaggaaaaaaauacugcuguggaaguggcaucacccaagaaaugagcaccaccagagggaucccaucauuucucaacaauugcagaauugguggucuuaguaaacagcccaugagaggggaaguaaaaauccucaacugaccuauuacucaaucaccacaaagaaagugcuggucaggggaccggguagcgacuuagccucaccugcucccugaaucuccuggcuguauucaaauucuuaacacaagucuuggaucugaaauucucccaacugauuaggucaguguuaaaaauuaugacagugaagaguucaaggccaaauggccuaaagaggugaagcagaacaagagccagaaagaacaauaaauuacacacuuuaaguauaaaaugggccccaaaaacuuuauaagcucugggaaacaagagagagaaacauaaaaggaaagcgguccggcuauuagccagcucugggaggcuagaacaugaugggagcucaggcaagagaaaagucaaaccccagaagcaagccuccauuguucugaaggaacagcuaugaagaaagcugggccacaaugguagauguguuauaaugggaggaggaaaauuuaggcaaugaggaagccaaaggaauuuugagacucacaguaauaaacuuaggcguucuuauucuauuuccaguucugaaaccaguugacuuaaccaaagaaaacaauccuagugacacccucuaagaccucucucacagcacuguaggcaaauguuuaucuagauccccacucuagacucuaagcuccaaaaaggcagagacaccacgauuucccuggcauaaacauagaguaacuguguguguguguguguguguguguguguguguguguguguguguguguguguguguauuuacuuaaauaaaggaaaaccaccacuuucugaacuaaauuugggaugaggaacauccaggucaaggaagacaacauauaucucucucuuccuuccacacacucccugagagaaacacuguugauaauaaaugaguaaaacauuauaacucccccaaacagggaagagaauaguagagucaagaguccuuaaugauuaagaaauuucaacaaauccauggaagguggaaggcagaugggagaaaguugacaaaagaagcaucagucaaauuagaugagccagagaguagagauuaucaucuaucauaaaacuucuauuuuuaucugacuuuuaaaauuguaaauaucuacugcuuuguuuaaacgugccgccauucauguacuagaauauaugucugucugccuuagucuuuaccaagccaaacauccccacucaauacauuuuuacugacacagacauaaagaauguccaaugcacugguguauuuuaaacagauuuguagccaaucugcagcucuucaagcaaaagguaaguaaugaaauaucacuuauuccaggaaagcaaccuuuguugggacagaauaaaaacugcaaugaaacuaauuucagagauccagugugucaaagaguucucuggcagagacagguaauuagaauuccuggaaaccauucacagcuuccuaggacuauuuuuuaaaaauaccuaccuuuaccuaaaaauggggaucauuugcuuaacauucuccauaagcaacuugcaaggacugaaaauauuagcaaagacuuaacuauaucaguuaaaacuacauuucuccuagcaauguagauguuauucuuaauguuauuucuuucugggucuggccuuuuuuuuugcuuuaaaaagagaguauauaguacuacaggugcuuaugaccccgcagggguaaaagagaaaggaacagucccuuggguagaaaguuacaaacagaaguggaggggaauuuucugaaaaaauugaagguacuugcaaguaugggcaccucagcaggaagaguagagugaguaauaagaaaacuaucugaacuuguuuccagacacagguaaaagaaaaaaacaggacgggcgcaguggcucacgccuguaauuccagcacuuugagaggccgaggcggguggaucacggggucaggaguucaagaccagcguggccaacauggugaaaccccaucucuacuaaaaauacaaaaauuagcugggcgugguaguaggcaccuguaauccuggcuacucaggaggcugaggcagagaaucgcuugaacccgggagacggagguugcagugagccgagaucgcaucgcaccacugcacuccagccugggcgacagagcaagacuccgucucaaaaaaaaaaaaaaaaaaaagacaagacaaaacaaaagaaaaccauguaccaagcacugucuuggcacuucugacacaucaucuuauuucauguucauaaaaagccuauaccaucugugauaaaaauccccauuuuagagaugcaaaaacaaggaauuaaacaaguuaacuaaucugcuuaaagucacacaauaaguggucaagguaaaauuuaaacccaggucugccugacuccaaaguucuuguauuuucucuacuccugcuguuccuuuucuaacuucuggcugaagacagcauauugaacuaauaugacauauucaguguaacagaaauaaagcaauaauaaguuaaagacuguguaaagguugaaaauaaaaucccacuggcuuugauacaaagaugaaauuuaagaauaaaaugucagagguuuauaaauuuagucagaugccaaaaauuaucuuugccagaggaaaaaaaucuaagagcuucugcucuauaucaucuguuauuauaggcuguguaccucuauugcauuucuucacauuccuuucaaaacuaaauaaccccacucacauuucuaaucacccaacaguauuauuuuuguaggcuacagaucagaacuauagggaauauuucagaaggauauaaugagugcucaaccaaccauagucauuccuuaacuuagaacugacuccuuuacuaauacuagaguaucuaguugauagcuucaaagaccuuuccaaaaucuucccaaggucuuuuacugauuggaaauagggaagacuguuccaauuagcaccuauuccuacauuuacuuccuaauuauuuucccaugugucuacauggaguuguuccuuucagcagccuuggccaaagcauuuugauaaaugacaauggaaugaaaauacagcauuugccucucugggaugcucacgugucuuacuccuacccauucuaaagagccacuaaaacccacggaaggacauuguaccucucacaggauaucacaggcuguaauucuaaacacauagcaugaaugguagaaucuaaauccacagaagugucaaagaugcuacaccuuuaucacagauucagcuuccugcuacuauuucuugggucuguucauuucuuuugcauuacugucaacuguauauauaauuuguuuuuuuuucacucacuuguauaguugagcuaauauccuuuuuucggaagccucucuuaccauuuucaauuccucuuagaguaguuucuggaaaaagcagaaucuuacaaguuucagaaucuuacaaguuuguccuuugauagcucaguagguuccuuuuuugcauucauuauucuucuuuacucucccuuuuaguaucuguucguguuugucucuguaucuuuaugugaugcugaaauccuuuggacuagauuuccccucauuacuuaaaauguuuuauacccauuaugccaugaauucauggacaauugauuagagcaguucaaacuuuucaccacugugucucaaagugggcuuuucaagguagagucguccagcauaucaguucaacccauuuaacuuucuuuuuagccuccuucuuuuucuauauacuuuauacaauuuggggcaagaucuuggcucuucaaaauacuugauauuuuuuuaaaagcauauuaauguucccgguaaaacucuugcccuuaugagguuugcuuaucuuacaacauugcccacagccuaaaacuagaaggguccacagugucauucccuucuaacaaugacacuguagguuguuccaguuaacccuaguuuuaccuguguggaccaccaccaguaauacccuggcugccuagaacgucacaauuuuuaaaagauucacaugaagguagcuaaaggaauauccuccccuuaaaaguaaaaaaaaaaaagaaaagaaaagaaaaagucuuagauaauauguauaauaauaauucuuauccucuuuccuucuguguuauuuugacaaauuuccaaaagaucaugguucuagucaaaaggcuaaugcagauuucaaacagaaagaggugcuauggugucucuuaaugcuagaauuacuacucucauugugauccuuaauccauuacuuuuuuagcuccuugaacauugaaaguaaaauugaucccccuaacccaaaaugaaugguaaugcccaccuucaucuucacugcuaucagauucaggaaguuugauucuucuccucuuuuuccucauguuuucaguuuccuuugucucaucaucagauaaugcuacucgcuucccccuguugccauccagaaauaaauuaagcguguuacacagaacaaaaauguaaguauucacaugcucuuauggguuuugcuuuauaacucguggucuuaauuccagaggguagaaaaggacggccaaauaguccaagaaggacucuuguuaaggauacucugcuaacugaccacaacuaagucacuucaugaggugacuugaauaaaaaaguucuagaguucucuagagacugcuggaagcuacaaccagguuaucaagaaucuuuccaaauuccuucuuacuucccugauuggccuuucaauuauccaacaagcauuaaauaagcagcuacuacauacauacaaggcucuuugcuagccauugagaaugcaacaauacagaagaaaauacuguuuucaagaagcucuggcaaacaccacuggcuauaaggcaaugugguagauuuaacuggacaaauaaaauguuauggaauauaauucauauuuggaaaacuuaaaagcuaaguagaaguucaucauguagaaaggggaaacauauuuuaaagagaaagaacaauaugagcaaaggcagagauauccuuuuaaggugauucuaaugacauaauaauaauaaaaaaaauccuagacuccaucaugacauuauuuagcuccucuggaugaauggauacuccaucacacuccucaugcaaccaacaaguaauuuaucaaaggccuacugaauguuagagaaacaaauauauacaagacauaaucuuugccaucaaguaccuuauguccuauauaacuuuaaauaccaacuuuccuuucuaccuugaacuagaaaaagaacaauuaaacccaaaguaaaaggaaacaauaaagauaagagcagaaaucagugagauaaaaaauaagagaaaauuaacaaagccaaaguuguuauuuuugggagauuaauuuuauuaauaagccuuuuauaaaacccauuuugaaaacagaaaaauauaaauuaucaaucaggaaugaaacaguaaagaaaucuguaucgaguacagguucuacaaacucgaagaauaaaguuauauaaugaacggguuuaugccaauaaacucaacaauuuagaucaaauuuugacugaguuuuaaaaacacaacucagucaaaacugauccaagaagaacuagagaauuugaacagcucuaguuaaaucaaauucacaauaaaaaccuuucccacaaauaaaauccagcccuggauucacugguaaauuuuauuaaacauuugaaaaauauacacguauauauaaacuccuucagaaaacagaggaaacuucucccaacugcggucauggaucacuuaaugacagggacauauuuugagaaaugcauuguuaggugacuucacugugugaacaucacagaguauacucacacaaaccuagaugguauagucuaugcuccuaggcuacaaaccuguacaucauuguuacuguacucaauacuguaggcaacuguaacacaacgguauuuguguauuuaaacaucuaaaaagagaaaagauacaguaaaaauacuguauaaaaaagauuaaaaaugguacacauguauagggcacuuaccacgaauggggcuuucaguacugaaaguugcucuggcugagucagugagugagcggugagugaaaugugaaggcccuaggauguuacuguacacuacuguagacuuuaucaacacuggauacucaggcaacacuaaauuuauuuuaaaauguuuuucuuucuucaauaauaaacagcuuacuuuaacuguauuuucaauuuuauaacuuuuuggcucuuuuguaauaacacagcuuaaaacacaaaaaauuguacagcuguacaaaaauauuuucuucuuuauaucccuauucuauaggccuuuuucuauuuuaaaaauuuuuuauuuacuuuuuaaacuuuuuuuguugaaagcuaagacccaaacacacauuagccucggccuacacagggucaggaucaucaaugaucauugucuuccaccuccacauuuugucccacuggaaggucuucuucaggggcaguaacacacaugaagcugucaucucuuaugauaacaaugccuucuuuugaaauaucuccuaagggcugccugaggcuauuuuacagucaacuuuuuuuauaaguagaaagacuacccucuaaaaugauaaaaaguauagugcaguaauuauaguagcauagucauuuuuauuaucaaguauuauguauauauaacuauuaauauauaugauauacuuucacaugacuggcagcacaguagguauauuuauaccagcaucaucacaaacacgugaggaauguguugcgcuaccaugucaugacagcuaugaugucacuaggcaaugggaauuuuucagcuccauuauaaucuuacgagaccacugucauauaugcagcccauuguugacccaaacaucguuaugcagcgcaugaguaaucuuaugaaguuagcacaauuuugacacagcaacuugauaaagacauuaccagaaaagaauguaacugaccuguagaccucauaaacacaggcaacaaaugcuuaguguaauauuaacaaaucuaauccagcaauauauaaaaaaggauaauacaucauaaccaaguggaguuuaucccaagaacacaagguuggccuaacauuuuaaaaucaguguaauucaccacauuaauaaaaacaccaucugagcauccaaucaauucaaaaaagcaucuguccaaaaucaauacccacucaugauaaaaccucuuagcagacuuggaacaaaaaacaacuuccucaaucugguuaacggcaucuauuaaaaaucuacauuuaucaucacauuuaguagugaaauacugaaugcacugcuggcaauaaguaucaacagugagugacguacccaugguuguggacauuuuaauccauacaagucauauguuccuagguggugaggcccacuggacagagcuuuaacccucuaaaauuucaccauuuuguugauguuuucaacgagaguagucccaaacuugccacaaaagucgucuuucuaggccuaucaguguugacaguguccuuuagaauuucuuucagcagacuaauucuaccaacuaugagguagugucuccaauuccuggaucuaguuuuaauagcuuuaugugcuuuuuauuuucuuuucuaauuacauuuuaccacuugaaaaauaaacucauugauauaaaaagaaaacaaagaaguuuuucucuuaaauuugacuggaaacaguaacuguucauuuggcaauuugaagugaaacacacacacacacacacacacacacacacacacaacuaggcacacuuaugccauguccacaaauuuaaaacaaaaaucaacaaucaauuuagaucaauacggccaaaaacacgacuuugguccuuaaaucauccaaacuggcugauccuacgguccuacuccacuagauaagcuacugggcuucucuuuccauuuugguuguauaguuguaucccuuaggcauuaaguaggauuuaguacuuaacugaaaacugccugcugucaauaagcccaaagagaccuucucacccccaguaaagacucuuccccaauaagcaacaaaauuuuccuaccuuuuuuuuuccuucugcagcaccuuaacaggcucugcuuuuuugcuggauuuuuucaggccugcaggaguugccagcuuugguuccgugacagacacuguaggcugcuccacuauuuuuucuucuuucacugcuuguucugaguccaaauugacuuuaaauuuaucuauaaauaaaguauagcagacgacauaugaccccaucaugcaauauuaauacaucauucuuuugacagucuaccaugugccagguaauauguuaggagcaggggcaaaaaggagcucauggacuauucagaaacauuccuccuuuccaacuaccacucuaacuguaacuuuucauuucugccuccugcuaaucccucauuguaucacagcccccaggcuaaaugauaguaaaagcaaggcuuagaaaaaacacauacaacuuuaugaggcaucauccuucucauuuucagaugaggaaaaucaagaaucagaaggauuacaagauguuucccaacaauacacaguuuacaaauggugacaacgauuugcagcaagaccuuugcuuucuauauauucuaucuuuuaaugccuggauacccuuaauaucucacuacuaccuuaaugauaaaauuuaaagacuauuuuggagucaaagaaguuugguucaaaccccgcuucacucugggcaaguuauuuuaucuaagucagucuuuucuaaaccugagauaauauuuacaagauuaucauaaggauuaaaagagaucaguauugguuaaaugauuuauccagguaacacugacagaaaagaguagggauuugaaccaaagucaguuuaacuccucaaaguccuuaacccuuucccuacaccaagcugaagaaugacuacagugcagcagggagaacuaagaaaugcaaacaggccuagccaucugaggaacuauagaagcaugucaucuagccuucacgcuguacuuagugauagcuuuucacaaguaaaggcacaaaauacuauuagaaagcugucauuagcuggaggugcuucaauaaguaguuuugguuauauguuguauaauagcuuaaaccaucuacaguguagaaaaaaauugguaucauagucugggcuauuaugcauagcuuaguacaauaauuuauaaauaauguguauuauuugaaggguaguugauggaccaaaguguaaaaugcaaucuauuuauacuuuucuuuuuccugaagacuugaauggaaaaugcgaaugguggaauccaccuucccaacgauggcauacucuugcauuuucaacuguuguucucaaguaucagugccucucaaauaucccaaauuguauagaagaguaaacaugcaucuccaggggucuaggggucaacagccaauccaaaaaauacaguucacuggagucacauguguagcuuuaaaauuuaugcaaauuuugcaaucuaucacauaaauuauauuguuuuaauagcaauuguuuuaaaaauugcaucauuaggagaaaaaaaccuccaaauacuuccuaccuaccuauggauuaaggaaagagaggcuauugcauugaguuuaccaauuacagaaaacugaucugaauuaaaaugccacugaucaaacauuagauucagcauccagaguuucuucugucuugguuucacagaauuuugagaacuccaacuuaaacauauaugcagcuaccaauagccaauuaacugguaaagagguaguuuaaugcaacauuguaaggcaauuauuaaggaaaauuuaaugacuuuuuuuguuaccugaaugaucaagucaccuaucuucuagcugauuaaaagcauuuccuuuuuauacucaagaaaacacgaaaccuuuucaagcaaauaaagauaaccaauuaugaccuuuaaauuuugucaucaaugcugaauuuuauuacauauaaagcguuacuuuuaaaaauugagauauaauucacauacaauaaaauucaucacuuuacauucagcguuuuaguuguauauccaccaucacuguccaauuuuagagcauuuucaucaccccagaaagaaacccugaacccauuagcauuccuccucaaccccaguccagccccugacaaccuuuauuuacuuauuuauuuauuuauauauuuuuugagacagagucuuucucugucgcccaggcuggagcgcgguggcgugaucucggcucacugcaagcuccgccuccuggguucacgccauucuccugccucagccuccugaguagcugggacuacaggcgcccaccaacaggcccagcuaauuuuuuguauuuuuuuaggagagaugggguuucaccguguuagccaggauggucucgaucuccugaccucgugauccgcccgccucggccucccaaagugcugggauuacaggcgugaaccaccacacccggccccuacuuucugucucuauagaccugccuauucuggacguuucauauaaaugaaauaauauaugaucuuuucuaucuggcuucuuucacuuaauauuucaagguucauccaugucauaucacauauccaucuguacuucauuacuuuuuauagcugaauaacauuucauugucuggauauaccaccuuuguuuauccauucaucagaugacagacuuuuggauuguuucaauuuuuggcuauuaugaagaaugcugcuaugaacaucuuguacaaguuuuuguguggacauacaguuuuaauucccuuguguagauaucuaggagaggaacugcuggguaaacucuauguuuaacuuuuagaaguacugccacaucauuuuccaaagugaguacacaucauuuuacauucccuacagcagagcacaaggguucaauuucuccacauccuugccaacacuuguuacuguccaguauuaaguuuuaaaugguucaaguccccacagugaacucucuucauccaauucucaagcuucauuuucauuguaaugaucuugucaugugucgaauacaauaaaaaagucauaauuuuacucugaacauucagccuugaagaaaugucaaauaaauuaacuuuguaagcaauuuuuagauuaauauuuaauaguauuuuauuuuauccagguuuucccccucaccguguuacaugccaucauaacacccuauuacuccuaccuagcaauuacaaucauccacuauucaaauguuuucuuucuuuccuuucccuuuauuuuuuuaagaaauggggucuuacaugcacacguauguuuauuguggcacuauucacaauagcaaagacuuggaaccaagccaaauguccaacaaugauagacuggauuaagaaaauguggcacauauacaccauggaauacuaugcagccauaaaaaaugaugaguucauguccuuuguagggacacggaugaaauuggaaaucaucauucucaguaaacuaucgcaagaacaaaaaaccaaacaccgcauauucucacucauaggugggaauugaacaaugagaacacauggacacaggaaggggaacaucacacucuggggacuguugugggguggggggaggugggagggauagcuuuaggagauauaccuagugcuaaaugacgaguuaaugggugcagcacaccagcauggcacauguauacauauguaacuaacgugcacauugugcacguguacccuaaaacuuaaaguauaauaauaauaauaaaauaaauaaauaaauaaauaaaaagaaaugaggucuucuacauuuuuggcuggauuugaauucaugggcucaagcaaaucuccugccucggucucccgaguagcugggauuacaggcacguaccaccaugccuggcuuuuuuuccauauuuauuuguccaucucucucaguagaauauaaggacuugagggcagggaccuuguuugucuuuuuccucuauuguaucaccacugcauaacaaugccaugcacauagcaggugcucaaucuauuugcuaacuaaacacaugauuuaaauaagcauacuucuguaugguuugauuuuuuuaaaaaaaaccauaacagccaggcaggucagugacagcaugaugcuuuaacacagcaguccccaaccuuuuuggcaccagggaccaguuucauggaagacaauuuuuccauagacaggggugguggugggcggcgguggggggucgggggcggugguuucaggaugaaaccguuccaccucagaucaggcauuagauucucauaaggagcccgcaaucuagaucccucacaugugcuguucacaauaggguucacaauccuauaagaaucuaaugccaccacugaucugacaggagguggaguucaggcauaauaacgcuugcucauuugcugcucaccuccugugccacccgguucccaagaggccacggacugcuacccaucaguggacuguggguuggagaccuguuuuaacagaaguaggaagcauucccugugcaccaacugugccugcaguaauacaauaaugcuuccgaguaaccuuuaaguaucacauuuuccauucacuuuucuaguuacccauucugagcugcaagaacacaaaaacguucucugauagcuuuuacagcaaacacaaaaacugucacccuuacauaagcagaauaugaaaaaaaaaaaaaagucacuucaaucccucccgugaccaccaauuuagccaucauggaaaggcagaauucuaacuaauuuugcuugcauaggcauguaacaaaaugccuccuugaaaaaucuuuguaaaacugaugcuccaagaaagugugccauaauuauccuguggcuccugcauucuuccugguauucuaccacauacucucaggggauguacacuugauaugagaaguaugaaaauaugugacuacugguucuuuccauacgaaagaauucuuacuuaaguaucuuuuuaaaaauaaagaagauuuuugcuuucucaaaaaagauuuuuaaauguccauuacuacuugggcccuucuaauucacacuggaagucuaauucauuacugugaguaaucugcaaaaaauaacugaagaaaggcaaaauauuugcuuuuguggacccuugagagauagaagaaauaaaggucacaccaggcaaacugacucuagcauccacguuauuaaccucaacacuauacugcguagccaggcagccucccuuuuauuuuaaucacccauuuucaagggcccuaugaagcaaauaguucauuaucuuuucaaggcaggaaguuaaaccaggaauaauaaacugcucucaaagagaucucaacugagccuaacucacccauaaaguucuagcugaguuacuuucaucaauauauugggcaguacacuggaaauuuguuagaaugcagguagucucuuggauuggcaaaaacuagacaaaguggcuuucacuucagguauaauaugucauuacauuaacauucauucguuagucaaagugagguaagaacaugcuuacucauagcagcuuuuccaaaaaaguugcucaucauauucccuuucccuggugccuuguugccugcugcagaugccuacaagcacagaaaacacauaugauuuuuugcuggcauuuaggcuguucaugaaguagcagucucaaacaaacucuucuauagcaaacuguugcgaugguauagucucuauauaaucaugccaaaacgcguagguguuagauauaagaacaaaucuagaacaauaauccacaccagacaguaacugguguuaaucucuaaagcuuaguuucuuauauaucuuauaaaauuaauuauccauggauauagcuaaacuuuucuugagcacauuuaaaaacuauuuaauuugacagaauuaaaaaagaucagaggcaguauguacacaaagcgggaaaaccuaaaacauuacauuuuuaaucaucagaaguagaucugaauuccugguucccaccauuuaguagcaauaugggcuccaggcaaauuacuuaagucuagguuucaguuuuaccauaugcgaaagggaaauaguuaauaucucccucacagaacugauaagaggauuuaaacaaagacacuggcacacaguugaaauucaauaaacguuaguguuuuccuccauccuucuucuuucccaagacagacgcuugaaaaugacagugaucugaauuaaauacacuugacacuggaaaaugacagugauaauaauaauaguaacaacaauaauuaugcuuuucuggauuuuuaaaauaguaucuuaaugauacuuuucuuaagucaaugcccuugaguuaguucagaugacugaacaauaaaaaucuaagagaagcaaauaaggcaaaaacaaaacaaaaaaaccugcauaaaguauaagaaugggaaauacacuaggaaggaagguauauguugcaaagcccagaauauaagauguuccucagaaagacauauugcaaauaaacauuuuuuugaaugucaacaauucucgagguguuuucacauguuuucaucuggguuucacaacaaucuuguaaugugcacaagguaggcauuaccauuuugcaaaggaaauccaagguuuggugagaaucauuaucaaaagcaaaagaacucuuucagauaacaauaucaaguauuaaaggguucaaacuaaaguagaaaaaucagaacugaauaucagaaucuuauauaaauaaacuacuaccacugcaaccauuaaugcuuuucuaguuacccacucugagcugcaaugaagggguaucuucaaagaagacuuacauuuguuacuucuuuagccucuguuuucguuuccuuguugguuucuuggguuuuagcagcagcuuuggaggcaaacauucccauaauuccuuugggcugcugggaaaccugcuuggaugcaggugggccaugaccauugguggucagcucauuguuggcuugugucucacuugacaugugaagaugugacugcucaaacuuuuuggaagacgaagaggauucagcaggagcucuagggacggcagcugcacauuguauagcacuaaaucuggggacagaaauguuacauuaaguuaaugucagcauaugcauucuugggugguucaacaaaaaaagaaaaaaaaaacuaaugucaguauaaaacuuuauuuucaaacucuugcuucuuccacacaauacuuaacucuaauauuguuuagaaucgacuuuagaaaaauguaugaaacucucuauuacauaaagaaacaaauauuagagagaagugagucacuuuuacuagguuauacaucuaguuaguaauagauaggauuggaauuaggugccuucuaccacuaauugaauauucuuguuuuugauaaaaguauucuaauucaaaagaguaggaaugcaaccaacaauaauaaaagaugcaguaauuucauuauccuugggaaaugaaauagccuuuguuuuuaaagaccuuccucugauagggcuagauuugcaauauugacugaaucaaaacuaagcuuuaaauauuaacaaauuuccuggcaacucucuuggccagaguaaaucaugcuguaggguugggcgcauuggcucacgcuuguaaucccagcgguuugggaaccugaggcgggcggaucgcuuaagccuaggaauuuaagaugggccugggcaacauggugaaaccuugucucuacaaaaaauacaaaaauuaguuggguguaguggcgcaugccuauagcccugauuacucaggaggcugagguaggaggaucaccugaauccaggaggucaaggcugcagugagccaugagcucaucacucaacuccagccuaggaacagagugagaugcugucucaaaauaaauaaauaaaucaugcuuuaaaacaaagaagaggccaggugcaguggcucacgccuguaaucccagcacuuugggaggccaaggcagguggaucaugaggucaggaguucaagaccagccuggccaacauggugaaaccccgucucuacugaaaauacaaaaauuagcugggcgugguggcacgcgccuguagucccagcuacucaggaggcugaggcaagagaauugcuugaacccaggaggcagagguugcagugagccaagaucacacuacugcgcuccagccuaggcgacacagcaauacucugucucaaaaugaaaaacaaaaaaaaaugggagaagcuggaagcagagccacuggcuccuauaaccuauaguccuuuacagccauuuguuaauaauuucuaauaauacuaacagcaccggacaaguaaguaugcccaaggccaagagaagaaaauugguggaacagcuuguguggcauauuaaagggaacauacaucucucucuaaucauuauagaagugccguuucacacaaauccauaauguaacauuccacauugugaauggguaauugauuuagccuucucaaaggauuguacuuaaagcaaaguuccccagcuuuuucuaacaaagaaaaauauuuuauuuuucccagucuugcuuauugagcauauguaagaccuccuugaagucuuauuuaucuuuuuuauuucaggcacccagcucaagaccuggcacauagaaaagugcuggaaacgacauguugaaagaaugacuaagugaaugaaagugaggcuucuggcuucucucccuucuuuaguguaucaccuucaacuuggggugggagauuucuaaacuauguggugauggcaauuaucuuaaaagaucaaccaggcacaacuucaagauuaacugcuagaauaccuggccuaaugaaaaaaaaaaaucccugauacaucauuucaucucagaaguaacuuuagacugggcagccccaaagcuagagucaaaagcuccaaaaaucuuccacugauuuauuauggucuucaucagaaaacucuguauuuacacacaucuuuuaugcaucagaguuaagaacagacggaaaucauuugcuuucacccacugcucuuccucucugaccuugcagugcuuccauauacaaggaaaagaguaauguuuuauuucacugucaacgucugaaguuggccuugaaacaacucuuucuccucuggucugaauucuacaccauagggucaggaccaggaauuggcaaugaggaagagaccgaguuaggcuaggaguaugucugaugacaagagaucucugcucaauccuaaaauuucaacucucuucaugucacggcacuucuuaaaacacacgaaaucauaagugagaucucaguuggcccauaauucucaggacuaaauacaaacucauuuguuggagauaaauucacuuuucuacugaggauacuuuaaguauuuagguaaaguuucacugaagugcuuccuauuaccacauuucuacuugccauguuuauuuuagugggcccuggcagauuucauuuugaacuuuugcgucacuuuuauucuuguuugcuuacuugcuagauauaacaagggaacugauuuuuagagccuggaauacccaacuagauuuuaaaauuuuuugaaaucuaguaauauauuucaaauaaacuuaucaggguguuaauauuuucuugaaauccuucccuaaaagauaagagacuuguaaauuauuccucuuuggccauauauuuauuuaauaaauauuuguaugcuuauuauacucaagguuuugagcuaaagaaaaaaaaagaacuaaugucuaucauuaauucacucaguaacuacuuauuagugugccaggcacuauuuuggguauauaguuaacaauuuagacacgaucccuauucucauggaacuuauagaaacuauggcaauucuauaucuuucucuccuugaggacccaucuuuaucagucauaccaccuccccaggauuuucaaccuuuucuuccuacagcaccuuucuaacaacccaaguucaagucauucucaacuuaagaaauguauauauccuucccgucucaaucccuccuuagcuaccacccucuuuucugcuuugcagucuaaucuccuggaaagagcuguccauauuugcugucucacuuccucuguccccauuuacuuagcucaccagaaucuggucacuccacugaaaaugcucuuaccaaggcuaucacuaaaugucauggacaauuuucacuuccuaacuuacuuggcuucucagcauuguuugacauuguugacugguuccuccuacuugaaccucuuuccuuaggggcugaaaccccauauacucuuaucucugguggcuccccuugggccccucuuuuucuauucuucccuugaaaagcagcuaucauuaaauagugcuuacuaugugccaagugcuauucuaagugcuuaacauauaauaguccauuuaauccucuacaacccuaucuggcugguacuacugucagcuuuacugacaagaacagggaggcacugagagguuaaauaauuugcccaaggucagacaacuaguacuuuggccuagaguuuuacuuucugcccuucuuucauucuauacauucucucugauaacucuaucuacugcuauggcccauuuacuauucugauuucaaaaucucuaucuuuaccccagauuucucuccuuagcucuagauucaccuaucuuuugcgauggacauccucacuuggauuucucacaagcuucucaaacucaacaucucuaaaacccaauuugucauuuuucuaucucuccuaaagccugcuccuccuguuauauuccccuucuuaguacccagcugcccaagccagaagcauggguaucaaccuuucaauaccaagaaaggcugucuuccaccauccccuacccccacacaccuuguccccaaccacuaccauacaucgagguuuuuuuuuuuugagcuggagucuugcucugucgcccaggcuggagugcaguggagcgaucucugcucgcugcaagcucugccuuccguguucacgccauucuccugcuucagccuccugagcagcugggacuauaggugccugccaccgugcccagcuaauuuuuuguauuuuuaguagagacgggguuucaccguguuagccaggauggucucaaucuccugaccucgugauccaccugccucggccucccaaagugcugggauuacaggcgugagccacugugcccggccaaacugagguuuuuugauggucaugacucauuaaccuucauacuucuccauccccaacagcacaacuucacauuagaaaacugucauauccaccuggauuacugccacauuucuccucccugauggccuugccuccagauuauucucuucugauuuaucuucaauacugcaaccagagcaaucuuucuaaaaugcaauuuugauaauuucacuccaucugcuuaaauauuuucaguggcuccccagcgcucucagaauagagucuaaauuuuuauccuaguagucaaagcauaauguaauuccugcuuggccucuuuagucuucuaucuaauuauuuccuaccuuucacucuaaguugcacccauagaaaacgaucaugguucugcacaagcauguuuucucucuuagcucuguccuuagucucucauuuuuccuuugccuggcuauuucuacugggccuucaggccucaacugagauaucauaaccuucugugucauaagucauaacagucuuguccccucacucuauccauccaaaagugggagauaagugccccugccaacaucuucccccaauauuccuccuauuacaguacucuuacacuguaccauaacugccugucucccaucaguuacaugaaaagguacgcgggcacauucacucuauacuguaugguaugucauagguacucaugaguuauuugcugaaugaauucaaaugauuuugcucaguaccugucaaaguaguaggugcucaauguaugucuggggaacugaucugaauuaucaauacaaccccacaaaggagacauuauuacauugaauuuaaaggcaaagaaaccaaagcucaaagaguuuaaguaauuuguccaaugccacugggcuacuaagcagcaaagccacaaaucaagccugugaccaccaauuuccaaaauguacacgcauuauaguccguuaccuccuugugcuguuaaggauacaaaagauuuaaaaaaaaaccugauccuggcuauggaagcucaagaaaaaguugcuuuuggaugaaaaguagagggauaucaaauuaggaacuguuuuuuuaaggacaacguuugaacugguucuugaaggauggguaggauuuagacaagcagagacuggguaagggaguuagagagggcacgacaaacauuucugguggcagugacaggauaaauacaugagaaauagauuuauggagaguccacugggguuuucaauauggguuguggcugcuauuuuucaccuuaugauguacuaauaaaaccaggcauguuucuuacugcaagauaaaugggguuuuacuagacuuggcauucacucuuaagaggcagccacuguguaaacaucuuacaaaaucaauucguaaagaagcccacaaggaacauuaagacgcuuacuugcugcaguucugcaaguugcuuuuaaggaugucauagucaguauugaacagaggcccacuguccuuuagcauggcuuucuggaugcuguacacauggaugcuggcagucacagcuagcuuggacuucacugcuacaagucaacaggaaaagcagucaguuaauacacaaacuucauagcauguggggacuuuaacaagaaacccuucugcauuaaagcauuuguaaucuguggugguccaaaaaacucuaaaggccacacagccacauauacagugaaacaucaacucuucugucugcaauggggacauuaugacaagguaggugguggugagucauuucuaaggacagcaccugagaggguaucacucauccaguggacacuuaguaaauauuaaugauugaugaugacuacgaugaucuuuuucuuuuggucagaaaagagccuuacacuauagcauauaauuaaagaguacuaaguaauuucuaucugagaauauucauuuauauauuucaauuuuaguuuagagaaagcaacucuguaauaaaaacacuacuaacuagauaagucuacggaagagaaacacaaaagaacaccacaagaauaaauguuagguuccgcgaaggaagggauugcagcuaacuuguuccauguccccagugccuaguauagagcuuggcacauaguagaucaucauuacauaucuacagaauaaagaaauuuugcuuugcuuaacacugugggaauucagaaaguaaaaaguggacaaacccaccacucugaauacuucagaguuaaauuugguaaaauacccccacccuacccccauggacaggaacucuuucuuuuuaaaauacacauauuuuuugugucccuggcguggcugcccuccacccuccucagucccaaucugugaaauggggccugcaggccaaggagccuuuauauacaaaguacaacaguacagguuuuaucuugagauauagguccaagaucaugaggacccugacuguuauuaaauuccuuugaauuggguuuuuaaacaauccaacgguagcacugauagucuugaaacaguuagacaaauuuaauuuagaaguuauuuagaagucuuucugacuuccagaaaagcauucuuuaacuuguuuccuaaaaaaacugccacugucuuuucacaguugaugagguagcucauaugguauucauaacaguuucugcaugugucacgaguuuugaaauucugugauaaaagugcuuuauaaaugucagcaacuauuggcccuaaaaaugggaagucaggcagauguaguaucauauuuuaacaugcuuuaaaaacuacucauaaaaugaauauugggcuauucaguuaaauagcuaaauauauuauacgcagauguuagaggcagauuuuuuauugcaccuacacugaugccauaagaggaaaaacuugcuaagucacuaaaacacuuaccuuccaauuuaucuucucucacuacugcaaccuuguggcacuguaagaaaauaacacuuuauuagugcuuaauguaagaaucugcaauuuuaguuuccuugcuccaauaauucaauugugcuuggaugugaaauuaggaaaacaccaggcacuccuuaaaacauauguuauaauuuaauaaagucagacucacuuuuaauuugcuuacuuucaggaaaaaaaauaauaauuugcuuaucuuaaaacuucucaauaagguuaaggaaagugaucuagcacagauuucaguacuacaauuaaaaaaauacagcaucucaaaucagugugagcaaaggcuuuuuagugagugauuuaauaagaauuacuguauaaucacauggaaccagauaaaaauuggaucuguuccucacaucauauaccaaaauaaauucuaaauggauuagagauuuaaauguaaaaaauaaggccggguguggugggucacgccuguaaucccaacacuuugggaggccgaaguggguggaucaccugaggucaggaguuugagaccacccuggccaacauggugagacccugucucuacuaaaaacacaaaaauuagcugggcaugguggcaggcaccuguaaucccagcuacucaggggggugagguaggacaaucacuugaaccugggaggcggagguugcaaugagcugagauugugccacugcacuccagccugggugacagagugagacuuggucucaaaaaaaagagaagaacacauauaugcacaugaaaacaugugugaauucuauaaccugcuauaagcuaagaaagagggaacauuuccuaaguauaauucaaaauccagaaauaacugaaauaaucuauuuuaaaaaagcaacuuuuaaaugaaaaaaaaacguaaguacaaaaacaaaugauaaagcggaaaaaaacugcaacuuacaucacaaaggguuaauacacaacuucuaaaauuaaagaaaacaaagacuaacaacucuuuagaaaaugggcaagaaaggccagauguggcugcucaugccuguaaucccaguacuuugggaggccgaggcaggcagaucacgaggucaagagauggagaccucccucgucaacauggugaaaaccugacucuacuaaaaauacaaacauuagcugggcaugguggugcaugccuguagucccagcuacucgggaggcugaggcaggagagucacuugaaccugggaggcagagguugcagugagcugagaucgugccacugcacuccagccuggugacagaguaagacuucgucucaaaaaaggaaaaaaaaaaaaaagggcaagugguaggaacagacaguucacagaaaaagaaauauaaauagcccuaaaacauauuauaacauaaugcuauauggaaacaggcacucucauacauuguuggugggaacaagaagcagagugauauuuggcaacauccaacaaaaguacacaugcacucacccuuugaccgagcaauccuacucuaggaauguaacccuaaaacacacuagcaaaaauauacaaaacacacagacacuaagcuauucacuacagcacuauuaauauuuguaauagccaaagaucauaaauaacaacuaccaauaagggauugcugaauaagcuaagguauaucuaucaauguggcacuauguggcuguaauaauuaaugaggaauauuucuauaacugcuguggagugaugcucugaaucuguuauguaaaaaaaagcagaguguaaaauaguuugcacguaugaaaacauuuaucuaacaaagagaggcaaaaugaauauauauuuucuuauauuaaaaauauauacaacaggccaggcgcaguggcucacgccuguaaucucagcacuuugggaggccgaggcagauggaucacgaggucaggaguucaagaucagccuggccgagauggcaaagccccgucucuacuaaaauacaaaaaaaauuagcagggcguggcgguggacgccuguaauccuagcuacucgggaggcugagguggagaacugcuuaaaccugggaggcagaggaugcagugagcugagaucacgccacugcacuccaaugcuuggccaacaggcaaaaguccaucucaaaaaaaaaaaaaaaaaaaaaaaaaauauauauauauauauauauauauauaucaaaaacaauggaaggagaaggcaaacucaauguaacaguuaccucuaagggaaaggagggaaccuaucaauugaaagcaaaauggaaaaaaaaaauugaauugaacuagauauugaauugguggcuucaguacagugaggaauuauuucaagugauucuaaaauacaggaugacugugcauccuuagcaggacauauccuacagacaaagaacugcaaagaaaucuuauuuucaguaaucaaauuguugguaauaauacagguuuugcuuuucuaaaccucguguauuugucuaaagcaaauagauauuuuuguuaauguucggaaccaccaaaauucacaacauaaaaaaaacagcaaucuaaacaucaaauaaguuuuuuaaaaaguguaaccauaaguuugagcugggauuauuaauguucucauaaugcauuuucucuuaaaacuggcacuccuaaaaaugucauuuucauugguuuauucaagggaagaaaaaagucauguuccguaaaacugcacacuaaaaauuacagagcuuauuauaaaaauuacagaccauuaggaaugaaccacucaaaaccaaugcagcuuugcaguaagagcccuaaaaacaguaauucgcaccucaugagaagaucugaauagaccagacagguccguguggcuauauacugcccugggggauacugaaaguacauaaaaacaacagaauggaaaugccagcuggugcuaaaacaaugcagaccagaguggagcucugauucaauggguuccuauuaaaguggacacgggaguuagggagcauccacaaacccagagccuaggaggggguaagcccucuguucuuagcauaacagggaaaacacggcuaguugaugagagaaaauuauucacagaaaaauuacagcuaaaaaaacagaaaggccaggugccgugguucaugccuguaaucccagcacuuagggaggccgaagcaggaggaucacuugagcccagaaguuuaagaccagucuggacaacauagugagaccucgucucuaauaaaaauaaaaauaaaaaauaagcugggcaugguggugcaugucugcagucccagcuacugaggaagcugaggcaaggggaucgcuuggacccaggaguucaaggcaaaacaucaccauuuuguaaccuuuagugaauuaaugauuuaggcaaugauuaaaacuaaucucagcuaaaaucauuagaugaaaagcuaacagggaacccauaaagcauagaucagguugacaguucuucacauuacaaaaagaaccaaccaaacauuuccuugaaauuuucaaauaauccucuggaagaaucucugggaugagauuugaaggaagcuuucacguucuauauauuguuaaacauuuuuuauaauaaucauuggaaaaauaaaaauuauuuacauuuaaaaaaauccaggccaggcacaguggcucacuucuguaauccuagcacuuugaaaggccgagaagggcagaucacuuaaguucaagaucacuugaacuuagaaguucaagaccagccugggcaacaggacaaaaccccaucccuacaaaaaguacaaaaauuagcugggcgugguggcaagcaccuguaaucccagcuacuugggggguugaggcaggaagauggcuuaaacccaagagauugaggcuacaguaagccgagauucugccacugcacuauagccuggaugacaaagugagacccugucucaaaaaauaaauaaauaaauaaaaaauaaaaauaaguccaggcgcgguggcucacgccuguaauccuagcacuuugggaggccgcgguggguggaucacaaggucaggagaucgagaccauccuggcuaauauggugaaacccgucucuacuaaaaauacaaaaaaaaaaauuagccgggcgugguggcgggcgccuguagucccagcuacucaggaggcugaggcaggagaaugacgugaacccaggaggcagagcuugcagugagcugaguucacgccacugcacuccagccugggcgacagagcaagacucggucucaaaaaauaaauaaauaaauaaauaaauaaauaaauauauaauaauaauaauaaauuccauacaaagcugcguaaugucuuuuuucuuucuagaagcacuaaaaacuuaaaaaggaaauuauuaauagaagaauuaaaagaacaaaaccugaucauauugcuuaauaaucugccuuuccuuaggaggauucccuuuaagggaaaaaaggcauagguaagcauccacauuuggucaguucguucuacaggguuccacagagcuucccagugaggcuauugggagggcagguccagggcucugaaauccucacaaccacuucaaccacagcaaccccacucuuaauaaauuuuauauauagaacucugauuaagauuuuguuugaaaaagcacucugcugcuaaaaaaagauaggcagaauuuaaaugccaucuuauacuuagaaacagaagaccuuuuuauaagcaagccauggcuuaguuuuuaacugauuauagguuauacaucauuuugaaaaauggucucggaaauaugcacugaggaacacaauuugaacacuuucagugucaucuaagaaaacucuagacuuugaagaccaaccaugaagaccaucuaagaauccuaaauuaagagccccuguuauaaugggucaguuugaguaaaaaucuacauuaucucaaaacguaaauucuuaacuuuggauccuauuccagaagauccaugaacucaaaauuuuaugaaugucaacauaugcauuuuucuuucagauucucaaggggaucaaugaccaaaaaaagaauaaaaagcacugcuuuaaagaaacauaaugauuuccaaguaaaggcuugaauaugacuagauugaggguacugacuaauuagagaaagagacagaaggucaguugacccuggaaacagaagaaaauaugacaaucagccauaaacuuugacaguauccauucaagagcucuacaguggcagaacucuggaggcagguuuaucucugcaaguaaaugaguuacgucuguuuaacuuugcuucagagauauaaaugacaucuuauuuuacacuugcaaauaucuugguuaucauuuggcuugccaaauagcuuggaaacaagaaaagaauauguuggcuagagaguauaaggauaggaucccucuagcaguuuuguugcuccuuguaaauuacuaaauugacguuccaguuuuauuuuauaucacccaagcuggagugcaguggcgcaaucacagcucgcugcagccuugaccuuauggccucaaguaauccuucccacuucagccuccugaguagcugggacuacaggcgcaugccaccaugccuggcuaauuuuuguauuuuuuguagagaugggguuucgcuagguugcccagguuggucucgaacuccugggcucaagugauucucccaacccagcuucccaaagggcugggaucacagcagcaaggcacuguacccagccuggcauuucaguuuuaaaucucacaugcuggggacucaaucgcuaaaaaacaaauccagucaauauuuugacaaaucagggcucugaacuuaugauucugagggaaaaucaaaggaaagaggaaaacagcggaucucugagaagcggccaccugaccuuugggccaagucccauggggcuuuuuaugcccgaaagaaccuucagauaggaaguuugaggaagugagaacagaagagguaugccuuacuuuugggaggacgccagagagggggaauuauuaaaguucccaaggcccaguuuggugcaggagagggaacaagauaucuuagcagagcuucugguagccaccaaggcaugggaguaauagaaugaucccugugccccugagagggacaugaaaauaguuaagagaaaagucaagcagaccugagaaagccuuacagucaggaugaugaaauccagcagucaccuguguugccagaugaccagauaccaggugggacuacaaaaagaagaggaaggagaauaaaauguucccagccuaugcacugcauuagcuaugcuccugccaaaaacucuuacccuucaggcacuuagacguaagccuacccaaaugaauguucaaaauuaaaagaaguucaguuaaaaaaauuauaauuuuugaacacuuguauucaugguuugaaauuugaacagguggaaaauuaaacaccauuguucuccauauaccuucaagaggaaaaaaagagauauagggaauaacagaagcagucuccuaacaucuuauugcauaauaaugauacagucucugcaucacagccaagauauuacccaaacuucucaguuuuagauuuaaucuaaaaauccaaaauaaucaucaccaucaaguagcucuuuaaaacuacuauaacacagaaucuugauuuuuuucucuccccugaacuauguuauaacacucuucauaacacaaacacauuuaagcucauuacaaggcucugagaacuuacggaauguccauucugaaugagacugccagacaccaaguagguaacaugcaguugggcuccugaauuuucuuuucguuuccuuucaacauaaucauacagcauccuauuccaaagaaaagaaggcacaaguaagacaucaguaagaguuuuuacaugaucaacucuuaauuaaugacuuaaaagauaaaugaaaucugguaguccaucaaauuuucugaacaguagcauuuuugcuuggccuauggacaguugaaaaaaaaaaaggauggacuucagacaggacauggggaguagaguccauguguuuggagcuggcacagugaucaguacauuaacugaaauaagauuaauaauagaccaagagggacugaaccugcauuaaaacaguggcaaugauacauaauaaauagaacacugaaucaagaaguaguuugguaacugucuaagcucuggauaaguuaauuaauuugucuaggccucuuaauaucccaaggcguaaacaggaggguuauauuagauuagugauucuuuuaaccugggauucagguggccaucuauaacccuccaauccuaaaguuucagcaaauguuuaugugcuuuuuugggagaugugugaggguuuucaauggauucugaagagugaauuacuccaaaacauuaagaacuacuaaguauaugaucacaaauguccagcucugaaauuccaauuuuaugauuacucagauuuaaugccgguucagaauugcagaauguaacagcuuacucacauugcccaguauucagaauaauucauuaaccugagauagccaaauacuaaaugcagaaauaauguugcuuuuaguaaaaucucuaaauucauuuuuacucuaugauccagcaaguaucagaaguuggcucccuucaauaaucuaguuuaaaaacaacaaagagacaugucuuuuauuuugagaaacauuuacaaucugucuauaauauacuucugccaagcauagcuagaaauuuaaaaauccccagagaagcucaaccuacauugcuguucacucucuucuugaagagccugcucucucagcuuccauaaaaccaugccccacugagucuucugcuaccccucucacugcuucugcuuuacuuucugaagagacuucucuaccuccucccuuuccuuaacuguugguauucugucuuuagcuauuuuuucacucuauguauuagagugacugaccauuccugucugccugggucugagggguuucuugggauguggaacuuucagugacaaaaccaaccauccugggcaaacccaggguggcuagucacccuacuacauauuuuccucgguuuauuucauccaucucugacaacaacaucaucugcugaaaccacgcaagccagaaaucugggagucauuauacuucacuucuuccuauccaaugaguugccaagucucaucagcucuccuucccaaguaauucuugacuccaugcccuccaaaucucuugacuagacuauuucaauuccaaguaucaauuccucuucuccuccccaccucaccuucauuauccaugaugcugccagagugaaguuuaaaaaaugcaaaucaagucauucaaucaacaaaacuuuaccaagugguuacuuuauguucuacgccuuagggacagaacagugaauaaagcaaaguccacucuuagagcuuacauucuagaaaggagacacacaauaaacauauaauauauaaucucagaugacaguaagucuauggaaacaaaguuaaguaaguuaaggaggacagagggugccugagaaguuuugcuauuuuauauaaggugauuagggaaggccucauuagcagagcccugcagggagggagggagccagcaagguggauaucuugggaaacaauguucuaggcagagaguccagcaaauaccaagguucugaggcaggaaggucagcaagauccaaggaacagaaaggccagugugcuguaguggaauaaggacgguaguaggggagagagggcagagugccaggcacauagggcuuuguggcuaccacaggacuuuaagaagccauuagaaaguugagagcagagguaaugugaucucaccuuucagaaggaucugagaagguuauguggaugauauacuguagaggggcaagggaggaagcaagaccaguuaggcuauugcaauaacccagccuagagaugacugguagcucaguuuggggcaguagcagugcagguaguaauuaguggaugaauucuggguauauuuuaaagugagaaacaacaggauuugcugauauacuguguugaaguguaagagaaagaagagucaaaaaugacuggacuaggcaacccaaagaaggaagcuguaauucacugagaugggggaaaagcaggaaaagcagguguugaggggagaagucaggaguuagguuugggggcauauuaaauuugcaaugccuauuagucacuguugauguugaaaagguugcuagagagucuugucugaaacauaauuccuuguuauaaagcuuucaguagcgccaggugugguggcucacgccuguaaucccagcucucagggaggcagaagcaggaggauagcuugagcacaggaguucaagaccugacugggcaauauagcgagaccccauguuccacaaaaagggaggagaaaaaaaaaaguguaacaaagcuuucaguagcuucucauccccuaaggaucaacuucaaaucucuagcaaugacagguaagacccuucuuguucugggcucuguaucucugaccauuccccaucauaccuacacuaucuucauccuuaaugaaacauucuacaauucucuuuauuccuuuguauaugcccuuccuucugccuagaaggcucuucucaggccucaacuaccuaauuucucaucaagacagcagcucaguugucaccuccucuaugaaguaugaacccuuccccaacaccaucaggucaccagggcacaucuuuuuuuuaagagauagagucucacucugucgcccaggcugaagugcaguggcgcagcucucuauaaccuugaauuccugggcucaagccauccuccuuccucagccuccuaaguaaacaggaccacaggugcaugcuaccaugccugguuauuauuuuuucuuccugguagaaacaggcuuuuguuauaucucccagccugaccucgaaccccugcgcucaagugauccuccugccuuggccucucaaaaugcuaggauuacaggagugagccaucaugccuagacaaugagcuucugccauccaagcucuaacaaauuuuaucccauaucuauuauuacagcacauaucacccugccuucuaacuauuuauuuuacauaugacgcauccccucuagacuguuaacaccuugaguacaaaaaggugcccuagucaggauuuuugcugauuccuccucuuugcccucuaauguuucuuuccauuacaacaauuguguuagaaggauaaaugagcuaacagauccacaaacauuuugguuuauugaugcuaguuuggaccaugcuaaaggaagacaugauaggcagguaccaugcccaaaaugcuugcaagcuugcuggccaaaugcacuaucuuuuauccacaacuaauaguccugcccauaucaucagucauuguccucuaugcacuugucuccccaaauugaccccaguucuucucucuuauauuaacagaaaaugcaaagcaaacucuuauuuuaaaaaacaauucuuguggcugggugcgguggcucacaccuguaaucccagcacuuugggaggccaaggcaggcagaucaccugagguugagaguuugagaccagccuaaccaacauagagaaaccucgucucuauuaaaaauacaaaauuagccgggcacaugguggcgcaugcccguaaucccaguuacucgggaggcugaagcaggagaaucgcuugaaccugggagacagagguugcagugagcugggaucgugccaucacacuccagccuggacaacaagagcaaaauccuaucucaaaaaaaaaaaaaaaaaaaaaaaaggaaagaauuccugccuacuuuuugagucuuuaaaacauguuuuaucuaauuuaagccaaacuuuucuguuuuuuuggagauagaguaucgcucugucgccaggcuggagugcaguggcgcgaucucagcucacugccaugucugccuccuagguucaagugauuuuccugccucagccucccaaguagcugggacuacaggcacacgcuggcuaauuuuuuguauuuuaguauuuuuguauuucaguagcgccaggugugguggcucacgccuguaaucccagcucucagggaggcagaagcaggaggauagcuugagccuggucucaaacuccugagcucaggcaaucugcccuccucggccucccaaagugcuaggauuacaggcauuagucaccgcgcccagccuaagccaaauauuuuuuaauaaacaaaauauaaaauauucuuaaauaagaaugacaacaggcugggcacaguggcucaugccuguaaucccagcauguuaggaggccgaggcaggcggaucacgaggucaggaguucaagaccagcuggccagcauggugaaaccccaucucuacuaaacauacaagaaguuagccaggcgugguggcaugugccuguagucccagcuacucgggaggcugaggcaggagaauugcuugaauucuaaaggcggagguugcagugagccgagauugcaccauuguacuccagccugggcaacagagcugucucaaaaaaaaaaaaaauaauaauaauaacaacauauaugacuucuuacaagauacacuuccuacacaugauuaauuauagcuucccauuuuaauucauuaaucuucccuccugaucaguuccacccauaauguuccccaggaugaguacaguguauugcccauaccgcuuucucuaacccaacuuaauuauuucacagcauuuucacagucugaaauuaucuuguuuaaaucaaccaggggagggacccugucugucagguuuacuguuguaugacauagccugaaauaaugcuaaaaaaaaacaguaugaggccaggcacgguggcucaagccuguacucccagcacuuugggaggccgaggugggcagauugcgaggucagggguucaagaccagccuggccaagaucgugaaacccugucucuacuaaaaauacaaaaauuagccaggcgugguggcaggugcuguaauccccacuauucaggaggcugaagcaggagaaucguuugaaccuggaagguggagguugcagugagcugaguuccgccacugcacuccggccuaggcaacagagcgagacuccgucaaaaaaaaaaaaaaaaauuacuugagagaaauguuugugaaaauacuauagugaggccgagcaugguggcucaugccuauaaucucagcacuuugggaggcugaggcaggaggacugcuugaguccagacguucaagaccagccuggucaacacagcaagaucccaacucuacgaaauaaaaaaaucagcuagcaugguggcauguaccuguggucccagcuacucucaggagacugaggugggaguaucccuuaagccuaggaggucauggcuaaaggaagccauguuugaacuacugcacuccagccugggugauacagugagacucuaucucaaaacaaacauaaaccauagugcuugguauucauucaguauguauuggcauucauuaugugccugacacugaagacagaauaauuguggcauguuauauuuuccaaagauggcugagacagcaucuuccauuccauaugcucuucuacauucucucauugagaaguagagcccacuucuugaaucugguaugaccaguuauucacugcuugacuucugaggcuagucagaaaaggcaauuggcucuacauugugcuggaacacaagcuuuuggagcccugagcuucuauguaagaaguccgacuaccuggagacaccaggcugugagaaagcccaggccauacagauagaccacaugcaagcacucuaguccacugccccagcuaaaggcccaacagauggccagaaucaacagccagacaugugcauaaagaugccuagagaugaccagguuccaguuauugagacuuuccagcggggaugccagacaucauggaacagacauaagccauucccacugugcccuauccaaauuccaaagcaaaagaaucuaugcgcauaauaaaaugauguuuccaggcacuacauuuuggggugauuucugacacagcaauaguaaucagaacagugaugaaccugacaaguuuccugccuucauagaguuuauauucuaguggggaaagacauauaauuagcaagaaaaugccaagacaauaauaugaauuauaaaaugcugggauaaccguauacccaugugcaaaaaaaugaugcuggacccuuuccuuacaccauacacaaaaaaucaacuccaagugauuccuagaagauauagucaauauuuauacauuucagugauucauuuaaaaauuagcuugaacuaacaccuaaucugaaagcuuuaguauagucuuacuguaggaacuaaagcauuuuuuucuuuuucuuucuuuccucccuuuuuucucucuccucucuuucucuuuuagagauagguucuugcucugucacccaggugugaucauagcucacugcagccuugaacucccgggcucagacaauucuccugccucagccuucugaguagcuaagacugcaggugcaugccaccacaccaggcucauguuuuaaaaaaacuuuuuauaaagaugugggucucacuauguugcccaggcuugucuugaacuccugggcucaagcaauccuccuaccucagccuccucaaguguugggacuaauacaacugagccaccacagccacccgacugaagcauuucuaauguuaacaaguacauggccaggugcaguggcuuaugccugcaaucccagcacuuuggaggacaaggcaggaggauggcuucagccugggaguucgagaccagccugcacaacacagcaaaaccccgucucuacaaaaaauacaaaaaguaaccaagugugguggcaugcgccuguaguuccagcuagucgggaggcugaggagggagaaucacuugagccugggaggcugaaguugcagugagccaaaauugcgccacugcauuuccaucugggcaacagggugaaacccugucucaaaacaauaauaauaaugaugcuaacaagcacacgaucuguagaaaacuuaaacauagugauaaccaugauuuuuuuaaacucuaaguggauuacagaauuaaauauaagugcaaaaacuaaaaaaucuuagaaaaaagcacaggaguaaaucuucauaacccuggguuaggcaaagccuucuuagauauuaugucagaagcacaagcaacacaucaaaaagaaaacacaacaaggguauggagaaaacagaaugcuuauacauuguuggugggaauguaaauuaauacagccauuauguaaaacgguauggagguuccucaaaauaucaaaaauagagcuacuguaugauccagcagucccacuacggauauacauccaaaggaaaugaaaucaguaugucagagauauuugcacucacauguuuauugcagcacuauuuacaacagccaagauauggaaucaauaaauguccauuaauggauaaaggaaauauaguguauauacacaauggaauacuauucagccauaaaaaugaauaaaauccuaucauuugcaacaaaauggaugaaccuggaagagacuauguuaacugaaauaagccagacacagacaaauacuacaugaucucacucauuuguggaaucuguaaaaggugaucucacggaaguggaaagcagaauuuucuuuccauaggcugaagugguuaggggagggggaauggggagaugugggucuaaaggauacauaauuacaguuagacaggaauaaguucaagagcucuacuguauagcauggugacuacaguuagugaugauauauucuugaaaaaugaaaagaugguagacauuaaauguuuucaccaccaaaauaacugugugauguaauacauuuauuagcuagauuuaacuacuccacaguguauauauacuucaaaacauaauguuguacacaauaaauacauacaacuuuauuucucaauuuaaaaaaucuuggcuuggcacgauggcucacaucuguaaucccagcacuuuagaaggccgaggcgggcagaucacuugaggucaggaguucgagaccagccuggccagcauggugaaaccccaacucuacuaaaaauacaauaaaauuagccggguaugguggcacaugccuguagucccagcuaccucggagguugaggcaguagaauagcuugaaccagggaggcggagguugcagugagccgagaucacgccguuggacuccagccugggcgacagagcaaggcuucugccucaaaaaaaaaaaaaagaaaaaaaaaaaucuucuuaggccgggcacaguggcuuguaucuguaaucccagcauuuugggaggccaaggugggaggaucacuugaggucaggaguuugagaccagccugggcaacauagcaagaucucaucucuacuaaaaaaaaaaaaaaaauaagauuaaaaaaaauuuaaucauuuuaaaauuuaaacuuaaaaaagcauaagcaacaaaaggaaaaauaaauaaauuggacuucaucagcaauaaaaacuuccaugggccaggcaugguggcuuaugucuguaaucccagcacuuugggaggccaaggcaggggcuugagccugggaauucaagaccagccugggaccagcaugggaaacauggcgggacuccaucucuacaaaaaauuuaaaaauuagcugagugugguggcacgcaccuguagucccggcuacucgggaggcugaggugggaaaaucaccugagcccagggaagucaaggcugcagugggcugagaucacaccacugcacuccagcuugggcaacagagugacauccugucucaaacaacaacaacaacaaaaaaugucugugcuucaaagcacaccaucaagaaaguacaaagacaauccacagaaugggagaaaauuuuugcaaauaauuuuucaaucagggucuuguauucagaauauauaaagaacucuuaaaacucaacaacaaccaaaaauacccaaugacaaaaaugggcauaauuuugaauaucuauuucuccaaagauauggccaagcagcauaugaaaagauauucagcaacauuagucauuaggaaaaugccaaucaacauaauuuaugagauaccacuucacauccacuaggaugguuaaaauaagacauaauaaaaaguuuuugccagguguggugauguacaccuguagagcuaguugguaggcugaggcgggaggauccuugaguucaaauccagccugggcaacauagugaaaccccaucucaaaaaaaaaaaaaaaaaaaaaaaagaguucauccaugagaagucugagggaaaaaacaguguuaguguuaaccagaauguggagaaacugaaauacucauauacuguuaggacuguaagaagcgcagccauuuugaaaaauaguuugucaguuccucaaaauguuaaauacagaauuaucucaugacccagcaauuccaauccuaguuuggcuguguccccacccaaaucucaacuugaauuguaauaauccccacaugucaaagacggaccagguggagauaacugaauuaugggggcaguucccccaugcucuucucaugauagugaguucucacgaaaucugacgguuuuacaaggggcuucccccuucgcucgacacucauucucucuccugccacccugugaagagaugccuuccgccaagucuccugaggccuccccagccaugcggaacugugagucaauuaaaccucgucuuuauaaauucaaucucaggugugucuucauagcagcaugagaauggacuaacacaaauacccaagauaacugaaaauauauguucauauaaacacuuauagaugaauguuuuauacaugaauguucauaacagcaucauucauagcagucaaaauauggaaauaacccaaauguccauuaaugaugaauaaacaaaacuuguuguauccauauuacagacugaaucaugucuccaaaaagguaauguuaaagcccuaacccccaauaccuuaaaaugugaccuuauuuagaaauagaauuauagcacauguaauuaguuaagacaaggucauauuggaguaggguggauucguaauucaguaugacugguguucauauaagauggacgugcaaagauacagauauacagggagaaugccaugacaaugaaggcagagauuggaauuacgcagcuacaagccaagaaauaccaaugauugccagcaaaccaaauuagcucuaaucuauguaggcuaucuguagaguuaaaagcaaagcauaacaaaacaaaaaaaaauuccaauaugauuaaaauugguaguaaauuggacuuacuguuuggccugguuaacaugaaccccuaguguauagcucagccauuuguaugucaccuguaacaagaaaaaauuuuucaaauguuuuauuagaugacuccagagugcacaucagucccgaaggucuguugcuaaagauuccuauucuuagaugauuaugccuuacaaauuacaauaaaugccacugcaguuuucccaagaacuaucuaucuggguaggcaggaccuauuuaucuuaaaaaugcuaagaaguuuguuucaugaacuaaugaaaaguaaucuaaaaagacaagcugaacauaccuaacagaaaaaacucucauuuuccucacauuccuuguuuuacucaggcccuuuccucaugauguuuuuuuugggggccaccagccaaagccauccuaaaacucauucagaagcuagaugacuuugaagugugaugucucagaaacuucuaaagaaaguugcacccaugcaaacauuaaagggcacagguggugcaggggucaggaaacgaaaaaaguggguaaauauuuuuauaagagauuagauugggaacuaccagcaucaagccuucaucccuccuagacccaggaugccugcacucucuucucucaaagucucuuccaauuccaaaugucaagcuuccaauaguuagaagacuugcacagguuaggcaaaggcagugugauguagaagaaagcauuaguaagaggacagaccuagguugaaaaacugccuaucccuuaccaaacgcaaauaaacaaguuauuuggccccucagcuucaauuuccucaucucgggauaccaccaccgaccugggauggggugcggggaggucacuguaaagauuaaagugccuuggcacacagcaggcacucaaucaucacgguuugcaaagugcacucacauccaucaauucgcucgaucuuuuccucacccgugugaagcggaucaaaccucuaucaaugcuuaaauuuccaggaagaggaaacaguaucuggagguuacgcaacuuguaacuuaacacaguuaagacacgauuuccucaacuguaaacuuaaaacuuuaaacgccaaccaccuuaaaagaaagguguagggacgccuuagaacucucagccaacggcccucccuccgcgcccggucuccgcggcuccagccccaggcucuguucccagcacgcccacccaagggacgcggacuuccgugugugcuggaggaccuucccgacgaguccucgcucgcucuggggcacagagcucgcccagguccccucguggggaccugucuccccugguccccacgaagccacaagcagacagagggucaaggcucccgccgcccuagccgggcccaggaccccggucgcacgcccgcguuccccaguaguagcugcucacgaucuuguuuugguccgugacgaacucgucuauauuuuccagauaaagcugguccgccauggugcggcagcgcugggacccgccucuaaccccucucucaaucacagccacagcucccgccggcgggaaacgucuuugcucccucccaggucccgggucguuuccccggcaacggaggcgacgcacuacggcggcccucgaaggguca

SEQ ID NO: 15292 - RNA, 83782 nt, Homo sapiens
agcgacucuuccucuaacagucuccggaaaacggugcgaagagaaggcgccaagacgccuucccuccaauacacuacaauacccaggacgcuuugcuacaauaccucuccgggguuggcuggggggcgccuccagcugcgcaagcgcauagggaugcgcccuuuguggacuccauugcgcagggugcauugcccugaagagcgcuccuccuuccggugaaagucgucggguucccagccgggagucugcggaguucucauacucuguuacccagcuuccuuuguaugagugcuguugcgcacuuccgguggaagcgcugaagcgaguggguggaguuuacggagccggugggcgguaggcggugcuacggguagcugggugcuguccaaaggcgacagggcgucguuaggggagcgagucgugaccgguugggccacacucaacgugggacgaagcuucgccuacuguuugacuacgugcgugcagccuccccucgaugucggcccucgaaaagagcaugcaccucggccgccuucccucucgcccaccucuacccggcagcgggggcagucagagcggagccaagaugcgaaugggguacgugacccauaccccuucucccuaugggccaggccccagccguuggagaaugguaucucugggcguucauagaggcacgggaaaggagucuacugauaggagaaaauguuggcggccuggagauauuuagauggaguagaaggcagauugggguacuaggggaggcgccaagucaauagaaauuggaggaaaaauaacguuguugaagggagaggggaaugaggcaaagguuggggaagcugagagacuaacauaagggaucugagaaucacuuccacaauaaaggaggcuuagaaaagggaguagaacggugacaaagguggaggagaaucggccagggaagguggagggaaguggggaaugacugagagaaaaguugaggggaauugggccaacaacuaaggaaagguuugggaggaguagauauuaucagaguucuaauaucugcacugugagaacuagauacuagaaaagcugagggggguagaaaacacucgagacagggcuggagaaggaaagaggagaacuaggaagcagacgauucuagagaauucccagagguguaaagacagauucagcgaaugagaggugagauuaggucucuuaagggagaaugagaaaguuuagggaguaggccuaagguaagguggagaacauagccacgaagauuguuaaggguaguaggaaugugcugagaagcuggacaggauaagggagagagaagaaggagaggacugaagaauuuacagagugagaagcuggacaggauaagggagagagaagaaggagagaacugaagaauuuacagagugaccauaggcucuaaagauugagagaugacuauaaauacgguuuggugaauggaagugcugcaguuguaaggucugggaagcuuagaggaagauuugggcaaucaguuuuugcugggcuaguagaucugagggaagcgacguacuggccuaagacuuugaauuagugaagcauugggaguucgagaaauaguuugcuggaaaggaaggagagccauguagaagagauagguuuuggaauuuuagaucguuaaauggcuugugccagguuaggggauacuugggccgaggagaaagaaugaggugaacaugggagaaguaauugcuggaaaguggagagaauugaauaggcauuugguuuugaggggauauuuguaguuucaaacaggauucugggaauuagugacuguaaagagaaaaggaguaggaaagauacuuagguaugagggcuccagaguauauuugggauucuagagaugaauugguagauauucuuugaaaaaggacuacagaagagaaaccuuagguucugaagaaguaauauguguaaaaacuuaucaaaaaggaggcgagaguaggagaugcaguacugugacaguaaguccuagggaugaaaagaaaggagaauccuauaaaacagugggguaaaggaaugggaaaaauggguggaaaaaccagggaaggaaacuaagaauugaguggagaccugcuaugauacgcaguagaaaaaugagaaaacuuuagcaggaggagauagagagauagacgcacaauagagguagaaggcuacauagaagguaaagugaagauuguuuuggcuuuggaagacagaaaaguuggacuauaacaugaauaaagagaauuuggaaacugacccauaacauuauuugggaaaacuaaccuggaguuuaauauuaauguaacauuaauuguuguuaaauaucuuaguugcugccuuucuuaaaauaaauuugauuuuucaguauaccagcacccuucuauacaaauacauaagaaaaucagauuuuuaauaauuauacauuccuuagauaagcuuaauuagagcucagcuucucaucuuggagaaacaaguucucugaagauugaagaacugaaugaagauacugagagaaaaaaaaaggaaaaucugcugauuagaagauuguauaauuguuaguaauuuaucguuuuuauuuuuuauuacuuuucauuuuauuuuuuuuuagagacagagucucacucuguugcccaggcuagagugcaguggcacaaucucggcucacugcaacuuccaccucccgggcucaagugauucuugugccucagccucccaaguagcugggauuacaggcaugcaccaccacgcccggcuaauuuuuguauuuuuaguagagaggggauuucgccauguuggccaggcuggucuuaaacuccuggccuuaagugaucugccccacuuggcuucccaaaguacugggauuauaggagugagcuacugugccuggacaacuuaccuuuuuaaaaagaugcuuuggucuucuugguuuagguuaacugcuuauccuggaaaagaaaguucuuuagaaaggccuuucuuuaugauaguauugugaagagaagagcauauauuggcgaauauuugugugguccucaaauggcuuauuuucccguaucuuucuuuucuacuuuauugguauauaagcaggcuucaucuaagucucaugguaguaauaauauagauucucuuucuccuuagaaucauaaagcugagagaaagcauagacauggucucauuucaccacuucauguaguugaggaacccaauauucagagaguucuguauucuauaagggaauguauuaauaaaugagggaacugagacucagauauuccuaagguacccuagaagcuuagcgguagggccguuaaggacuaggacuugggucucuugacugugagacccauuguguauuuuggagucauaauugucaucuggggauacuuauuuugaguuguguaucuuacucauuugcauauaaucuaggauucagucuuuuucuucagucguaauuuaugaagucucacaccaauuucaaagcauucuuuaugucuccuuaugcuuacuugcuuuuuucuuaacuuccauucuuccacucuaucuauguuacucacaaguuaguccuguucucuugauagucucuuguguggcuuacucuuaacuauuuuucaugaucucuugccuucaauuucacuaaacauuauuuaggcauguuugcauauucagggugcauauucugaguuggugauuuuucaugaguuuccauaauucaguuuuucagauuagauuuaguaauuccaaaguauuguuggauaauuuaauaauagcaauuuuuaaaguaaguacugugugccagacauuguaaugguaacuuuauguuauuuaauguguccacagaccugcauggugaauauuuuccugcauuguggguaaagacauucagacccagagauuaaaaguaacccaacuaguagguagcagagcuaggauucaaucuaaguuuagucucuagaauccauucacuuuucaguacacuaauauuuucucuuggguaaggccugaaauccuggugucacucuuccuuuuaauagaugccaauggauguugccaaaaacagugguuuugaacuucuuuauuaaagcuuuuagagcuacucugacuaaaguagauuugagaucccuauuugcuuugcaccccuggugugcuugagagaaguaucuuuugaaagucacugcuuucguauauacuauuacuauuagaggaacuauaaaauauuaaagccauucauuauucaacguguuuuugguuuaucaguaguuguacuuuuuggccaggugugguggcucaugccuguaaucucagcacuuugggaggccgaggcggguggaucaccugaggucgggaguucaagaccagccugaccaacauagaaaaacaccgucucuccuaaaaauacaaaauuagcuggcgugguggcacaugccuguaaucccagcuacucaggaggcugaggcaggagaaucacuugaaccugggaggcggagguuguggugagccgagaucgcgccauugcacuccagccagggcaacaagagcgaaacuccaucucaaaaaaaaaaaaguucuacuuuucuauuauuaucucuuaaauuccuuuuuuuuucuuuugcaagagauagagucuugcuguguugcccaggcugaaguacaguggcuuuucacaggcauaaucuuggugcauuacaaccucaaacucgugggcucaagcagucuucccacuucauccucuugaguagguaggacugaggauacaugcuagcaugcccagcucuguagugauuuaacugacauguauauaguagucccuuuuuauauucuaugagguaaacuagggcaggaguuaauauuuucuuuuaauaaaugagaaaacugaaauguucauugacuugccuaagaucacagaaucauuauguggcaggaacaacauucaaacccaggacuucguauuuuuaguccauuguucuuucuauagcuugcauugaaggguuugauauuugaagugacaaagaucuaaguuugaagcccaacuuagguauuuacauuggucgagucauuuaacuucucauagucuauuuucuuaucucuaaaaugagaauacuucugcuuaccugagagugcugugagaauaagauaauacauaaaaagcacuuauaguuccugacacugacacauaagcucuuaaagaaugauagcuaguagauaauuauacauugagaacugugaagaagguucauaguuuauguggaagcucuccuuucaguuucuuauguuaucagcuuuuuuguccccacaagcuguauguuuauucauaucugauuagauagucuuucauccaucuucuuaaauuuauuauggauaucaggccucuuaggaaggcuuuaaugagcuauucacacagauggggaaauaaagggcaaagugaagugauuugcucaaggucacaaauugaguuacuaaaauaaucaaaucccaguauuucuguuuuuuuuuuuauuuuuucauuagauuuuuaaaaaguuaaauuuauaugccauagaauucacucuuuuaaauguacaauucagugauuuuugguauauucacucaguuguacaauuaccaccacuaauugcagaacauuuucauccucccauaaacucguuacucauuagcaucuucccuuccucccagcauguauugcuucuggaucuugagucacagaaaggcuuuuccuuuuuuuggguuauaaaggaaucauuuauauuuuuuccugguaccuguguaguguccuuuuuuuuuuuuuuuuuuuuuuugagacagagucuugcucugucaccgaggccggauggagugcaguggugugaucuuggcccacuacaaccuccacuucccggguucaggcgauucuccugcuucagccucccaaguagcugggauuacaggcaugcaccaccacacccagcuaauuuuuguauuuuuaguagagacgggguuucauuauguuggccaggcugcucuugaacuccuggccccagguaauccacccaccucagccuuccaaagugcugggauuacaggcaugagccaauuuuuuuuuaauccauuugaaguuuaucuugauaugcaaagugaggaaaagaagacauuuuauuuuuauccaaaggcuaucuaguuguuuucaucauuuauuaaauuuuuuaguccuuuacccauuacguaaauuucacuacaauaaagaaauaguccuggccaggcucagugguccaugccuguaaucccagcacuuugggaggccaaggcauguggaccacuugagcuugggaguuggagaccagccuggacaacauggugaaaccucuucucuacaaaaaucacaaaaauuuagcugggugugguggugugugccuguagucccagcuacucuggaggaucauuugaguccgggaagcaaagguugcagugagccaagauaaugccccugcacucuagccugggacacagagugagacuuugucucaaaaaaaaaaaaaaaagucuucuuucucacugauuaaaaugacaccuuugucauaugccaaauuucuauauaaauccgggucuguggaguuucuuuuacgugccacuacuguacuuuuaauuagaggauuuauuaauauguuuugaugggugguagagguuguuuaccccucauucauuuugaggauuuucgugguuccucuuguuuuuuucucacaaauaaacuuucuaaucccauagacuagugccagaaaaaaauccugauaguauuuuuauugggauuacauuaaauacaaacauuaauuuagaauaaacguuuuuaugauguugaauguuccuugaagaaauaugguaucuuucaauuuguaugaaucccuuuugaaggaaauauauuucagauuccaaguauugaccuaaguuauauucaaucuaauauuacuuaaauucaauaguacucuuaaauaauugugaaacucaguagauuuacucuuuaaauacaauuaagucuacaaaaauccccaaacucacauuagcaacauuauauugaugugaaacaaucuaauuugcuguuaucaguuuacuguaguuuaaacuacaaggacauuuauuauugauaggauguuccaggguucauucaguugcuaaacaauuucauucaggacccaggcuguuugcauccuuucuuuugccauccuuagaaugguggcuuuuccuucucuugcuugucaccuuaugguugcaggauggcugcugccacucuacuucuaucuuaucuuuacaaauaaaaagaagcgggggccaaaguccuuuccuagcuaagcuugucuuuuaauuuuuucccagaaaugcaagcuccccaacagauuuuucccuuaagucuuauuguccagaacuguucacauacccauccuaaaaccaaucacuggcaguagggaaugggauuaacuaugacugguuuagaccaauuuugauucauucccuuggacuggaggagagacaacaagagaucuccacuagcugcucaaacaaaaguauuacaauucuguuagggaagagagagugggaagugggcagguaaugucuggaauagagaauaaacagcaucuggcccaaauccugagguuaacaaguggagaagccuaaucuucugauuucaacuucccuacuguuuucauugcaguguaaguauaggaaguaauaaucccacccccaacuccccugccccuuauugccagauuucagccccuugacauucauuucagaacuucugaguaaaaguccguuuuuccauuguugcuuauugccagcaaaucuauuucuucuuaguaucuccaaaauuggguaauuugcucuuuuguuuuauuuuaaaccuaaugagccuuccauguuaugcuacuugaugucagauuucagaaaacaucucuaguuguuugggaaagacuguuuccuucaaacuacaaaauaguuuuuuuuuuuuuaagagaagaaacuuuuaauuaauaguucuauuaagaggguggccacacuuagauauucuucaaauacaauauugauuacaaguuacagguauauucuaccaauauauuuugaagauugaauaagagauuauauugaaaauuccaaucauuucaaaccacaccggaagaccgaaguuguuuacuuaucaguccuuuuccuauaugcuucuguguguguuuuuggccauagacuuuuuccagguuuaaguagacauccucucucugccacuaacaaguuguaugacucuggucaguuucucuuccugggccucguuaucauggaaagaaagaacgcuuuggcaccugacguacuuguuuaaauccaagcuccccagccugggcaacauaggaaaaacuugucuguacuaaaacaaaacaaaacaaccaggcaugguggugcgcaccuguuagucccagcuacuugagagacugagaugggagaaucacuugagccugggaguuugagguugcagugugcugugaucgugccacugcacuccagccugggagacagaaugagacccuaucucuaaaaauaguaauuauaaaauaaaaagucaaauccaagcuccggugcuaccaaaaauggcucugggaaaguuauuuaguauuucugagucaccuuaaaaugagaauacuuuaaugguacuguucaaaaccaugcuugguacguaauaaacaccuaguuguuuccuuucauaaaguaagauuugaguuagaugaucucuaacagcaugauucaugauguaguuuuuagaauccugaagucugcugcuuaauggcaugccuuggaguaaggaacacuucagaccuaccacaacccucagccagccaucugguugcuuucuuuucauucucuucaaaguacugcuaauaaggacauuuuaaaaacaguggugccuugauuuaaauagcuggcugcaauuaaacuucaguauuuagccuccacuaccagacuccuagacuuugacagaauuugugacaacaagugauuaagacugcuacugugcccauucaugacucaucaauaacucucuuaacagacuuaagcagccuagauguugauguguuauuccuauuuagauuugagacauucauguaaaaacauacaacuuacauuucuugguuauuguucucuaggcaaggaagguuuuuccuccuucccuuucuccccuuucucuccuuccuccuggcuuuccuuaggauuugaucauauaauuuuguugguuuuggucauuaucuccuaguaggcauaucacauuguagacaagcagaacauucucuauucuccuuaguccucugaauuguaauuauuggucaacuguguauuccucaaaacuguugagguucauaaggguaggaauugugucugaauuuugcuggugcuuagaaugcugucuccuuuagugcuaacugaacgagaaacccaaauccuggccuauuuaaccccguucuauaagaacaacguuauuuccccaucaguucccuuaagaugguauaacuagggcuauacugccuuucuccuaaaagcgguuauacuucauagaauaauagaaucucuauuucaauaccagcuuuuagguaaaauguauuguguuuacaauauguuacuuugagauuuaaaauaauuauauggucgaaacucuuguaauaggucuuguaauaggcuuguaauaggucucaugauauguacagauucaggcuuguuacuuuuauuuuaucaaaauuugacaauuuaugucuuccucuuugauuccccaaaccugaaagcaaguccacuauuauaagacagcaaaugucaauuagcaauuauuuucacacuagccuuauuuuauaguauucaauuuuucugcccuugcccaauuuaucacuuauucucuaagagcgaagacuauuuuccaagcaccuucaccaaguuuagggaccagagcaagugguccaccauuaaaggcuaguguuaaaagcgcuccaaagucauguccuaagcagugguaauuuccuaaguguuucuugcacuuaacaauugccaaguuuauuuuguuggcaaugccuuccauuuucuucacuuuuuuuuuuuuuuuuuuuuuuuuugagacggagucucgcuuugucgcccaggucggacugcggacugcaguggcgcaaucucggcucacugcaagcuccgcuucccggguucacgccauucuccugccucagccucccgaguagcugggacuacaggcgccugccaccgcgcccggcuaauuuuuuuuuuguauuuuuaguagagacgggguuucaccuuguuagccaggauggucucgaucuccugaccucaugauccacccgccucggccucccaaagugcugggauuacaggcgugagccaccgcgcccggcccacuuuuucaacuccuauccaucuuuaaaacucaugaagcacuuucagacuacuuuaguucauucauuugcucucucuucucugagcaccuauaacaauuuuggcaucuccacucaucaauuguuugcauugguauuguacuuuuucacuguuacugugucagacuuaucgaagauaauuuuaugcagauuuuuguguguuuccucaauaacauuuagaacuccuguagugcaaggaccuuuguuucuuugugcuuucuacuguaacacaguuaaauguuuuuguaaaauuuaauuuaauggacacauagcacaaauucauuuaaaauaaaguucugaggcuuuuucugaucaguccagcuugcaccgauuuuucuauuuucuguccuuugguggcaccugucauuuuaccaggaaucagcaaacauuuucuguuaaaagccagauaguauuuuaggcuuugugggccauguuagucucuguugcagcuacucagcucugcuguuuuagagugaaaguagccacagacaauauguaacugaaugugucuguguucuaacaacacuuuauggacacugaaauuugaauuccacauaauuuccacaugucauuagucucucuucucccccugcccuccaccuuuuaaaaauguaaagaucauucucugauccugggccaugcaaaaauagguggugggcuggauuucccguaggcuguaguuugccaacccaguuaguucuauacuucuacugucuuguaguagaaggaagguagguuuuaaaaucaacaaacuaggauucucuuccuggcuuuacuacuuaccgcuuaacuggugcaaacuugacuuuauuuuuuuuuaaauguagauaauaaugcuagccucauagaauuuuugaggagaaaaugagaugauuuauguguagaaauauuauuuaaauuggaaaacugucuaauggaaacuuacuguauuuccucaauucuaagauacauuucuuuuuuacauuuaaauugauaaugucuuuuuuuuuuugagacagaguucucacucugucacccaggcuggagugcaguggcaugaucucgguucacugcaaccucugccucacagguccaagcaacccuucugccucagccacccgaguagcuggguuuacaggugugugccaccacgccuggcuaauuuuuguauuuuuaguagagacaggguuucaccauguuggucaggcuggucucaaacuccugaccucaagagaucugcccaccuuggccuccuaaagcauugggagauagugucuuaacaaugcuguuggucagguaacaauucuaacaugguucucauugccugaacauaagugaacaccaaaaccagaaucaaaauuuacaaaacguauacauguugagaacuucuuagagguaaaacuggacugcucuuuuaaccacuaggaacugaaugcuugugaggaggcguggguguucaaucggguggguugagcaacauuccuaaagugagagucaaaaguaaggcugaggccaggcaccaugguucaugccuguaaucccaacacuuugggaggcugaggugggaggauugcuugagcucaggaguucaagaccaaccugggcaacauagcuagaccuugucucuaccaaaaaaaaaaaaaaaaguacgggcuggugcaguggcucacgcuuguaaucccagcacuuuuggaguucgaggugggaggauugcuugagcccaggaauuugagaccagccugggcaacauagugagaccacaucgcuacaaaaaguuaaaaaauuagccaggcaugguagcaugucccuauagucccagccacuggagaggcugaggugggaggaugaauugagcccaggagguugagauugcagugagccaugaucgugacacuguacuccagccuggaugacagagggagacccugucucaaaacaaaacaacaacaaaaaaaguaagauagcucuaaauaauuguaaagcuggcauaugaacugguguuuaguuauaugaaacauuccaucaccaauguucuugugaggcacagaaaacuauauugguccaagugauucaaaagagagugggacuccaacuaugaagaaauggucaggaauaccuuaaguauuuuauucugcuuucauuuauauauauuauauauaugucuccauaaguaauauauaauggaucuauauaaguguaaaagagcuauuucuucuauagaaaaauagaaugaauucuuuuuuauauaaaaaauguaaaaugaauucuaagugauaaaguauugugucauacuugauaguucuuuuucuuaguuuuucaucuuacaaauucuuuuucuuagcuuuucaucuuacaaauugauggugccuuguacauacuguauuucaucuauucuagcaacaagauugugaucugcuuguuuaguuuucuuaauuguaaacuccuuuuguauguuauuuacuuguccuaaggcaguuagcauuuaggagcucaauaaacauuuguugagugaaugaaugacacucagaugcaauggaaacaucacauuuucccaauagcaauaguuuagaauuguccauccugaauuuaauagagaaguaaaugggagggaggagccauagacuuagagugaaauuuaaaaaauaugauuauugaaagcuugcaaaaaugaacucgugcccuauuuauauucuuuugugauuccauauuuauaucucucugucuuuauucuuuuaagaaauauaucuuagguggcugugaggauuaaauuuguauaaugcuuauaaagugccuaguacauauacaugucuagcuuguuucauuuaauccuuuucauuccuuuaauuaaacagcuuuuccuuaagcauaagaaccauuguucauuauauauaaaaaccacuuuuaauugaguuuuucucuguuaauuaacugaacuauauuauuagcuggguuucauaaaaaauggcauuuuagcauauuauggauaaguaggcuugggaguggagcuacucauagaauuuaccaauauuuuauaacacuguugggagaaaugugucuugguauucccaccaucaacucauuuuuaaguuggaaaaucucuauacuaacauuuuuucacugauuauugggaauucuaaucuuuuguggguaauuagaggauuuguacuuuugccucuucccuaaccagauugauguuuaguaagggugguacuuuaaauuuuuauagcauuugauuuaacaaaaucuucacgccagauaucauccuugugaauccuuuucccaucuaauuauauuaacauguguuccacaagaaagacugggugugccguuuaugagcucugauggauuauuucauagccauaguguacagugacuguuuaccuauuuccccccugcaugagcucuuugaaggaaaggacuaaauuuuaaucaaugggaacuucuagucugcuuguuucccuagugccuaggaaguauaucagggccugccaugcaggauguacucaaaaugucucuucaauugaauugagauuaaauuagcugcuuauauaagcaaauugugacuggaaagaagcucugaaaugauugcccuaaugauauuuacuguuugcuuaugaaguaugucuuuuuuuuuuuuuuuuuuuuuuuuuuuugagacagagucucacucugucacccaggcuggagugcaguggcgcaaucucagcucacugcaaccuccaccucccggcuucaagcgauucuccugccucagccuccugaguagcugggauuacaggcacaugucaccacaaccggcuaauuuuuguauuuuuaguagagaugggguuucaccauguuggucaggcuggucucgaacuccugaccucgugauccacccaccuuggccucccaaagugcugggauuacaggugugagccaccgcgccuggucugaaguaugucuuuuauucuagaucaucaugacauucagaugagucuggggaggggaucguauggcuguuggucugaaauauacuucauuagaggcuuuuauaugaaccucauugguuuuuaaacuugaaaccugcuuguuuucuugcuguuuuggcagaauaguagcuuacauaaaugcugacuauuggguaaugccacacacguugauuuugaggguaagcaacugcauuagccuuugcaaaacaucaaaaagucuguauucugucuguucucuugcuuucauuaaugguguuucaguggcuuuuuuuuuuguuugaggccagaucauuuuagaaaaguugucauuauaucuuuuuuuuuuuuuuuuaacuuuucgaguuguagaaaaagaaguuaauaauuauguuguuuuccuguugggugaaagguggaaauaaaauuuagaaaauuuauuuucuaauuuaggcaaaguacaauucuuuauuaucaaagguauaagauuacaccuguucucccugugcuacagcagucuguguuuauccaugcacuuuaagcaaaguauauuuuuauguggucugacucagcagguuggaaguuccuauggcuuaaguaucuuaucugaagaugguuuuaagugagguaagguuucauuuauuugcuugaaagcacaucauauauugggcuguacguguccuguucugcuuaaugcaagacauuuugugaaaugcuucuguuuccauuuuuggauuccacgaugcucaacacagaaaaguaauaguaaugggagcuaggauuuucaagcacaugguaaaucaguauuuaauaaauuagaacucuuuaagaaggccuucuguauucucugucugugaauggcaucaggaaaacuugagaguuuuccuugauucuuccuucucacuucacucuucagcucccugugaucaugaucauaauaguucuaaaccuugacuuuguucuuagucuauauggugcucaaccuugcuacaagguucuucucccaaucauuacuaucccuacagcaggaaccaguccucuuccuagggauuuucaggguguucauugccagcuuugaugauuucaagaauggggaacuuaauauuauuuugaggauaguauugaaaaugguaaggaaauaacccugagagucagauucuagcucagcuacuucccauggucuuagacaaguuauuuaaacuccauuggccuuaguuuucucguuuggaaaauggggauaauaauagcuaccccagaggcuugguguagaaauuaauuccuguguuuaucuccauugucuccucaaauuucauuaaguuauaguaauuuggaaaaaggaauaaagcuaaaggacaaagaagaguagggauauaagaugcuaacaaaauuuaggaagcuagaaagcaaguugauaaauauuuagaagagaaaacugaaaacuacuuguagaaagagaaugaaagugcaagcuaauccauaucacuauccuauaaaggcucaagaauuccagguacuaggugccugugaaagggggcuuagaguuuucuucuaagaguuuucuaguuuuggcucauacaugcaagucugugauccauuuugaguuaauuuuuauguaugauaugaggaaugaguccaacuucauucuuuugcauguggauauccaguuaucccaguaugauuuaauugaaaagguuucuuuuccuauacaguuaucuuggcauccuugucaaaagucaauugaccauaaauguauguguuuguuuuugaacccucaauucuauaucauugauuuauauaucgaucaguauacugguacuacacugucuuuugauuacuguagcuuuuuguaguaaguuucgaaaucaggaaguauaauguuuccaacuuuguucuuuuuuaaaaaacuuauuuugggucccuugaauuuccauaugaauuuuagggugaguuugucaacgucugcaaagaaaccagguguaauuuugauaggcauugcuuugaaucuauagaucaauuugagaaguauugccaacuuaauaauacucaguguucuaauccaugaacacuggaugucuuucuuuuuaugucuuuuuuaauuucuucaacaguauuacauaguuuucaguguuuaaaucuugcauuuauuuggcuauauuuauuccugcauauuuuauucuuaucagugguauuguaaauagaauuguccucuugauuuuauuuuuggauuguuaauugcaaauuacagaaauacaauugauuuuuauauauuggucuuauuuucugaaacccuacugaaauuguuccugugguuuuuuuaguggauuccuuaggauuuugcccuacacauuuuaacauguauagguaauauacaaguccaaguuuaaucaauaucucugcuguucuucugaaauaauacaaugacuuuagcaaccuguggcagguggaauaacaacauccccaggaugcugaggucugaaucccuggaaccugugaauauguuauuuuacauggcagagaggaauuaagguugcaaauggaauuaagguugcuaaucagcugaccuuaaaauaaagagaauaucauggauuauuuggguaagcccaguguaaucacuggugucuuuuaaagagaaggaaacagaagaccaagucagagccugagagauuugaagaugcuguguugcuugccggcuuuaaaguggaggaagaaccuguaagccaagaaauacaggcugccuccagaagcuggaaaugguauuuagaccucucaaucugggcacuagacuaacucauugcuacuauucugguuauugcuuauaggccuuuguaguagacauaucuagaaucgugaguucauauugauauuucuuccuuuuucucuuuuuuuuuuuuuuuugagauggagucucgcucucacccaggcuggagugaaaguggcacuaucucggcucacugcaaccuccgccucccgguuucaagcaauucucugccucagccuucugaguagcugggauuacaggcgccugccaccacaccuggcuaauuuguguauuuuuaguaaagaugggguuucaccaucuuggccagacugaucuugaacuccugaccucaugaucugccugccucggccucccaaagugcugggauuacaggggugagccacugcgcccagcccauacugauauuucaaaaggaaggacaaaaggaaucaagcguucacccugacauuuucauuucaaaauuaagauuauaggguuuuuuacuuuuuugauuuuuauauaauuaucucuucccuuaacaacgaaagucuugguuccuaaugacauuaaccuaacuaccuauuugcuuuauccaaauauguauguauauggugcucaaaauaacaaacugugcuaccauuaaaaauaaccaacaauaugauuacugaauacuguuuaaaauuuauuuucaguucuuuuuuuuccuuaaaguauauuuaucccacuaaagaugugcagucaaauaauuguuuuuaaagucacuuggaauaauucuuaauacaccauuaagguaauuuguucucuuuuauguuaauugugguaauugauuuguacaaaguguuuaacaugcuuauaaaacaaaaauuauuuacaugacuacaauguugaaguauaaaacaauauauauucaggaaaguauagcuuuuuuguuuguaauauccuacaaguaacuauuuucauuagucucugcuuuuaucaaugcacuucaaaauauguaaacauacaguuauauuucccccuuacauaaaagauaacauuggccaggugcauuggcucacaccuguaauuccaacacuuugguaggccaaagcaggcagaucacuugagcucaggaguucaagaccagccugggcaauguggugagacccugucucuauuuaaaauuaaaaaauauaauaaauaaauaaaauagcauacauaugguucugcauauugcuuuacuuauuuauuuauuuauugagacaaggucucacucugucacccaggcugaugugcaguggcgugaucauggcucacugcagccuugacucccugggcucaagcuguucuuccaccucauccuccuuaauaguugggacugcaggugugcaccaccgugcccccuaauuuuuguauuuuucauagagacaguguuuugccauguugccuaggcugguuucaaaccccuaggcuuaagcaauccacccaccucggccucccaaagugccgggauugcaggcaugagccacugcaccuagcuugcaccuggcuugccuacugguuuuuaaaauuuaagauauucuaaucacuucuuauuaguacacagaaaucuuuuccauuauuuucccugcaguugcauaguauucuguuguauggacauaacccaguguauucagccagucuccuguugauggccauuggguguuuuucauccuuuucucuuucaaauagugcugaaaugagcaaaauuuacucauaugucauuuaguauuuuggggguuagggccacuuuuaagauaauugucuuuaauguucuacaguuuuaccauaauguauuacuucucuuuaaaucuugugauucacugggcuucaugaaucuguaguuugauguuuccucaguucugaaaacuucagccacagguuaaacauuccuaaucugaaaaucugcacugcugcaaaaucugaaacuuuuugagugcugacaugacacaagucaaaacagagcaagaaaugaugucaguuuauaaaaugagagacagacuuucaagacaaaaaccauuguuaaugaagcagaugacuggaaaaaaauuuuuagaaagccaccuagcagcaugcauucucaucccuagaggacccaccuucuggucccuugauaggguuagaauguuuguccccuccaaaucuuacauugaaauguaaucaccaaugcuggagguagggcccaguggaaaguauugggucaugggggcagaucccuuaugaauggcuuagugcuauccccuugguaaugagugaguucugguucugaguucagucgagaucagguuguuuaaaagagaguggugcagaucccugcugucggcucccacucuugccaugugauguggcugcuccagcuuuaccuuccaccgugauuguaagcuucugaagcccucaccagaaacagauacugguagcaugcuucuuguacagccugcagaacuccaagccaaaauaaaccuguuuucuuuaucaauuacccagccucaaguauuucuuuauagcagugcaagaauggacaacacagaaaauugauaccgaagaguaggauguugcuauaaagauaacugaaaauguggaagcaguuuuggaacuggauaacgggcagagguuggaagaguuuggaggacucagaagaagacaggaagaugaggaaaaguuuggaacuucuuaaagacuugguuaaauaauuuugaccaaaaugcugauagaaauauggacagugaaagccaggcuaaugaggucucagauggaaaugaggaguuuauugggaacuggaguaaaagucaucauguuaugcccuagcaaagaguuugccugcauuguguuguucaugccauaggaaccuguaaaaaguugaacuugagagugaucaagaguaucuggcagaagaaauuucuaagcagcaaagcauucaagaggugaccuggcugcuucucacagccugguaucagauacaggagcaaaggaaugacuuaaaguucgacuuuauaggccaggugcacugggaggccaaagugggaggauuguuugaguucaggaguuugagaccagcuuggacaacauagugagacuucguuucuacuaaaaauaaaagaaguuaucagcuggauguggugguauaugccaguagucccagcuaguccagaggcugaggcaggaugaucacugaagucugggagauugaagcugcagugagcugugaucaugccacugcacucuagccuggacaacagagugaaacccugucugaagaaaaaacaaaguugguacuuauuuuaaaaugggagcagacuguaaauguuuggaaaacuugcaaccuggcccucugguagaagaggaauccaggagggcuuuggaguaaccacuuacuagagagauuugcaugacuaaaagggaaccaauuguuaauaucuaagacaaugggggcaagguuucaaaguuguuucagaugucuuugggaaggucccucucaucacagguccagagaccuaggaggagagaaugguuucagggcccaagcccagggcacugcugcccugcucagccucaggacucugcaccuuguauccuggcuacucaugcuccagccagggcucaaaaugccccaggcacagcuugggccgcugcucuagagggcacaagcacuguaagccuugaccacuuccaugugguugguaagccugcaugcacauagaaugcgagagugaggaaggcuagguagcuucugccuagauuucagggcauauaugagaaagccagggugcccagguagaagccugcugcaagggcagagccccugcagagaaacuuugcuagggcaaugcugaggggaaaugggggguuggagcccccgucaaagaccccacuggagcgucaccuaguggaauugugggaaaggggcugccacacuucaaaccuuagaaugguagagccaccggcagcuugcauccugagcauggaaaagcugcaggcacucagcucuaaccucugagaaaagcuggcagggcuauacccuacaagcaauagguagagcugcccaaggccuugggagcccaccccucacaccagugugcccuggaugugggacauggagucaaaagagauuauuuuuggagcuuuaagauuuaaugacuacccugcuggguuucagacuuucauagggcuuguagcaccuuucuuuuagccaguuucuccauuuuggaaugggaauguuuacccaaugcauguaccaccauuguaucuuggaaguaaauaauuuguuuugguuuuacaggcucauaaguacaucucaggcugcuuccaccuuauagguggaaggagaugagucuuagaugagacuuaggacuuuggacuugaugcugaaacaaguuaagacuuugggggaacuauugagaaggggugaugguauuuugcaaugugagaaggagaugaaauugaggggccaggggcagaaugauaugguuuggauguuugcacccuccaaaucucguguugaaauguaauccccaaugcuggagguggggccuagugggagguguuggaucauggaugcagaucccucaugaaugguuuauugccaucaccuugguaaugagugaguucuugcccugaguucucuccagaucugguuguuuaaaaagaguguggcaccucccccuucucuugcuucugcucucaccuugugacacagaugcucccacuucaccuuccaccaugauuauaagcuuccuguggcccuuaccaggaacagaugcugguaccaugcagaaccauuagccaguuaaaccuuuuuauaaauuacccagucucagguauuauguuacagcaagaacagacuuaacacaucccucagcugcuucugauguuucuucucaccuaaaaaaauaaaauaccguguucaguaacuuuuuaaucaaacacaacauuguaggugggagacugaaagccugccauuguugguuguugcuuuuauuuaauaacugguagagguguucugugauguuacugugcugguugguuacccugaguacauuauguuuuuucacuguauuaaugguauguuguaucuuuuacuguuaaguacuuaugugugaauaaguguaauaaaaaugauuauuaguaacguguaaguucaaucaggaaugauggugaugccaaacaaccauagauuuuccacauggguggcuaagauagugacaccguugcuuucugaugguucaguuuacacaaacuuuguuuugugcacaaaauuauuaaaaacauuguuuaaaauuaccuccaggccauguguauaaggucuuuauuaaacauaaaugaauuguguguuuagacuuaggucccaucuccaggauaucucauuguguauaugcagauaauccaaaauuaaaaaggaaacaauaaacugaaauuugaaacccuucuggucccaagcauuuuggaugagggauacucaaccuguacggccucuucaaauacugcuuuuauuucacugucuuuauuuccuuucagaacuucaguuugacauauuuaagacuuauuuacucuucccuucauauuucuuaacuuuuguauuuuccaucuucuauuuguauuuuggauucuaaauguaucuagauguaucugaacaaauucacuacuaguuuacgcuucuccuuagcugugucuaauauguuaaacuugacuauuuguuuuuuaauuuuaauucuuuucauucuaggagcuuguuucaaguuucuguucauuuaaauguguuaagcaguuauuuuauauuguauuugauaauuucuuuaugugaacucuuuacaggucuguuuccucacguauuuuaugcuuuuugauugugagauggucauuugccuuggaacuuucuuaaaguucuuaguccuagaaugaagauugauucuucaaagaggauuugccuuuguuucucuuggggguccugagggcacuaccaguuggauccacuuuacauucucaucuugaaacuucuugggauauguaaaugauauguauuuagcuccauaucaguuugagagcugucuuuguuuuuucuugcuucucccuucucaaugcuaaguuuuaagacaggccuuuuuuuauuuuauuuuuuauuuuuuaauuuaauccugagauugugguaagaagcagaaaguuaauucuguuucagccuuucacugagcuuaugauucuuugggaucccagcuugauggagaaagguuuccuacugggcuccgcagcaagacuucccaccucgggcuuuguguccuguucugugugcaucgcaaaacuucaaguucagacaguuggcaaaugccaucaagguaaaagccagauuuaauggucuaagugccucucuggauucccaccuuacuuaacuuuugaccugggucuucccuguuccuuacuuucuugccagcucaucuaugcguuuaagaagaacgaaugacuauauaauuacaauauauaagaucauuauauauaauuauuuaauaauuauacacuaugauuguauaaauauaacaucuauuuauauaauauuuuucacacaaauacuuacauauaauuuuagccaauauuucucaaguuggaucuauuaauuaccauagacagaagcagucccuaauauaagaugucuauacucaggcagacugucagucauugugugaaaauggggaacgcuauuuucaacaugcaaaguuucaaaauuaaugucccuuucucaugaagcugauggaggauguguuucaucaaaauaagagacuacaacaagaaaaauaugggauaugggauaagggauucaacacaggugaaaggcaagaagaauuccugagaugauacuaaauuguuagcaguucauuauaucagacagcaggcaguccuauuuggagcagaugaauggaggaugccagaaauggaaauuugagugaaaaauagaccugguagauuauuuaaugugaaugaccaaauauuaagagaaguuuuacagaauucaaaggcuuuauuuguuuaaaauugugaaauacucauacagaaaaguaaaguauauauguacaguucaaagaauaauaaauucucauguguccgucaccuagcuuaagaaauaaaacauuaucagcaccuuagaaaccuguuugucucuccucgagagcaucucuguuucccacacugguauugaauugcaugauaaucagugccuggcuuuucuuuauuguuuuaccacuugugcauguauacauuaaaaauacauuauuuagcuuugccuguuuuugaacacuauuauuaauggaauuauacaggauucagucuucugugcuuauuucuuucucuaaguauuuuucagauucauguacuuuuaaauuuauuuucacugcuaugcuauauucuauuacccagauacaucacaguuuguauauucuauuggugaugcauauuuagcuugcuucuuauucuuugcuuuuauagacaugugucuacaaacauucuuauauguguguuuugaugccuaugugcaggagguucucuguaaaguaaaauuaccagguugaaggacaccugucuaauuuuauuaggugaugccuuacaguuuuccaaauaaucuucccuguuuccuuguuaauaccuguuaaugucuggcuuccuauauuuugucaacaugauggaugugaaauaugauacuucacuguaauuuaaauuuuauguaucuuaaauuggaaaccuuuucauaucuuuaugggcuguuuguguuuccuccuuagggaaaagcauauuaaugucuuuugccuaucaaaaaguuuugggaaacaguuagugacacuuuaauagaaaacuaagcaaacaaaauuaaaaagacaauuauucuggaaaaaagcaaaaaguuguacaagaaguacaauugguauaccauguggcucaacuauaaacaguguuucuauaaugacuaacaggaaguacuuacuaauaaucacuuugcaaagcuuacaguugaagaaauugagacagauuaauuugccaacagucacauagcuuguaauuauuggaaaugaaauuuagacuaaaagaaucugacuucagagcccauguucuuauccaugaaacuaugcuuauuucucucuguauguagccauaguaugaaaauggcauauaguuuaaugaaaaggauuuuauuuuaaugaaguucaaguccugugucuuuuuuaucacuucugcuuuggguguuguaucuaagaaauuguugccuaaccuaagaucacagaguuuuacucguuuuuuacuucucagaguuuuauaguuuuagcucuuguauuuagguuuaugauacacuuugaguuaauuauguauauggugugaggaaggggucuggauuuguacuuuugcauguggauauccaguugucccaauaucauaucccccauugaauuuaucuuggccccuuuguugaaaaucaguuuguuacaggaaaggggucccaauccagaccugaagagaggguucuuggaucucacucaagaaagaauucagggcgaguccacagugcaaaguaaaagcaaguuuacuaagaaaguaaagugaaagaacagcuacuccauagacagaguaggacguucccgaaaguaagaggaggaacauauccacucuaaguauaaugcuuguauauauggggagauguguucugcuacaaggguuugugauaaaggauuaauuucuuaauuaacuauuuuugcaagaauggauauuauaaacuuuaaagcaaaauuaggaaugccuuuguucuccagauaucaggauagcuggaagcucccaagugugggucuguuuaguaaacauuauuaauuuguucccuuaaccauaaacaccuagaggcuaggaaugccuaacuuucugagaaugcagcccggcaagucccagccucauuuuccuagcccucagucaaaauggaguggccugguucaaaugccucugacaaauugacuauaaauacuaguuuauuucuggacuuuugauuguauuuaggugaucucuaugucuguucuuauaccuguaccacagucuugauugguguaguaucccauucgcuuuuacuagaaaguuuauaaggauuaaguaaggauuauuagccucaaagcuauuuaauaauaguaauaaauauuuauugagaaacccagcuaagugcuuuaugcacauuaauucacuucagacugucaacagauauuagucauugauguguaucaggcucugggcugggaauacaucagugaacuaauggagaaccuucuugcucuaauggaucucacauuaguggugaauuaauuggggugacuggaggauaauaacaaauaugggaauaagauaauuuuagaaaaugauuaguuuuaugauaaauagaacugacuaauuugagaguaaccaagagaugaaagggcaucuuugauccucauaauaacgccuauaaaauugguacuauaauccccuaacaugaagaaacucaggcuuacagaacugaagugacugcccaaagucccauaguuuaauaaaggcagaacuggguugugaaaauaaaccuuuaguugguagcaaauggaaaaugaauucagguucaggaacugauaagaaugcaguaucuccuaauuccuuuucucuuucugcuggaaauagguuguuaaggucaaauuauaggcuaaggguucuuaauuugggauucguagauagguuucuugaaaccaguggaauuauagcaaaauacaugugcaugcaugaacccucuggauugaggguucauagcuuucaucaaauucugaacauggucugugauaauagcaaaagauccauaaacacauuugauucaugugacucaggcagauaccauauuuucuuugugucuuucacagcaccacuuugucuccucucugucaaacuucuuccuuuggcaauaggaggggggaggaaauuauuuauuuauuuuguuagguuugaaauaaauuguauucuaacguaaaaaaauuauacaguuaccuaccagaguagauuuuuauuuauaaacuguaggacuuaauuauuaauuucucuguucaaaacuuuaaaauugacuuugauucugcugucaaucaucuuucauaucuugaacauucccaagauuuguucauugccuuugaaaggucauucuauguuuucuugcuuuuaauuccauugccaguuaagucucccauuuuuuucucuuuuuucuuugucaacccuauuaacugaucccauccuuuucuagccagguuauugcaacauauuuuuucccagaaucaaguccaucuugugccuguaaccagauugaucuuucugaaauacuuuuaucuuuacauuuuaucgacucuucauuuucuuuucuuguuuguuugauuuuuggagacaggguuucgccuugucccccaggcuggaaugcagugguguguucacaacucacugcauccuugaucuccuggucucaaaugauccuccugccucagccuccugaguagcuagagccacaggugcacuaccuaauuuuuuuuuguuuuuaguagagacgaggucuuguuguguugcccaggcuggccucguucuccugagcucaagcaauccuccccccuugaccuccaaagugcugggauugcaggcaucagccaccacguccagccuggcucuucauuuucucccauccaaguacuaaccaggccugacccugcuuagcuuccgagaucagaugagaucgggugcauucaggguguuacggccauagacuggcucuucauuuucuaggauaucauccaugacuguugggccacuccaaaaaaucacacacauacaaauaaccggaaaaagaacauauauuccccauuuuauuaagcuaacauucuuucuccacuaucuaauugugucagcuucuuuuagcuuuucaaaaauacuguacuauucccaccucauuccaguuagcuauuuuguuguuguuuguuuucaguguucccuaugacaggcagcaggcuggguccuuaucugccugaaaugucuuaucccucucuccaucccuauuucuaucagcgcaaauucuuucuguccuucaaugccuagcuuaagugugucuguguguguuuuuuuaagccugucuuucuucuccaagcuggaaguaaucuuucuuuccuccuuugaacauucacugcacuucagcuguacuucuuaggguauuuaacucuuuguacauuuuguuagauauuuauguacuuaauacuaacuucuugacagcagaugcauugucucucuaguuuuauaauugucccagcaucccccauuauccuaugucaguuccagccuuauacacguaauagguucuuaguaaauauuuuuugaaugaauuaauccuuuuuuuugggagagacagggucucacgguuuuguccagguuagaguacaguggcuauucacgagugugauaauagugcacuacagccuugaacuccagggcucaagugaucauccugucucagucucccaaguagcugggacuacagggguacaccaccacaaccaacaauaaauucuuccuuuuaaaauguaacuauauuagucuguuuuacgcuacugauaaagacauauccaagacuggguaauuuauaaagaaaaagagguuuaauggauucacaguuccacauggcuggggaggcaucacaaucaugguggaaggaaauaggcaugucuuacaugguggcagacaagagagaauugagacccaagugaaagggguuuccccuuauaaagccaucagaucuccugagacucauucacuaccaugagaacaguauaggggaaacugcccccaugauucaauuaucuccaaccagguccccccacaacacauggaauuaugggagcuacaauucaagaugagauuuggguaaggacauagccaaaccauaucaguaacuuaaacuuguuaugcuuuugaaaguucuuucacuacuuuaaaauucuuucauuacgaccccuugagggggggaaguuaguaauuaaucuaaaaauuauaauuaaaaaaggccuacacaaacuauaaugacuauaaaguaucuaggcauaaaauaagaaacuaaagcuauuuuuuaaaaucaaucuaaacuauaucccuaaaauucacaauauucuguucugacuaaaauacaaaaauaauguaagauucuugccacuuauguaaugucuaauaauacuaguuacaaaauuaauugaagucuucuaguuuauaaacagucauguguuuuguguguguguguguguguguguguguguguguguguguguguggacgaagucucgcucugucacccaggcuggagggcaguggcacgauuuugacucacugcaaccuccgccuucuggguucaagcgauucuccugcuucagccuucccgaguagcugggacuacaggugcgugccaccaugccuggcuaauuuuuguauuuuuaguagagacaggguuuugcaguguugagcaggcuggucucgaacuccugaccucagcugaucugcccaccucggucucccaaagugcugggauuauaggcaugagccaccgugccuggcccaauuauguguuuaaaagaagguguuaggggugugcuagaaaaucucugugggaguaggagcaaccuuuggagauggagaauuauugauuccuuaaauaaaugggaauuacucauuugguggaaauaaguuggguagucccuggaaccuguuuuuuuguuuauuuuuauuuuuauuauuguuuuuugagagaugagaccucacuuguugcccaggcuggauuagaacuccugggcucaauuuaucuucccaccucagucucucccgaguggcaggaacuacaggccuuuuuuuucuuuuuucuuuuuuuuugagauggagucucgcucuguaacccaagcuggaguacaguggcgcuaucucggcucacugcaagcuccgccucccggguucaugccauucuccugccucagccuccugaguagcugggauuacaggcgcccgccaccacacccggcuaauuuuuuguauuuuuaguagagacgggguuucaccguguuagccaggauggucucgaucuccugaccucgugaucugcccgccucggccucccaaagugcugggauuacaggcgugagccaccgcgcccggcuacaggccuuuuuuguuuuuuguuuuuuuuaaaugaaggaaauuagaaguggaggguguucuccugugaauaauuucuacuuauaggaaguaaguuuuaacugguaccuggcuaacuuguaaagguucuuuggcauuggcagaaucagcuauauuuagacuacaaaaagaaaaccucuaauaaugugcacuuaagccuuauuacuuuucagaagcauaaaugacagcaugagaagauaaaaggaugaaaggagugauacagcauugggguaaagagcagaggcuuuggagaguggcagaacuggauuugaauuuugucacuaccauuuaguaguuguguggccuuggcaaguuacuuuuaugucuaaaucuguuuuuucaucuguuaaaugggcauaaaaaguuuugugaggguuaaauggaaucacgucugugaaguauuuggcacagugacucguuugugcauagugaauauuauguacuauuacuaugaugauauccuagguccagauaucaaaauucauccauggaucguuagaauccauuauaacauguuuggcaugccauguuaucguuauaaucaaauuaguguaggauagguagauuugugaguaacuugugaguaaguagaauucuaaguucugcuuuuaguuuucccauaggauuucaagugcaaccagaaaagcaaaaaaagcaggucgaggcugaaguugcuguuuacuucacaaugucauuuuuauuucagaagauaggauuauccaucuacugagcaauuaucaaaugcuagauguauuagauucuuuaaagguaauuuuauucagucucugcaauccaaggcagaauaauuugaccaaguucauaaugugucaggaacuuguagagaaaugguaggacuuauaaggaauuugaacuccucugucauuccaaaucauguacucuaucuuuauauuuauagugccucucucaacauggggaacuuuaaaaauccucagggcucaggccauaacacagaccacuuaaauauguuucuagaggugagacccaagcaugaguauaaaguucuccaggugauuucauuguuagauucagaaauacugaccugguucaaugccuagaacagaguagacauucaauaaauguuucacuuuugaaagaauauaucccuuccuacccagccgcuguguuguaauuuuuccaguauuauagucaacuaggagugcuuuuauauuaaguuuuuagaaagagcuuuguaucauacuuuguagauauucuccauagcauauacaggaagaugucuggcaagagguaauguuuugcugcugauagaauucugaauuuccuccauuacuaggaagaagaauagguuggaaauugggacagcuuggaauuucuuucuuguauuccauccaagguugaagacguaaauugugaauagacacuuacugauuuauuuuguuuuagaauaauuuuauauuuuuuaauaauacaugaucaaaaaucaaaagauaguaaggaacagagauugaaaauuuuuccucucauuucccaaucauacuuuccuuuccaagauaccauaaauguuguaucaguauccuuccagagauguugaaaacauacauaaacacuuacauguauuucacaauuuuacccaagugauagcacgcauaucguguucaucuuggaguuauauauaugaaucuuggaauuauauauucauauauaaagauuuuuauuaauauauuuguucauuuuuacaguuaacuaguauuuuucuauauacuacaauuuauuuucaucgguccccuauugauggauauuagauuuuuuccaacuuuucucuauuacaaacgauguuucauugaauacuuaagucauuucacuucugugugagcaauucuucagauaaauuccuguaaguugaagguauugauauugccaguuugccuuccauggagguuguauauugauuguuugggaaugacaaggaagcaugaaagaguauggagaauuaaauguguaaaggagugauagugaccaagacuauugacuguugacugagguaggaaugauauuaaagucaguugggaggauggaaaugagccuacagccaagagcaaggugaaaaacuagcagguuuuguguguauaugaacacagaauuuauuugugauuaaaauauacuaaugaauuuugaaaaauccuaaaauuuuuacucuuaaaucuauguuuggauuuaaauacauuuuaaaauacuuauuuaaaugcauuuacauuauuauguaauacaauacauuaaauacauuuuuaauaugauacuuugugaugaacucuuuauaucuuuaagagaaaauaccuuugcuguuuucauuacugacuuacauuuagcauuuauugaccaagauuuuaucucuuuaugcauaauuuuucugaaaugucucucucuuuuuuuuccucagcccuggaagaaagcgggacuuuuccccuguuccuuggagucaguauuuugaguccauggaagauguagaaguagagaaugaaacuggcaaggauauauccuuugcaaaauggcuuauucuuuagugagcuuaugauguugucuaaguuaaaagacuuguguaguuucuaaaauguucuuuauuccugcuacuuauuucaccuuauuccucacuuguucuuuauggaauauugccuggaaguccaugccaauaucuuucuuggcuguaauucucuaaugcauggagaagggauuaagaauuaaauucuugaaacugauauacugucuuaggggcccaggggaagguuucaugagucaagugaguugaacuaguuucauuucuagaauccagggguuauguccucaugagggcaaagggaauuuuuuuuuuuuuuucauugaacaaaauggucacacaggcuucaugcuucaaacagaggguuagugucucagaaaagucugcuuacaucucuuacauuuggcagucugcaguuuugcauguaaguuucuagcgguauuacuaugauuaaauaaugaaaaacuuuagugagcaaaaacauagauguuuuaucuuuaacuauucauacacuuuucgagucuacaagagugguucagaggguccaguccugcuccuucugcauggaggaggucauucugcccuuucuugggcuguguucacgguaaguagguuguugauaguacaaguuaauguuagcacuuuugaacuaaugaaaguauagggacaaaucuuggaaguuaacacauucuauuugggaagcaggaauugcuauuccaggcauacacacagacugggugguauguucuucaguaugucugaagaacaaagagaagguuggagguuuuauaaaaaggagaaauguuauguauuguucuuugagaaaguuaauuggcacuaguaaagguuuggggagaaaaagaaaagauaauagggagugauggaaaaugugaaagaaaaauuuaaaaauguuaaaaaaggguuuggaagcuggcaaguucugauugauaaguaacugcggugaguaaaacuagucuuagagucacagcagcuuguuucaguagcuauuagauaaaacugguuucauauuuuagcagggaguuucagcagccaggcuugcagagaauuacuuacauucuugcagcaauguuaugugcccugagugcuuuuucucucuggccucucaacucuguuuuaaugggauaugacaagaauaacccaauuuguguaaacuuccauagugcaauuauuguuuacuucuuugacuagccuaacucuucauuuuguguagagaaccagacauuuuauuuaggugcuuuagauaaugucuaucacuuugucucccauauagagccuauguaauacuuugcacauggagauaucucauaagaacuuggaaaauguuucuuccuuuuugaaaugauucuuuauauuuuaauggugcuuguuagcuacaaggaaguaaauaauauuuggcuaaugauacuguggucuagaguagaagauaugugucugugugaaugcugucaauuauagaucuuccuaauaccuuugacucuggggugggacagcccaugugcaaggagagauacugcuaaggaagauacuagcaacaucuguguuuaaaaugaaguugucaucucaugugugugucaagcagauaugcauccucuauuuaccacuagagagccugaaggacagaaaaugagagcaagugggaaugcagcacuagguaccuggagccagauggcuguggaguugaggaagucccugaacauagcacuuuguuccuggcagcggggauuauugggguuaaguuuaaaucucaucuugucucuucuuuuagaucaugaauuccuugaaaauaaggauaauguguuacacuuuuuuguuucccaaauggcuugaaauaguucuuuaaacauaggcacauauucaaccacuauuaaaugauuuggcccuugucuuguuugcuacuuuuuucucuuacucuaggauaaauugugugacuuguccauaaguaccaggcucugucaugucucuggaccaguacuguccaauagaaauagagugcaaaccacguaugucauuuuaaauuucuuaguagacacuuuaaauagauaaaaagaaacaauaaauuaauuuuaauguauauguauuuaacuauuguauccacaauaucacuucaacauguugaaguaauuauauugauuaccuaaucaauauaaaaauuauuauugagauauuuacaucuauuuuuauacuguaaauuuaaaaauuuuauacuuacagcacaucuccguuugggcuagccacauuucaaaucguagcuuuagucauuuacuucgcaaauagauugcaaaauuuuuuggaggcaaauuccauggcuuauuaugccuagcacauauuguaugcuugaagaauuuuauguauguauuuauuuuuuaagagauggaaucuugcuauguugcccaggcuggacaugaacuccuaggcuuaugaguaauuuucuuccaucuuucuauuuucuagguuuucaguuaaauguuuauuacuuucauaauuuaaagacuguuuuuuucuuuuacuggaaacuauuuucaaggaaaaaggucauauucacuucuggaucugacaaguuuggcaaacugaaacuugucuagagaagagcaaucaagauuagaauacuuuaaacaauagcauuuaaggaacaauuaaaggaacugaaagggguuugccugaagaaaagaaagacuugggagacauaauauuuguuuucaguuguauuuuauuuauguauuuuuaagacaggaucucagucuaucacccagauuaguguacaguggcacaaucauagcucacuacaaccucaacuccugggcucaagugauccucccaccucagccucccaaguagcuaggacuacaggugugcaccaccacucccagcuaauuuuuaauuuuuuuguagagacagggucucacuguguuccccaggguggugucaaacuccuggccucaagcagucuuccucccucagccuugcaaagugcugagaauacaggcgugagccaccaagccugcccuucaauaagaaaaaaaccagccacaucuuuuaaacauuuacucugugccagguacuaugcuaagugcuuaaguggauuaucccauuuaauuuuucuguaauacuaugagauuagccagauaaggacugaaauuuagagaaguuagagagccaaugacagcaugaaaacucauacuuguucugacuccagugugcauauuucuuugaagacugcuuuuaugccaccuaagaggaaagauucagggcagaaacuagagaccuauuuugacacacauaggcagaaauucuaaagauuaggacuauuacaaagcaacccagguccucugcagaggaaaagcaagcaucauuucacugaaaggauuuaauugugaauguauucuuccaaguuccuucuuguccauaauucuauaaaauccuugauccugaguagaacuccuuuuccaucuaaauguuuugugguuugggagggaaaaucccccaaauccagauucaccagaaguucuauuauguaugaagagaaaccauuuauaccuuggcuuuaguaacaaaaacaaacaaacaaacaaccauaaagcacuugggaaacuuuuaucuguaaccacuuuuguggaacuaucaaagggauauaacuauuagaagaaaauuauguuguuuuaaaggauagucuuuaaauaucuagaaaauuaauuuuugaaccuuuuauuccuuguuuauauucaauaaguuagugauuguaguugcugcuacaguagucaaguuuaucauauauaauggguaauaauguauggcuucuguagccuucucccaucagcaaguacuagguauaacagaccaccuagcugcugugggagaauccagaaugaagcagaaacugaaguuuggcugagccagaagagagaugagaggaacagugggaucucauuagcacaugcagcugcagcaggcuagauuuugccagccuccaaugguuuucagcuuugguaccucugaagaaucugggaccagauaaguguguguugauugaagccaagaauugaaccugagugucugcugauucccauuucuucuucuaguuaauucaguugauuucagcaaauauuuacugaguauauucuauaucccaagcuuugugcugagucacuaagauucaaaaaauuaaacuucaggguccggcaugguggcucaugccuguaaucccagcacuuugggaggccgaagcgggcagaucacaaggucaggagaucgagacaauccuggccaacauggugaaaccccgucuuuacuaaaaauacaaaaauuagcugggcaugguggcacacaccaguagucccagcuacuagggaagcugaggcaggagaaacgcuugaacacggggggcagagguugcagugagucgagaucgugccacugcacuccaugcuggcgacagagugagacucugucucaagaaaaaaaaaaaaaaagagacuuuacucuuuaauaagaucagccaaucagcaaauacuuacuaaaccccugcuguguaccaggcaucguacaggugcuguggauacaguggagaauuaaacauauguuccaucuuccuguucuuacgauguuuaaaucuaauagggaagguaagaaaaauggaaauggcacauguauacaaaaaauacagcaaacauuuuaagaaauuuuuaucucagacuagguuuugaaugucaaagcagcuuaauuuaucugaauuuuagauagauggguauaauaccuccuaguuaauagagugguugugaaaauucaacaaaagauguaagguucuugguaaaguacuugacucauaagcacucaguuguuaaaugaguuugcagcaagauacaaagguaaugcagaggaaggaaugauuaacuugugguagaugaggggacuacaaggaaaguuucauaagagaggacaucugaaaugguuuuuaagaccaaauagaaguuggauuaguagggaaggcaugccaagaaaagguaagcacaaaggcauugaagaguguaacagugaaauauguuuuggaaauuauaaguagcuuggcuauaguuugaauagaguugagguuguaguuguauaauauaugaugaggguggagagcagggaaagaagugacuagagagaucacuggagcaaaauuauagaaggggcuuguauaccuagcuagguaauuguaccuuuaguuuccuuuuacuucuggguaacaguagagggggcuauuuuuguuuguuugcuuuuguuuuugauacagggucucacucugucacccaggcuggaguacagugaugcaauccuggcucacugcaaccuugaccuccugggcucaagugaucuucccacuucagccuccugaguagcugggaccacaggugcgcgcugccacacuagcuauuuuuauuuuuuauagagagggaaucccgcuauauugcccagguuggucuugaacaccuggccucaagcaauccuccugccucagccucucaaagugcuggguuuacaggcaugagcuacugugucuggccaugggagcuauuuuuaaacacaacauuuaccccacgcacauccacauuaagcauauuuuaggcaugucaaaauuagggaguauggaaagcauguuuugcuugacacacauucacacuguaaaguucuggugaguuaaguaucuugauacacauuuaccugauuguaauugaguaccacuguuucaggcaauaggaagcuauugaagagcuuuagaaaaaucaaaauacuaguauagaugauugauugggcaggaaaccacaguggaggcagggagacuaguuagaaggcuauucuuauauuacucaauucuaaauauuugacaucuuauggaguauuaauuucucucaaaaaggaagaaguucauuuacauuuucuaccauguaaaaaacuacuuaggauaauacuguuugaagcuauuugauuuaugaagguauuauuagucugauaccaaaaccaggcaaugauaauauaggaaaacuaagccagugucucuuauaaaauagauacagaaguggggcauaguggcacauaaccuauagucucaguuacuuggggagcuaaggugggaggagugcuugagcccaggaguucgagguuguagugagccaagaucgugcuacugcacuccagccugggugacagagcaagaccccaucucauuuauacauacauacguaaauauucacuugcucauucaccuaauccuaaggaaaauaacagcagauugauagugugguaaaauaauaauacacugugaccagguagguuuuguucaaggaaugcaagaaugucucagcauuagaaaauauuaucaguaugauucaccucuuaccucacuugaugccccaaaaaggacuugauaaacuauaaugucccuucauguugaaaacucuuggccacuaggaauagaugaaaaacuuccuaaagauuauaaaauucauacagaaacuagaaaauugcaugaauaucauacuuagugguaaaacagacacauugacacauuccuuuuaaacucagggauaagacaagugcuguguuuuggauauuuggccacucuaaaucucaguugaaauuugaucccuaauguuggaggugaggccuaaugggaaguguuuaggucaugggaguggauccuucaugaauggcuuggugccguucucaugguaaugagugaguucuuacucuccuacuuccaagaguuauuuaauaagaucugacaucucccuccccucuuucugcuuccacuuuuaucacaugaccuuugcaccugccagcuacccuuagccuuccaccaugaguggaagcagccugaugcacucagcagcaggaccagaugcuggugccguacuucuuauacagcuugcagaacugugacccaaauaaacuucuuuuccuuauaaauuacucaggcuccgauauuucuuuauagcagcauaaauggacuaagacaguaagggugcaauuuucaguguuauacuggaguuucuagucaaacaauacaaaaaaacaaguuuuaaauauuugaaaaaaguagcuagaacaauuauuaugugaagauauucucucucuacaaaaucaacugacaaacuacuaguuaagcaguuuacaaaguugauguuuaaaaaucuguuuuuucuaaaauuagcacuuugcagaucuggaaauguaauaggaaaaauccuauucauaaaagcaacaaaauguaaaauacgugggaauagaccuuauuuuuuaaauguaagacauuuaugaagaaaacaauaaaaugucacagaaggauuuaaaggaaaaucugaauauggaaauaaguuauguuccuguaugaaucuagcuaaacuggcuaagaucccagugggauuuuuucaugagaguuaauuaaacaaacugaaauucacacagaauaauaaaugccuaggaauaaccaagauaauuuugaaaaagagcaaaaaaaaagagcaaucuggucuuucagauaccaaaacauaaucuaaaagucuaucaguuaauaguaugguauugguagaaagaauaaagaaauaagcccauguauaaaaaggaauuuaauacacaaugaaaauaacaaugcaaauggauuaaacaacacaaaugaauuuaaauaacaaaucguaagaaaauucagauacgaccuuaaagcaggccuucuuaaacuuagccaaaagaagugaaagccauaaauaaaagauuaauuugaguuuaccaaaacaaaaacuucuagacaaaauaccguaaaguuaaaacacaagcuaugugcuagauaaaaaauauuucauauaugugcaaaacaaacuauaggcaaaggguuaauauuuucguuauauuaaaaagaagaaaaaacuacaaagcgguaagaagaaagacaauccagaagaaaaaugggcaagagauaagaaguguuaguugacagaagaagaaauauagauaauggauaaauuuauaaaaaugggacuaccuuacuauuaauuagcaaaauauaaagugaaauaaaagaauaacacuuuugagaggggcggcagagcaagauggugaaauagaagccuccacuugucguccuccccacaggaacaccaaauugaacaaauguccacacaaaaaagaaccuucauaagaaccaaaaaucaggugaaugaucacaguaccuagauuuaucuucauaucacuuaaagagacacugaagaggauagaaacgacagucuugaauuacugacaucaccccuuccccaucugcuggcagugguugcguggaacggagagagaaucugugugcuugugggagggagagcacagugauugugugacuuugcauuggaacucagugcugcccugucacaguggaaagcaacacugggcaggacucaguaaguuuccacagagggaggauuuagaccagccuuagccagaggugaauuacccauuccaguguucugaauuugaguucuggaaagccuugccacccaagcuaaaggguccugggguccuaaauaaacuugaaaagcagacuaggccacaaggacugcaauucuugggcaaguccuggugcugugcugguguuggagccaguggacuugagcagcacauaaccuugugagacaccaggggcagccaggggagugcuuacgccaccucucccccaaccucagguggagcagcuugcagcucugggagagacuccuucuuucugcuugaagagaggagaggaaagaguaaagaggacuuuaucuugcaacuuggauaccagcucagcuauaguaggauaaggcaccaggcagaguaccaaggcccauuccaggcccuaauucccagacagcaugacacauacugagcuagaagggagccugcuucccugaagggaaggacccaguccuggcaggauucauccccugcugacuaaagagccuuuggguccugaauaaucagcaacaguauucagacaguauuugccgugguccugagguaagacucagagaugugcuggcuucaagugugacccaacacauucccagcugugguggcuaugaggaaggacucuuucugauugagaaaaggagagggaagaguaaagacuucauguugcaguuaggugccagugggguagagcaccagguggacucuugggguucccaauuccaggccuuggcucuuggacagcauuucuggaccuacccugggccagaggggaccacugcccugaagaggcagucccaggccugacagcauucaccauaagcugacugaagagcccuuaggccaugaauaaacacuggugguagccaggcaguacuugccaugggccugggguaguuguagccauggggagagacuaugcuuguggaaaggauagggaagaguaggaaggacuuugucuugugacuuggaugccagcucagcugcaguauaguagagcaccagguagauuccuaagguuuccaauuccaagcccuggcuccuggauggcaucucuggacucaccugggaccaggggcaacccacugcccugaagggaaggacagaagccuggcuggcuuugcuaccugcugauuauggagcccuagggccuugagugaacacagauagccaggcagugguuacuguaggccuugggugagucccaguguugugauggcuucaggucugacccagcacaguccuagugcugguggccacagggguacuugugucacuccacccccagcuccaggaagcucagcacagagagagaccccauuuauuugggagaaaauaaaggaagaguguaagaaucucugucugguaauccagagaauucuucuggaucuuauccaacaccaccaaaauaguaccucugugagucugcaagagcuaggugcuuggggugcccccuaaugcagcuauggcugcagugaccaaaaacuuagaugacaauacccaaguuucuuugaauaccuggaaagcuuucgcaggaagaauggguacaaacaagcccagacuacaaagacuacaauaaauaccuaacucuucaaugcccagucacugaucaauauucacaaacucaagacugucuaggaaaacaugacuucaccacaugaacuaaauaaggcaccagugaccaaucccagagagacagagauaugugaccuuucagacagaauucaaaauagcuguuuugaggaaauucaacaaaauuugagauaacagagaaggaauucagaaaauuuaucuauagauaaauuuaacaaagcaauugaaauaauuaaaaagaacagaaauucuggaguugaaaaaugcaauugacauaauaaagaaugcaucagagucucuuaacauauuugaugaggcagaaguaagaauuagcuugaagacagguuauuugaauauacacaaaggagacaaaagaaaaagaauacaaaaacaaugcagcacaccuacaauagaaaauagccucaaaagggcaaauuuaagaguuaguggucuuaaagaggagguagagagauuggcauagaaaauuuauugaaagaguuaauaacagaacuucccaaaccuagagaaacauaucaguauucaaauaaaagaagguuauagaacaccaagcagauuuaacccaaauaagacuaccucaaggcauuuaauaaucaaacucccagaggucaaagauaaagaauucuaaaagcagaaagagaaaagaaacaaauaauauacaauggaacuccaguacaucuggaagcagacuucucagugaaaaccuuacaggccaggggagaguggcauaacauauuuaaaaugcugaagggaaaaaaaaaaaaacuuuuaugcuaaaauaguauauccagucaaaauauccuucaaacauguaaaagaauaaagacuuucccagacacacaaaagcuggaggauuucaucaacaccagacuuacaagaaaugcuaaagguaguucuugcaucugaaagaaaaggacauuaaugaacacuaagaaaucaucugaagguacaaaacucauugauaaguacacagaaaaacacagaauaacauuguaauuguuguguguaaacaacucauaucuugaguagaaagacuaaaagaggaaccaaucaaaaauauuaacuaugacaacuuuucaagacauaaacaguacaauaauauauaaauagaaacaauagcuauaaauagguugggcaugguggcucacaccuguaaucccgcacuuugggaggccgagguggacagauugcuugagcccaggaauuugagaccagccuggacaacacggugagaccacaucucuacaacaaaaaauugacuaaguguaguggugugugccuguagacccagcuacuugggaggcugaugugggaggauugcuugagcugggaggcagugguuguagugagcugagaucacaccacugcacucaagccuaggcaacuugagacccugucuuagaaaaaagaaaagaaguagagacaacaaaaauuaaaaaguggagugcugaaguuaaaauguagaguuuuuauugguuuucucuaugcuuguuuguuuguuuaugaaaucaguuuuaaauugucaccacuuuacaauaauggguuaugauacuauuugcaagcaaacucaaaccaaaaacauaacaacagauacacaaaaaauaaaaagcaagauauuuaaacauaccaccagagaaaaucaccugcacuaaagaaagacaggaaagaagagaagaccacaaaacaaccagaaaacaaaguugcaggaauaaguccuuauuaauaauaacauugaauguaaauagacuaaacucgccaaucaaaagacguggaguggcugaaugaauacaaaaacaagacccacugaccuguugccuacuagaaacacucuuuaucuguaaagacacauauagacugaaaauaaagugagggacaaagauauuccaugcugaugcaaacuaaaaagugggaguagcuauauguauaucagacaaaauagauuucaagacaaaaacuauaaaaagaggcaaaagucauuauauaaugauaagggggucaauucagcaagaggauauaacaguuauacauauauaugcacccaacacuggagcacccaaauagguaaagcaaauauuauuagagcugaagagggagagaugggccccacccaauacaauaagagcuggagacuucaauaccccacuuucaguguuggacagauaaucgagauagaaaaauuuacguaaucugcacuauauaucaaauggacuuaauaauuaccuacagaacacuucauccaacagcugcagaauacacauucuucuccucaagacauggaucauucucaaggauggaccauguuaggucacaaaacaagucuuggauaacauucaaaaaacugaaauuauaucaaguauauuuucugaccacaaugaaauaaaacuaguaaucaauaagaggaggaauuuuggauacuauacaaacacauagaaaauaaacacuaugcuccuaaaugaccagugggccaaugaaauuaagauggaaauuuuaaaauuucuugcaacaaaugauaauggaaacacaacauaccaaagccugugagauacagugaaagccauacuaaaaggaaaguuuauagcuauaagagccuacaucaagaauguagaaaacucucaaauaaccaacccaacgaugcauccuaaagaauuagaagagcaagaacaaaccaaacgcaaaauuaguaggagacaagaaaaauaaagaucagagcagaaauaaaugaaaucaaaacaaaaaaguagaaaagaucaacaaaauaaaaaguugguuuuugaaacaugaaauuggcaaaccuuuagcuagacuaagaaaaaagaaagaagacccaaauaaaaucagaugaaaaaggagacauugcaccugauacugcagaaauucaaaggauuacuagaggauacuaugagcaacuauaugccaauaaguuggaaaaucuagaagaaauggauaaauuucuagacacguacaaccuacgaagguugaaccaugaagaaauccaaaaccugaacagaccaauaacaaguaaugaaauccaagcuguaauaaaagucucccaguaaagaaaaaugggaccugauggcuucacugcugaauuuuaccaaacauuuaaaaaagaaauaacaccaguccuacucaaacuauucugaaaaauagaggaggagggaauacuuucagacuccuucuacgaggcuaguuacccuaauaccaaaaccagacagacaaaaacaaaaaaacuacaggccaauaucccugaugaacauugaugcagaaaucaucagcaaaauacuagcaaaccaaauucagcaacacauuacaaagauuauucaggcugggcacaguggcucgugccuguaaucccagcacuuugagaggcugaggcggguggaucacuugagaucaggaguucaagaucagccuggccaacauggugaaaccccgucucuucuaaaaauacaaaaauuagccagacaugguggcgcgcacuucuuauuccagcuacucaagaggcagaggugggaggauugccugaaccugggaaauggagguugcaguaagccaggaucaugccgcugcccucuauccugggugacacagcaagacuccgucucaaaaaaaaaaaaaaaaaaaaaaggaaaaagauuauucauuaugaucaagugggauuuauucuaggaugugaggaugguucagcauaugcaaaucaaucagugugauacaucauaucaacagaaugaaggacaaaaaccauaugaucauuucaauugaugcuggaaaagcauuugauaaaauucaacaucccuucaugauaaaaaaaaaaaacuuaaacugaguauagaaggaauguaacacaauaaaagccauauacaauagacccacagcuuguauaauacuaaaaggaugauaaaugaaaaguugaaaccuuucuuguaagaucuggaaaauggcaaggauacucacuuucaucacuguuauucaacauauuauuggaagucuuagcuagagcaaucagacaagagaaagaaagggcauccaaauuggaaaggaaaaaguaaauuauccuguuuugcagaugauaugaacuuauauuuagaaaauccuaaagacuccaccaaaaaacuguuagaacugaucaauuuaauaaaguuacaggauacaaaauugauguacaaaaauuagcagcauucuuauaugccaacagcaaacaaucugaaaaaucaagaaaguaacccuauuuacaguagcuacaaauaaaauaccuaggaauuaaccaaagaagugaaauacaaugaaauguauaaaacacugaugaaagaaauugaagaggacacgaaaaagagaaagauauuccauguucagggauuggaagaaucaacauuguuaaaguguccguagcacccaaaacaaucuacagaugcaacacaauccuaucaaaaauaccaaugauauucuucaaaaaaauggaacaauugugaaauuucuauagaaccacagaagacccagaauagccaaagcuauccugauagaaaagaacaaaacuggaggaauaacauuaccugacuucagauuauaccacaggguuauaacaaccagagcagcaugguacugcuauaaagacagacacauagaccaauggaacagaauagagaacccagaaacaaauccauacaucuacagugaacucauuuucaacagaggugcuaagaacacauguuggggcaaggacaguuucuucaauaaaucaugcugggaaaacuggauauccauauacagaagaaugaaacuaaaccccuaucucuugccauauacaaaaaucaauaaaaaugaauuaaagacucaaacuaugaaaguacuaaaagaaaacauugagaaaacucuccaggacauuggacuguggaaagauuuuuuuugaguaauacccaacaagcacagguaaccaaagcaaaaauggacaaaugggaucaugucaaguuaaaaggcuucugcacagcaaaggaaacaacaaagugaagaaacaacccacagaaugggagaaaauauuugcaaacuauccaucugacaagggauuaauaaccagaauauauaaggagcucaacaacucuauaggaaaaaaucuaauaaucuaauuuuaaaaugggcaaaagaucugaauagauauuucucaaaggaauauauucauauggcagacacgcauaugaaaaggugcucaacaucacugaucaccagagaaauggaaaugaaaacuauaaugagguaucaucucaccccaguuaaaauggcuuuuaugcaaaagacaggcaauaacaaaugcuggugaggauguggaggaaagggaaccuucauacacuguuggugagaauguaaauuaguaaagccacuauggagaacaguuuguugauuccuuaaaaaaaaaaaaaaaacuaaaaauagaacuaccguauaaugcagcaaucccgcuacuauguauauagccaaaggaaaggaaaucaguacaucgaagagauauuacacucccauguuuauuacagcacuauuuacaauagccaagauuuggaagcaaccagugucuaucaguagaugaauggauaaggaaaaugugguacauauacacaaaggaguacuauuugguuauaaaaaagacugagaucucugucauuugcaacaacauggauggaacuggaggucauuacgguaagugaaauaagccaggcacagaaaaaauucacauguucucacuuacuuaugggagcuaaaaauuaaaacaauugaacucauggagaguagaaggaugguuaccagaggcugggaacaguaguggauggggagagggaggugggagguggaggauaauuggggaugguuaaugaguacaaaaauauuuaaauagaaugaauaagaucuuguauuugauggcacaacagggugacuacagucaacaauaguuuacuguguauuuuaaaauagcuaaaaggguauaguuagauuguuuucaacacgaagaaaggauaaaugcuuaaagugauggcuaccucauuugcccgaugugaugguuaugcauuguuugccuguaucagaauaucuaauguacuccacaaauguauacccuuacuauguacccaccaaauuuuuuaaaaaacaauaccauuuuuuacuuaucaaauuagccaaaauuaaguuugaggauaucauauauuuguggggauaccuauuucuccacacuuucaccaauaccugauaaaccucuaagaaccuguuuuguucgccaaaaaaacugugcuaauauuuucccagccgacuucuuaagaagauaauaugagauuaucugagauaaucuggugaaauuauaaagugauacagaagcauauuauuacuacccaguucuuccaaucuugucucuguucucuagucucggguuaggauagugggccuucauuuuggguauacauuagaaucaccuggagaagucgaaaauguguaaauaacuugaaucagaauuucugguggguuugccccugggcaguaguauuuaggugauugauucuguuauguagccaggguugaaaaccaccuggaaccaggcagcuuggauuugaaaauuggcucugucacuuauuagcuauuuagccuugggcaaguuacuuaaucucucuguaaaaugcccuuaucuguaaaaugcugaaaauuaugucuaaguaguaaagaguugugaggagaaaguuagguaauucaucugaagcacuuagauugcugacuggcacauagauuuaguagacauuagcuccuacugcuauuguugcaguuauugcuaaacaccauaauauucuagugagaaaaugguugguuaagucuaguucuuaaauagcugcuuuccacucauccauuucagaaguagcaaaguuguacuauuugugacaagaucuggaguagcuaccauagaucugcucugacuuuuugauuaucuuuaaagcauguguuagucugugaauuuacuuugcucauuuauuuuuuucuagucuucuuccaccauaguagaauguagauaucaugagagcaggaguauugccaguauuuuucccuccuguaacccaauuacuccauuggugccagauuuuuauuagaaagauuuguuaaauaaauaaaugaaaauuuuguuuuuaauauuuguagugauuuucugacaggcaccuaugauuguaaaucauugcuuucaaguuaaagguuggaauuucaaauauauauuuuguuucuguuuuguaaaccugguucuauuaucuagagcaaucaagcaaauucauacuaucuuuuccacuuaauuuuauuucuaacauagggauuuguuuuugucauugaaggcuuuacugucacuaaauaacuccuguaaauuagcaaauagcuuucaggaacaaacagcaaaguauaguagaauuucauuccauuguugccuuuaaaagguauucauuagaauaauagaaauagaaucagacuugauuuucuaggggauuuuaaaaauaugacuuaagaaucugacuuguuuugugauuuacguugacuuuuauauugguaacuuaccuugggucuaguucuguuuuuacuccuaauuuguuaugugacccugggcaaauaauuuucuuucucuuggccucaguuuucucauucauaaaaugugacggcuagacuagacaguucucuuauuuuauucuuaaaaguuaaaauuuggugacauuugcuagcccuaauugugauauauuauugucaaagaauccaguuuaguuuaggaagaagauccccaauuauuucagauuuuuuucacccucuaaaauuguaccucccccaugauauuaugauuuuuuucaauaaauuuuuaauagguacacaagcugguauguucugcaguaucugucuuaagugaaucuuuaguagauuccaugacuucugcuacuuucagcaaauuucaugauuugauugucauguuucugugauguccugagccaagauauaaacugacucaccguccuuaucuaagggauucucucuccagaguaaggaaaagauauccaaggaauauagaugaaaaccagagcucagagggucauugucuaaaggcucuuaacugugugugucaagaaaggauaggaagaauuaagauugaaagagggauuuagguagagaaagccauauuuugaaguugggacagaaccacaauauauggcaaaacuaguagaaaaucaucauucuuucauuuugcuuaaaacuagaaagucuuuugauucucuuggguccuuugaauuuugauggcaguucauuuuacaaaguuaucauugggaauugggugaaauuuguuauccuagaugugucuuaacuacuuuuccuuuuucuccuaggcagcgauuauuaguagaguucaguguaggauuguagcuuuggaucugcgaagucauggugaguaaaguucuuaauuagccauuaacuggauuauagucaucaagccccuuugaauaguuguaacuauuagaaauuucaacguggccauaaaauaaccuggucuauuccauuugagcuuuuuguuguugucguuggagauggagucucauucugucgcccaggcuggggugcaguggcacaaucucagcucacugcaaccucugccuccuggguucaagcaauuauccugccucagucuccccaguagcugggauuacagguaugcgccaccaugcccagcuaauuuuuguauuuuuaguagagaccggguuucaccauguuggccaggcugauaucaaacucuugaccucaagugauccauccaccucagccucccagagugcuagcaucacaggugugagccacugcgcccagcucgauuugggcauuuugaaggaaguccuagcuucuagucuuuacaaauguauguguguguauauauauuaaaguuuuauguauaauauuuauuuuuguauuuuauguguguuaagcuaagaaaauguccuuuaaagucaaauucuuuuuuuuuuuaauuuuuuuuuauuauacuuuuaaguuuuaggguacaugugcacauugugcagguuaguuacauauguauacaugugccaugcuggugcgcugcacccaccaacucgucaucuagcauuagguauaucucccaaugcuaucccuccccccuucccccaccccaccacaguccccagagugugauauuccccuuccuguguccaugugaucucauuguucaguucccaccuaugagugagaauaugcgguguuugguuuuuugugcuugcgauaguuuacugagaaugaugauuuccaauuucauccaugucccuacaaaggacaugaacucaucauuuuuuauggcugcauaguauuccaugguguauaugugccacauuuucuuaauccagucuaucauucuuggacauuuggguugguuccaagucuuugcuauugugaauaaugccgcaauaaacauacgugugccugugucuuuauagcagcaagauuuauaguccuuuggguauauacccaguagugggauggcugggucaaaugguauuucuaguucuagaucccugaggaaucgccacacugacuuccgcaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguaaguugcgaaaauuuucucccauuuuguagguugccuguucacucugaugguaguuucuuuugcugugcagaagcucuuuaguuuaauuagaucccauuugucaauuuugucuuuuguugccauugcuuuugguguuuuagacauuaaguccuuguccaugccuauguccugaauggugaugccuagguuuucuucuaggguuuuuaugguuuuaggucuaacauuuaagucuuuaauccaucuugaauugauuuuuguauaagguguaaggaagggauccagugucagcuuucuacauauggcuagccaguuuucccagcaccauuuauuaaauagggaauccuuuccccauugcuuguuuuucucagguuugucaaagaucagauaguuguagauauguggcgauauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugggcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuugguucucuguuugucuguuauugguguauaagaaugcuugugauuuuuguacauugauuuuguauccugagacuuugcugaaguugcuuaucagcuuaaggagauuuugggcugagacaaugggguuuucuagauauacaaucaugucgucugcaaacagggacaauuugacuuccucuuuuccuaauugaauacccuuuauuuccuucuccugccuaauugcccuggccagaacuucaaauucuuaugcugauguauaaggaauguggauaaaucuuugcuaggcuacuguaauuauccuucuuaggauaacuauaaagauuuuucugaagaaaauccuugcuaaacucauuguguaaaauugugaagucccuaauccauuguccaaagaugauauuuuuaaaagagaauacuucugcuuuuauaauuccugucugugggaauuuuauuuuuaaaauauuuucauuuuaggugaaacaaaggucaagaauccugaagaucugucugcagaaacaauggcaaaguaaguaaccaaauauuucuuauacauugccugucucccaucacuauuauaaauaguacuauaacuuuaucacuuuccugaugagauuguuggggaauaauuaccacaaggaaaauuuuacuucuguucucucuccucuacuucugguuucuccuuacuauuuaaucuugaaagaaaccugcgucuuucuugguguguccaaugcaauggucaucauauaaagcacaugaaaauucuucaaggcacaguuuaguuugugaaggcuuuugaaaaguuuucuucuguugauggaauugcguugaaucuggguacuuaucauggacucacgcuuggaaaaguaguuguaugcaagaggccuugagaguaucuccuucagguauccugcguacauucuucgucuuaugucauagaaagaugagaucaugauauuaaaaaaugacaguuacacccugggccuaaaguaaaaaaugaauguaacauguacaguggcucuuaaaacugcucacucaucagaaucacuugagaaguuacuagacauacagaugacuugacccuaccccagaccuacuucuagcaguggagucugggcauuuauauuuugguaaagcucuguguaggaaucugauggagccaguucaaugacuguuguuugggaaucacugaccuauagcauaaauaggauucuucuagccacucugcuuuaauacguacucucucagguauuuggucacuuuggccaaaaauaucuugcccucuuuuacuuuagcagcuuuaauuuaagaauaaacauuuuccuucagagcccaaacugauguaggcaacaauuuuaauauuauuauuuuuucacugucuaccuggagauaauuguuuuauuauuaugguagguguuauuuguguacuuuuuaucugccaacuuucauuaaaguauaaacuaagcauuuauuaauaauaaaucauuaacuuauuuuguguaaucauuuauugaaauuaauccucauuauuaacucuguaauacagauauacccuuuuacagaugaggaaacuggcucauauagguugaauaacuguaugaagucacacagucaguagauugaauuuaugaucauucaacuauaguccuuggcagagagagagagaaagaaauaauguguauaguaugaaugucauuccacucaaugaacauaugccuuaaaaaguaugaaaagagagguaagaaucuguuccuccaauuauuccuacugccuucauuaauaugagagcaauauauccucaaacagucaaggcuguuagugauaccuauaggaagauuugugaaugauuuuuaaggaaguaaaggguuucuuaacuuuuaacaaaaaagugaaauacaucaucugaguguccaggcagucagacaaauugaugaugauagcuugguugacauucuagaggaaauugaagaauugauugagaaccuuaaggaaacauggacuaaauaauaauguuucagucuggggcucaucaggaaagagaaaccauguaguaauuugaauaaguaaaguugaauauaaagaauuauucacuauaacaggggauuggaaugagcgauugguaguaagaaguaacaaaaacucuuaauaauauaggaauagcagauauaaggagcagccacuacucccuugggcugagggaguacacccaggguugagauccagaccuuguuggagaaugcacgaccaugguuuacugaagguuagaacuugcugaaaaucugcccuuuuggaaccugacagaauucugcccucuaggguauagggaaagcuauucguggggaggaucucaccagaggcacuuggcuacaaaaacacuggguuggggagggcuagaguacuggagaagccacuugugcuggaggaauugugcaggaauuggcaggaguuggauacugggggaaguucuguguuucucuagcacccuccauuaacauagcuuaauaucaugccuacuggcaaggguaaaauauuuacaggccucacaucuauuuuuguagaguaggcaaugaaggaugaauuggaguugagguaguaaguugauaacuggcaccaaaaaaauuuuuuaaugguaaaaaucauccacaguagaugaugaccaagaaucaaaagggcgaacaaauuggauucuugcugaaauuauccaagcaguaaaacauuugugugauuucugaauucaguuacuguggaaaaaaaaaaaccucaaaaugggcauacuuauuaucaacugcagaaccuaaauacuaccuaagaaaguaugugaaaaagccagaauuugagcuugggucauucugauauuccaauuucugugauacacaguaaugcuucucagaaaauuaaccuagcauuaaaauaugacagaaucccuuuaaaaagcauccaccaaaauuguaauacauccaguuacagucuagauuuguagguaacccuugcuacuucaucuuuauuguauuucucuggauuuucaggacuuaucucaaguaagguacuuguugacugaaugcucugcuugauuuuaauaacaauaaauuucucuuggugguagaugaucaagugauugaucguaacuaccuucuaccuggguaaauaugccuuucuuaagcucagacacgauguucaguugguguguuucagaccucucuaccuuugugcaugaggcagauacugcagaaccccuucaauucaguuaauguguauuuuaaggugacuuggacuuagauaaucguccauagcauccuuuuauuuuacucauuauuugucuguuaccaaccgaaaguuucuuggaauuguucaagaauuauucuggaaauuacauguugauauuuaauauaaacauguuuuaaacuuuagucuuuucuuuaaaaaaaaaaaaacaguuugcccccaaaauuguauccaauauuguuuuagauuaauuaauugagcauauaauuuuuucuggucuguuauuuuaauaugcagaauuagcuuuggaauacuaccuguuuuauuuuuuagaaacuguauguguaauaauuuccucuguguuacuacucuaaagaccacauauuaucgaaucuuuguuccugauauuuuccaguggccucugagcaaaggcaucaugguuuugacuucaugaaauuacucugaauucacacuacccuaugccaaggggagauggcuuuaccauuuaugccugagguugcaauuuuuugaauuuuugcaaucagaacuuggugaugaccuugggcaguaggauauaaauaacucccacaugcuuaguguuccaguaguggaacacuagcauaaauugguuaacucguugaaacauugaaaauauguuucagugagguaacaagaaucugcagcucuuuuuacuugguagaaaugcaauaauauuuuuauagacccagugagaaaaugcaauaauauuuuuauagacccagugagauuaauugauuaauacagaaccuucuagacagggcugcugaaggauuacguuaggugauguuauaagaaaguuuagagcacaacugaaaaagaagcacugaauaaguauuaguucucuuuucuuuccuucauaucauuuugucucccagagagaauuuuguguuacuauagaagcagcacuggugucaaagaagcuuggacuuuucgucuuaacuauuuguuaucgcuuuggaugacugccugaacugcuucacuuucugucuuaaucuuaaauuuaagucgaacgaauauuaaacuauuuguuuucacuuacaaaguuugguggccucccuaucucccauucagauugucuacaauugccgaggcuacccuauucacuccugcaguuguuguaugagauuuuaaaaaucaguuccuacagaacuaauaacauuugccuuugccauuauaaauacuguagagacuauauaugaaagucuguguuccuaccuugacacuugcuauauuugguuaacacugugugagugcuuaagguaugcagugacacucaacaagacaaaacuuucuuuugaaguugaaccagccacucccaaaagaaggggguagaacuagccuaaaaauauauauauauaauaaggcaguagagccagugggucuccagaaacacaccuuacuguucuuauccaccuauugcuauagcaaggaaggccuacaugcaauuaaaaaccaaacuucauacuucaguucuaauuuucaaagcuuuaaaauuagacuuuguuaaauagguccauuaauaauugaagauuagaaccaaagccaauaaaaugagcucugaacaccuuucuaguuucucagagcacuguacuuacauuuauguucauccuucaaacaaaugagaaauuguaaauaauaauuaacauuugugaagcauuuuacucuuucgagguguuuucuuguucccuucucaguuaauccucaaagcaauccagagcagucagugauauuuuuaucuuuuuuuauagaugucgaaacucaguuucugagagauuaaguaacuaacccaagaucacauagugaaaaauaaacugaggcuagggcucaucuugugauucugagguuuacuacauuauaaugcuuaauaaauuuuuguucuuguuuuauagaugggaaaauugaaacagagcaguuaaaugauuuuuccaguuucaaucuuagguucaaaauaaagguauauguuuauguaauuguacuacauauguggaacagugaaagugugauguaaaggaaaauucaguaauuuggguucuuaguccuuuaccugccauuuaucaggagagcuagguguguggcuacacauauugaugcuggggacauguuagaagguuuacauagguauguuuguaagauggcccaauagacuuuuacaguuucccagcacuguuacacaccaaagaaaggaacugggaaagaaaaccauuuuuacaguguugucagaaagcauucuuagaucuuuuucucuucucuuugcagagacguuggcaaugugguugaagccauguauggggaccuuccuccuccaauuaugcugauuggacauagcauggguggugcuauugcaguccacacagcaucauccaaccugguaccaagccucuugggucugugcaugauugauguuguagaaggugaguuuucuuagcacugaccaaaucaggauuucacuuauaagagacauccuugguagauuauuaccuugucuuaguuuauuguugauuucauucaucuugaaauaugucccucugucuuuauaucuuuuuuaaguuuauacaagauaaccauuuuuccaugucaucaaaaacucuucauuaacaucuuuuuauggcugcauaauauuucaauccuauguaugucccauaauuguauuuaaucauauaaaaagaagcugccaugucuuuucugacccagcuucagaagucacacugcugcuugugaauacaagucauccucuucagugugagggcaugacauaaagaagugaauaccccagaggcaaaaauuauugagggccaucuuuauuucucugcgagcaucacuaaauucugcugucaucaagagcagauauauaguaguugacucaguaaguguaaaugcucagaauaaguuaaauaugugguuacaguuuuuguuuaacauccagguacagcuauggaugcacuuaauagcaugcagaauuucuuacggggucguccuaaaaccuucaagucucuggagaaugcuauugaauggagguaaccaacaaaucuuugucgccuuuauuuaauuaauuuguuuguuuguuugcuugcuuauuuauuuauuuaggagacaaggccucacucugucacccaggcuggagugcaguggcaugauccuagcucacugcaaccuugaacuccuagguucaagcaauccucccaccucagccucccaaguugcuaagacuacagguacacaccaccaagccuggcuaauuuuuaaauuuuuuguagaaacgaggucuugcuauguugcccaggcuggcuucaaguaauccuccugcuuuagccuggccucaaguaaucaaguaaucaaauuccuggccucaaguaauccucccacuuuagccucccaaaguguugggguuguggcgugagccacagugcccagccacuguugccuuuauucuaaauguuagauuguagcuuuucuucuuuuuuaggucaagcaccaaguucaaggaauagaauuucaguugccacgccuuauuguaauagcauaugaggaaacauuauauaaacagcagaauuuuuugaacauuuaaaaauauuuuagauuuggcucaguugucugaaacccauuguuuucccaauacacuauaguaccuccuggaaucuuaguaauuauugaucaucugcugucuagcuguuucugccucugagguaagagguuagacuaggugguuucuaaggcaucauccaccucugaugcuucaugguuuuagauuuacuuucuguguuucagauaaaaugguggagaaauggaagauggcuauagguuccauucccucaaauuuauuuggauuuuggguaaauaaacucaauggguaaauaguuuuuauaaaaaucagugacagaauuccauuuaagcaaaggaaugaauuuauucauuaauucaguuaaucauuugauaaaguauuuauuaaacacuuauuuugugcuaaugagugaagauucagagaugaauaaaacacugucccuucccacaaggagaucagucuuuggauaaaugucuucaucauccuaucuuccuuccuauucuucuaacuccaucuccagucucuucuucagaacauuuucucuuaaguucuccaaaccacccagaugacgcuuucagcaaaauuacaagagaccuuuaagucucuauuauauugcacuguauacccuuaaguuuuccaauacucccuugagggauauggcucauauuguuaauuuucauuaaugucugucuuaaugcccuuccugcaucauaagggaagaagcuauucuguauuucuuuucuacuuucauauagcauauggcauacugcccuagcaggcagaauauaucuguuaacugaaucagauaucaaguggaaauuuaggacuugguaaauauauccuaggcguuuuccuaggacaaauggucuuaugcaagaauauggcuugucagaaugauguuuguguuggugaaguuucuaccacuuccuguucacuacugugaugcaggauuccuguucucacagaaauaucaaagaucuaucuugggcagauagcaucaagaauguagcugcugccagcuuggcuuguaucucaggugcccugccugcuuccgcaguaacaacaagugagaaaguuauucuagacuuggcucaguugucuaaagcccauccaacuuuuauccaaacuuuuuuuuuuuuuuuuuuugagacagggugucacucuguugcccaggcuguggaguccaguggcaugauuacagcucucaccgcagccuugaccuucugggcucaagcgauccuccugccucagccacccaaguagcugggacuacagcugugcaccacgaugcccagcuaauuuuuguuauuugauuuuuuuuuuuuuuuuuuuuuuguagagacaggguuuuaucauguuggcucgacuggucuugaacuccugagcucaagcagucugccugcccgccucggccucucagagucaugggauaaauggguaugagccacuacgccuggcccuuuuuccgaacucuaaaaauuuauucaguaaauuuuuuuuucuagugccuaagaugugucaguaccugaucuaagaacugggggaugaaucaggcucaguuccuaucaucaaaaaacuggggaugcaaacaaggaaacacauaaacauaacacaaugaaggaagccaggggauauaccuaaugcagccuggguaucaugguaggccuucucuuaaaguagucuuguuucuuuugccagauacaggauagaauaaggguucuguuuguuaaauguuaagauguucuggguuucaugagagucauugaucuuucugaaccugaaaauuauuauacuaugagguauuugguaauuuuguuuuuuauucugcuggauaucugaaucaaguuuaugacugauggccauuuuggcuauucuagauuuuuuuuuauguugaaauauaaggccaaugauuuacugcuuuugcucucauagguuuccuaaugagaggcagcagggguauagucauuaagaaccugggcuuuaggccagguguggugguucacaccuguaaucccagugcuuugggaggcugagauaggaauauuacuugaggccaggaguuugagaccagccugggcaacauagcgagacccugucucuacaaaaaauauauauauuuuuuuaauuagcugggugugguagcaugugccuauagucccagcuacucaggaggcugaggugggaggaucauuugagcccagaaguucaagguuauagugagcuaugaucaugccacugcacuucagccugaacaacagagugagaccuugucucgaaacaaaacaaaaaaguuaggggaaaccugggcuuugaggucagacagauacaaauuugcaucuugguuacaccacucuggcuguucugaggaaaaucaaauagaagaaguggggaaugaggugugaaguugguuaggagacuguuauaguaaaggagaguaauaaugguaaacauagacgaggauggcaacagaggaagagagucauuuuuuaauguauuuucgagguagaacugacaggacugguuuauggauuggauguugggagagagacggggaagggcaggaagggacuuaaggaugacuucuagguuuuuagcccaagcaauugggugaaugguagaaacagaaagagguagauaugggagcaaauaaggggcagagaaucaguuuuguuuggauaaacucaaaugcuuauuacauauguaaguagaaauguuaaguaggcaguuguauauacuaguuagaagaggcugaacuagagauaaauuggagaaucgucaucacauaguuaauauuuaaaagugaaagauugaauguaaagaccuaggaacuugauauugauaggaaaaagauccaagacugagucuugggauauuccacaauauuuagagcuugggaagaagaggaagauccaacaaagaaacugaaaaggcacaguugaugagauaaaaggaaaaccaggugaguauauuaaguguuuguagaaggagggagagaauaacugugucggaugcugcagagagaucaaguaagaugaggaccaagaaaugaccauuggaauuggcaugauagaggugaccuugacaaaauaaauaucugaaaauaaaugggauauaaaaaucauauauaaguuggggaaaggaugagaggugacaaaguagagaaagcaagauaacucuuuugaggagcuuugcuguauaggagagcagagaaauggaguaauagguaguagugaauguggcauugggaauguuuuuaaaggcuggauaauggaguaugcuugugacauccacgagagaaaaaaagugacacagaagagagacaggauaacugaaagaaagaguaucuuuucagaagcaagaggggaugggaacuagugcccaagguuggccuugauaggaauagauauuucauguauuaaacaggcaucaaggcagaguauauuauuacaaguauuggugaauuuguggauucauuugguaguuaaaagaugagguaauaguucugauugccucgguuuaccauuaaaguaagaaaucaugucauuaucugaggagaggggcuuuaaaauuuugaaugauuuuuuaaacuaagaaaugagauuuaaagaagugcuuucuccuaguggcuugcuucaggcaguguuuccaguucacccugggaaugcagucauuuugcucugccuuaguuguacuuagguggacaaaugugagaagacuaauuuauucagauagccuaagcccuguagcacggcacacaaggcccuggagaagcuggcgccugccuuccaauccuauucugucacgcuccccuuuuaucuccucccugcuucuccuugcacccaguucucuaaaaucauuauccugccgacuuucacaucacagcaccuuuguacauaaugugcccucugccuagaaugcucuaaccaaccucuuuuauuuucugguuaaacuuguuaucuauacuccucaguuuagcugugaccucuggggagcuuucucugaccuccucauucauguucaagugcuuucuuugaaccuugccucauuauauuaacauuauaugugucuuuuucucccuaccgaauuaugugcuuuuugaauacaggccuggcaccuaguauccucuugauaaauaucugcagaacugaaauggcuaugauguuuuuacuuaauuuuuacuuauaaaaccauguagccaggugaguaauaguggcaaucucuauaguaagaaacacuggugaucacuacuuuuuauuaggucucacauaaucuguagaauuauuuauuugauuccaaugaugugauacaauagauacugaauaaccuucucucuuccuuucuuuucuuucccagugugaagaguggccagauucgaaaucuggagucugcccgugucucaaugguuggccaagucaaacaguaggucuuacucuucccccuuggucugguuagaggcggaaacauggugagggaauuacagauugcuucuuuugucuuacaccaauucuaccauuccgguaaaugccuuuauuauuuuaaauaauuuuaaaggugaguucaguugggacagacauagauuuucuuucgccugccuuccuuucucuccuuccuuuccuucccuuucuuuuuuuuccuccucauuuaauacuggauuaccuuagcaaaacucugcguguuaaaaagcaaaucccagagcauagacauuacaaauuauguuaaccuuagugauagcagcugaguuucauucuaguaacagucuccuucuaagccaaaccuggcugugagggaauuauaauaaaaaagcucuggcauagccugagugaaagccagauucuaagagugagcuaagauuauuuagcccaauugaucuuuccugauagaauuacauggcauucuggguauugcuguauagucacaaaauaaacuuuagaugaauugagaaaauguugcccaacagaacagacagaaguuagaugaaaaugauaauggcuuugagugcuuacuauuugccaggcacugugcaagguauuuuauaugcacugucucauuuuuaaaaccuuauauuauggaaaaauuuugcacauauaaaagaagagugauacaguggauggaccccaguguucccauuguccauuuucaaugguuauuaacccauaaccaugucucauuuguuucaucugugccccuauguauuuccccuagucacaaaauauuuugaagcaaauuccaaacaaauauaauuuccucugcaagauuuucauaugaucuaaaaauaagggcucuuuaaacaucaucacgaugacauuauuacacguaaaaaaauuggcaauucuuuaauaucaucaaauaucuaaucaauauuuacauuucugauugucucauaaauaauuuuuuacaauuaaagucaaaaucaaaauaaguagauagcaauugguugauccaccucucaugcaucuuuuaaucuaagguuccacuucugucucccucuuuuuuuugauuccuugcaauuuauuucuugaggaaaccuuguuugccccauagaauuucccaugaucuggauuugcugauugaauucucaggccauaauuuaacauauuccuuuguuccuuauauucuguguaaauaguuaaaucuagaagcuucaucggguucagguguuuuguuugcaagaauacuugauaggugauguugcguacugccaucaggaaguacauaaugucugguugucuuuuuuuuuuuuuuuuuugagacagagucucacucugucgcccaggcuggagugcaguggcgcgaucucagcucacugcaaccucugccucccagguucaagcaauucuccugccucagccuccugaguagcugggacuacaggcaugugccaccaugcccggcuaauuuuuuauauuuuuaguagaggugggguuucacuguguuagccaggauggucucuaucuccugaccucaugauccgcccaccucggccucucaaagugcugggauuacagacgugagccaccaugcccagccaauugucucuuuuuuuuuaaugucaggagccguugauguuuauuaccuagauucauuaauucauuugcacuaucucauuuaaucccuacaauaccucuuuaagauaaguauugcuuuauagaugaggaaauagaaguucagagagguaguuucccaagaucacauagcuaguggaugacauagcugagauucaaacuccuguguauuugacuucaaggccuaucuuaugguuuuaugccuaaaagggcaauuucaguagaaauaucaggcagucaaaaugcaagacuuugaauaaccugugagacugcccacuuuucaauuccuaaauauuuugagaccucaaauuugucuaaucaguaguaaagcauuuuacauggcauauaugcagauaguugagugauuuuaaaauuuuauuuccagugauguuuucucuuaauaaguaaaccuauguguaggagaguguguaugugcauguguauuaacugucacauagauagcuggaacuuuccugccccuuauaauccaggugaaauugccuugaaccuccuaauccacaggcuauagaaauucaaagcauauguuucuuuguuacacuguuuuuuuuuuuuuuaucacaucuauacuguauacuacaugugaaacuuggcacaaguuucauauaaaacaccuacuuaacaaaacauuugugaacuuacacuucacugaagguuuggcagagaagacagaaagggagaaguuaucauucuuaaaaaucuaccgcugacuuuugaauuuaucccagucucuuuuuaucuugcuuguucucucuccuuuuccuucucugucuuugucaagggcaaaauaacagauuguucucuaucauacagagcaaaccuuggcacuagcuguugcccaggcccuugggauuuuuuuaccuucagagcuugucaauguguuuuuuccaucaaguucucucuaaaggaaguaugguaccagcuguugauauaauaauaauuuuucuaccaaagaauauaauaaaaagagaugcaauuuuuaagagaaaaacaacaaugauaauugguugguucagaugguuucugucagcuaauuaaaaagugaggccuuuuaucauucuguuugagccuuguucuacuauaagcaggguucagcagaaaagcaccauguuuuggaguuaguugagccuggauuugcaucccagccuuaaccacuuaugaguuaggugaugcuggacaauuuucuuaacucuucagggcuacuucauaggauuguuaugaagauuauauaagauuaugccaauaaaacucaugccugaggaagugguugcucccuuucuaugggucaguauuggugcaagaacuggaaaccagcccuuggagaauaguuauacauuggccaugauuuuccacagcccuggaaaugcacaauucuauccuccuaccaggaugauuguuaaguuuuagcuaacauuugauuauaaaaggccguaaguaugaguaucucugagauaauuuguguauuggaaagagguguguaauagcacuuuuuuaaaaaaaccuaggugugaaggaauuacaaguccagaaggcucaaaaucuauaguggaaggaaucauagaggaagaagaagaagaugaggaaggaagugagucuauaagcaagaggaaaaaggaagaugacauggagguggguaaaaacauucauucuugaaaagaugcgguauggaaugguucaaacugugugugggugggaaggggugauaacauuguucuuuuuguuugccauuagguauuuuagggagccaagacacuaucauaagagauacuuagcuuaacuauaagauguaaagcacuguugauagcucugaccaauuggaacauaaaacuuacgcuauauacccuccccuaaaacagacugcuuucucaccuguucuucuguuccuguguuuccucccaugagaaaaauuccauuuccuaccagucuacucuaagcucauccagaucuuuuuuuuuuuuuuuuuuuuugagacagagucuugcucagucacccaggcuggaguacaauggcgcgaucucggcucacugcaagcuccgccucccggguucacgccauucuccugccucagccucccauguagcugggacuacaggcgcccgccaccacacccagcuaauuuuuuuuuguuauuuuuaguagagacgggguuucaccggguuagccaggauggucucaaucuccugaccucgugauccacccgccuuggccucccaaagugcugggauuacaggcgugagccaccaugcccggccuaagcucaugcagauuuuacccuguccaucugucuuucaaaguuuuucuccuugaggaagcucuuuaauuuucuuuccauuuuuuuuuuuuuuuuuuucguuugagacuggguuuugcuauguugcccaggcugaauuccuuggcucacgugaucaucccaccucagccuccccaguagcuguagcugggacuacaggugcgugccaccacacccaacuucccuggggaagcuuucugaccucaauuaguaucacugucuuuccaacacagcacugaaagucuguaugacacaccuuagcacuuuuuuuuugaaguuguacauauuaagucauagaacugauuuuauaagucacacucagaaauacuaugguccuuugcuagucaucuguugacucauguuguccucugugcaagaauuguauuccaaacaaacaaaaaauguguauuuuguggcagaaacugauguucugcaugaauuucccucugcauuuagcucaggguuguauaaauaguguuuuaugaguacuugccaggcaaguagugguaacaagugcuuuuuucuugaaaauguuuagugcucaugaacagcagacuagggaugguuucgauuauaaacaucuuacuaauggcagguaaugaacauguaaugaccuacuccuuugcauuuggugaugcugcuguuagcaagaaggagaauacauuuuuaaacaguauuuuaaauuugaggaucuucuugccaucuuuaaaacagugaucagaaauguaauacuuuguaccucuuuagaguuuacaaggguuuaaauaacgcauggucuguuugguccucugaacaccuuaugagguguggagagaucuuuucucccauauuaugguguagaaucugaggcucagaaguuaagagacuugcccaagguaaucaagaacgcauuuaguagauuugagacucuuaauauaaucaauugcuuuuuacccauuaugugcuaagcacuaugcugaaugcuucacauuuaucaucucuaauucucauuuuaguucugcauuguagguauuaucaccauuuuacaacuuagguacagauacuugcccauggucacacauaaaaguuaaagcuaaaacacacccagauccucgauuuuuaauucuaacucauuuuuucuuuguauuuuuuuauaagcccaauuaugugguuucauaaacuccagcaguucuguugagagggugaacugaggcacauuaaggaguguccaugagaauucacuccccauuucuccccaacccucccagcuuaggcaaccacuaaucuaaucucuauagauuugccuaaucuggacauuaaauauagauggaacuauauaauauguggucuuuugugacuggcuucuuuucucuuaaaauaaaauuaucaggguucauccauauuguagcacguaucaaauacuucauuucucuauaugguugaauaaugugacauuguauggcuauaccacaguuuuuaauccauucaucgcuugauggacauuuggguuguuuccacuuuuugucuauuaugaauaauacuucuuugaacauuugugugcaacuuuuuguguggauauaggcuuuuauuauuugucuuggguacacagcugggaguggaacugaucgaucauaugguaacuauauuuaaccuuuugaggaacugacagaccguuuuccaaagcaggugcacccuuuuacauucgcacuugcaguguaugcguguuccaguuucucaguauccuugucagcacuuguuauuuucucucuuuuugauuauagccauccuaguguguaugaagugauaucugauugugguuuugauuuucauuuuccuaaugacugcugauauugaguuucuuuucaugugcuuauuguccacuuauauaucuucuuuggagaaauguuuguuagauacguugcccauuuuuuacuuggguuauuugauuuuauuacugaauuuuaagaguucuauauauauucuagauacagaucccuaauuugcaaauacuuucucccauuccauggguugucuuuucacuuucuugauggcauucuuagaaguauagacguuuuuaauuuugaugaaauucaauuuauuuuucuuuuugucccuuguacuuuugguauuauaucuaagaagucuuugccuaaaagucaugaagauuuauaccuauguuuucuucuaagaauuuucuuguuuuagcucuuacauuuaggccuauguuccauuuugaguuaauguuuguguaugauaucaggaauggaaccaacuucauucuuuugcauguagauacccaauaaacagccugucccagcuccauuuauugaaaaggcuccuuuuuccccauuuaauugucuuggcaccuuugcugaaaaucaauugacuauaaauguuagauuuuauuucugaacucugaauucuauucuguugaucuauaugucugcccuuaugcaaguaccacacugucuuuguuauuguagcuuuguuguaugucuugaaaucagacaguguguaaguccuccaacuuuguucuucuuuuucaagguuauugacauccuauauauuuuuuaaaaauuuuaauacuuguuuaugugccagaccacgcuccuguuguuuuacauacaugaguaucuuuagcucauccuuacaauucuuucagaucuuguguugccaauuucacagcuaagaaaacagucugggguugggugcaguggcucaugucuguaaucucagcgcuuugggaggccgagguggguggaucacgaggucaggagauugagaccauccuggccaacauggugaaaccccgucucuacuaaaaauacaaaaauuagcugggcgugguggcgugcgucuguagucccagcuacucgggaggcugaggcaggagaaucgcuugaacccgggaggcagagguugcagugagccgagauugugccacugcaccccagccugggcgacagagugagacucugucucaaaaaaaaaaaaaaaaaaaaaaaaacaggcuggaagaaauuaaguaacuuucccaagggacccacagugauuaguuaagaauggcuuugggacuugcauucagucagaucugacugacacaaagcguuauguuuuuaaacacuuuuccagugaaacaaugggagauaaugcaaggccugugguggaugcccuuguguggagaacugcaucucgcccagguaaacaucccaggaagauuguuagccaacuuucuguuucucccacccaacaacaaguggaucucauuauaucagccugcuuuauuaccauuuucacagcaucuaauaggcaucuaaacuaaacuucaugauccagcucuuuggagaaaggauuuauuuccaauaaccuaaauacagaagaaauccuaauucuguccagaauuuuuuuuuuugguuuugcaaauuuuaagauuugagaugaacuguuauauauauauauauuauaauguuacuuuuuggagguuuucuuaccuuaaauuugucauuucccugugaaguucagugugcauguaggaggggcuugugagauuaugccuugucucugacgguggagcugaucucuuagaaauggcucauaguguuguggggaauaggacaggcugagguuccagguugaaauggcaguaaguguuuccuuuaaaguguccuaucccugguaaauauuaacaguggagaauagaauuaguucuuuagugagaauauuugaaucauaagguaccuuuguaucuccuuuuacugauggaagaccaaggcccaaagaagggaagggaucugagaaaaucaguggcaaagauaggacuagaagacccaaguuucuugauuucccaucuggcgaucuuuuucuuuuucuuuuccuuucuuucuuucuuuuuuuuuuuuuuacugugauaaaaaacaaaaacaaaacaaaaaacaacccauaaaauaugccaucuugguaauuuuuaaguguacaguuaauauucacauuguugugaaacaucugagauuuuaugccuauuaaacaacaacuccccuuuucuaaaacucuuccaaaggccccugguugccaccauucuacuuucuaugaauuugacuauuuuagauaccucauauaagugggaucauauauuauaugucuuuuugugacuggcuuaugucacuuggcauaauguccucaaaguucagucccuaugcagcaugugauagcauuucuuuccuuuuuauggcugaauuauauauguauauaccacauuucguuuauucauucauccaucaguggccauuugaguugcuuccaccucuuggcuguuauccauagugcugcuaugaacauggguuugcagaucccucuuugagauucuguuuucaauucuuuggauauguacccagaagugggauuccuggaucauacaguaguucuguuuuuaauauuuugaggaacugccuugauguuuuucuuauugguugaacuauuuuacaacucaguacacaaggguuccuuccgaauucuccacauccucaccaacacuuauuuuucucuuuuuugauaguagucauccuaaugggggugaggugguaucucauugugguguugcugugcauuuauuuauugauuagugauguuaagcaucguuucauaugcuuauuggccacuucuguaucaccucuagagaaaugucuauucaagcccuuugaccauuuuuuaaucagguuacucgauguuuuuaguugcugaauuguaggaguccuuuauauauucugaauauuaauccauuauaagauauaugauuugcaaagauuuucucccauuccauacacauaguaccauuugucuauuuuugcuuuuguucacugcuuuuuggugucauauccaagaaaucauuaccaagucuacuguccagcuuuuccuccauguuuucuucuaggaguuuuauagucuuagucuuacuaggucuuuaauccauuugaguuaauuuuuggauaugggauaaggccccagcuucacuuuggaauaugcauaucuguuugguuaucccaguacuguuuguugaagagacuguucuuuccccauugaguggucuuggcagucuugucaaaaaucauuugacuauuuaugugaagguuuauuuuugggcucucuauucuauuccacuggucuauuugucuuuacggcaguacuaagcuguuucaauuacugcagcuuuguaauuggggagugugaguucuccaauuuuguucuucuucaaaauuguuuuggcuagucagugucuaugagauuccauaugaauuuuaaggugauuuuuuuuauuuccuaaaaaaaaaagccaugggaauuuugauagagauuauauugaaucuguggauuacuuuggguaguauggacaucuuaagcauccagugaucuuuaagauaauauguuacuaucucauguucacuuuuagauuuucauauugugguugauucaguauauuuauuucaauuauaauguuucaaauauuucaaugguacagaaaaauauagagaauuauuuauuuuuucagccaauauuugauugcauacucugugcuuaucuacaauaaagauuuaauaaauguugacauuuugucauauuugucucauauuuccuuucaaaauuacuauugcaggaacauuauaucauuaucauaaaauauaagaaaaaaugcucuacugacaaaucaaccuauuuucaguuuuccuuuuuaguacuuuacuauaccacauuuuuccaguaguaauccuaacuuagaugacauguuguaaucuguuucuugcuuauauuauaagcauuuuuucauacugcaguauguucuuuguaguuauucuuuugaugaaacauccuuuugccaaccaaguauaagaaaggcuuaaucuuggcacuaccacuuacuagcuuugugaucuuaagaaaguuuccuaaauucacagaaacuaauagcaauaaaaaguaaacuuguaauuaucuuaaaaugaauauuaacagugacccauacaacaagacuguuggaaggauugaauguauauuaaaaugucuaggacuuaguagguccuuaauaagugcuaguuuccuucccuuuccuuuucccagggaucuaguuuuuaauccuguuccuccagggguugcccucggagacucagaacuugcucuuauuccuccagaccaagaaagaccauccauacaccuggagaauugaacuggcaaaaacagaaaaauacugggacggcugguuccgaggcuuauccaaucucuuucuuaguugucccauuccuaaauugcugcucuuggcugguaaguguauaugugcauauauuagucagcucaggcugccauaaccaaauaucauagacugaguggcuuaaacaacagaaauuuauuuucucacaguucuggaggcuggaagucugagaucagggugccagcauggucagguuguggugagggcugucuuccuggcuugccuucucucugugcccucacauggccgagaaagagugaaugugagcucucuggugucucuucucuuaaggauauuaauuagggacguucauccuaucaugucagagcucugcccucaugaccugagguuacguccuuauaggcccuaguuccaaauacagucacauugggaauuggggcuucaacaugaguuuuagggggacacaacucaguccauagcaguguugguauauugucaucucaauaugaccucauuaaaacuucucaccaaaugaguagugacauccaaaguagaguaccuuccucauucaucuaugccuuuucuccuccccacacccagucucuaaaccuaacuaagcauaagcauucaucuaagcauaaaggaugaccuaauucuggccuggccugucuacuuggucaagcucaaguccuucuuagucuagagcuagaugcagugguauaaggauauucugauuauuaugagaauuaaaauaguaaaaccuuguuuucagaaccaguuuaacauaguaauuauaggggaaucucaaccugaaaaguuuuaucugguggugagaguaugcucugggaguuaggauugguauaaacaugaauggagaaugucaucauauuuaaaacuuuguaacacuuuuuacuuaauacgugaacagcaaaaucuguuucacaaugaauucucuuguuuucuagguguugauagauuggauaaagaucugaccauuggccagaugcaagguaaguuaucaagaaauuauaccccuggacccuuuucugaagaaagggugauagggcaguuaacauccugagauagugagguauaacggagaaagcaugagcuuuagaguccgacccaaguuggacauccgccucuacuccuaacacacuauaugauuaugggcaaguauuucccuuuccugagcuuuaauuuguuuaaaaaaaaauccauccaaaaaugaagauuauaauacuacuaccuaugucucaguuauaagaguuaaaaugaggcaauguguuuaaaaauuauaaaguacuguauagguguaugauacugugaaaagagauauucugacuacugaucaguuuuuuguuuguggguuuuuuuuuuuuuuuuuuuuuugaauuggagucucacucuguugcccaggcuggagugcggugggaccaaucucggcucacugcaaccucuaccucccagguugaagcaguuccgggccucacccaccccaguagugggauuacaggcaugcaccaccacgcccagcuaauuuuuguauuuuuaguagagauggaguuucaccauuuuggccaggcuggucucaagcuccugaccucaagugauccaccugccuuggccucccagagugcgaagauuauaggugugagccacugcagcuggccaguauuuuucuuauuguuagaaguuuuaggaaagggaaaggcucaagauaauccagauauaaaaagguauaaauaccuguuuagaagacagcaugguaagaugguaaaaguaaggucucugaaguucggaaaacugaguuuugaauacugcuuuuccaguaauuuuuugacucugggcaaguuaucugacuugccucagcuuuagucuucuuaaucuggaaaaugaaaaaacugauggcagccucaaacagaucgugggguauaaugaguaggaaagugacaugcugagcacuguauacagaugcauguauguuagcuagauaacaguggaggcagcggguccaauuuugugggggcucuugcuuuaguacggguaaaagacucagugaaggugaagccaguaggcauacaacuuuuggguuaugggaagaagaggugccaacuccaagaccaaaguuucaggcucaggcagaaucuguucuagaccuuucuucccuacuuacucucccuggacaauuucauggcuuccauuuauauauugaugacucccaaagcuaaacauccaccucaccccucucuccugagauccaguccuagccuauguagcaaaccugcuggauaucucaugggccucucaaacuguucuuuuagcuauccucaagcuuuccacagcaaaaggagcuauauucucucauaauaguuguucaaaggcucucacauauaaaacucuggucccagaccuucauggcuuugccuuccuuuaacuacauuguauccugaggccuagaauaggacuaugagcugggacugugugauuuuuuuuccauggcacugauguugguaauuaugggcuuagacacuuauuuaaguagaugcuuauaaaugucuaagcccguaauuaccaacaugagugccaugaaauugaaucuaagacacuuaaguucaauucaagaaaccuuuccuaggcacccuuucugugcaagaccuaugcaugaugcugggcagacagaagaaucagauauggccccugagacugccugaaggcaguugacauggacugggauagcauuugaaaucauuguugaucaccagccuuggaaucagacaauccuggguuugaaucacuguuaauaguuuugcgguaugagugaauuccuaacuuauuuaauuuugaguuucuucaucugugaaauggagauaaugauauaucucaguacaguuacaugaaguuuaaaugaaaaaaaugcggguagucuaacaaaugaugccuuucauuauauucaggaaguaaucacgauuccuuaugagauguccuccuguuuccucaauauggauuauaucaagaccaccuucugguuuaaagaaagccuccuaugaguauagagaguaaauggcgaggauaaggaacauuccacagaacaaagggaaauggcuaaggcugcauagauuccaaaccacagcuuugccagcacuguguucaaaccaacugacuuaguuaugaaauccuggaaaacuaccaccuauucauaguaccccuuggguaaauaauuuaggcucucugaaccuaaggcuccuaaucugugcaaugggagagaagaguuuggaaauauucccaccucauagaauaaucaugaggauuacccaugaacauguuauuuuauguguaccuggcacaguguuguugguguaugugaguucucucugauuauaccuacucuuccaaagaggaaggacaaaugcgucccuagucaucagagcugaucuaacagaaagaacagggagauuggaguuguaaguuuuggaucuagucauuuguucaucauucauucgcuaaagacuuaagcaucuacucagugcccuacccuguguuaggucuuauuagggauauagagcaaguaauaacaccauuguccccuguucuuauggaaaugacacacuccuggggaggcaagcaccaguggcauguaaaauguaaacuuacuugaaacuuacaagagggccaugugcugcucuguguuuggauccaagugcauuaacaacuuuaggagcuagaagggagaggugacuaggcuugagcacccagagagaggcagcuuacugcaggaggaggggcacaggauggacuuuacuaaaugggaucaucuuauuccuccacuaauuaaugaaguggccuugggcagguuacuucacuaaucauggccucaguuucaucaucucagaaaagaauuucaguauuuuugugcuuaauuguauaggguagauuuugagaaucaacuuuaaaaauggauagaagaauacacugaaaacuuuugaauccugcguaacugggguaagaaccacaggauguaaugaccagaagaacuuucaagcccauuccuuuauuuuauaaauagagaaucugaggcugagaaaaucugcugucucuacuuaugggggcucugggucucauauccuuuagucuccuuagggaucuucuuuaucagucaucgcuguucauucucaaucauugucgcauuaguuacgagcuuacaguguucuguaagacaguaugagaaagugcuuaguacaaugccuggcacaugcuuaagugcucagaugguaacuuauuauuguaauaauacauuuugaauccuuaacauagcuuacaaaauccuuaaugguuuggccccugcuuaccucuccagccuuauuguuaaccacucucauaagcaccaugccaagcuucuuguauuccaagccauuucaagccuuccuuccuuccugguucccucuuggauugugaaguucccuuucuuaugcucuuacagccccauguagccaguuuuaucauaggaaugacaugcugcauuaaaauguugguuuuuguguuuuacuccccuacuggacuguaaauccccugaggacaagaacuguuucuucuaugugucucuggcccacaguaaauguacacuaaauaggacagaaggaaaaagugaagggaaaugauuggcgcaagguuacaauuacuuguauuaccauccucagcaagacuugauaauuggguccagaguauugaggugagguuggaaauggggagguagguccugggcuccuggaaugaccuaugaggcugcauaagagagggcucuuuuagucgcugaaguugccuugcuuugauuccucuccagggaaguuccagaugcagguccuaccccaguguggccaugcaguccaugaggaugccccugacaaggugagucuggugcucagugacuguaaaaggacaacugugagaauaacccuggaugucacagaagacaagucucugagucucagccugcauugccugcagcagcugcuguggagccuaugcagaugcaguuccaccagcucuccaacuucucccuggcagcugcuuaugguauugguuuuguguauaugugcugaggagcuacugacacucugcuauuucaucccagggcccugugguuaagaucuuaagcucuacuucuccaauacccccaaaagccagagauggaagagggaugauuaggguagaaacugcucccuaaaccacaggcacaguuaggaauuaauaugggcuccuccugugagaaaacaccauucuguaacucugagggcacacauaagcccuucacgucauuccucuugagcucuauggagcuaucccuggcaaggauaguggggaggagucuucuagcucugcuagggagggccuagguccuuuuaauuucaagccacucagaccugugggugggaugagggcaccguagagccuaaccaucuaacaguagcucacagcccaaggcuaagccccaucacuaaccuuuauauggccuggaauaucucucccauuuccagguagcugaagcuguugccacuuuccugauccggcacagguuugcagaacccaucgguggauuccagugguaaggcggguacaaggguuuaagaacccagcagugcuggccgaaucugacaagcagacacuuguaggacuguaaauaucucugccuuaccccugccugguuuggucaccaugccuuucuuccuccuccucagugaagagccuggcaugucuguuucuacaaagccaugguugguuguuucuuugugcugugcucccacggguugaugcugaggcugugauuaaauugugccuagucucacuccccacugugaugugcauuucuucuugaggugccccuuugaggaggcugggauaggaaucaguccuuuuccaggcuccuagagaaguuuucuuuggcuucuccugcccugcugccaaggaaagcugggcaggccauggagcagggcuuuuuuuuuuuuuuuuuuuucuuggcacagucuugguucacugcaaccucugccaccugggcucaagugauccagugccucagucucccgaguagcugggaucacaggcguacgccaccguacccggcuaauuuuguuuuuuuuuuuguuuuuuuuuuuuuuuaguaaagauggugguuucuccauguuggccaggcuggucuugaacuccuggccucaagugauccacccgcaucggccuccuaaaguguugggauuauagggauuauaggcacaagccaccgcgccuggccuagagcaggguuuucuacaguguugcacagugucuucccauggccagcuacuaagcaagcugggaauggaaugggugccucugccaggcuugcuuccccucccuuuccgaagcuggcagaauauuagccacucugcaggggugauccuggaagcucuagagcaggguuuucaaccucagcuuuauugacauuuugagguggauaauucuucauuguggggacuguccugugcauuguaggaugcuuagcaguaucccuggcuuuuacccaccugauaacaguaguaccccucccacacacgguuuugacaaacagaaaugucuccagauuuuaccaaaugccucaagggaggcaaaaauucccccucuauuggucuagaggaagaaacagggccaggucucucauccuagguagcucuucaucuguuuagggaaacacaguugggcucuuuguugaggaagaagagaggcauguugaccaaaccaggugguauugacccaccucagccagcuccuagucuguacugcagaaggccuuugauccucagagagcccacaacccucaugaggagucauuccuaccauugaaaagucucuucucugauuuuggugagggcuuggggaaacuuguuccccacucucagaaaguuugcagaagaaauauuaagaaaaggaaauggcuucugcguuagagaacucugaauuccagggccugggagaugagagugacagggcaggguaagcacuggagaugauggcaagaccuugggacagugaaccacagaagcgacaccccuaugcugagccaucccucuaacaacugaccauucauggaucccaggaaccaacaauaaagacuuaauuucucuuacuaaacaguguuuggcuggggcccuucgaccauuuggagccuugggcaaaugagcagcacacugagagcagacccuggguccagcucuggucagggcugugaaaugggucagauuugccagggccuugguggucauuagggagggcuuccuggaggauacagauaagcaagggaaagcuauugauaguuacauuuguuuuuccuucucuuucuguucuuccacaguguguuuccuggcuguuagugaccugcuguccaccccuccucaacaucgagcucuguuguaaauacgucgcaccagaggccacugugaugccacugucuccucuccaucccgcccagccaugugacacuggcucccgguagacgggcaccccgagauguaccaaccuuuucauguauucugccaaaagcauuguuuuccagggcccuugaccaacaucggcuuccccaguccagggcuccccugcuccuuucccuucccuguacugggguagcuccugccugcucucccugcguugccuaggguaaagccuccagauuugccauacugagccccucuuccuagcaucaggcgauacaucugaguucaaaugucuucccaggcucagggaccuccauuccuugagauugucuuggcauggcccagcccugccucaugggauggacaaugcaugggguggucuuuauuuuucccuuucaaauaaaacacuagucagguaccguuuuaucccagucguacucuuccagguuuggaagacccagagaggccaagaucccauccuuagccauagcgagcgguggugguggauagcaucacaagaaacgagccugaaaaucagguccagccgguccaagcacauggccucccaucugggagagcccacugucccacucccacaugucugggcaccugcccugggcugaggccaggcugcuccaggggccuccugcgcccucaccugccacagagcaacccagguuaaauacagcccaugcacaaagccacaggccaaagccuauggaauuguuuuuaaucaucaaauuuaaccauuuucauaacugguuccuggaggugugcagugcccccuugccucuucaaaccuacagcuucucuuugccauuuguggauuucacaucacuccacacagaaacauuacagccuggcauccccagucuuugccuucuuccagcugccucgacacagcacuguggccugucccuauugcccaggcacgccauuuccaagggcaggaaggggcaguguccugaagcccaucuuuucugugacugucuuaggugauguguagcccccuccaccuuuccacucaacaaccucccaccccuguccugcugcaugguccggagucugggaccuacuuuguuuuuuguuauuuaugaccuuguuuaaagaaaauaaauaucucccaaccuuuauugg

SEQ ID NO: 15293 - RNA, 13389 nt, Homo sapiens
gcgccgccgccugcgcggagccccacugcgaagcccagcugcgcgcgccuugggauugacuguccacgcucgcccggcucguccgacgcgcccuccgccagccgacagacacagccgcacgcacugccguguucucccugcggcucggugagccuggccccagcccugcgcccuuugcgccccccacgcuuguucugcgugcgcugcccgcucuuccauuuaccuucucucccacccaaguuuguacucuuuucuuucucucgguuuuauuuuuuguuuuuguuuguuuguuugagacaggcuuucgcucugucucccaggcuggagugcaguggcgcgaucucggcucacugcagccuccaccucccagguucaagcgauccgccugccgaguagcugggauuacaggcgcccgccaccacgccuggcuaauuuuuguguuuuguagagaugggguuucgccauguuggccaggcuggccucgaacugcugagcucaagcaauccgcccgccucggccucacaaaguccuagaauuuuaggcaugagccuccggguccggccugugcuaauccuuucuguccuugguucuuuauuucucuucucucuuuuucuuagucccuuuuguucuuucccucucccguucaguuggcugucguuugagccuccaccuuuucacucccuccuuuccaccacgaugccgagcccugccuuggauggggaccaucagcgaugaccacaaugaccucucccuuaccaggcagcuccaggcaguguuccugcaccgccuuucccagggcuugggggcuuuuucuagugggcuuugagcugcucaaucuggccucugcagggccggcucccagcccuuccaaccuccucacagcccgaccugggaccuagccaauucccggagagucucugucccaucgugacccccucacaacucucccacucaccaaagucugaugacugugcuagggggugcuuauauagaguacugaguguuacaaaagcagaagucuggaugagaaccaauuugugauauuaagcaggugggguggggguggggaguguaccuagguucauuuuccgcccugcuuuuccccuuuccagugugugcacuuaaccagucccugggcccuguuccccaucccccuccaaggcauggauugggugggcuugugugucuuggggcagguggcccuuucuaaacucucugccuuugcucacccacaggacacauaguaugaccauuagguguuucgucucccacccauuuucuauggaaaaccaaggggaucgggccaugauagccacuggcagcuuugaagaacgggacaccuuuagagaagcuugaucuuggaggccucaccgugagaccuuacaaagccggguaagaguccaguccaaggaagaggucucuugcugccuccuaacccuguggucuaggggcaggagucagcagggcauuaacaaaaauaauuaccauccccacccccgacagugaaguggcucuuuccaguucacagagcacucucacaccuccccgcucucauucuggcccuucagcugacucggacaagccaaggaucuugguccccauuuuauaaaggagaaaacugaggcccacguguaacagugauuggccccaagucaucccgggagccagcagaagagcuaggacaggaaccuauuguucuaacuucauauugaugcuagcuuuugacuaucccugaaaccgagauugguaaucagcccggcucugaaacugguuauuugcuggggacuguaaaauaggauuaacuauuucuaguccugcauuuuaauugcuguuaguagggccaucuuacccacccucugaaggaccugacuuggcaagcccaaggcaacauucagaauauggcagcugaaccucugugcacuugucuuugggcagcagcugggucuuauucuucucuggccuucacaacauccugcaacccagcucaaggucaggaaugugacagacucaugucaucauaucucugaugcccagagaagggauaccauuugccugagccuucucaguacuguuuaaucagccugugagaacuuuccuugugaaaggcccugucugugccuggggcugauaaaacagcaagaacgaacugaggagcugggcagcagugcaaagcaaauacuaccagcuuuggugccuguaaguguggcucuuacucaucucacauggaaauaagggcagccaccuugcagggcugcucugaggauugagcuaauacagugcccugggcguugggguggggaaaguuguggagcaccuccugggggaagggggugucagagcagggaaucuggggaguccgagggcaccuucaucaacccaaucugucauuugagcaccagucuucacugagccucgugggcaagcuggagggaaacaggaauaaggucaggcccuguucuauaggucccaguguaguugcuauggugaguaucuucauuucccugcuugccccagccaccuggagugagaagcccaagaggaagcugggugagcuguuuguuuccaugggucucuguguucacagcugacucccuucaccagccagcccuuucaccugagccccagcaacaaaggcagucaggcggggcucaaagcagcugcuccaaugaagucaaagaaauaagcucaggggaagaagcaggucacccucccccacuagggugcugggcucacuuccuccuggggcaguggaggagggugugguuccaacucagaacaaaauggggcuuuugguuuacuuuaucacucuucacagcucugaccuggaccccucaucccugccugucuugugguguaagugcggaucccccuaaguuggaggaaaggaaacuggcccaaacaaaaaggagagcaguuuucucugcaucacaugguaggccaggaggagucuaaugccccagaguuuacucucagcccccaaaaucaccuagcuaaauguuaccuuaucuaagaaguccuuagguuuuuugggguuuguuuuuuuuuuuuuugagacaaggucucacucucucacccagacuggagcacaguggcacaaucacagcucacugcagccucaaccuccugggcucaagcaaucgucccaaguagcugggacuauaggccugcaccaccauguccagcuaauuuauuuuuauuuauauuuuuuagacagggucucauuauguugcccuggcuggucuugaacuccuggguucaagcaguccucccaccucugccucccaaagugcuagguuuuuuuuuguuuguuugucuguuuuuugaaacagagucuugcucugucgccuaggcuggagugcaguggcacgaucucagcuacugcaaccuccaccuccuggguucaagugauucuccugccucagccuccuaaguaguugggaauacaggcgugugccaacacacccagcucauuuuuguauuuuuagcggagaugggguuuugccauguuggccaagcuggucucaaacuccugaccucaggugauucgcccgccucagccucccaaagugcuggguuuacaggcgugagccaccacacccagcccaagaagucuuuucugaucacccacucuuccuucucucccaauggcauuaguuguucccuccuuugcauuuugagaguauguccuguaagccccaaaugcagcuugaaucaucugcccauccacccccugugcccaacaguaagccuccucuagaguagauacuaucuccugcaucucagugaaccacugcccagcaaagcagucuugcuaaaacaaugacucuagagauccuaagcugugugagagcuggaggagagaauuagacugauggucugggaagggauugaauuagucaucuuguaccuuuucuucuugacuuaaguuccagaccuguagcaaccauuccugcuuagacauccagaacauaagccuaugggucugugccuguugggucuuagucugggugaaacuuuucucuacuucugucagcucuccagaugaaccacagaagcaggaaugugggcaucaucagugaaaucucugcauacagcagacaaagggcugguccaguggcuguuuaugaggcagcgcuaggagagcucugauccagacucucccugcagugaaagggagggagcccuucaugaaguauugacugcuugagcaggaauugcuucaccagcaccuaacugagugccucucgagcucacaucgguuuucccucaugaggccacuuggagucuugcugagggacuugguucuauuagggaaggugaguuuggggauggugagcagggagggccuggggacauuguggcuaauggggcuuuucuccucuuggcuuagauuccggcagaguuccucuaucucgucuuguugcugauuaaaggugccccugucuccaguuuuucuccaucuccugggacguagcaggaaaucagcaucaugguuggguucaaggccacagaugugcccccuacugccacugugaaguuucuuggggcuggcacagcugccugcaucgcagaucucaucaccuuuccucuggauacugcuaaaguccgguuacaggugaggggaugaagccugggagucuugauggugucuacucuguucccuccccaaagacacagaccccucaagggccaguguuuggagcaucgagaugacuggaggugggaagggcaacaugcuuaucccuguagcuacccugucuuggccuugcagauccaaggagaaagucaggggccagugcgcgcuacagccagcgcccaguaccgcggugugaugggcaccauucugaccauggugcguacugagggcccccgaagccucuacaaugggcugguugccggccugcagcgccaaaugagcuuugccucuguccgcaucggccuguaugauucugucaaacaguucuacaccaagggcucugagcgugaguauggagcaaggguguaggccccuuggcccuuuuuucucagugaugauugaucuuaguucauucagccauauaguuuuuuaggccccacgaucccuaggaagaucaggggaacagagaacuggaaggggcccugguccuccacauaguuccuaagcaccugggcuauaccaggcucugagcagggcgucaucccaucacagucuucaacaccaccuugggaguagguaguaucaucccaguguuauagaagaagagacugaggugggaaggcaguggguagaguggggacuuggccaggggcacacaguagagagccagaaaacacacaguagagagccaggacacucgucucuaaggccagcguucuucccuuucaccuccuuaguaugccaugccaacccuccauuuuacacaugacgaaacagagccccagacaaaagguugucuuucccagaucacauggcaggaagaaguaaagcugaccugagaucccaagucuuaggaaucccaguccucagaaagccacuucucucugagccuugguuuucacauuugucagauggaaaugauugugauuucucagggcuguugagcagguaaaugaaaauguuuuaugaaagaaagcaccaaguuucauuuuggucuuagcccuugcuaugucccuagcaagaaguagauauucauagggauauuuuguuugaugugaggaguucuuacagcaagagcuuguagaaggccaaaagcuucuggauucuauucccaaaagcaggagaugacagugacagggugguuuuggugaggagagaugagguagaaaaugagugcaagcccgcuggccacugaccccauggcucgcccacagaugccagcauugggagccgccuccuagcaggcagcaccacaggugcccuggcuguggcuguggcccagcccacggaugugguaaagguccgauuccaagcucaggcccgggcuggagguggucggagauaccaaagcaccgucaaugccuacaagaccauugcccgagaggaaggguuccggggccucuggaaagguguguaccaguuguuuucccuuccccuuuuccuccuccccgauacucuggucucacccaggaucuuccuccuccuacagggaccucucccaauguugcucguaaugccauugucaacugugcugagcuggugaccuaugaccucaucaaggaugcccuccugaaagccaaccucaugacaggugagucaugagguagacggugcugggucucacccuucccccaugccaggagcaggugcgggggucuagcugacaccagaagaccacaucuuuucauccuauuugcccuuugcagggagaguaagauaucucuuacuugccauauugaagccaauugggaugaagcucccacuuugcacauugaggaacugaggcuagauuggcaaaaugacucuuucagguccucagaagaugucucagcuggagucccugucuguuuuuguuuuuuuguuuguuuguuuuuuguuuuuuuugagauagagucucacucuguuacccguguaaucucagcucacugcaaccuucuccuccuggguucaagcgauucuugugccucagccucccgaguagcugggaugacaggugugcaccagcacacuggcuaauuuuuguauuuuuaguagagauggaguuucaccauguuagccaggcuggucucgaacuccuggccucaagugaucugcccaccuuggccucccaaugugcugggauuacaggugugagccucugcgccccauccucuuguuuguuuuuugagacagggucuugcucgguugcccaggcuggagugcaguggggugauuaauggcucauugcagccucgaccucccugacucaagcaauccucccaccucagccuccugaguagcuggggcugacuacaggcaugcacacugugccuggcuaauuuuuguauuuuguagagacaggguuuuugccauguuacccagucuggucuugaacuccugggcucaagugauccacccaccucggccuccaaaagaaguccuggauuacaggcaugagacauugugcccagccucucugucucuuuaaaaucaugaaaacucguagcuacuuaaguaauucuccugccuucuggaaugaugggugaagaucuugacugccuugccugcuccuccuuggcagaugaccucccuugccacuucacuucugccuuuggggcaggcuucugcaccacugucaucgccuccccuguagacguggucaagacgagauacaugaacucugcccugggccaguacaguagcgcuggccacugugcccuuaccaugcuccagaaggaggggccccgagccuucuacaaagggugagccucugguccuccccacccaguucaggccucuuggcuaugcaugucuauugugggugggagagaaccaccuggaagugaguagcagccaagugugacuauuucugauccugguccuggcauuucaccagcauucaccuauccccuuaauuccuuccucccagaauugcuaccaucacuguuuauuagguguuaaauggagacucaaagggaauucaugcuuauagccaagcagcugugagcucaguucauugaguccucccagccuccuuugggacagagcaacuggguuggauugaauaccaggcccagugagggaagugggagguggaggugcccccaugaccugugauuuuucuccucuagguucaugcccuccuuucuccgcuuggguuccuggaacguggugauguucgucaccuaugagcagcugaaacgagcccucauggcugccugcacuucccgagaggcucccuucugagccucuccugcugcugaccugaucaccucuggcuuugucucuagccgggccaugcuuuccuuuucuuccuucuuucucuucccuccuucccuucucuccuucccucuuuccccaccucuuccuuccgcuccuuuaccuaccaccuucccucuuucuacauucucaucuacucauugucucagugcugguggaguugacauuugacagugugggaggccucguaccagccaggaucccaagcgucccgucccuuggaaaguucagccagaaucuucguccugcccccgacagcccagccuagcccacuugucauccauaaagcaagcucaaccuuggcgucuccucccucucuuguagcucuuaccagaggucuugguccaauggccuuuuugguaccuggugggcaggggaggaaccaccugacuuugaaaaugggugugauccaccuuccaccuccagcauccaaucugaagcccguguaggucaucugguccauuucucucuagacccaggcccuguacuaacauggggagugcaggagccaccugagagacagcagugccuccccuuccuuugccgggccacuugagcucuuacucagaaucugguacucuagugccugccaucccaaccccccaccccagccgcaggccuguuuaucugcacaacaagagugcuccugugugcccugcaucuccugcaguuccagaggaacaugagacucuuagaugcuguugacuuuauuuuauuccauuuuacaaauggaaggaagacccaccucccccaaagucccagaccuugugagaacaagucagucagccuccuuccacccuccacagccacagccacacccacagaggaaauguuacugaacuggguggagcaggcccugacuccacagaggguggguggaggcugcagggcaaacaucuggucucugccugaggauacuuuccauuuguguuuuuuguuguuuugagacagagucucacuugcugucacccaggcuggagugcaguggugcaaucuuggcucacugcaaccucucccagguucaggcgauucuccugccucagccucccaaguagcugggauuacaggcauacaccaucauaccuggcuaauuuuuguguuuuugguagaaacgggguuuugccauguuggccaggcuggucucaaacuccugaccucaagugauccaccuaccucagccucccaaagugcugggauuacaggcaugagccacugugccuggccaggauauuuuccauuuggagucucaccaccacaaccccccuccaccugccccugccccagcuaggcauccaaggaggccgcaagaagccagggccuuggcugcacaggggucuccgcuucucugucccuguucuuaucaccugcacucagaggcaggugggcagggguacuacaauuucaaggaguggagacugugagguccuggaaucccaaggcaucuccuguagggcugggcccuuagaauuaugucacucagacccaguuuguaggugucugaagaaacugaggccugacacaggugaugcaggcaagaacacccagaaaguccacuacugaacugggaccgggacccaguccuccuuccccuuguggacucccccagagaccagugcugggguccuuggggaagccuguuuggcagcuguggagcuaggcccugagaacacgaccacccucccucuucccucagccucaagccgcugaagccacugcugcuucgccgccucguaagcccaauggucagagcuggaggcuagacccuucagugcuuggguugagggccaggguguuagauugguuuuuggagaaggaacgagggcccaggauucuucagcuucuuaguuuuugacaaauugagcugaggccccauaguccucgggagggacaggguugagugccauaagucggcaaaccaggguaaaggugacaggcagcucagccaggcugcaggggguggcauauacagaggaccuggccacuacuuuauguaccuucuuacacuaauucugugaggcaggcuguuuguuagcucugcucuggacgggaagaaguaggggcaguuugguaggugugugucaaagcuaaacaggcugggugggcaugagcaagucagcugguucauucagcagccuuaauagacacgaggcuacccaacuucacugugguucuggguguggccuuaggacaaugagcugggaacagugguaggaaccacuggaaaacauaccagugggucucauucauucugaucacagguagaucacuucucuuugguucccaacccuuuaaugccuauuaagugggcagaugauaagcccugcuuugccuaauucaagguaacacugaagaucacuaagguaauaggaaucuccuaagggacuuucaggcccaagacccaggcuuccuucaagauaaggaguaggcuuuccugcugcccuacaggagaccuagaguugaagaauuucacagcccugccucugcacuccaauucagggcuugcccucagaacagggcagcucucaccaucccacuccaccugaguccugccccagagcauuucaugccucaccaucugguuuccaugaaaggccugcaagguaggggcuguaagcuuuaagaaacggguucagagaggugaagugauuugcccaaaggcacacagcuggcuaguagcacacuggggauccagaacaggugugucugacuccaaagcccacaugcuuuuaacuacuaugcugaaaugcuuccuggagcccuggucccagagucuucaccucaaggucuuuggguagcugacuucauggugauuuuuuuuuuaauuuuaagauggcgucucuucugucgugcaggcuggagugcaguggcaagaucucagcucacugcaaccucugccuccuggguucaagugauucuccugccucagccugccaaguagcugggauuacaagugcaugccaccaugcccggcuaauuuuuguauuuuuaguagagacaaaguuucaccauguugcccaggcuggucuugaacuccugaccuugugauccacccgccucggccucccaaagugcugggauuacaggcaugagccaccgcgcccagcccauggugauuuuuuuaaugacaaaagugcuacugaacccccguuuuaaaaaaaaaaccuuaagcugaugugauuugaaugguggagucccaagcaaucuggagaacauggggccuuuucuggcaccucugaaggcauuccauggaauuggcuaccuacuccccguaagccuggaucuauccucacccaagcucagacucuagaagggaaccucccuggcauggaaggggagcauaacacacguguugacuaugaggaggcaaguguggucuacgcaggcccaguuggaccuggaugcuggaacuccaggccuugagggcagcagugcuguuaccccuuccugaaucuaagcagugaguucaccaagcacuuucacaucaauguucucuguccucacaacaugcccgugagggggguuaugggcucugcuuuacugacaagacagguguggugacuggucccaggagaaaguggcagggcuggggucagaacucagguuuccugccucccagaucacccugcccaggacccuaucacagaccaggggauugaggccagagagguagaaccaaagcuguuuccagugcacauguguucuuuaugcugcuucucuacgcagggcgagucugugggaagugaccuucaagguuuuuggggguuuuuuuuguuuuuuguuugagacagagucuugcucugucacccaggcuggagugcaguggcgcagucucggcucacugcaaccuccaccuccuggauucaagugauucgccugccucagccugccgaguagcugggauuacaggcccucgccaccaugcccagcuaauuuuuguauuuuuaguagaaacggguuuucaccauguuggccaggcuagucuugaacuccugaccucaggugauccaccugccucggccucccaaagugcugggauuacaagcauaagccaccacacccggccuuucuaguuuuuuugagauggaauuucacuuucgcccaggcuggagugcaguggugcaaucucagcucacuguaacucugccucccagguucaagcaauucuccugccucaaccuuuggaguagcugggauuacaggugcccaccaucacaccuggcuaauuuuuguauuuaguagagacgagguuucacuauguuggccaugcuggucucgaacuccugaccucaagugauccgcccaccuuggccucccaaaguccaggcaugagccaccgcacccagccaccuucaagguucugaugacagcuuugccacugaggccugagugaccugcaaugaauguuuucuuuugugcuuuaguuuuccugucucuaacgugaccauaucaugcuccagagauugucucuucugucaugaaaagccagagcagagcuagagacccucagaggccacacagcccugccccacucuaucaaaguggaagcacagaggaucugaacccuuaccugcccuuucccacaaagccaggacagggacucaggcacucagcuccuuaggccucuuucuucccugugccccacaagaagggcuaauaugaagcuccucuccaauguacucucguggguguagcuggaggacaggaaauagaucuuuauuaugucaguuuaagcccugcgccaucccacccuuguaucauaucugugcagcaggcuccccugcacacccugaggcuguggcggguagggguggggugaggcccggcuagccuccucucaccccugcuccagcccaccacagucaugucagcaaugccuggcgcagcaucugcuucuucuggggugugaggcggguggggaacuggaugucgaagaagaugaagagauccccuuucuuagugggguccuccggcaauggcauccccuccccuggcaccuucuugaaguauuuggggcugaaauaggaugaaagaaaggagcauagagggcaucccagagcagcaccucagcaggucccugucauauaaccccuacucacauaaccccaggaaggggacagucacugcagucuucaccuggagugguucuuagccagaacugguugggaaaggagcucccugaaaaccuguuuacacugagucucugauggaggauuccagaaacuuuguuuaagacaugggaaacgggaaguaaaggugagcaaacccuggggugagggcgagggugcugggcugccaggcaaaccuccucacgggcagagggccuuucuuggaaaaggacuuaggauaugcaacucagaacucuaaugagaaguuugcagggcauggaggcuacaggguugcccaacaaugggggccucuagccucugcaguggcuuuguguggauuagaaaaagauguuccuuuugccaggugauugcagcccacagcuuggccag

SEQ ID NO: 15294 - RNA, 1482 nt, Homo sapiens
ccccauacuuccucuucuguaacacucaucacaguuguggugacuuauucaacaucuauucagcaacaaaaucuagcugcaugagguaagggagugucgaugucggauuccgacauuuaucuccagcugcuaccacugcagcaggagugaaguacccucucaacccuugugguagacgcucaauaaauauuuguuaaaaaaaaaaacauguuuuuggccaggugcggugacucacaccuauaaucccagcacuugggaaggcugaggcggguggaucaccagaggucgggaauuugagaccagccugaccaaaaaggagaaaccccaucucuacuaaaaauacaaaauuagcugggcaugguggugcaugccuguaaucccagcuacuugggaagcugaggcagaagaaucgcuugaacccaggagguggagguugcggugagccgagaucacgccauugcacuccagccugggcaacaagaccaagacuccgucucaaaacaaaaaacaaaaacauguuuucagaaaaauguacugacuccuguuguaggcuuucuuaggaacgagccagaacguccuuaagauccgauggaaguauucaggaauguaguuuagucaaugcugaaaaccuccaucauggccagaauugaauuuaaaacauccaucuggccuggccacucccuuguucacaagccucugguucuccauaauauucaagauaaaguucaaauggcuccuuuguccccacuucauugcugggaaaagcaaggcacccaggagaggauauagggcauggagcauaaagggagauggguugggagcagauugaggaacuaaagaguucaaauuuccaaccugggcccugacccagaccaaagccaggauacagguaugcaagaagugaaaggaggaacaagguuuaccuugucugcgcuaagcugugcaggaaagcucguuuuggaagagaagagggcagggccugccccagcacaccccuaaggccuggcucccaccccaacuuacgccugcuugaucugggcauccucugaauugcgagugaucccgagcacagaguaauaauccuggcccauggcuggcuagcuggcagucaggcccuggauaguccucagacucuagcaaggcuguuaguuggcuuccuugguugcuccugacaaccgcacaggugcacucugggaguuguagucccacuucccuaaacaaauuucagcucugccacagagaggagucagugaaaggacugggggagagcuggggcugauucugcgacccugugaaaggucacucaacucggaaauugaagacucacagggcucuguuuuauuuuguuuuuguuuuuaaagagagcaguaauuaguuuuaauaaaaagguuuuagaagaaaugcauuuggcuaauuuuuuaaaaauacauuuauuuuagaacaguuuuagaguuuagaaaaguugagaagacaguacagaga

SEQ ID NO: 15295 - RNA, 5990 nt, Homo sapiens
gccccuuccgugugcacgcuccccacgaggggcugguuccugaaaggauguacagaggauccccaaccgccugcgaaacccaagccgccgcguaggagcgugcguucgggcccucuucucccaccuguucggugagcaucgcguaccgcguucuucaggaggcguugcgggcacaacggggcugcgaucagcggccgcgcgcgcgcaugcguccucaaaguucaaaguccucgauacgccugaggcgccucaggccucguggcugccagcauuuuucugcuuuaagauccuuuccaugacuuccuuguuuaggccagccuccacgauccagcugccaaccaucuagccuacccugaucucugagcaggggucgucgucauuuuacuccagaggagacugaagccaaaagguggugagaggagaguacagcagcauuuacugaguccuauaguagcccaagcgcuuuucauucguuauauuaaucuucauucuaauugugcgaauuaaauauuauuaaugggaaaacuaaaaugaaaaagauuacauaguaaggcguagugcugggauuugaacacggaucucuugguuuaggaucaaggcacuuucuauuccacuguucuuucucuaaauuauuugcuccuggcccuauuuaaagaguuaacaguguauuuaggaagagaaaacuaucauuuauugaacucuuuagacauaccagccuccuuacaaaccuuaccuuuuuuuuuuucuuuuuuuuuuuuuuugagacagggucucccgcuguaacccaggcuggaaugcaguggcgugaucacggcucacaguguugcccaggcugggcgcaaaccauccucccgccucagccucccaguguugggauuacaggcgugagccauggcacccggcuucaucucugugcuuccagagagguuauuaaaugauguguccaagggcaccaaaugaggcagugacaaagcuagguccaagucuguuucaaagcccauuuucucccucuugcuuaaguuauaccgccuccaaggcaaaugaguuguguaaagugccuaacucccucuugugauuccccauugcccucagaauaaaaagucuuaaacucccuacuauguccuacaaagccuugugaugaucacuuacuuauaucgccaguuuaauauugucuuauucucacacuguauucucccaucacugaacuuuuuuuuuuuuuugcucucaugugucagauucuaucucaaccaccugcucuuccauugaccaaaaauaguuuucccaucucuggcuaacuucuguuccaucugucaaguuucagcuuggaaaucacuuccucuaggaagccuucccugccuauuccugcccuugucuggauuaggcaucccuccacuguggucccagucuuugcuaucuguacacuguguaguaaacugcccuguuuccuugucuagguuguaaacuccaugaagccaggaacuuaacugacuuagacagucuugaauccucagcacuagcauagugccugguacaugauagguacuuaaucauuuguugagugaaugagagacacaguuaaggcaauaaggaguccuaguugcuuuacagcccaucauggugaaauuuuugcaaaggcugaagucauuucucuucaaaccuuaaguuccuucuguaugcugcuuucugcugaguguucugaugcagacgggcaagacaguuugggcaaauaaauacaccucacauuuuuguauaguuuacaaagccaucucaccuuauagacccagaggccagguuucugcauacuguaugcuacagccacagugaacucuuuccauccuucccaugugucaaaaccuacccauauuugggcacucuuucacuuuguuuguuuguuuguuuuggagauggagucucacucugucacccaggcuggagugcaguggcacgaucuuuggcucacuacaaccuccgccccuuggguuaaagcgauucuccugccugagccucccgaguagcugggauuacaggugccugccaucacgcccgccuaauuuuuguauuuuuaguagagacgggguuucaucaucccggccaggcuggucuugaacuucugaccuuaugauccaucugccucgggcucccaaauugcugggauuacaugugugagccacugcacccagccucuuucacuuuuuaaacuuuguucuucagcauagaauaaggcuaguaggauaaaagaagaaagguuauuuauuugaaacagggucucacuaugucaccuaagcuggaguacaguggcaccaucauagcucacugcagccuuugaacuccugggcucaaaggauucucccucuucagccucuugaguaccugggacuacaagugugugccacuaugcccagcuaauuuuuacauuuuuuuucuuuuuucuuuuuuuuugagauggaguuuugcucuuauugcccaggcuggagugcaauggugugaucucggcucuccgcaaccuccgccucccgaguucaaccucggcucuccugcuucagccuccugaguagcuggcauuacaggcauaugccaccacaccuugcuaauuuuguauuuuuaguagagacggguuucuccauguuggucaggcugaucuugaucucccgaccucaggugauccgacugccucagucucccaaagugcugggauuauaggcaugagccaccguauccagccauuuuuaaauuuuuuuguagagaugaggucuugcuauuaccccugcuggucucaaauuccugggcucaagggaucuuccugccucagccucccauaaugcuaggauuacaggugugagccaucguaccuagcugaaaguuuaguucuuuuuagguagaucagagauagcuuaucuaaaaagaugacauuucaccuaauucauauuccaauagcaaaauccacugagcuuauugaauguuaugucaagcauucucacaguuuaucucauucaguucaaaccacuuuucaggccugcucucagccaggccuagugcugggggcacaaagguaaaucaagacgaacaucagccgggcacaguuggcucacaccuguaaucccagcauuuuggguggcuaaggcaggaggaucacuugagcccaggaguuugagaccaugcugagcaacauggaaaaaccuugucucuauuaaagaaucaaaaaaauuagcugaguggugaugcacaccuguagucccagcuacucuggccagggagggacugagggggaaggauugcuugaucccuaaagauggaggcuacagugagccugggcaacaaagcaagacacccucaaaaaaaaaaaaaaaaaaacaagcaucugucuucaagcuuagagucucccacgggagacagacacauuaaacaggcuaaauggugcagucuggucagugcuauuuauaauuuaggaaccuuacauauuauaucccuacucuaaccuguuaauguucuauagacuccccauccccaggaugucaaccucagucccucaaggccauaccuggacccaacgggugaagaaagacgaugaggaggaggacccgcuggaccagcugaucucccgcucuggcugugcugccucccacuuugcagugcaggagugcauggcccagcaccaggacuggcggcaaugccagccacaggugcaggcguucaaggauugcaugagugaacagcaggcgaggcggcaagaggagcugcagaggaggcaagaacaagccggugcccaccacugagaccccaaaccaccuauccccaguagauggcccugccaagaccagcacccagcaagauuauagaggaagaaauccuaaaugcuggugugggaggucuaaaacauggggagaguuuuuggaucuggaguugagagccauggguuuggacaugacuggcacaaacagcugucauauguucauggucagaugucauacauucucagcugucuuguuccaccaguauuuaccaggaaaacaaagaauguguuaagggaugcucccccaccccacaucuuaagucagugugccaaguacugagaugauuuuagggacauuuuauuuuaaauuaaauuuacaaucuaaugguaaauugauuaccuaauuagugccuuucucuuucaucacuuguucuggauguuucaaucaguuuaguggaaggaaaaauaaauggggaaacuuuuuauucaaauauguuuuucuuuuguuuuuuugagacagggucucuguugcccaggcuggaguguggugguggagucagggcucacugcauccucagugggcucaggccauccucccaccucagccucucaaguagcuggaaccacaggugugugcaucaccacacccagcuaauuauucaaacauugaguaccuauuaaaugccagauucuguugaauuaacagauaccaagucuggcuuuaacuugcucccaacccaacaaacacaaaguugggcuaacauuuuuagaguauauuuaacacuaaaauacagauuuucagcuuuugaaaaggggagaagaugucaacauugauuuuuauucccucuuaacaauuugcuggagcugaauaauaacucccccuuuaaguagguuguguuuucccauucaaaacaguugcauaucauuucucauuuuucuucaacaaaacgacucuuccauucuauucuuuuuuuuuuuuuugaaauggagucuugcucuguugcccaggcuggcgugcaguagcgcagucucggcucacugcaaccucugccucccaaauucaagugaucccccugccucagccucccaaguagcugggacuacaggcaagcaccaccacacccggcuaauuuuuguauuuuuaguagagaaugggguuucaccauguuggccaggcuggucucaaacuccugaccucaagugauccacccuccucagccucccaaagugcugggauuaaaggcgugagccaccacacccagacaauaacaaauauuucuucaggaucuauuagaagcccaaaucugagguauaguaggccuuaaaauuuacuuugaaccuucaugccaguauuuggggaagaaguaaagagaaaaggggagaagguaggaguuuaaagaacaauccuauuucuggcugaaggggauaaccagcaaauuauaaagacaaaucgcuaugugugugugcucagugcugauucaucaaaggaaacaagcagugugcacuggaguuuucagcaagaaucucaaagaagagaagagauuaguugaguugaacuuuuaaagcugaaguaggccaggcaugguggcucacuugaggucgggaguucaagaccaggcuggccaacauggcaaaaccccaucucugcuaaaaauacaaaaaaauuagccaggcaugguggcgcaugcugaguguaaucccagcuacuugggaggcugaggcaggagaaucacuugaaccugggagguggagauggcagugagccaagaucgcaccauugcauucuagccugggugauggaguaagacggucucaauaaauaaauagauaauaaagaugaaguagacaucaccuauuuguaaauuauaacagaaaagauuaccauccagaauuaaaaguaccuggaagccaccaagaagcacauaguuugacagcaaagugaacaaguaaggcaggcgcaguggcucacgccuguaaucccaacacuuugggaggcagaacuggguggaucacuugagaugaggaguuugagaccagccuggccaacauggcaaaaucccgucucuacuaaaaacacaaaaaaauuagauaggcgugugccuguaaucccagcuacuugggagacugaggcaggagaauugcuugaacccaggaugcagugaagguugcagugagcugagauccugcuacugcacuccagccuaggugacagagcgagacuccaucucaaaaaaaaaaaaaaauagugaacaaauaaacc

SEQ ID NO: 15296 - RNA, 17173 nt, Homo sapiens
uuuucccuuuggcuuaaaucaguuugaacagggaguuucuaucugacagccccaagaagccugaugcaggaugaugguguuuccuuuccugaccaccugguuuucuaugagaacaauucauugauucaacucuagaaggaugggaaccuacuggaaaagacuccaacaugaacaggauucucagaaagcaggcaggaccuggcuuggaucauccaucagcucagacaacagagacuccaaggcagucccuccucuugagcccucaggaauggucaacuucaaccagcuaccuuaaguguagggaaaacaaaauccagaaagguuaagugacuugccccaaaugacucagcuaauaugcugucaccaguuccaacugaucucagaauccacacucuuuuucacuagaccagugaaggcacuaguagcugcuggaucauggagagggaaacagggccuucugggggaacaaagcaagccacaguuacugcuagagccaaccaaaucuuuauuagucucggcagcagaacuaauggagcccccauuuacaggggagcuuuagugggcuagucuggcuaccaggcagggauguuagcauuucuauuggugauugggauagaaagggggaagagacuggaagggaaccaaagggggagacugguggaccaccugagggcaggcacagauggggcuuccugggcugguguagagguggaucaggccccagaggagaacacugccaucuuauucagaaugaaggaugagacaaagccugagagggugacagucacagcuacaaagagagggccgagcuccuggugugagaggcauuucuggacggaggcagcuuucuagggcuggaagucucaaauagaacucaccuguuccccaaccagggguccccagguucagcucaauuguuaucauggguaccagccaggaagcuguuugugggaaggaugggacuugacucaggaguguuuuagguauggacaugugucaguauucacaaaacaggcaauauauucauuauagaugcaaucaugaaacuucccuccagagaaggcucacaucuccccuuucaccuaggaagcuccuuagcuugaaggcccaccacggucugaucccagccuccaccccagcccaaaugaacucccauuuaauuccuuggacaugccaugacguucacggcucugcauacuugccaauaacuguucuuccagccuaccugucuugcucccugccccaccuguccuugucaaaggacugauaacucuucagcuuugucaaguccuuguuuacuccuguucuccccaccaggacucgagcucccuaaggagagagcagagagcccgauucauguugugucuacagcgccuggggaacucgaagccaaaugaagucguauuugcugugcccuguuguguuuagaggaaauguauccauaaaugucuauaacagauuuugggggugucuagugguagaugugaagacuucaagcgauguuuguaccugugaugauagcuucuucccauguggggauuaaggguagggaguggggggaaugguccaaacccggaaggagcuaauggagaggauagggccaaagugggacagggcuuggaugguagaggaugggguccaggaggaagaggagucuagcaauccaagcgcaggggucagugcuccgagucccagggcucagaaccagcagggcgaccacaugagcgagcccagcgccgccccaguggcggcucccgcaagcaugcccauggccagaggggcgccggcgcuguagcagggauccucccgcacuaucacgugcgucacgccagggccugcagagggagacagcccaugaggaucagcgacuuaggagggaguagagugaucuucguacccuuccugcaucacuccagcccaacccaguguaaggcgccgaacccacucuccugcuccccagucaaagaacagaucuagacgcgggaagagcuccacccuacggcucccaggccuuggaucggcuacggaugucccggaaccuacggguccgcuacggcaggcuagggcggagcagcgaggaaacccugagaucgcuaagcacaaccaccaggcgccuaacgaugggcauucccaaccgccaggccccagagcggggaggaggcagcauucccgcaguagccaccaggggccgcuaccggcucaggaauggguauugccgaccgcagggcugaggagccaucccagaagggugaggucagcucgagacgaacgcugguuccagagcucucccagucucaggauggagaggggcuugcggagaguucugccugggaaaauccgugcacgcuaaaaggaugaagccugguccggacuuacggaccgugggcugggccuggcgcugaaucggugcuggaucgaggcaagccccggggcacgcuggagacuuaccugcguagggcgguccguaguagcugcggacauacguggccucgugugcauuggggggcaccaccucguaguagucuugguacgggcuguagacgcgcaccuggggaauccaaccaugucaggugcccaggaacucccuggcccggauuugguccccuacccccacgccuggcacaggccucucugggauccauggagccaccuccccaaguuuagaaaugggccuccagccacuagcaagcucuuggagaaaggcccugcccuccccacaagguccacgguccucuaaaacuucugcccuacauccagcucccagugacacccauucuccaacucuggccucccaccuagcucaaaaaauucucuauggcucccaauuucuccuuauagguagucuaauauuugcuagcagcucuacaauaaugccacuugaaagacccagcucuacuagucacaaggaggggaacauggccaagccccaggcccaggaaauaaacagggguuggggaggaaggaagggaaaggaaggauagggaugagaaguaacuaaaauacaguuaugcgucuuuuaaacaacagggauacagucugagaaaugcguccuuaggcaauuuuaguuaugugaauaucauagaguguacuuacaaacaaaccuagguggcacacaccuagaguauaugguauauccuauugcuccaagccaacaaaccuguucagcaggcuacugcccugaauacuguaggcaauuguaacacaaugguauuuguuaucuaacuaaucauauauaaauguagaaaauguaaugcauugcccuacgacauuaucauggcuacaacaucacuaggugauaggaaauuuucagcuccauuauaaucuuauggaaccaccuuuguauaugugguccaucauugacccaaaauuguuaggcugcacuaggcuguaacgauuauugagcaccuacuauguaccagguccugaaggaagugaucacguguguuacaccaccucuaauccuuaaagcagguauuagcuccacaugaccauaggguuggggacugaggcucagagaauggucaguguucucucuggaaugcauucccugcccuccccucucucccauuagauuucugccaacccuucaaagccuagcucaacggucacccacuccacuccaggaagcucuccuggucucaggaagaauuuuuuuuuucccugaauucuguggaucuugcuugugccucuuguugcuauccuuucuccuggccuuucuugcagcccaaaugugagcugcuuguagacaaggacucugauuuguuugugucaccagcagggccaagugcauaccaggaaccaagaacuaugugcugaauuaaauggaaacuccaaaccccucauuuuacccaugggggagcagaccuggagaggggucaggauccccuucucuucuggaucuuuccucuuagccccauuccacccuguaucucucucuaacugggauucacaccugaacaguccagcuccccuuagaaguccaggugucucaaacuccacucaucucaagaugauugcaacauuucuccaucugcuaaaacuguugcuuuucccauaaaucuuuuuuuuuuuuuugagacagaguuucauucuuguuguccaggcuggagugcaauggcaugguaucagcucacugcaaccuccgccucccggguucaagcgauucuccugccucagccucccagguaacugagauuacagguuccugccaccacgccuggcuaauuuuucuguauuuuuaguagagacaggguuucaccauguucgccaggcuggucuugaacuccugaccucaggugaucugcccgccuuggccucccaaaguacccagccccauaaaugcuucucucaguacaugccaucaccaugcacucaaaucaagaaaggcuaggcacagcggcuuaugccuguaaucccagcacuuugggaggcugaggcgggaggauugcuugaaugcaggaguucaagaccagucugggcaacauggcaagaaccugucucuacaaaaaauuaaaaaauuagcugaguguggugaugcaugcccgugggcccagcuauuugggaaacugaggcagaaggaucacuugagcccaggagaucgaggcugcagugagcaguguuugcaccacugcacuccagccugggcaacagagggagauccugucucaaaaaaagaaagaaagaaagaaaaagaaagaaggaaagaaagcagguuguugcccuugucuucacacaucugcuuuccacacaucagccaccaggucucgugauuuuaucuucuaaauguguucuucugcccauucuuuuggccaauuccaagauaauaggccacugguuuuagcaacuuggaaguugugagugaccuugaaaaaacuuuucagaggaguugcugaguaggaaaagccaagcuauggaggguugaagaaaggcugagaggugaaggaugcaauccccaugucaugacaucucuuucaagaaguuuggugguaaggggaaggucuccaagcacaccuugugauuucaaaucuccaugccauuuuccuuugcuagggauaugcuucucaccucauucaaccugucuuucagacucaacucaagcaucacucucccugaaccucagguucuguuggggucccaucuggacacucacagcccuuggaugucccugcaucacagcaccgaucaugcugucuucacguuguuucccugugucucucccaucagacuuggagaugccuuugagggcagagacugggucuaaucagaucugacuggaacauggcagguaccuaauaaauguuuauugaauucauuccagugaaucaaauacagggccagacuggaacuaagguugcccaacucugaguucaguuucaagucagggaaaacauauagucccaagacaaugcaagaggcucagacaagcaaugucguaagucagugaacucuacggugcucccuccccaucagugauccaauagggauuucugguaggcagugccaagauccaggcuccaggcccaaaagggguuggagggaucuaagcucucagguccaauuuuauugguggggaaguugagguccacagccuccaccuugcccugcugcuacacagugagccaguggccuugggaggcccuggagaggguggagcaccccauaucccucgagggcaccuguuuuuacucuccacgucugggaggcccagaaguaaacuccuauaagucaccuggcaacaaauagggacagcccagagacccaugggcagaaccugaggguuugaaccugccucucccucuccagaggcccagcuacuuuguggguacaaccaguguugaccaaucagggggucacaugcaaaugacuccccuuagcugagcuguuguguuauuagguuuacagucuguuaaauccuaguuuuugacauccccacuuuaaacaaacuugcauccuaguuugggcauggaaaauaccucagaacgaugggcugggagucccagaccugccauugaugaguugagugacccugaucaaguuagguaaccucuccaagccacugaggaucuaacagugccacaucuauacaauuugguggcccaggcacuucuaggcuuagugauucugcacaucagagucaucaggagacaauuuuuuuuuuugagauggagucuuacucuguugcccaggcuggagugcaguggggugaucuugguucacugcaaccacguccgccuccugaguucaagccauucuccugccucagccuccugaguaucugagauuacaccaugucuugcuaauuuuuguacuuuuaguagagaugggguuucaccauguuggcuaggcaggucuugaacuccugaccuugcaaccugcccgccucagccucccaaaguucugggauuauaggugucagccaccaggccuggccaggagacagguuuaaacuacagguuuccuaggccuaggccccaugccagauuaaaacauccagagguggaacaugaauacuuguuauuagugcuuguaaguuccuaaacaauccugauacauagccacacugagcaccacuguguaagaugagcucagaguugacuauaagaucacagguacucucacucaagcccccuccugccacccaccccaugccaggcccugugcugaguucuggggacagagaaaagauucaggccagauccugccuucaagaaacauugagggugaggggagacagaccuagacuaaauuagacuauguaguaguauugcuauaaaggaaguuuuucacucccuccuuccuuccuuugcucacucagugaacauucccugagccccacuguguaagaaaggucagcauagacuccccaucaucgagcacuaauugagcaugugccauuuaccuagccuugugccaaguuccauagaggcagcgcaaucaggccucauucuugccuuggaggaaguucuaggccucauggaagacuacacagacaggaauaaaccagcucugaaaccaggcagaaugaagaaagcacuaagccuuggugccgcuaggcugagggagggaaugacgaugccuaguggucuaggaaguccccacugaguagguggcaggcagccuuugaggugggccuuacaggaugagcaucaguuugucaggugaaugaggaaacugaggucuugucagcagagggaacagcaugugcgaaggcuggcagagggaaaaggucugguguggcuggggacagaggguacagcagagcagcugguuuguguccugugggugauagggagccauggaauguuugucacagggaagggauggacugggccugguuuuggaggcucauccugguggccaguauggaggcagggagggccgagccagcacuuacccagauccgccucucaaccuuacaggggcuccacgagcgggucacacaccugaccuuggagcaaacccggcggcuccugggagggacgguggcuccagcuggggccugcucaagccacagaaacccaagaaggaggagggagggagggggugucagaggcccucuacaccuaaagagacucaagagcucuuuccagacccuaccagagcccuccgccagcugggcuguggcagggagcauccucuuucuccucagcucaugguaacgggggaggcucagagaaugcugaugacugccaaaguuacgcagaaaagaaggacaaguagucucuuuccagaauuagcccacccuccccuauuucauccugcugggguucccagucuccagggaggacagggcgacucccuucuguccucuagcccaccugguccgcuucaccccagccucgucccuagcugugcccccaggcccuguguucccaguaaagcugguguuaggggcuccuggagccuccaccuggagugagguaugaacuccagcaugucggaggacaaagggcaggucauucccacacaggcuacagagagaagcccauaaacagaggugaacacacaaagauagguagacacaggcacaaauacaccccgacucuaguaagcccgggcacagaaggacguguauauguggaguagugggagguagaauagaggccagggcagagagaagggucagcagagccacaggagauggacaggcagagaaggacgaggccgcuucauagagucacagagugcagacagucacccuugccuccuucccuccgccucucuuugguggaacugacuugccccacauaaagaggcuuuggagcucagagccaggguagccugaccugggucccuccacccugcagacuacugcuguagccuccuuacucccagcuuucuccaauucacccgccacuuggaagccugagucugcuccccaaaaucugaccacagcccucgcugcugaaugcccuuuauugcucccuacaggccucagggaaaguccauuucuuccaacuggacuuugaggcccaucaugagcuggccccgaugaccucagaggucaucucuccuguuucauucgccucaugaauugcucuccagccaggcagacucugggcccuuagacgcaugcauaugugcauaagcacuugugcacacacacaugugcacacaucacuucucugucucugcucaugcagcuacuucugcagauaacgcccuccucucaaaaucucacugaccuagguuccaugguaggcuuuuccacugacuuaagaguauaagcuuuggacaagucaccuccccucucugaaccucggcuuccuuaucuguaaaaugggacuaauaauaccaacccccacccagcugcccugccaggguuguuggaagaugaaaugaugucacugcugccaggggcuuagcaugaugccuggcacucaggacguggaugccugaggagguuucuaaaugcauccaggucuccccugcuacuucccaacggacuuucucuauaggugagagggggcuccauugugccauacagagaaagagcaagcacagauucuggagucaggcagauggggguggaggccaagcugggcuuugggcggcucuucaaaccgccacuuccaucagucacaagcucuguugacuccaucuccuaaauauguccuguacucaucagccugucucggccaacaaggccuuaauccagaucuccagucuguugcccggacacugucccagccuccuaaguggccucugggugucugcaguuacccucuauaauccauucccuaccuaccagccagacuaucuuuuuuuuuuuccuuuuuucuacaacaaaauuucauaaacugacagacuacccccuuuuuuuuacaugccccaacguuacaacaauuaucuuuuuaaaaauauaaauugaaccugaucugaucaugccaucccucuguucaaaaacuugucauggcucccuggugcucuuagcagaaaccaacauccuucauacagcccacaagaccuggucgugccaacccuccuucccuccuuacccacucacucccuaagcaccagccaccccagcuguccuucuguuccucaacuugccaaaugucuuaaccucucucagagccuuggcacaugcugaucccucugccuggaaugccgugcccuuuacccgauccccacaccuuucacccagucaauuucuguuuauccuucaguccucgguuuaagccuugccugaacuaccaccuggaugaaagggccagacacugcaaaucucugucagagcuguuauuacuauugaaauggaauaauuaauuaguuguuccaugucuggcuucucauuaggcugaguccaggugggcagagcccauaucuccuugguucaccucugaucccuggcacuuggcacaccaccuggcccauaguagcagcucaguaaauauuuguugugcggaugaaugagcuucagucuuaucaucugcagagagagaacaauaaccccaacuucacaggacuguugugaggagcagcuggaaugauaccugcaccacaccuggcacauaauaguugcucgauaaaagacaguuccuucuccccagcucaugugccacucccuccagcaaaucuccauggaggcuucucucucuccucugagcaccaguuggcucucccuuauccuuuccccgaacacuugggacucaggcaucagaguuugcagaaaccuauccacauaagacugagaacuucuggcagguggagaccgagucugagucacucaugauuccauggcacauggaggugguggggaaagggggagagaacgggagacucaccgggguggaguuugccuccagcagugcugucuuccaugcucugcaaagcaaaucccaccagaccaugaggagggaguuugggggugggugaauugggcccccacauuuuagacuuuccucuccaacccagccucaagcccaagucucucaugaaaggagagaucucuugucucccucaggaagacaaaagugaccccuccccugccccagucacauggauggagcacuaaguuaggcuaauucauucuucucguccccucuagaaguuccaguuuccucaucuauacaguggacgguugggcuuggguggucucucaggggaugucagauucugacacucuuggguggguguuguagcccagucccccuccacaucccaaaucuacaaacaaaacacuuccccaaagcucugaccccagagccucaggaaggcccagcagacacgggacaauggggccuuuguugguugccauggcaccuggcuggguuggacaaggcggcucugugcugucugccuggagcucagcuucccccacucccacacacccaucucuuucacucuccuccagcgcaaaggccauguaccccuuagccagaggguaggaagggacggaaugugagccagcagauggugccugagaaggacacacccaggcuggccacguggauaugcaucugacauuggggugccccugccugggacgcagcugacugccuuuguaggcagguccagggcuaccccucagaucagagucccccaccagggcaucuucuaagaagggagcaagggugccacuaggcugcucugcugcuuugcaucacccucaggugagggcucaccucagaggccgcuaaagaccaggaaccagauaccugaggcaggugugcacaccucccccucagcaauccugaguucacuguagaccacaugaggaguucacugugugccaugccagucaccacaagcccuucaaauccacuccacccgccuccaauaagacucccuugcugacuggccuuagugcccucuuccuacggucagagaaccagaaggcccaaugagaagggggcacaugguaacuuuccccgagauuccaccccauccucuccugggagugacucacagggcaucauccuuggucuccgcacagaggugcaggcggccgccuucccguagguucacagucagcaggccaucucggcuccggcccucugggggcugcacaucuggaagcagacacacauauauggguuuccacaggcacaagccccagguccccccaguaaagcagggacaggaauaggaauugacuucucugggcucuguuuacuggccacugccaaccuccucugaucccauauacucucugagggauuccacucuacguuuccaaccuuuccaaccuuuccaugcugaggcuucccucagcacaccucccaguuacccuguuagaacuguggccugggccuugguggaggaauguggagauuugcugugacucugggccacuucgcuucucugggccuccuaauuucauuucgucuucauccaguaccgagcgccuggagggcaggaacugugccuggcucaccucugagacagcacagaggagaaaggcacuaaaggacugauuuuucuuuuucuuuuuuuuuuuuuuuuugagacagggucuagcucugucccccaggcuguagugcagugccaugaacacucacugcaaccucugccucccaggcucaagcaauccucccaccugagccucuuaaguagcugggacuacagguacacacuaccaugcccggcuaauuuuuguuuguuuuuguuuugguagagacgggguuuugccauguugcccaggcuggucuugaacucuagacucaaguaaucuacaugccucucaaaguacugggaucauagcuuacugcagccuugaauuccugggcucaagcaauucuccugccucggccuccccaguagccauaugugaccgcaucucaccaauuuuuuuuuuuuuaagagacagggucucgcuauguuggccgggcugaucuagaacuccugaccucaagugauccgcccgcuucagccacccaaagugcugaaauuacaggcaugcgccaccacacacagccaaggaccuauuucuuaacucacaccaaacugaauuggaguugacagaggcucagaagcaaugucugugaaaugccucugaaagcugcaaaaagacuuccaacagcaaguguucucggagacagcgggaggcucugcccacagucacggugccacagaggaaggggcuucugcucaccauggcacucugggccgaucuuuaugucacggacauugaaguggaugagcacacgguccuccucguccugcgcugucucaucgugguaguaucccagggucccguccagccacagggcaaaccaguuccgcuuccagcggcggaggauggagccuguacgauauuccagaugcacuaggcaggcugaucccagagccugcugggaauagaagccccagacagacucccaaguccccucagccucagucccuaguguuacaaccaccuuuuucuugucuacccccugaaaugagggcaggaccucuuucugucuuguucaccuccugccucccauugggucugaugcauagcagaagcucgauacacgugcugaacagggaaaugagugacugggcccauuacuuggaagcuucuaaggccaagccccaggucucuucaagggcaaagaccucucccuaccuuaagccugcaucuucucucucucugucuuugagacagggucuugcucugucacucaggcuggagugcaggggcacaggcauggcucacugcagccuuaaccuccugggcucaagugauccucccaucucagccucccaaauagcuggaacaucaggcacgcaccacugcaccuggcuaauuuuuaauuagccagguagguauucuuggagacagugggucucaccauguugucuaggcugguaucaaacuccugggcucaagcaauccucccaacucagccuccuaaaguguugggauuacaggcaugagccacugugcccggccucuuaucucucaucucugacuugugugaugguuauuuguguagcaucugccuccuguaccacucugggggcuauggcuccccacgcagguccuggcacccagggagaccuggcucaguguuugcugaacuaaaugaacugagaaugggcagggguauggggcauggggcugcuugucccagggguccccaggauagcucuugcucaggucaugacucuggucagaggugggucuagaagcccgagaccgagcuucugacauuuugcaacuggaaaucuuaacagggaagggcaaagacauaagagagcuucuuagggcuuuguggauuccaaagcacaaaggcauuuuucacuuuguucugugccucguucuguguccagcccgggguugggggacuguggacacacagagggucaaacccagccccuguccuugaggaguucgcagacuggggccagucuggggucagggaguggggauacccacagauagacaguucuguucuaaggagaucacuguaaggcgccgugaaaaccgaggagggagccucuaauccagcuugacgcuacugcaggagcaggggugggggccagaggaaaagccagagaaggcuccucagagaggggcccaucugagaugggucgugaugaacaaauagaaguuuaaaccauguagucgggaaugggaaggaccuucaggcagagggaagagcauggacaaacaagggaaggaugaaaagguccugguuucuugagagaaguguuccccguggcaagcccaguaagccacuuccuucacccugccccaggaccaggggcccaggaucacucacucugucuccacagccagccgccccucaccagggccauuucuucaaaaggacuuuccagagcggagucaggcgggaccugucagaggagccacgggagacacaggccucagcagcagcucccuggagagaagcccccagcccugccgucccuggggagccacccaggaaacguuugagggaggguuaguaaacaagggccaggcggccucggccuccuccccauucucugcucaggaagagaaugggagcacugucacuguggggucagcagggcagccauuggugugggguggggguggggaccaggagccuggauuccagccucagcuugguaacuuuggccauaucccuccucccuggcccucuguccuggucucaguuucuagaucuguagaagugugucugugaggcaggcagaggcuggagggaggagcucuugaaacauuagaauaugccugacuagcucagucgguggagcaugagacucuuaaaguauuagaaaccuugggauucuguaauguggaagugcagaauauuagaaucacggcaauggaugagggaaaagcucccuccuauuuggaccccacuagagcuguuuacaaagugcuucaaagagcaguucaacagcagcugugauggaccgagcacucuguccggguacccccuaucagugcuuucauccauuaucucauuuaagccucccugcaguccuuauuauuccuauuucagagauggggaaacgggggccggaaagguccagucaguugcacggggccacuugauuaguaagcaauggagcccagacucacacccagcaguccuggcuucaaaccguuaugccggcaggagcuuugagaacuuccgauaccaggccacacuccguaacaauuaaaucagaaugucugagggcaggaggcaagcccugauacucuucaaagauccucagaugauuccaauguacagcuaaguuuggacgucaccgcacauucuacucccucaccuuguccccacucuaacccuguuaggaagggaauccuuacuccuguuuuacagauggacaaacugaggguuagcaaaugacucauccauguacaugauguagcuugcacuggaauccagguaggugcccucuguuccugagggcgacucacuugccagcgggugccuccgccccucccccaccugcucacaccuguugcugcguaacaagggcuggcacaccugggcuggaaggcccagccuugucuguuccucuugccgcucccuccccucuccacggucuugacacagaucagacaagagggucaggugcagacuccuuuuccagccccuccccuugaugcacccaccuugucuacacuuguugcggauguugcugccuaagcggccgcuacucgaugcugcugccacccaacccgcugcgccugcgcuuugugugccccggagagccuggggcauuucucuccucccgcagcgccugagagcccagcugcccccgggccccgcccuccggaccugcccaccccagggagggggagugacgugaagagaugcugacccgaggcguacugggacuuguagucuaccccuguagagcugggcagaagcagccccgccugcaauuuuacuuuucuauuaagacauuuguucacucauuuaucaugaaauacuuuuucuuaagaaucauugaacucaguuccuagaaaaaaagaaaaaguaaaguugcaaggagaagccaagcuccuaguuuugcauguuuuuuugaugcuuccccuuuccauccccagcuuccagucuagugagggagauuacauggaaacacacaauuggagcacaaggugugauuuaacaauggaaaagaugagccugacuuuucucaagggguucaggaaggcuucccagaggaggcugaaaggggccuuggaggaugaggggcaguuuccuaggcgacccgaaauuuccccuaugaauacugucaggauguugaagagugcccagcauuuccgugugucuagaacauaaagcgcagggguggggagggcaucgggagugucaggcgauagagcugcaggguuuggaaagaaauagcacagaggccuugcaugacaggcggagagcuuggauguuaggacgcagugacuggagcugggggugggaguuucaagaugaggagugaggugugugauuagggggucggaaaggccccucuagggcacagugaagaauggacuggcgggagcccaccuggagaaaggaagacuuucuguaucuaucaccucggacugugaucauuuccuucaauagcucagccccgcaaacccucaccuaccagcagccacaggaugucauucagagaccagaggaugucagggccuaaaagacuucugucccguccccuauguggcaagggugcccacccugcccugggcccuuccuccugucccagagaacucuuccuuaccggggcugcagggcucaugguuccuggguggccagggcagcauuucccagaaggcucccgcagcggggcauuucccugagcgccuuagagauaaggggaucaggaaggugcuaccaagugggaggcuggagggggaggcaaggagggagcgcacagaucccaaggaaggucgcccucuuucuccaggcuccucccagccuuuccaacugauggcucugacccuagguucacuagacaagucaucccugauucagaaguggucuuggcucagcaucgccgagguucccggaguggaaucggggcgagguugcgggggcaggacaggaaccgggcugguccuccucccuagguugggggcggggcuacaucuucauucuuuggccuggcaggacagcgcccaucaccccaguccuggcugcgcagucuggcucuuuaagccuuccucucuugcuccugagucucuguaauccugaccucgagcuacccucgcuccucggcc

SEQ ID NO: 15297 - RNA, 20660 nt, Homo sapiens
ggccgugacgcgcgggggcgggucugcgcaccuucccggcccagccggcgauucauucaaaaggcgcgcaggcugcgcggcuguccgggcgcucgccgagccgggccgcggcgccgagucgaacggggagccgagcuggagcugccgcggcgcagccagguaaggagggcgcgcggagcgcccauccagagucugcucuccgcggccgggccagcgggauacggacccuaguggcgcccccugccuccccgugucucugaggaaguucgcgggcucggcggaugcggcagcccggccgcgcgcccccccaccccacuccucccgccucgcguccugucccggcgccuuccgcgcaccggccaccgccagucuccgagccccgugaccugcagguccuccggccgcgacuccgggccggcccugcgugguggcugucggggggcgcgcggggaagcagcggaacuugcggugugaggggccggcggggcccggagcgguccccggcccgggaaacuuggaccgagaccagguuguggugcgggcuggacggcggcgccucggcgcggcugcggcgcggggcggccaagggggggucuggauggugucagcccgugacugugggugacacggcgcgugaggcggccuggccgggcgaacguguggcugggacacugggcggugacgccgggccgagcgggcgacacagaggggcucugugugugggagacaggcagcgugugugcguguguugugugagggaaagacccggggucacuggggucacgaagugcguggcuuggggcgugaccggcgcagggccagggccacccguuacugugagugugaaauagagggagaggagcccaagugacugagaacgagccgagcucgcuggcgccauggugugcguguggggucaaguggugucagugugugugugugugugugugugucugcgccuagggugaugaugaguaagaggcaggaggaggagggaccggaccuaggacaccuuccggcagauguggggcgaugaggaaguuggggagccaggagacaagggucuccaggacuguccccacgagggcaccccucaggaguucagcuuggugaggagauggacccugagggauaggcccuggcugagggagaaagccgaggcugggcaacaucuggugggguggcccagauggcagcaggguaggggcccugugguagucucagcuuccccccgcccaccugcauccacacacucacgcaucgaagucccuacaccuggcaaaguucugccccuguguaaucuguauucucagcggacccggacacaaucuuguucucagacccccccgccccccucccccgcgcaggccucagucuccccaucugcacacugaggugcugggcuuugaauggacugugaaucaucacuuugggauccucuauuguuuugggucaacugccuguguucucccuucccuucaggcagaaagacugcaguggggggugggggcaggcuucuccuggggacacagcggcccaggggcugcacucaggggcuacugauaggguuggaagcacagccuucuccaaaacuggucaaggaaacguuagccucccacccaaaggcuuccugguccucugucacgaaauggauccauagacaauauggauccccaaauccauagacauucacuucucugccuggguguccuuucuucaguuccuuggguugggggagaguggggagagacuuguuccccaggaguggucucuggucugggaggcuaaguucuugcuggagagcuggagcgguacccuuucgccaucugggcaagacccuucugaggccccuucucccguaugaaggucugugggguucaugcagggugggguggaagcugagcucccuagucuaggagaggguggcacuugcuguagaaucuggaaguucugucuucugcugucguccucugaaaaugcugauuacauucuaggggugggggacagggugggggacagugucaggcacuguucugaacacuucaugguguucugucuuguugaaucuucgcagugauucugagauguagugacuguguuucagagaaaggaacugaggaucagagaagcaaagugacuuggccaaggucauacagagucaggacagugccaggacuggaauucaggucuucugaccccagagaccagugagaugcugggagagaggaucacccaccuuccuaauaacugcucauggcuuuccuggacuucugucucucaaacuugggcuaguaggcguggccuagccagggcauuacauugugaguucuaaguaugaugugugugugugcacacaugucuggaacacuggggauggguggguuacauggucuuccuguuccuccccagacuucacucccaaccagacaucaccagaaaguccuguccccugccuucuagagccuggaccuggcuuuggggguguccccauggcuuugaagaguguauggaguuagcagcacagccuagggguagcagggaaaauugagagucccaggugaccuucaucauacuugagaggcccccuccccuuugcaguugcucuagaggcauuuccccaaauccaccugcauguuaugguggggagcagacagggagugaccuugagcuggucccuacucucucugggccucggucucccuguucuucccagagaccccuuuuggcucugaccacuguugccacuuggccaagaacuggaacuggggaucagggugucccucgguccucucugcaaugacuggagcugugcuucuuggggcugaugaaaauagcugucguggucucuaggggcugagccggaguuauuuccauccucaacaaagagguggaaauagcuuagggccugggagggggagcaagaggagaaggguuaacuucuccuuaucccagccuuaaaggaggcccccagccucagccugugcccuggccaagccaaaccuuucugggaacuugggccucuggggaugacaguggggccaggcuggguuuccacuugugaccacaguugggacuggugugauagcugcuggagggagggcccuaugucuagccaaggaggggagauauugagggccagucagcaccugccccuacucauagggucaggcccaaucucauuucacagaaggagagauugagguucugagaauucagggacuuacccuaggacuccuagaaccuucaccuuccagacgcgguaccugccuucuguccugaguuugucauucuguguccacacuuucccuggcggcuggagguuggccagcacuggaagcaggcccaagacacaccuucuggacgucggccugccucauauuccagcucuggccuugccaucccugcccaggcucugguucuagcuucugugcuuccacgucggcucucccgcacacugccagagugaccuccauaaaauaacuugcuuuucgccuacaaaguguaguucaaacuccucaccuggcaaugaggccuuuccuuccaaggccuuucagaauuugcaucuuuacccucgccucuccuugccagaugccuugucugccuugccuuugcuuuuaaagcuucccucuuucuagaacccucuuggccauccagacuauagccccagcuccaccucacccaggaagcccuccuggcccgaaauuagucucccuucauuguugugggccaccugccagguguccucccucacugcuggggaaugggcacagguuuggggcaccuguggguaccgcaugcucagcuugguggggccagcguggccaguagcccacccccucccacugccgucucugugcugacgagaccucuuccugaggaagggcagcugcucuaggaucccagcaccugugugcugggaggcaccgggagauuugcacccaggucucuggugcucaccaugaccugaggcagaaugugugcuggcgggugggggcaaagacucacggccacuccuguggguagggggcaaguguagugcuugucaugguccucgacaucuugagccaguagaggcaacugucccugcucaggcccuguagugugccaggcucugggcccagcauuuccucacaacagcacucacccgggcccucuccuuuccaaguugguaugggggaaccucgacucagagagcagcccuaggcugagucacgcagccacuuguguuguagucagguacuccagauccuacccagcccccagccuggucuccaggcaggaggugagggucgagggguuugucugacaauucuaacauuaguuucucaagaagggccaggcuggucagcacccagucuggcugggcgggaccugacuacuucuguuauggggccagcccuucugccaggucagcaggagagaggaccagagaggaagggguuuugccugagguuacucagcaggguguguuuggcgccauuccccacucaggaucgaugggggagcagggauguggucucuggacagggagaauacccacugugugcugaacccgugucuuucugggccuaggcuuggugcugcugaguggggcuggaguggcagagaggacaagagccaaugcugcaucccuacucugcccauccgugggauuauggcccgggaggcugucacauccucagccuuauacuccugggggucaucauucccuccaagcacaggcagggaaaccaaggccuagagagaggaggcacuugccaggccccagugucacugggauccaaacccaggucugcuggccuugaagaccagaguucuuuccuaggccacucugggaaagaugagagcucuauaaauaagcugcccauguggcugugagcaagugcccuggcuaguugucacagacagagggggacagcgggaccucuacagccaguuagagucagggucugagugugcagguagagagaggagugggggcuuccagaggggggaccugcgcuuagcccagugcaugcacugugaggaggagcagugagaggggaggaccuuggccacccacaccaccagccugcugcaugccuggccuccugcacagacccuuucccucccucccucaaggagccucaccccuucucgaggaaucaagggagacugaaaacugauggcaggggugaggggugggggagucuggagaggagagggggcccucuugacagggaggcuggggaggcuuccuacaggaggggaugccuggcccaaggccugauuguaagaagagccccuguugccugugaacgcugaguccuccaccacaccaugaggucagcugcacugguguaauugggaaacaggcuugggaaguuggggcuggguuccugacugcugaacuaccccuuacauuccugaccauggcccuggcuggugugggagcagguggacguaggccuguacaggggcugggacaugggcacccagggcccucccagagaggccgaggccccucuacuugugcugccaggguuuacguggaguuccccaaagcacucuugccacacccaagccucugggugaccucggcuggcuguugcuugguccugagcuuggguuccucuggcccucguggagcuguguugagagcccucaguaucccaugaggcagggacuagcaccccuguuugcagaggaagaccccgaaacucagggaggguaaguaaccugcccaaggccaucgaucugcgaagugacagagccagagucugaacccugguggguugcuccagggcccaaccuugucuccucccugcuccaccacugcacuugcacugaccccaguccucagcguagcuccacuggguaggaccugaccugggauggcccugggggcgccucuuuccccagcaccgcaagucuggggagaguuggagaauggggcagaccagggcuguggucucccccaagucccucccaaagccucugcccaggucuuccaggucagggugauugggggcagggcccaugcugagcacauuagggacuugggaucaguuuuauggccggggcagguggcaaagguggcuucuuggaggagguagcagagcaugagccggggcugcagugagguguccuucagcacccccagacccguugcuguccugucucagggccaggguuggcaacacagggcugucuguggugcugagagguugacgguggccagaagcaguggagauaccaggccuggguggcucaggcaggggucgccugccaguugccccuacuccaggguagguaaacuucaucuccuucaaggugaaguuguuacaggcuaccacuugaccucucugagccucaguuuuuucugugugaagcauggaacacugucuuugagggguucagugagacccagcuuagagugggaaggggacaggcaguagugcucagugaggaggguuagggagccuccucucugcccgagauaacugucuggucucagacaucccuccucuagccccagacucggcccaggaaguggggcaaggauugcaccuguaccauacccagacugggaggagcugggugggccagguguggccaccucagcccuuuucuuggccucaaggggccaauuuagcccccuuagccucagccccaccccauccaccugagccacugaaacccaggccugguggcagccaggaggucugaggugcagaaccaugcccaacuucuggggguguugcugagagugggcuggggagcagcugcugccuggccucgaggugcuccccagcccuugagggacugguuuauaccccaucguggugaccugggagcucauggcugcccagggcugugggagggggcaggaguggagcaccugucucacugaguggcccugagccagccucugcacaucucugagcuuccagcagcagcccuaguaagcugggguuccacccugggaccucuuuuuccccgcucugggaauucccagacuuccccggucuuccugccucuuucaguucacagcucccuuuccugccagagcuggcacagacuagaacaauaugcaaaugaguauagaugcaggcaacuccuagaggccccaugggauggcggugcagacagcaccuucuccuggggcccuccuggguccuuaguaacagacccucaguugagccaccuacugggugcuacuagcuugcuagccuccaccaucagguuggcaaacacugcaaggacauuuacuaugugccagguccugggcuaaguugcagggcaaaaggaggcagaaaagagacaguccugggcuccauuccugcuucaucucuuacuggcugugugacccccgccagugaccuccccugaccucaguuugcccagcugugaaacaggaaugcucacuucuccugcaaggaaaggcagcaacccaggaugagggcccggccugcacagggcugggguccauuccuuucccugugaguguggaagagggaaagccacucagcguggucgcugcccuacuucagccccacuugccagggaaccgcugggcuccuugcuaaccuggauuucucuguugauggguggccuuugucuuccugccuuggguguggccaccgccaagggaggccuguguccagcuguguuuccaggcaacccuagccucuggaggccagagggagguccacaggcucaggagccacuaucugggaagcagaguagcugccucccuaccugcccuccuccaggugggcaccagcccccaccuccaucucccccagugcggccucucuuagcaggcagccuggggagccugcugagaccgaacuguucauucuucuccaucccuugcuuaacccuuccuggcucccauaggcccuagggggaagugcaggcuuuuuggcaggcagcugagccuuggugugaccugagcacugcccaccaaccuucccagacuccuccagacuccucccgucuucuccgcccucccacccuccagauucccaccagggcgaacccagcaccgccuguauaccagacucugugccaggcacugaacguaaauaaaagguuugugcccuucuccuccacauuccacacguagggaaacugagucacagugaaguguggggaaugcuuacucugugccaggccugugcugaguacuuaaugugauucucuucuuucagccuuaccacagcccucugcaggcaggccacagagccagugcaagacagagcagagcaggacugcaccccauacuuuguauccccagguuagcccagggguucagaucuggguucugacccaccccagccucugggcuccuucccccucagccugcucacuggcucuucuagcucggcauagcugggcucucuaccaagagugccuuuucugccuucucccccaaaucagcccauacccgcccaggucggcacugggcauggagcaggcagcucgugguggggaaagggcuggguaauaggaucugcauggcaccaugaaugcugagggggaggugggggagaggguacuuccaggaggaagugacuucgagcugagcucuaaggaagagugggugcuggccaagcgaugaggggagagcagaaagcaggugcagcgugugugaggguggaaagcacucagcguggcaggcgugugggugggggagguuggugggggcgcgucacgacgccauccugaggguggugggagcuggcccagggccagggccagaacugggugucagggcaccuaggcugcagggcgggacugaccuggaggccagagacagggcaagggggcaagagcaaugggcgcaggccuugggagagcuuagggacuguagggaaggggagggcccugccuaggggagggggaguggcguggcagggcccgggugaccccagcgagcuucaguucugggaaaggggaagcugccuguggccugggcugguggcacagcuuccucuuucucugaggccuccaggcugcaccucccuggggcuccaccaucuguggccucaaucguggucuggggcccucagcuugggggucuggccguggccuuugcuaguuggcuuuucuccagggaauuucugguucucauuguucgggcauuuuuuuggagagcugagucugaggaaacccuccccgccucgugagccugcuuggaggccucccgcuucagacauggggcuggguguggaguuuuguggcaaauaaaacagacgucccugcccucaccacugucuggugggggagcaaggaauaaacaaguaagcaaacaaauacuuaaucacagcccucugccagcagggcagaggagaagggcuguggagaaggaaaucccaugaccuacuuuagcuucauuaccuccuuuaaaccccaugacuggcugggcacagcggcucacaccuggaaucccaguacuuugggaggccaaggcgagaggaucgcuugagcccaagaguuggagaccagccagggcaacauaaugagaccccgucucuacagaaaauaaauuuaaaaauuuagccaggcaugguggggcaugccugcaguccuaguuacucaggaggcugaagcaggaggaucacuuaaaaguucaaaguugcagugagcugugaucgugcuacugcaguccauccuggauggcagagugagacacugucucagaaaaaacaaaacagaaauuccccaaaaacuucgcgacagccaugccagcaagaugaacguccccaucucuguagaugagaaaacugagacccagugaugugaaggucccaaagggaguugguggcaguggagacugggccccaggcuaggagacaugggaggaguggccucuaagccaaguuccuucucugcuaccccccuggggccccuccuccccauccaguguggcuggguguggcucuccucugucaggcaucggaggcucuggggccucacugacugcccagccuuuaggaugaggcagagacggauaugggaccuucagauauccccucccagccgagggggcuuccaucuaacuguuuuuuuggucacgguuccagggccguuuuagacaguggaggccuuguggggcagggugugaggggugcugagcagcagguguggacaugugugugcaccaggccuuucuaccugaccgggcaaguccagugggggcucagucugggcugagugugggggccgggcagccagacuggaguaagugcugguuugggguaaugagaaggugcguaauuagaaggugcaaggcccuagguggcagugucuaugcgugugcuggagugggcccucguuggcuuugagucugggccuuuggaccccgcuuucuuccuggaagguucuagaucacacagcucugcgucugucugcagaugagcagcugcacagcugcucccugugggcucaggucaccuagcaggugccacccaggguuggggugguucuagggcucucugcugugguugcuuggccucuuuucacccccgcaucagcccucugggccuaccuuggggacauggagggcugcuagagcugggggcugggcuguuggguuggucacgguucccccuggcuuugucuuuuuuuuuuuuuuuugagauggagucuugcucugucgcccaggcuggaguacaguggcacaaucucggcucacugcaaccuccaccucccagguucaagcgauuccccugccucagccucccgaguagcugggauuacaaguuguaccaccacacugggcuaauuuuuguauuuuuacuagagacgggguuucagcaucuuggccaggcuggucuugaacuccugaccucgugauccaccugccucugccucccaaagugcugggauuacaggcgugagccaccaugccugccacagccugcccccacccccagcaucaggcucugucuugcguagucaggccuaguggggaagugaagccugaggacuuggggcucguggucaggucuguggguuagaucccucaaaggacagaggaggggccauggggagacaggcucgaggugggagcugggcccugacaagggcacaggacacuuuggggcagaaacuggaaggaagacuugugaccaaauuuaaggagugacaggggacccuccccaaauagccugggggugccaucuguuggguguugacugccagguguggccuccacccuauacuguggcccuaccuucuccugucccuggcuuuccccugagcuggccugggacccagaguggcugccagugaccuggagaguccugagaugauguaacugcugcccacucccuccccugaguguaacucaaacccugggccccucugagaucugccaagagggagggcggguggacagaucgguuuccugggcugcuauucuaggugggagggccgggcugccugcagggagaggacucugagugauuugggacuaccacaggaggcgcuuuucucaccucaccggccuuggagucacagcgggggccucagccgcggcggcccugagccaguggcuggguucccaggcugccccugggcuuaagaggcugcguguggccugaagagcacggcuuuccucagccucgugccccugaagccaggccuccaggaaguacacagcggacuuccuugcucugccaccugucccuucugcugucugaugugaauccuuuguccugcuguguccgccucguccacuggccggaggcuucuccagagcaggccaccgucugggccugggggccucagucucagaccggugggccgugacgccaccauggauauuucucugaaguaucacacacugcacucccacucugcuuuauuucguuucuuggcacuuaccaccaaauggcaggggcaccucucuguuugcaguugggucuccccugggauggagcucccugcagacagggaccuugucugucuuguucauaccgauuucuccagugcccgcacgcaguaggugcuggagagaugacaaagacagagcacuggcugccgugaccaccccagccccauaggucugccaggggaagagcuguggccagacauguuccagccucaagggaggagucagccucccuggaagagguguggacaguggccaugcagaaggaccaggaccuagaugggguggggagcugugggagccagacccacuuuggggaaagcuucuagagaagcuucuggaaagagaggccuucguguugagcuuugaaggguaaaggaaaaggccuuccuuggaccagaaccagcaggagugaaggcagaggccgggcaugcuugcagaccugugaggaggaggcggggggagccugagccuggagcgcugggcuggaguguggaggccgggcugggguguuggguguugguugcaacccugucaucacggacacaggccgccacacgcgcuuccuuccccugcugaugccucggggcaccuggcaguuuaaggaaggggaaggaagcccuuccuccucugggaagccucccagccugcagagccuucuuccugccuuccugccugugcugccccgugaggccggcucccaggcagggcagcccccucugcuugggccugugcuugcggguguggagccggccuccccgggcucugccugcccagcagcaccuugccugcuccccaugaguccugucauccuggaaguggugcugaggggacagcagcugccugccugucccugccgcucugccgagccuccucuccaucugcccuaggccggcgaccaccaggggccugaggaugaagccaagucugcugugccggccccuguccugcuuccuuauggugagcuggggaugggcccugggaaggagaaaagccgcacccucagcccugcagcccuccagcaagagggugcagacacucccggggaacccccugcugggcagggcucaguuacucagcucgucaagaaucugaggcagcuggacccuaggaagcaccucugggcccacccaggcuugucagggagauggagaaugaagggcuugcuggcauuuaugggcaaggcaggcauggcugagggcaagaugcccauuggcacgcaggcaugagaacggagcccagcccagaggguaugcugggcaccaagaggaaacugggcaaaagaggccugggauuuggacccugagagccauagcaccucaggugcugggguucaagaucuguauuggucugggggaucccagauuccaggucccaggaucacaggaucaggccagcugcccggagcugcaggcaaguccacauuacagacuugcagcaucuuggggucugcccuggggcccaucuuucugcugugacgcuagaagcucagggagggugagacuuggccuugggccuugcuaaggguugcuccauguacaggaggccuuccagccuuagcaggugcugggagccgcucuggggucugaggagaucccuauuccaucuccagggcagcugaugguagccucauccagccuaggccaaauugggggacucuaggagggauucaggagagacaguucauuccuaagaaugggaagcagagagaacuccuagugaaaugggcuggggacacacacugagaagauggagcuuucuuuugggaugcgucucccuguuugggugugugggugugaaugggguagccucgccuugagggaagauugcagaggaggaugugguccuggagacuuucgcugaagggagagcccagaauaggaagcgccaccugcagacuuggcuccagggauuauaaaugaggcugguuaaugauaugcccagcugugauggggccagggauggacccaaaguaggaggaagugggggcagaauacgagagaggauucggaagcauuuccuccucaucguucugguuagcuggaagggcuugagauccugauguggccuuaucuggggcuuuccagcacuuuccagagccagauguggcucucuccuugcccagguacuggucuugcagcaggucugggacaggacagguuuuccucagugugagggauugagguuagaagagugugucccugaagcccgggugggguagucaguggucccuaccacugggguuucaggaaauaggugggggauagaugaccccagagaccccacacccagcacuuucugccucuuucaaugccuacuguucuucuagcugcugcccuggccucucgccacccugacaucaacaacccuuuggcagugcccaccuggggaggagcccgaccuggugagcauugcccugcucuccugccuguccugggagggcccugagggccaggggcagaguccugugccuggcccccaaggguccucaggcuuggcuccuggccaugcucucacccuuuaccucccacaggacccagggcagggcacauuaugcaggcccugccccccaggcaccuucucagcugcauggggcuccagcccaugccagccccaugcccguugcagccuuuggaggaggcuggaggcccaggugggcauggcaacucgagauacacucuguggagacugcuggccuggguaagccaaagggagugcggggagggcuccuggcugggugaccaggacucuggauccuggggccccagccuuauuguacccugagcaggccucauucuucccaucugugaaaugggauggggcaggaccacggagggugccugguaggaaggaauccagccucuccuaaggauaguguuuggggaaacuucugggccucagugguaucuucccuccucgcaggugguuugggccuugggggguuccccgcguuccaugucaaccauguuccugggcaccucuggguacucauggcugugauggugaguggcagacuggggcuaggacuggugcagggguaugugcgggaggggccagugaguuggagcccagcagccucugcaguguucaugugggggcagugggguccuucuuccagcccagggcagggcgugcagccaaagggucuccagcagggcacagucagccgcuccccuggcuguuucugcccaccaugcuuccgaguggcagagaguguccugcagauggcagccacagcugggggcuggggacucacauacugaccuguccccuguccccaucccuucaaagagauucaugccagccaagugcaguggcucaugccuguaaucucagcacuuugggaggccaaggcaggaggaucacuuugagaccagcuugggcaacauagcaagacccugucugcaaaaaauaaaaauaaaaaauuagccgggcgugguggugcuacucgggaggcugaggcgggaggauugcuugaguccaugauuuucaugcugcagugagcugugaucgccccacugcacuccagccugggcaacaagugagacccugccuaaaaaaacccaugcagaugagugugcgcaugcaaacacucacauacccacacgcaccuccucccgccacugagucagucacccccugaggcacuagauucauggccaggccacagggaggcagaucccacgucccugugcccagacauguguccugugugccaucucuucacccccugaccccagcgugaggggaggguggggcugggugucuggccguccugaggaggccuuguucaggacaaugcuucgauggccagaagggaaaacaggagggcaguggguugaccuuugcauccccagcauggcggggagugggcuccccugggcacauuggcucuccugcagcccccacugacucgggcccugggccccugucucucuguguuugugucacucugcuuuuguccugccuccaucgucugugaugcucagagugggggcggcgggcccgacguggcguggagguggcagcaggggccagcagcgguggugagacacggcagccugggaacggcacccgggcagguggcccagaggagacagccgcccaguacgcggucaucgccaucgucccugucuucugccucauggggcuguugggcauccuggugugcaaccuccucaagcggaagggcuaccacugcacggcgcacaaggaggucgggcccggcccuggagguggaggcaguggugaggcccagcugggguccaggugggaaggacgggggcacgagcccagccccagcuccacuugggggcugccagcggaauccugccuggccucuggggucugagagggagaggcuugggaggugauagcugcagacugacaacaugggaggaaagguaaggggacgaagguguggccgugggggcagagcagagguggcacagcuggucaaguggcuucaguggauccuacccugggugaagccuugcccagauguggggaucuggacucuuuggaggccacaguuguguguaugguuccagggucggaugguggccuuggaguuacucaaggugaccucugaccucuggccuggaguagcaggagugcccuguggcaggagggcuggcagggcagcuguccuguccugggcaggcaccauaaggggcucggguuuugguuccaggcuguaguuugaguuacaaggccuggaaccggagggacaggcaugcgccaccaccuucacccccagggccccgggccccuuuccuucuuccccacaccacuacuccccugcagggcaggggcccacucgcacacacccugcccugggcccaugggagccuguggcuaccucaagagugaaauggcaucucccaugcuagcacccucggcugucuggggcuggcaugggagccagagacccuucuaaguccugacacugaagucuggcgggggcaggaagcggacaggagcaguaagccggcaggaggaaacguggugacucagggccauuuugccugggacugugcuuguuuuccuagagacuucccuuuaacugcuggaugcugccugggugcaaguccugggagcucuguuugcugcugggcccagggcugaucaucguggcccauucucacacccuugagauuugggcccaaagcugacuaggggcacucaguuaaauuguuacauagggcacaguagagaggccauggaauagcaguuugcuguagauuuggggaguucuggguaggguggcagcccacagcuccuugaggcugaggaggagacagugcagacccagaagacgcugacgcaccgcccccucgcccgcccaauucaaugacuggaguucacguggcccugaagccucuaugcacccgggcuguugggugcaggaagcacugguguugaaucaugaaggugauaugggcuucucugagccuggaucccacauuugcagggcucugggaggcuugucaccuaaaugcacaugcucagggcccuuaagaaggccaggguugcccucugcuggcagaucaugguuuagcucaggagugcggcuucccccucuuccccaggaucagggcccuucucuuccccaggaaucaacccugccuaccggacugaggaugccaaugaggacaccauugggguccuggugcgcuugaucacagagaagaaaggugaggagaaggucugaccccaucccagugcccaggagaggaggguuuccuccaggagccugugaggcagccgcggugggcagagucuugcccugcucugccuucccugccagggugccucaagcagccuggugcucucugacccaggagugcacaccucugccucccauucuugccugaugaagugggaggaaaaggcgcacagcccaggcugggaguggugguauggaggguaggugggggguucucugcuggggcagggggugggaggugugucccauauggccacagugagggucugacugcagcuacccacagagaaugcugcggcccuggaggagcugcugaaagaguaccacagcaaacagcuggugcagacgagccacaggccuguguccaagugagugggcuggugggagauaacggggccaaaaccuacauuaaccagccugccuccuggggaucucccacuugggucucccucaagucacccuguucccugcuggggucuccugccccuggccuggccuauggccacuucugccugugcccccugcaggcugccgccagcgcccccgaacgugccacacaucugcccgcaccgccaccaucuccacaccgugcagggccuggccucgcucucuggccccugcugcucccgcuguagccagaagaaguggcccgaggugcugcuguccccugaggcuguagccgccacuacuccuguucccagccuucugccuaacccgaccaggguucccaaggccggggccaaggcagggcgucagggcgagaucaccaucuugucugugggcaggugagaugggcacagaugcagcaggggcagguaaagacgugacagccugggggccgggagggggaggcagggccccagcuugggcccugagcacccugcucaaugggagcccugcccuuauugggccucucugggcaguggaggcggccagagagaucaggacuuuccgguuauguugugucucacauggagcccuugcaucccuagggcagcaucuuggcccccauggcacccgggccucucaggcuaaggcucugguccaugaacuugcugugugaccccgggcacgugcugccuucucugugccccgggauccccgcuaacggggaugauugccccacucuccucacagguuccgcguggcucgaauuccugagcagcggacaaguucaauggugucugaggugaagaccaucacggaggcugggcccucguggggugaucucccugacuccccacagccuggccuccccccugagcagcaggcccugcuaggaaguggcggaagccguacaaaguggcugaagcccccagcagagaacaaggccgaggugagagucaaggagaaaggcaucuguuggcaccugggccaacccugaccgaagacggggcagggguggaagugcagcgggcccuaggcaggggccacuuuccuggagccagaagccagccccugacucagcucugaccccucaccccugcccaccaggagaaccgcuaugugguccggcuaagugagagcaaccuggucaucugaggggcggucuagucuaaggacacugcggcccugcccugggagguuccgaaggcuuccuggaggagguggagcugcagcugggacugugaggaccgagaagcaauggcccagcagacgagacagcaaagaccaaggccuggaggugggagcgucugccccagugaggaggcagguggccggcgggcacuguguacaggagcaggcugagccccgccccuggcccugcugccauguugcuccccugaaggaugccccgacccccgugccugcccuggcuggauccuaggagcccacgggauucucuguaucaucagaggcugggcuuggcagaggggaggggccugugcccgucaccccuggccccauuccuugguaauuagccacacccuugccucuguacagggcccuagagcagaugugcgucccccuccucuuccagcaggucuauaaagggaagggguagcagaaaguccugggcuaggagagugagucccuggguucuaaucuugggcacaucuguggccaucgcuggguccauuuuucugacugugaaguaaggagagacgucucaguacccagggccucuucagcucuuuguagguucugggcuggguugugggggacuggggagcugggcucuaccaucccucccauuaguagcuuuauccagccccguuuuugcugcuuccagggccucugccuucaaggcccccauggggcuguccauccauggcucugccuacggaaggggcuuaaugcaugugccugccccucccccagcuguuuuuaaugaaacugaaaaaauagacuugaucccggcaggacugugauacagagcccuagccugcccagccagccccaagaucucaggagcuuuagggagaagacuugguggggcuggagcacaccuugggccucagugguuucugugucccuguggugccagugcuucugggcagugcaggcggcugccaggcccagcccugacuuccacucuggcucagcaaccugguuauuuauguggggccgugcaggcaugggcccacugccuguccauccuguuucucuuauuuauugaaacucaccauugcccuauccuugugucuccacccccuuccauguguugaauaauaaaaggugggaaagugcugucacgaggagcuccuuuucucugugcccuucccagcuuauccgccuguuccacuuguaccuguccagcccugcccuguguugggcaccgugacaggcugcccuccccucacaguuccugcaccucagcagccagggaagcagggcccagaggagacccaucaacucaucugguucucaccaaagccccuagcuagaggcagggcugucccacagaaauagugugagccacauaugugacuuuaaauuuucugacagucacauuucaaaaaguaaaaagaagcaggugaacuuaauuuuuuuuuaacccagucuauccaaaauauuuucauuucaauauaaaaucaguauaaaaagugu

SEQ ID NO: 15298 - RNA, 63248 nt, Homo sapiens
caaaagggugccaggagcgagcagccaagggcguugggcaggcggacgcagagucgaggaaccaagcgcugggaucccgcccaggcggugccgcggugccccuggucgcuccagccgcggcgggggcugggccugggggucggcgcugaggcgggaggggccgcccgggauggagacguugcggccgguggccacagaaacuugagccgcggcagagaaaccucugcuccggucucugcguccucuucccacacucccgugcgcugcuuucggcgugggccgcugcgcuccuagggagugggggcgcaggggggguuggccgcggcugcccgaggccagcccccccggagugaguuacgccacuauggcggacggggcaccccggccccagcuuuaccgcagcgucucguucaagcugcuggagcgcuggagcggcggccccgggcugagggaggaggacacggacacccccggcuugaggcgacgcgccucgugccggccgaccacggcugcccggggccagcccucucggcgcguguccaagcuggcgucugggccccuggccgcccccgcgcagccgcgcccgcuccgcagccucucgccgucgguucgccagcucucccggcgcuucgacgcgccgcgucuggacgacggcuccgcugggacccgagacggaggcgucuuacccgcggccgcggaagaagcggccgagggcccagcgcgaggagccuggcccagcgucaccgagaugcgcaagcucuucggcgguccuggcuccaggaggcccagcgccgacucugaauccccaggaacgcccagccccgacggugccgcgugggagccuccggcucgggagucgcggcagccaccgacgccacccccucggacaugcuucccccuggcgggucugcguucggcgcggccccugaccgggccggagaccgaagggaggcugcgccggccgcagcagcaacaggagcgggcgcagcguccagcggaugguuuacauucuuggcauaucuucucccaaccgcaggccggggcccgggccuccugcuccuccuccuccaucgccgccuccuauccugucagccgcagucgugcugccagcuccagcgaggaggaagaggagggcccgccgcagcugccuggagcccagaguccggccuaccacggcggccacuccucgggcagugacgacgaccgagacggugagggcggccaccgcuggggagggaggcccgggcucaggccuggaagcucccuauuggaucaggacugcaggccugacagugauggguuaaaucuaagcagcaugaacucagcagggguuucugggagcccugagcccccaacaucuccaagagccccuagagaagaaggacuccgggagugggguaguggcucuccgcccugcgucccagguccccaggagggacuucggccuaugucugacucugugggaggagcuuuccguguggccaaggugagcuuucccucguaccuggccagccccgcaggcucccgcgguagcagccguuauuccagcacggagacccucaaggacgacgaccuauggucuaguagggguucugggggcuggggcguguaccgcuccccuagcuuuggagcuggggaagggcuccugcggucccaggcucgaacccgugccaaaggaccuggaggcaccucuagggcauugagggauggaggauuugagccugaaaagagucgacagcggaagucccugucaaauccagauaucgccucagagacccugacgcuucucaguuuccugcgcucagaccuuucagagcugaggguccgaaaaccuggugggagcuccggggaccguggaagcaacccccuagauggcagagacucaccauccgcagguggcccuguggggcaacuugaacccauacccaucccagccccagcaucaccuggcacgcgccccacacucaaggacuugacagccacucugcggagagcaaagucauucaccugcucugagaagcccauggcccgccgccugccccgcaccagugcucugaaguccagcuccuccgagcuccugcucacaggcccuggugccgaggaggauccgcugccccucaucguccaggaccaauaugugcaggaggcccgccagguuuuugagaagauccagcgcaugggugcccaacaagaugauggaagcgaugcccccccuggaagcccugacugggcaggggaugugacccgagggcagcggucccaggaggagcucucaggcccugaguccagucugacagaugaaggcauuggggcagacccugagccuccuguugcagcauuuugcggccuggguaccacagggauguggcgaccucuuuccucauccucggcccagacgaaccaccauggcccugggacugaggacagucugggcgggugggcccuggugucgccugagaccccucccacaccaggugcccuccgccgacgacgcaaagucccaccuucagguucuggugggagcgaauugagcaauggggaggcaggggaggccuacaggucccugagugacccaauuccucagcgccaccgggcugccaccucugaagagccuacuggguucucuguggacagcaaccuccugggcucacugagccccaagacagggcucccugccaccucagccauggaugagggcuugaccaguggucacagugacuggucugugggcagugaagagagcaagggauaucaggagguuauucagagcauaguucaggggccuggcacccuggggcgugugguggacgacaggauugcuggcaaagcccccaagaagaaaucccugagugaccccagccgccguggggagcuggcugggccuggauucgagggcccuggaggggagcccauccgagaaguugagcccaugcugccuccauccagcagcgagcccauccuuguagagcagcgggcagagccagaagaaccuggugccaccaggagccgggcacagucugaaagggcccuaccugaggcucugccucccccugccacugcccaccgaaacuuucaccuugaccccaagcuggcugacauucuguccccgaggcuaauccgccgaggcuccaagaagcgcccagcucggaguagucaccaggagcuucggagagacgagggcagucaggaccagacuggcagccugucucgggcccggcccuccuccagacacguucgccaugccagugugcccgccacauuuaugccuauuguggugccugagccaccaacuucuguuggucccccuguggcugugccagaacccauaggcuucccuacccgagcccaucccacguugcaggcaccaucgcucgaggacgucaccaagcaguacaugcugaaccugcacuccggugaggucccugccccagugccaguggacaugcccugcuugccucuggcugcaccgcccucugcugaggccaagcccccugaggcagcucggccugcagaugagccuaccccugccagcaagugcugcagcaagccacagguggugaguccuuuguaggggccuucagauuggggccaaagaagggccaugggcaccgacuucgguuggagccuuuugcauuguauucacuggucaggugcccaggugccaagggugcuuuucugguccuggaagugccugugcaguuuuaagaguuguuaaugacacagggcuccugucuacucaggcccuguagaagcuucaguuuucugcuggugcuaauggcaaagggucuugucugcuccagguguucugggugguaauuacaaaggauucuuaucuuguccuuuggauguuucucagggacugguuuuggaaaucccugugugguucuuuguuggagggaugagugugauggcacccagcgcaggcucaguccuuucucugaggcuugcuacucuguuggccagacccuugauaggauguuuggcucaggggccacaguugacauggguuugcccuucuucguguggcuuuccugugacaggucagaauauagauguguuccugggccugggagaauuggggagguacaaggcuuuacuuuauggaggagcagagggggcucaggguucuaacugcaguucuguucuugcugugugacauuggccuuucucugugacuuaaucuccccaaucaggggagauagguggacaaacuagugccuauguuuccauccagcugguacugugcagauuugggggagccugcgguuuugaguuggggacucuuggggccugaguucugccagagccuccucagaugaaaaaagcuucuagaugggggcuucuaggggaggauagaggcagggagggggcugcagaggcugggcagccagggcccuuuagagaggucaggagugguucugggccccauauucagggcugccucuaugggucuggggggucgguucuuguucccccauccugucugcuugcaucuuuuccccacucuacccccuucuuggugacucugagaugcaccccguuucugccagacccccagcccugggggcucacucucccugagaccccuccuucuaccuucuggcuucagcuaucccuggaguuuaggcuguggauucagaugggauccagauggcauaugcccuggcaucuggguugggagcuagauuccaggcuguggauucugagcugagcucagcgauggccagugguuacuucaacuguggccugcgcucccacugcgcucccugacugugugagaagccuggaaauuauaaacccuggacugauucagucacucccuuucccagcacucucauggccccucugaacucccuuucucuuuguuucucucuccuugucuccaguuaccccugguccuggcucugggguuucucauggaggcugcagagagagcaggcagggaguggggagcggggcguuuugaaccuguccuuccuucugagucccagugagggcagcuccggugccccugaacuccagugccaguucugaaggugggggaggggaggaagacagcagguccaguucuugucaggggucuccuccccagccuccuuucccauauaucuuuucugggagccuugaaggcucaaaugggggagaggacaggaguaaaccaagggacucagggagacugaagguggguugggggugcuucuaagagaaggcuuugagacccagagaggaggugggaguuuacagaacuucuccugccccaccucccuucacauucuccucuaccccccaccccuuucuggagcucugaggcgggacagaucugccauaacaugggcuucucccugccacgaacagaggccuucucugaucuccaagcuuuugcccacuccaggccucucacuuuuccaggcccagcuugauguccccuuagggggagguaacuggugagucugucauuagaagagcagggugugagccuugcucuucugaucccuguguggccuaggauccaucauaucccugcucugugccucacuucccccuuccauaaaauggggguaauggccucugccuggcaggcugucucuuguggugaauggguggugugaucauuuccucucugguagcaggaaagaagaaaaauggaggcugcacugcccagcugcuucucagccaccaggcuuggcuugugaacacagggcuggguccucgggggccucaguauaaccugguggacugcaguagccucugagaacauccaucauccuccaauuucccacacccucauaaagccuggaaguucucccaucugcuagcuugaaccccuccugcuguccccuuccuucuggcucccagaauauggggagcagcuguccacccccuccugguggccucuguugaggagacaauguucccuuguuucaagccugaggcuccagucaugcucccugggccguggguggagauggcgugguauggacuccagaauaagcagagacgagaggagcugucauucuuugcuucuggcagucccuggggacuaaggggaugccccccgccccccaggcuguagggaguccuucacccucagguccacauucgugcucugugugguguugcccccauugccgggaagugggaggccuggggccaggccuggcucagccuuugacucacucagaccuggacagagucaucuuugucucucaguuuucccaucuguacagugggagguuagacugccuggucugugaggcucagaaggagggagucagccugcagggggugucaagugaaaugggaggagccagcgguguggcuggaggggagagaaaggcagcugucugcaauagcugcaugaacccaggagaacagggaguaacaguagcucaugggucauuuauuccaggaaugccugucugugugccgggaggugaggaggcagagcugucaggccucccugccccgccccucccacacucuuguuaccuccacugaggcccacuguagccugguuggucaacaacucuuccugugagggagagcuucccccgccccagccucaaagugcagagucuugcagucccaccuucugcccucaggucccugauacccguuugacacaugccacaacuguagcccacagcagggggugacuugucucucagcaucauaggcagaugaacucacgaaauuuuaacauacugaaauagcaguaacaaugacgaacauuuaucaagugcuugcuaugugccagacacuaucuguuucauucuucaacugugaaagcuguggauaucuuacagugcagacuuagagucgaagacuguuggauucacccugaauccuagcauaucagugucuuagaggugaggggucccaaggagauuggccugccaucugaguagcggggacaagucagcagacaguugggagugucaccuccacauccccaacagccugaacacuuucauagugguuauuuaauucaccagggccugggguugggaugggaagaacuuugagacccagaaagggagaaugcuaggucuaaggucacacagcaagggcgggcagaaccaggcccaugcaccaggacccuggccuuguuccucuccacucagacccccucccuacccagccagcucccugccuugcugaugaaggucuggcaacagcucuucuagucacccuucuuucuccccuuuuggcggggaaccugcggggguggagguucucuccuuccccuccuuggcucuuugugugauuuuuccauggaaacugguucuggggggaaaggaggaggugauuaggacacuuggaauucugagcgguaccaaauaucuauaauuaaaugucuugucacccagcaggagggggugagaugagggaggacaggcagaagggcagccccuuuccucuguuuauuccucacaucuccucccaacuccuuccuaagggccugggcucuuggggggaacacuguccaggaaugaguccuccccagcgaggaaggguugggggauggacuagaguugagucugacauuuuccagccccacguuucugggaccagcuggguuugggaggcggagaggcugcugcuaauccuguccccagcccccucuccccguguagggacuuaccccuccugcuucccucccacccucccaucugugaucuuucaggcuacacauugcugccccaaagcaggguggaggcacccccaggcuuccugggagccgaggcacacagaguguaggaucuagaagccaacucgaaggggcuuaggauguugagggacuagccuggaaacuggccgagggacuuccuagaagaggcucugccuaagcuugagcuugaacacugagcaagagggagaggcucuaugaagagggcacagcaugagcagaggcuaggagauggaaagaaauauggcagguugugugcaguaaaaguuuguuucagagacucagguggccuuugauaggguaaugcauucauccauuaaacaaauacugucugagcaauaagacaugucaggccuucuaggccugggaauacagcagcaaacaaaacaaaagccuguccuuguggagcuuccagacuagggaggaggccugucuguaaauggagauauucugugucagggagugguaggguccgagaaaaaaauaaagcaggauaagggaguagagaaugacagggugggguacuuuagaucaagagaucaggaaugccugucugaggaggugacauuugagcagaagccuggaggaagugagggagcaggucagguggcugagggaaacagcauucugggcagagaggaacagcagaugcaaaggcacugaggugguugagaaacagucaagagaacuguauggauggagcagagaaguagaagaucagagguggguuagggugaggaagaucauguaggccaauaggaggacuucagcacauacucaaagugagauggggcaggugcuguuggaagguucugaguggaauaguggccuggucugacuuaagcauucacaggucugcucuggcugcuccauguggauagauugcaaggggccagguggaggcugugaggccagucagaaggcugcuggaauaaucuggacaagagaugaugguggcuugggcccaggcagagaugguggagugguggguuucugcugcagccccaggggcuccucaagggccuggaccccaauguucaaggugaacacagagcuacaacuucucacauggcugggcagugugugaggggucacuuaggguggggagguggaguuugaaaaguccccaggguggacugggcuuugcgcuacacuggccacccccugcagacccacauuggcuuggcugaaaggcuaggagaguggagccgccacagggucccagugaggcaggugacagggccauaucccacuggugucuccucugcagccaccaugacacccauuuagcuccagcgugcaugucuccugggacagggagcucaugccucccccuaccccccaagguagccccaucccucccaucugauccuccagcuacgugggcauugccauggcuccaauaguccaauaaagaagcaggcucagagugggcagggucugcccaaggccccaaagcuugaguaugggauuuggcucccaguguccugacucccagaccguacauuggucccacagaguucccacuaagcagaguuggcagggauggcgguagcagggugggggaagggggagccaauguuucccagaaaggcuugaagcccuggcguacuuacugggaaaugugcccaggcagccuggcgccuugcuggcaagcccugaaaugggggcccuggguccccugggaagcaggagccuauuggagcugaugucuccccaugggaguugauuccccccaugauguccucccucuaauucucagcucccagggucucuggggcauucuggggguugggagagacagacacagaggaaaacugucaggcugcugggcucugugcagugagugaaccucagcccaugagaugcagggguuuggggccccaaccacagugccugagccccuggagggacuuccaggacccaacccuccaguagcucuaggguucacuagggacagccuggugucuguacuaggagucaggagaucagcuuugccucaccaccuuccugcugugaggccuucaauaaguuccaucccccuucagagccacagagcuguccaugcucuugggcaccaggauaaaccuccucccagggcuguugggaaaggacccaguucuaaggaggaucucgguugcagaaugaagugcuggcaggcagggacccaccaucccacuaggcugcugagaaggcagguucagaguggugccgggacucaggccugggucuacccgcuacgugcuuuccccaccaucgccuccugcucuaggaucccccccacccccagauagggucuuuuuccacacuuguggcaggcuguggugcucacuguggggccuguccagaagugugauguugcagcugacgggacaguaaaccuuuaucugggccgggcgugguggcucaccccuguaaucccagcacuuugggaggcugaggugagaggauugcuugagcccagggguucgagaccagccugagcaacacagggagaccuugccucuacuaaaaauaaaaaacaggugugguggcacagaccuguggucccgcuacucgagaggcugaggugggaggauggcuugagcccaggagguugaggcugcagugagcugugauugcccaacagcacuuuagccugggcgacagagugagaccuugucucagaacaaaaagcaagaaccaaacaaacaaaacuuccuaugguuucuuuccaguggagcuugaagaagccgccaggcaggaacagggugagaggggagggcagagcacacccgaggugggaagaccugugcugauugcagaggucuaggugguguauuaguguccuguugcugcaguagcaaacuacacacaucuagugguugaaaacaacacagaucuccuacucuccagucuggagaucaaaagucugaaggguuucacugggcuaagauccaggugcugacaggccugcccgccucuggcggcccuggagagaucaacgccucugccuuuaccauccucuccuggcugccagcacuccuuggccuguggccccuucccccaucuuccccagcaucuucaaaucucuugcucaccccguaccuccuuccuccgucuuuuuuuuuuuuuuuuugagacagagucuugcuuuguugccaggcuggaguacaguggcacgaucucagcucacugcaaccuccacuucccggguucaagcaauucuccugccucagccucccaaguagcugggacuacaggcaugcgccaccacauccagcuaauuuuuguauuuuuaguagagacgggguuucaccauguuggccaggauggucucgauuucuugaccucgugauccgccugccucgaccucccaaagugcuggaauuacaggcgugagccacugcgcccggccuccuuccuccuucuuuaagaacccuugugauucauuguguucuuaaagccuaccugauaauuugauaaucuucccaucucagaauccuuaauuacaccugcaaagucccuguuauuauguaaggugacauauucacagguucuggggauuagcaugaggauguaaugccagggccauuauucuuucuacugcacagauaggcaaaggaccaggcuguugguuccugauauucagaguccccagcuggugcuggucccggggcagaaccuucgaacucaggcccacugcauuuaacuugcuauuucuuuccauguucauuugucauucauucauuuagcagucaaucauugagcuccguguugggcaguggggacacacggggaaaacuuggacaccaucccuccuugccaggagcuuucaccaaggauccuagccuccugaggugggugagguccagaggcaggcagagcccaggccugguggggcaggggcagaagugccaauguguuccuggggccaggccuggcuuccagagguggcaggccauaguuuugcugacuagaagugggaugaggccgcucccaagaagggcaauugauaggagaguuuaaauccagggcaaggagggaaggugggcaccuagggagggggugggagucacgucucugccaggcugccccaucugagggcagaacugagagcccagcggcagaaggaaagaaaccccauguucugggagcuccaugugggaauugguggcauuggugcugucugaccagaggaacugucaggucccuucaucccugagaggccuagggaggcuucagggagguggcauguggaggguaaagggugcuguccagaaugcugucuccccgcacgcuggcuuucagacccaggcaagcacuuaccuacucccccgaggcuguagucgaugggggcaguauccccucacuccacagaggauuauuguuaagauuauuuuguuuuucggccgggcgcugugucucaugccuguaaucccagcacuuugagaggccgaggcgggcggaucacaaggucaggaguucaagacucagccuggccaauauggugaaacccugucuccacuaaaaaaaaaaaaaaauuagcagggcguaguccuagcuacucaggaggcugagguaagagaauugcuugaacccugggaggcggagguugcagugagccgagauugcacuacugcacuccacacuccagccugggugacagagcgagacuccgucucaaaaaaaaaaaaaaaaaaaaaagaugaugaugauuuuuuuuuuuuuuuugaggcagggucucacucucucaaccaggcuagggugcagugggucaaucauggcucacugcagccuugacuuccuggacucaagcaaucccucccaccucaacuucccaaugagcugggaccacaggcaugcgccaucaugccuggcuaauuuuuuuuacuuuuaguagaggcaaagucucacuauguugcccaggcuggucuugaacuccugagcucaaguaaucuucccgccuuggccucccaaagugcugggaugauggacaugagccaccgcacccagccuacugcugagauuaagugaaagcaugccaagagggcuuggcacacaguaagugcucaagaaauguuaccuccuccccucaugacugagaugcuaagguuuuaugauucuaagauucuuggcugcugggcaccucuuuccagccgugaagcagaagacaaagcucuagacaggaaggcagguuggggccuggcuacaguacccacauagucaguggcuccgagccugguucucuggagguggggaggagggagaaaccggggcuggaggcugagccacaugcccacuguccuugcuccacucaccagcucuucuccuuuuguuaccaccagccccacccugugacauguccaggauagcucagcccacacggggaggagagcagaggcaaagcccucucugcaucaaagcugccccucacuggaagcggccugugaaguggggcucagugagucugagugucuguaugccuggugggcuuuggguucagacugauaaggguuaaaaucacaacugacucugaccccuugccgggugauauuaacaagucauuggaucccaacucugagccuuaguuuacugcucuguaaaaugggggcacuaaggcguuauuaugagggccaaagagagaaugcuuguggagcgcucagcccugggcgcuggcuccagacagcucucagaaauguggccacuuaguguaugcuuuugagauugucauucucagagucuagaauccugugguuucaagaugaaggauucuggguucuuuuccaagaguccagaccucuuuuuuauuugugauuuugagauugugacuucuugguucugacauccugugauccugagacucuggggucuggagaggugcagcaggucgggggccagugggaaggcagugggggcagugugauggaggggccagccgagggagcaagcacaagguuggugucuguuuccuguuuauugguucccagggggugagcaggcccugcucccgcacagcgcuguggagcaggaagcggggaggcagaguuccuggcugccagccagccccacagccgggccuccagggacugcugggaccccacuccccaaccuccuggacaaacauucaguccuuucccaggacagggcacuggagguuaaggagcagauguggaagggaagggguggauagauggggagggacgccuucccccaauaaaggucccgauagcuccaucuuucuuagcugccugaaucacugaggucucacucuggguuucuugguaucccccgccuuucccugucucccugggauggggccuggugaugagauguccaacuucugggcaggccagaagggcaggaggaggaagaaaagggccagggccuuuaaugccagaacugucuaccuggaaagacucuuagaaaccagccauguuuucuagccuuccucaccccugcaucauucagauggggaagcugaggcccagcaaggggccuugcccaaggccacacaguaguggacuagagccagaaaucccccccaugcaucucaccauugcuccagccucacacuguaaggggucacugagaguucuugagaagugcagugacgugguucaccuggcauuuuagggaacuugucugagccagggcaggaaagggaagccccuguaugugucugaggccaagaggggcagggaggucucaguuugaccagagcaccuggggagaggcucugugugggcaggaaccagguugaaagccucaagugccgaguuaaauggccugagcagaggggcuccccucugccagcuccccucucccuuucugggagaggaagggcugggagcacugccagcuuugcacaucacaguauccucugguugugaggugaugaucugacaugagggugcgggaacaugaguagccugagcuuagguagcagaggauguggagcuggcgaggggagaacugacugggaagacaauuuggaggcagaaucugggaauucgaauuuagguucagggguuauaucagaaacaggguugggggagcgggacucacuucuugucucggcagaaauuuccucugcauucugaaagagugagguggcugugagcccugccucugugcccagcaagccuccugucugaccucaaacccucugcuccaguggaagugcccugccucucaggggggucccugaagagccccagagcuccaggccacaccugcagucuggcccuccugggagaggccuaauggagggagcauggaagggaaugaaagagcaggcuugggcugccuugcuggcucuaaccuaagacaagucccucugccuugguuuccccaucugugaagugggaguccuccagaguccagcagagcucuagaauaugcaggcuuuugggaacugagggagagggacugguagguccacaggcaggcauccuugccagcagcccucgugguggguccuguagucagagacaaagaaccuugugauauuuguacccuagauccugagaccagugcuauucuguggccccgcagcccuggaggccuuccugaagaagaggagagccgcgcuuuagggagaggagugccucacacugggggccugagcggaaagccugcuucccugucagaugccugagcgcccucccagcuccugccgcuccugggccccuccuccccucuggccuggacccgccacuuccaggcuucuccccaaggccagcgggggcguugccuggggcgggugaggaauuuccgagggaauggcuaaauucagccccagcuaaaaauagucccgggccuggccccaaggcugguggaggaauaggagaagggugggcccggccugccccaucucaucaccuggacguggugccugggcaguggagggucucugcugguccccugggcaucugugucuuuguuccagccacucgcaccaggacuuccucucauggaggcucccugcuuucuucucuccuucuguccucuguccuucucccuguucuccucccugggucuugcuccucuuccugucucucaucuccucugaccaucugugucacccugccucccuuuagagagccagacagagaccccuggccagggacuggucuuaggaaaacggccguguagggcagagucccccucagcuucccagcccaggugucaggaaccgccucugucccaggauacacagugauugcagcuccucucugcuucggagguaacagaccucuaaggcucugggauguggagaugugggugggagcccccaguuugccccgugacccaaugcuugauucuggucggguggauccacccaugccaagcccuccuguuccuggcacgagguggagccuggguacacguuuauuaaauaaauaaugugggggaggcaggaggaggacagcugagcccugcccugggggagcgcccaggcuccucucagcuccccuuaccacccaugccuaugccuagcccuauguugcugcuguccuggggaccaggcagguggaagcuggcagaugggcaaagggugccgucccgagucggcacugauugggggugggaugggaagcagacacaggcccagagaaggugagggugcuuagcucaggucacagagcccagaaagagagaggugguauucaaaccaggauagucucacuggguuggaguucagacccagauggucuggcuccagaacccgugcuuaggccccuggcuuucaggacugccugaguugggggcagugccaucaucaaggugggcacagaaagaaaggguggauuuugcuuuggacauagugauccuacuggauucacaguccauggucugagucccaggaaccagcacauaguaguugcucaguaaauauuaguugaauggcucaguugcacuugagaggcccuuggggagugggaggaggugacaggcacagaaggaaugaguguuuccucccuuuaugggcccagggacccuucucuuggugcuggaaagcagcugaggugggugcugggcuuucugcuggcggagagaacucagcccaggaguuugggaagguggagagaugggccacgggcaggugaaggggagacaggcaggccaggcagugcagugcagucccguuugcaguaucuggaaagcagaucucuugggccauggccggcgugacucaaauggagacaaaaaaaccuuccauauuuggacaaagagcccagagaggcccagacccgcagccagcccaaaccucccccacccccagccuccugcccugucucccucugggccccuagcccugaguccugucccaugaguugaacucuugggccucagucaucaggucgcuuccuguguggccaggccugggcugugggugcuggggaagaaauuucguuccagggcugggcccugugcuugggcuggagauguagagaggagcccugcuggagccugcgggcuggaggggagcacacugaaaccaacaguucccacacugugggguaagcugacagcaaacccccacccaucucaacacaggcaaagcuugaggagcaucgcauauaggcauuguacacacacacucucucucucucucucacuuucucacuuuucaauccccagcagauuuccauacccacaaagacaucuguacagauaucaggagugaggaccgagccugagaccuucccuggagcaagcuuugaugacagcaaaguuggaguagauuggggcagccagaugucaacaaguaacauaaacaggcauuauccaucuggagagaugugaacagagcaauuugcuccuguaccacccucugaguguccagcaaggggcggggcugggcaguggaugccagagccuggugaguggggagagggccuaggccgcuuccugccugggagcagaccuugcucccaugggacagcccagccauuugacugagaaccgggguguucacugucauugguggauugacugagcccugacugcacagaugcuucuaccuuuucuaacuagucuuggauaauuaacgcugaaauaagcucugaguggcggguugggggaacccaggggaaccuuuaaaauucaauugcacuguggcccacuggugccuguaugugcaggguuagcaugggggccgcagggugaaggagaagggguuccugacccaagaagccccaucugagaacugggggucgaaggaggccaagaagggugagggcagggaaggcuaacuuagggcaguggcuggaaucuugaaggacuagccagaccuugacaggcagaaaugagccaaggcccuucagggagagagaacugcaaagguagaggccugugauggagaagcccuggugugucugggguaccaugaaagcucccugguucuggagaggucaggugggccccgggaguuccuaaaggccaggccuaaaagccuggacuugaucccagagugguaauuuccaagcucacggcuguaaucccagcacuuugggaggccgagguugggaggccgaggagggcggaucaccugaggucaggaguucaagaccagccuggucaacaugguaaaaccacaucucuacuagaaauacaaaaauuagcugggccugguggcauacgccuguaauuccagcuacucgggaggcugaggcaggagaaucgcuugaacccaggagguagagguugcagugcaccgagauugcacauugcacuccaaccugggcaaccaagagugaaacuccgucucaaaaaauuaaaaaauaaauaaaugaauaaaaauaaaaauaguggaaccuuuucuucuagaggaaucuugacacagaaguauaaagcaggcugaucucauugauuuaagugaaaguagggucaugucugcccccuggaccacaucucacgccauguauuuccauggagcuuucaggacucagucaggaaaucucuguuguggaaagagggaagcccucccugaugggaggcguuagagugagacaagccucucccuucagugucucugcaggcucagaagggcaaccagccaggcucccugggcagggguaaacucuguugggggccaggucuccagacgcagccaggaugauggagcauaccacccauccuuggugcuccuaugagcaggcagcaccucccacccggggccuggagcuggcugggccccacuugaucagaaggacaaacuguuggaguggugggaaaauccugccugcccccugcugacaccuggaaggacacaggcccuuugagggagguaggagcuggcaaccagcuacgcucccagaaugugcacccugucucagcccagcucagucacacugacaguggacaggcaggagcacauucucuagagguccaggaaucguccugacuccuguaggaugagugaauuagguuagaaucaggaaggaauuccccagaguuuguaguguguaaaaggaagaguaugaacaaguguuggcaggagaaagacugagcucugaggcuggcaggucugaggcccuucaggaccuaggccuugccccgcuuaguagaccagccugccugguccaccauacagccuaagcucccacuucuuuggccacgaaaaauguagaaugaguaggaaguugccaaacauagacauaggaagccacaccuggcagagagaccagcaugugcaaagggcccaggguguaacaaugcgauggguuggaggaacuacuguggccagaacaugaugcagccagaccgugguaaagguggggaaauuugaugcuggugagucagcaagggccaggucauugagacucucgggggacaaguacuugaucuuacauucagcuggguuaguguaaugguuagaacagacugaagccagauggcuuucuucaaauccugcucuuccucuuaguuuuguggauaguccuggguaauuauucauuggaaaagcugaguacucacguguuaguacuuagucccucuguggcucaguuuauguaccuguaaaauggggaugaugaugauggcaccuauuauaggguuauggugagaauuugaugugauuaugucugugguggcugggcuggaccacagaccacuggggaucagugggaagccguaaaacaaguuggaagggagggagggaagugaccuagcuggcugaggaagagccccagggauggagagaagaggauggggucacugagaguagcccagguaauccucuuugguagggggaugagcugagcucccugagggaggcuuggaguuccccacgggcagcuguccaaaggaaaagaguggggcuaugcaggagggaugggacucugcaggcugggggcucugccggaguuuugcuagcagaaauccccaccuugcuuuaaaguugcccaucacugacucuggagcagcuggucuguguuccuugccauacagaugggggcccagagaggggcaggguugccagagucacccagugacuucugaccccaggaccuuccuccaggcuggggacucacuuugaagcucaaagcccagcccugaggucgcucuacccaaggcagggguugagcguuuggcuugaaggaggaauuggacaguucuaccccagucugaaugugauuugggcagggagggcuuccuggaggaacaccacaugugagacuggaacugucccagaggagaccaauguggaaacagaagagggaaagcaaagacaaaggcuccaaacuuggggcuccaaggcagugcccccuguucucuggugcagucuucauucagugggaaccucguccucuguauguaggcugggaacacagguggugccccagcuaugaggaggcacagacugagacaggaacaucaggccugugucaccagggcaggguccgggcuggggcagagauacuccgaggccaggggagcccagaaggucuaggagagagagucauggagggagccuagagaggcaggauggagaaggaagaagaggggugcaaaggcuguucagagaugagacgugaggcuggagugggcagcaggggccugauugcaaggugaauuuuuuaaauuaaauuuauauauuuaauauuuugaauagaugauauauucacaugguuaggaaaaauccaaaaggauaaaaagucuccuucccaccuggcugccuauuuccuacccugccugaccccaggccacccagcuaguagugucuuugugaauccuuuuaucugcaaacaccagcaaauucaucaucuguucccuuccugcacacagaugguagcacaccgcuuugccccuugcucguuacacuuaaugucauuugcaggucuugccuuaucaguauuuugagagcuuucauauauauauauauauauauauauauauauauauauauauauauauauauauuuuuuuuuuuuuuuuguauuuuggguuuuuguuuuuuuuuuuugagacggagucucauucugucacccacgcuggagugcaguggugcgaucucagcucacugcaaccucugccucccagguucaagcaauucuugugccucagccucccgaguagcuuggauuacagguaugcaccaccacgcccagcuaauuuuuguauuuuuaguagagaugggaguucaccauguuggccucgcuggccuugaacuccugacuucaggcgauccgccugccucagccucccaaagugcugggauuacaggcgugagccaccgcaucuggccucauauucuuuuuuguacugcauggugucccauuuugcagaauaccaaacuaugcaaccacauauuaacagguauuuagguuuuuucagucuuuugcuguuacaaacugcugcagugaacaagcuuguuuguaggucauuucuuaggagugcuaggauacaggguaaaugugauucucauuuugcugcuguccaugggggucugccaucagcaguagguuagaggcccauuuccccacaaucucaccaacucagaccuuuggguaucuucccaaucugauaggucucaguguauuuuaauuuguauuuaucuuauaaugaguaagguugagcaucuuuuucuaucuccaagagacauauggauucccguuucugugaaugcuucauauccuuugucuauuuuucuguuggguuguuggccuuuuguuuuuaucaguuucuaggaaccuuuuaaauauuagggaaguuaguucuuugucuggcauaugaguugcaaauauuuuuuuccugauuugucacuugacuuuugacuuuguuuauauuuuuacuaugcagaagguuuuguuguuauguguucuacuuuaucaagcuuuuauuuuauugcuucuggauuuggagucauaguuagaaaggccuuucccacuccaagauuauaaaguaauucucucauauuuuuucucugcuauuuucaguuuucuuguuuuauuuuacauuuaauuccuugaucgguuuggaauuuauccugguguguaguaugaguuaugacugcaacucuuuuuuuucuggaugguugguuuuaaggugaggaaugacuuggucagaaucuuucuagggugggugugaaggucagcugaggggaucgaggcuguggcuguggaggggcaggggcagagggaugaacagaagggccuggaguggcaccagauaacuugcugggcccuggaagguggcauaacauucccaaauuccuugucuguacugugugacuuugggcaagccccauccccucucugggccuagauuaucauagcuggaagaggcccuggacaucgcccuggcuguccuggagguggaggcagagaguaagacuguggagcuagcgcccacucaggcuuggcccaagaagauggagggcuggcagcagaauucacuguguuccuggagugggcaggcaggaaggaggagaggggcaggcacccauuuaaaaaugcccacugcagccuggcacagcaggugggggugggggcaggcccucugccagcccucuggauccaggaaggccagggguuucuaggggugggcacauuaccugcugucucagcacugugggcccagcuauuaccauucuuggggauccucuucucccuaccgugaggcaggcacccuuguccucuccuuuagaaaaauagagaagccagaguggacagaccacaucccccagaaccuaguccugccacuacccuggacuugcugugugaccuuggauugagucccuguucccuggggucccuauccaucaaagggagcacuggccuuguccuggcugugucccauaccccuagcccuuacccaugucucgauuuggauuagagguagagagaucuuaaggcccaugccucucucucccucuuuuacagauggggaaacugaggccauggaggggacccuggaccccugcccugcauugcucuucuuggcuuuccugggccccuggaccuuccucccuggccccagcguagccuauaccaccuccccucccccacuccugggccccaguggucaaauuccagggcugucauugccauggcaacagccaguucacagggccccuccucugggguucuccaccaguccuguuguccagggaggaggcagaaagggccucccaccccugggggccuggaggguugggcgagggggagugggggggugcggggggaggaggucagacucagcuggcuucucauuuguuuuccaaaggagaaaauggaaaaggcacaaagugcugccaacaaaugcuacucuguuguccuggagagagagagggauagagguggucaccugggcuggggacaagagagccaccuggaaaaccucucccagcucucaccuggagaaucaccccacagaagcaucagagcccaaaggauuuuugaaugggagguggaggaaauuucuuccugaggugacugcuguccauuucuaaggccacccagagacugagggguccagcccagcauggcuuuuucucaagcagacaugcccauagugaaaggagcuaccauggccccaugggagggggagcuugucagcccugcggauaugccagcgagggcugccagggaggccugccauggaaggagggugcuuaagccaaccacugaccccugaggggaccugcccucugagauucugguuauucauaacagccaauauuuguugaacucaugcuuuguucugggcacugugggaaguaagcccucuauauucucuacuuuauagauggggaaacugaggcacagauguggucuucuggaggucgggaagccaucaguggagaguggucucuggcucuaccccucuacccaccuuuguccagggccccugcccacuguuaauguucugguauauuucccuccaggcuuuuucuccguguguguguguguguguguguguguguguguguguguguguguguguguguguguguauuuuaaauaacauugagauggugcagaauguaugcuucuugcuucuuucauuugauguuauacccaaauacuucuccauagcauuucaaagauuucaguaagugcaugaaucucugggcuuuccugugguuggaccuugagguugucgccaguuuucccugcuguggaaaaggcugagugggcgagugggcguccucaugcugggagccugggcugcucccggggucacucccuuaggcuagaacaugcuccucucuccggguuccuagauaaucccacaccucuuccuucugggguuccuggggggcgggaauccugucugcuugagagaccuugagcaagguacuuaacuuuugagcaagguccuuaacuaugccucaucaucuuccucuguaaaacaggguaauaauagggccuacccaggaggcuuauugugagguuaaaauaauaccugcagagcgcuuaguaagcagcgcagaggaaucccucaggagaucuucuccuccugguuuaugcuuuugcucucuuccuguccucaggcccaacgagguuguguaauuugcucacagucccacagcaggucagugccggcacugagauuugggcccuggccccaccaaccucuuugucuugagaaccuaagcacacaugacuucucacugagccuugcuuuacccacggaagagcucaugaaauuaggcccuggaaguguuuuguaaacucuaagguacugggugguuccacuuauugccaauaauaaugacaagacuagaaagacccugaguuuuaaaggccgaaacucuagaaguucagaggaggggagugggcaggucugugcuaccagaaagacuuucuggcggugguggccuuguccugggccucaggagaguauacccuggguuuggcucaggcugaccuucagcugugaaucuuauccacugcgcacacuugugcacaugcacgcgcgcgcgcacucacacguaacuaucgcuguccaggcauuagggcuggucaccauugguggauaaauucaguaaggccuaaaagcccaagcugcuguuggucagccagaggcagagaccacuucuuccagaggcuaggguggagggauaauugaacgggcauggucacugccccuggacauccugaccacccuaugcuugccuggugugaugggagggggcuucccucggcucuggguuaugccagaguccccaggggcagggcuggagugaccgacugauggguagaacuuacucuccccucagagugucacccggguccuggaacagggugggaguaggggagguaggggccacagugcaacccagcugguugggccucucuggacaagcuacagugggagagcuccagaggccuggucuggucugguucuagcucagcugacugucugccacccugggggucaugagacauuuccucuuugagccucugugcccauauaucaaaugcguagaaauggucccuucucugccucccuccuucaagagaggauugaacauggacauucuaaacuaaucagugcacauuaauuacacugauacuugcuuucauucauccucaaauucacaaaugugaacugagcacuuaacugugggucagucucuguuguaggcauggaagcugcuggaacaaggcagaagugcacccucccuuuuggagcucacagacuuuguuauaugucccuuaguaccugggcagcuugccugagugcaagccugacauauaguaggucuuucaauaugccaaaaaggaggcugcugauuggggaauuagcaccaggcaguuuggucagugcccuggucuauagcagggauaggucagggaggguggaggacuuaaaagaaacuuccaggaagaggcagagcauaaaaguuagauggcguuuaaacagggccaagagcaaggagggcagcccaggcagaggagcagucuacacaaagauggagagguggggaggagacugggguuggacaguggugaagagaccagccuggcuagaggagaggcugggaggucacacacguaggcugcugggggcugauugcacuucaggcuucccuaggucucugguggcaugaauagaauuucuggcacuaugguaaguggggaagacagccucuuuuggcuguggggcuucaagagcccccaggauuuaucuucagccgaggcaggcucuggcccccuccuuccugccucagcuccuuggggcucuggcugaggcugaccuggccuuucccagggugccuggcccacagcccagugagucaucuucugcaccagaggcaggacaccccaucccaccgacaacacaugacugcagcccuucccccugcuccugggucugagggagggagagaacaagaggggcuggaaacagacccuggauaacuuccguucccacgaucccagccccccugcaggcuggggaacuggguggaggauagggaagggaucccugcuuuccagugcucugugcaggucaggaaucagaggcugaacgguggugguccugggccacagggccugauucccugagcacuggucuggugcugagccaguguuagacauuuugaaugaaauaacuuuuagagcugggagaggagggccccuggaggucaucucauucauagguuuuaagccagggcugggaccacaggccaggccaguauguaggcagaagugugcauaggggaaggugggugcauuuccugggagcccuaaagcaggaguugccagauuuagcaaguccuaccuacccuaaggccucaugggauuaccagugggguccuucucgacugccaagggcagggcaaccuccccugcucagacucagaugugggacccagaagaucuggguucugguuucucugccuguaaaaugggggugacagucccagccucuugggcugagaggaugauugcauucaaagcuucugagcuccuaagauguuuuucacaucuguugggggucugucuauccaucuacuucucaagccccaccuccugcuucccgcuauuauccauaaugagaaacuuuuccuucccagccuggaagguccagcuguaucuucuugaaauugggagggaggggggcggaucucagagaagaaagaaagggaaaaaacccacauuaaaaaaaaaacccaccaguuaaauucaaaccacaugcaccacagccccugccaugugggccucugcugccaccugugggcgucugguggaagugcaguucuuggggcuucagcuuccucacuggagccauaggcuuaauccugaagccugaaaucaggaaggaaggucaagcuguccauccuccaccucugagcaugaccucacccccaccaccucugcugccaggaagccugguggggaauuuagaauccaucuacaccuucccuucucccccauuuguuuacagagggggaaacugaaucccagaguggagaggaauuuggcuaaaguugcaaagcaagacagucaauagauaaguauuguacaccuacuguaugucaagagaccuggucucugcucuuauggaucuucugguuguggaaagcagggagcagacauugagaccguccuauuuccaucuaacucccagccauccauggaagagaauacagccuccuaccuucucauucaaggugcucugggcuuggcuugacuucuuguuaaugugcucugugacccuggugaggucacucagcuucucugauaugccaguuacuuggggucaaaucccagcuuugccacauccugacuucauaaccucaggcaaguugcuuugcuuccuggagccuuuguuuccucaucuguaaaauggccauaacaggaauacauaacucagaggacuggugugaggacuaaaugagauaauacaugagaaacagugccucacuaaacauuagccagcuguauacaugagcucccaccaaggauacagugagcacaccucauucccagaggucuaggagggggcugggagcgcaguggguacgggggucccuucugggcuaagagugcaccagcaagguucagcaguuagaagucgggccugagucccagcauaaggaaugagggcuaccaccuccauccuccuuucagccagcagggacaguuucuggaaggaguggugagguuggagucccagcuggaccccucuggggcaauagaugaaaucuagccugugcagaaaucauccccuuccuucauuucuccugucagcauaugaaggacccuggguucacauuccgucucuuccacucacugccugugugaccauggcuccuccaccucccugauccucaguuuccucagcuaggcacuucucacugagagucaugcaguguggucggauagugcugggcuggaauuaccuugaaggcauccucacucacaaauuggugauuaaugcuggcauuuggcuggaccucaucuggccugucagcuggcauaccuacacauggccccugcauguggccugggcuuccccacaacguggaggcuggguuucaagaaugagcaagccaagagagcaagauggaagcacauggcauuuuuaugaccuagcuuuggaugucacauaguaucauuucugcugugcucuguggucaaggcagucacaaagcuuuacccagcuucaaagggaggggaccuggaccucgucuuucugugggaagagucaauaccacauuguaagaagaacaugugggccaggcgcaguggcucgcgccuauaaucccagcacuuugggaggccgaggcaggaagauugcuugaucccaggaguucaagacuaggcuuaaucucuaaaaaauauuuuuaaauuagcugggcgugguggugcgcaccuguacccccaccacucaggaugcugagacaggaggaucgcuugagcccaggaguuugagguugcagugagcugucacgccacuacacuccagccugggugacagagugagacccugucucaagaaaaaaaaaaaaaaaaaagcaugugagaugauagcuaucuucaaaacauacagucuaccugaagaugauuaugaggaaaacagcucauuguagccuugacaucccagagcucaagugauccuccuacuucagccuccugaguagcugggaccacaggugugugccaccaggucuggcuauuuuuaguauuuuuuguagagaugaggucucccuguguugcccaggcuggucucgaacuccugggaucaagugauccuccugccucagccucccaaagugcugggauuacaggcgugaacuaccacacccagcuauuuuuuauuauuauugaagugaccccuucacuuucagucucugccauugaacccuauggaccaucacccucaccaguugugcagucacauguccacagaagaccccaacaggaguguacacagacacacagaggaguccacacagagaggacacaggucgugucacucauaaucccaccccaggugcauacacgcacccaccuaagcagggcacuguccccauagcaggaagauccugaggcucuaaggagcucuccuucccauucccaaagcacauuccccagaauuauggagcccacccugagcagccaguccccagggagcccuguggcuuggacacuucccuucuagcugccucagaggccugggaacucuguggagccuugagaggcuccucuuuccagaagagagggucucuaggaaacaggaccugaccagggaaggcagggggaagggaggagaggagagaagauagggggaugggaagaagacagaguccucaagcaggaacagauggagagacugaggccccaagaagugaaguguccugcccaaggucacuuccccaguaaguggccaagccaggauuugggauugagcuuucuggcuccagggccugccuucuuaaucucucuacccaaaaagucccucuuuuggaacuuucaucuccuugaugaacugagcaccugaggaaggcagcggcugucagggaaauggauagcccauuagguugggaacaucccguaccaacccuaugcuuguggacuuugguggggucaggagcaucagacagucugugugggccauucgccagggccgaguucccagggaagaggaucuucuuugacucuagcauugccuguggauggcaguuuguuuaccaccuaaaccuucaggagaaucuguucaugucacugucuuggaacaaaggaggcugaagaaaggcaaccaccacaccagggagguggggguugggggagcccagcugugugcaccaggccaggggagguggaguggggcucuccccacuggggagagggugggguuuaggagccugggcccuggagguggcugguagaacuggguucuaccucuuaccagccaggugaccucucugagccucaguuuccuaguuuguaagaagggagaguaauaauaauagaguucuugauguggggcugcuguggggauuaaaggagccaggacguguaaagugaugguagggugccuggccccugagaauuguccaaacagcauuagugguguggcaauucugagauuaugggguuccuagucuuccaguuugggcagcucuggggcccaggcacucucuugacaaagauuuaauaggguugugccuccacucccaggagccugaugaggccugcugccccaguaccggcauuucuccuucaccaccugcaucaugcuugccauuucuuucucaguuccugucuuccuguguagacuguggugcccaguagggcacagaccucuuuccuuaccuuuaaauccccagcacagugcuuggcaucuaauaggugcucuauaaguauuuauugaacuaaucaacuaaugaauaaaauaaaaaugcaauugauuacucaugcauuaaaccauguaucuguggauucauucauguauucaugacugucauugaucuguucauccauuaauuuauuauuuauucauuuaucaugauuucauccuuucauccuuucauuuauucagccauuaccgguuaucuguccauuuguuuguucaucccugugucuagccuuucucaucauuggucccauuugguccagcaccagcuggaggaccagguggcccccagguggacagugcccagaugcaggagguaugggugggcucagacugggugguguguccagaggcagguagucaggguauugggauucccucagagauggggaaguuguuagcagauugggcagaaguagggaggguuaggugcuccccagggcugguagaaagguggucccacagacuugggacccccagccugccccuccuggaguggggugguacucuuguagagcagagcccuuuuucccccucucugucuuuccuucucugacuaaagagcaggugagaguguggcucuuucaugggagaagagguguuuaugguugggugugggguauggagaggagggcuggguaggccuucaccaagcacccuguauacuuacaaaaacucuucugagccacacucauucuauacaacugcacauaccccaaaggagauaaaaucagcacucagaacaggagcucagaggaacaauagcagaaccaaccugcauagggguaccguggcccaccuggugcccucagcccccaccccaacugaccucauccugaagggcucugaugccugugcuguuauggggcccucccuggacacccugccucagcgaccaacccaugugcuccuguuccuucucuuugcuuccuuucaucuccccgaaccaccagccccacuccauugccaagacaauaggcuuggaucuaauuagucauccuuaaugaagcagcagcagcaagcagugccuuuggcaccaagucccgcccccuucuugggggcagggccuuucagugaacucugucuucugggcacccauaugccuguggaucucucgaccucaggaccuuguucuugccaugccuccuccaggaagcccucccugaauacuuuccccugaagcagcagugacucccucugcugagcccuaugagaaaaagcccuguguugucugggagcuccuggaggcaaacaaggguggacugaucucugcagggccccaucccacuggaacuagugagggaauggaugcacgucucuaaauccugagccacacacugccucucagccacucagaggaagcugaugcccaggguuguguagcuugagagggucagaugagggacgaggugcccugagagaaagccagauguggguuaaguauccucagugaccaagcaaugagccagggauggggccuucagaccaccacucugcaugugcugugggaccuggaugucuggacuggaucacaggccuguccauccucccuuucaagccaccacucagucaauuggucuggcuguuccagacccccugcaugcccagcccugggaggaggaagaggaggagcaggcuccauccgcagggaagcccacaauccauccaguugggaggguaagaggcagagagcuauucaggcuggucugccucucagucaguaacugcugggcauguggggagaagggaggaggaagagcuauugggggcuuguuuauuaagccagccuuccuuauaagugcccuggcuuacaaaagggacaaggacgcugcccucaggaagcauauagucuccugggaggagacgggccucaaucuaguaauugcuuaaauguauauuuacgaacugccauacaugguuaagguaaggaaaacugagagccuuuaagagcagaaauuagaugcacaugaccuaaucugaggaucagggagggcuucccuaaggaggugacauuugcacuaaaacugguauuuuuucuuuuugagauggaguuucgcuguuguugcccaagcuggagugcaauggugcgaccucagcucaccgcaaccucagcucaccucaaccuccgccucccggguucaagcuauucuccugccucagccucccgaguagcugggauuacaggcaugcgccaccacaccuggcuaauuuuguauuuuuuuuuuuaauagagaugggguuucuccauauuggucaggcuggucucgaacucccaaccucaggugaucugcccgccucagccucccaaagugcugggauuacaggcgugagcuaccgcgcccgcccgaaacuggucuuaaaggaaaagaaaaagcauuacuaggagagggaaaaggcaugggccaagacccugaggcaggagagggcauggucaguuucuggaaguuaaaacggaaguggcuggagcacaucaagcaaagagaugagaggagucgacagaugggccuggcuugagcuauggggucaggauguccacugugcaggaaacucaggggaaagcagguuugggagaaggagucagcugggggcuuggugagcguggcagcgugcagcacacuaaaaggcaugaaguuggccagggcugaggcacagcugcagggugcuucagagcccccccaucuugcugggugggagcuggugcaaaagcagguugcucgcccccaccccucaguccagauugagucuaggauagguucugcugucacucugggcuuucaagcagcacguuaugaggauccugcuuggagacagucuaggggugcacagucuagguacgggagcacagucuaggggugggagcacagucuagggaugggagcacagucuaggggugggagcacagucuaggggugggagcacagucuaggagugggagcacagucuagggguggggcggauggacagggacaggacuggaacccuccaagauggucccagguauaggacacaggacaagcuggauccgggcagggguagggaugauucaaggugggugauuugagugauagcugcccuccuucaggcccaagagcuccucccuuggguggaagaccagggauguguaugugugcacaucucuaaauguccgagccuggacauaugugccuguuucugcuggcaauaguuauguaaacacagaagcacuugucugggcgcaacgauggaucauguucguuucugucaagguucaggucuguaagggacuguguugaugugggugcacuuggccugacccccuugugcauacggguccaggccugagggcagguuuccaugaacguggccuauuccguguagguguguucgugccccugugugugucccgugcuccguggcuccucggugggaagcugcguucagcgugugccggcgcuggguacaggugcggacggaaaguacaugucggcgccuuuguccacgggugugcgccgacuuguguccuggggcgggggauggguccgugagcggacgcugccgcgugggggaaggggcgggugcgagggcagcccagagcgugcugggggagauggggcggcgcggagagggcggggacccuccuccccacaacggggccgcgcgcgccuggcucgccgggcgcacucccagcgcggaggaggcagcagcgccgccggcggccgggccgcagcgcucagaucgacgcuggaacugaccaccgcgaccgccacugcggcugccgccgcggccgggcugagcccuuagggagcgagagugggaggcggccccugacuccgcgcugacccccgccccccgccccgccgccaccccggcgcccccgccccagcggcuggccggccgcaugcugcagauggugaagacccuggcccaguucaccaucgcgcuggaagacaugcgcgauaugggcccagccgccgccuccggggagccugccgggggcagcagcacugacgccgaggagccuggggaggcccagguacggggagggggaggggcagccagggaccugggccauggccuagaacucagccgacccaggagccaacccaggagacgguggggggaggggaggcauggggcgcagggacucucugugaccggggauggagaccuggagauugccggugaggaacccuggcaggcggugguguggcuggcagggcgcugagggucaaggccugguggcacuccgcuugcagaagugccuguagaagcugaggcugucgccaguguuauccuggguccacaggcucaggaaggagagguuuucccagcccuccucuuaggcuugagguggcccugguguaugugugugcuggaaaguagagucaguuuugcacccccacugccauccucucccugccgcugggccugcuggcccuuggaggagucaugcugcggugggaacagcagcguccccguucucgcucaguguguguaccccugcaggggaggggaggcgucuuggggcuguuucccugucuuugugugucucugggccuggacucugugccaugcucccggccccagugggggcuguaauucuguccccuccccgugcaaugaugugucucuccacagccucaagucucugagcuggcgggccugguucucagcugcgugaccuggcugcguuuuuuauuucuguguggggcggcuugccuuuauggcgucucugugugcgugucugucuucacacugugcccgucaggguuucagucuuuggguugugaugccccagucaucccaggaguggcccccucugucuuccugcuguaucccccagugcccaccucagugcccgguguagcgaaggucuggggauggggcuggugagggaugaggggugcuguggggaggcugggugugaagggcuguucugccuggaacaggugggccugcuguucaggcugacagcugcgcugucugccuccugccuccccuguccacccccgcaacccccgcacacuacacccguggugggcacguguagagggcugcucgcgcagugacagggagcuggccuuguuuucugugucuuuaccugacagcugagugacaggccgcugugcucugccgcagggaggaggcugggagaggcgggcauuugcagcgucagccuccccgugucaccccagccucccggcaucaggcacagcgccagcccugccucucaggaagccucccugaccaugaccauuguggugcccgcugggccugaugggccguugugugggcgggggaguguggcugaggggcccagggccgcgccuggccuggcccugcugucagggagcuccccacgccgucucacugagggggagaaaggguggacacuggugaccugcugcguguggacagagcugcucugcucgcugccgccuuugccuucacggugaugggagggcgggguuauuagcuccauuucauggaagagaauguggaaacagggccauuaggugacaccacagucacacagccaguaagggcagugcuggggaccuguggcccguggcugcccagucagucugggcgagaacuccaggggcuggggcccugagagucaugagguggcugaagagacccugguccuugcuuugccacucacaggcugugugaucuuggacaagucaugucaccucucugacaugaccccucaccugugcaguggaaauggcaacaccugugucacagagcugagugugaggcugaagcaagaccaugucuguggggugcugagaugucccuggcgugggguagggcaggauuaggcaucugggccuguccucgggaggccuuccuggcccuccacgcucucccaagucuccauccuacagugagccuugcucgcacugccuccuucuggaagcugcccugguuuuuuagaggucacaagaguaccgaggauagauggucugcuugucuccagaggcucugaggcucuggucugcuguuuccggaggcccugagguaccuucccacccgucagagcccagggcuggcaauggugggcuggcaaggauggggagagccagccccccuuccucccugccccaagggguguccuucacacccccaccacugaguuccuagcaugggagcucacuuuucugagugugcuucauuauaggacacuguggggacaggccuugccccugagucccuggucagagggcaagggaucugaagugggugugccacaagcagagggggagcaguggcugggucaggcaggacaggccugggcucagguccacuaaaacaugagcccugggcauagcagugaccaggacagccccacugguugaguuccuacccugaaggacuagagguggaggcuggagggaugccacagacauggacacccuggcauugccaucugcacagcacuugcucgaaccaguaagccuugauggcaggaacccgagauacgguccacagaugcucaggccaagccgagaccugggaggggaggggagagaggagaauaacccagagaucuggagccuagaggaguuaggggccuugcccaggaucacucuagggcuuuagaggggucaggaguggagucuaggggucuagggcuuggaguggagucucugccagagaagggaaguuguuggggcuggugcuaucugggaaggcuuccuggagguggggauuuugaggggagagguguagggacugguggagaggagcagcagguaaguucagucccaggggcugaacacaaggcaucccagacagggaugagcacccugugccugggggugugggugcagaggcugugugaccccuuggggacucaguaauucaggucaucagauccauagguuggaggcaucggugucuggguuuccuuuuuccccucccuaacaugaagagaauaauaacauauaccucacaggguggccaggauuauugaauaauaugucaugcuuagaacagugccuggcgcauaggagggcauaguuaauguuuuuaaaugacagaauugggauccagccuugucugagacuggcugaacccugauacugcccagcugugugaccuucagcacugacuuccccucucugguccacagugucuuccucuguagcagggugauggugucuacucuuagggauggugggcagcccagccaggugggcauguccccauagcacugagccugaaguuggggucuucagagauggcagcuggagugggugcuggccuggaggcauuguucuuugcaaaugugaaagguuauugauuuuuuuaaagacccuuuuucaauagccuggcagaggagccaagaaguggguggauggggcaggggcagaggagugagugccuaacugugcaaggccacguguuugagguguaagucgggggcagggggagcagcugagcaaagaccuggcagaguggagggccugggggccucgggggaacagcccggagcccugggcggcaggagggaagggccaggagggcagggagagggugugggcggguucucugggcaccauguggcuacaggugauggggucuggggggaaaaagaccccuguucacccucugcuccuguccccacaggacaugcggaagcacguggccaugacccugcuggacacagagcagucguauguggagucgcugcgcacccugaugcagguggggcucggggcccacuccccugagaauggccuuucugagccuaggaggcugucagaugggugugagcaaaccccuuucauggacaagggacugaggccagagagccgugucccuggcauccgucgccuuuccaugaagaacccccagcauggccauuccagagaaggaggaaggcuucucccgggcaagagagaaugcagaggggccaggccaccccagggcaggcgucccuacccugcuguucuuccacgucccccuggcaacccugacccugaacuuagauccgugaacucccucugaugugccgccuccauuguauucacugacugggaaguaugaguugaauagaguucaguauugagcaccugcugugugcaggcccuguuccaggugcaggagacacaggaaugaauaagagagcccagccccugccacaggagcucaccgcccugcugaguacguaguggaguauacgggcacucuagaaacaucgaggggcaccugcuaagcguggggucagggagguuuccuggaggaggugcucacuuccaccaugaccugucuucucaacagcaggaauagcacauugcaaagccaagugaggccuggcacauucggaggucuacguggccagcacagagcacaacgcgcuggucccauagcuaugcugucggagucggcagaggccacgcugugggggccuagaacaccaguuggaggcaguagauucugccaggguccguggaugaucagcgaagggcuuugagcaggggagguguguggccugauucaugcuucaugaagucugucugacagcugggaagguggguggcagaagaggaggucaaggccauugagauccggcaaggauagagguuacaggaagggagugcuggggacagacacucaggaaguggacuggucaggccaggcgugguaacugguugguuguggggggcaagguggggaagcccaagaugaugucugggcuccuggccucggauagguggggcccaggggagaagcacaacuggagcaagguggugaguucaggcucagacaugaaccugggaaggcccacagccuggaugcacacauggccuggggcuggaugaguguggaccugagcugaaguggggccuggcagucaccauugaggaugaauuugcccaagcuagcugggcagagugacagcaaaggguaaagguagaaccuucacccuauggaaacauccagagcauucacucacucaccauucauucauucauucacucacuccacaaauccacggugagccccuucugcgcuccagguaguguucucugugcaggggcauuagugguaagggccugucuccuggagcucacggucuauggcagagacugacagugaccagccagacaucaacacacaguggcauguggugaugcagaagugcacacacagagaaccuacacacaacagggauacgccuuaaaaggagggaaauucugacauccuacaacauggaugagccuggaggacaugaugccaagugaaagaagccagucucaaaggacaagcacugucugauuccacuugcaugagguuccugggguagucagacucagagauggaagguaggauggugggugccagggaaagggugccaggcugggaaaggagggaauggggaguuacuauuuaauggguguacaggguugcaguuuuacaggauaaaaagaguuuuagagcuggauggucacacauuaugaauguauuuaauaccauugaacuguacauuuaaaaugguaaauuuuauauuauauguauuuuaccauaaaauacaaugcguuuguuuauuguuuuuaaaaagugcauggggagaugagaacacagaagggggccuacccuggugucggggucagggagggcuucccugggguugggguauuuagcugagaccugaagggugaguagauuucagcagaaagagcccggagggauggcucccagcagaggguaugucagggacaaaggccaggaggcuggaaggaaccuagagcagcagggaaccagagguggccagguggcugcaggaaggaaggcugcugggcauggagcugggcuuuccugugcacgcaaggaagccaugggaggaugcagccagaaugccaggcaggaggaguagacauggcaggggccugaggggguccuuugccauccccuagaugagaguuggaggcauuagggucagacaguccaggguugaagucacgugcguccucacugggugauacuagccuaaucaccucaccuucucugagccucaaguuugccugcaaaauguagcuaaucuaccuaucucccaucaagaagacuuaaaggugagccaggcgcggaggcucacaccucuaaucccagcacuuugggaggcugagguaggcggaucaccugaggucaggaguucaagaccagccuagccaacguggugaaaccucaucucuacuagaaauacaaaaaucagcugggugugguggcaggcuaccuguaaucccagcuccuccagaggcugaggcaggagaauagcuugaacccgggaggcagagguugcagcgagccgagauccugccacugcacuccagccugggugacagagcgagacucugucucaaaaaacaaaacaaaacaaaaaaaacaaaaggugaugacggcacccaugccuguucacaggcaggagucaggagcaguggagagcugggagcaggcagggcuugggcaugucuuucuaccuccgccaaaucucccagacccguccagggcugcacuugggagagggugcaggaccuguggguggaggaagccagaauguugggugagcaagguggagguggacaggagggugucacgugaacccaaagaccgucccuggaggcagcccuggagugugggaggaggacugaggucuggcuccaggucaggaguaugacucuggagccaagccaccagcauucaaacuuggcuccaucuccuggccagcugcaugacccggagcaugucacauaaccagucucugccucaguuuccucaucuguagagaggggauaauaauagaccugccuugagugcaguuaauuagagacacauguuuauaauuuagcauacugccugcagcucugcaagcaugguaaaaaguugcauuuaaucuuuguauuaaccuugugagguagauauuauauucuuuauacaaagaaacgaagacucacagagguuaagaaacuugcccagggucauccaucuagugagugguauuaguugacauucacugagugcccacuaugugccaggcacuguucugaaugcuuuagaacagugaguaaauucauauaagccugacuauaaaccccauuuugcagaugaugcagcugagacacagagaaguaaagcugcuuguccaaggucacagaguuaggaagugccacacccuggguugaaacccugucauugugacucuggguucucccugucacccacuagucuacacugccuagagcacagugguauucaaauugagauuggacuccauagucccaguguuaacuucgaaccaucacugcccucacuaauugauaaguguuguuccugcaggccagguguucaaaaugaacaaagaaguuaaauagaaguuaggagccagaaggagggaggauuugaaacuagguccuagggcuacaucccuuccucagugucacccucacccucugagccuauuuucaacucugacacucgaagcuaacaaacgccccuuccccugaccacccugacgagucccccuccccuuggcacccugaucccacuucucuuuuccguagcacucacugucuuccaccaugcuguauaguaauuuacgcauuuaucgugcuucuuuccugccucccaccacucaugugucagccccacagggggucugugcagugagaugccccagugcugggcaggcugagcauuggugagugaauggggcauuggcuugugccagguuccguauugggcucucagucauuguuuguucuuuccuccugcugugugcccgcuucuguguggggugccgggacccugaggugagcgguuuagcugcugcuccugcuccuuguggagcagcgggcccugacccagcccaggagcuggcucaccugugggcaggagacugccugccuaucuccucaccaucaucccggccuuuucagaauccccagccaagagagaggauucuguugagcuuuacuuucucaagcuuguuuuacaaaacaagccagauuuuuaaaaauguuuaauauaaauguuauugcaacaucacauaugcuuuuucaaacaacacccuccuguuuuuuuuagccugcaguuacagcguagggccaguagagggcgaccucuccacaagcgcaccggccccugagcugggcuauuaaagcuaggggaacaucuuugcacguagauuugacguaaaauaacgggaguuuuagucacagacuggccagcaggucugaaaucuguauaacagcguucagaaagugucaauaagagucuccaguaacuucccauguggucucaugaucucccacgacccucccugcucuaucuucacaccauuaucgccuuauuuauuuauuuauuuaguccucaggcuggagugcaguggcgcgaucucggcucacugccaccuccaccucccagguucaagcaauucuucugucucagccucccagguaucugggacuacaggcgcacaccacuaggcccagcuaauuuauuguauuuuaguagagacgggguuucacuguguugcccaggcugguggcgaacuccugagcucaggugaucugccuggccucgaccucccaaaaugcugggauuacaggcuugagccaccgcgcccugccgcauuaucgccuuuuaacugacuacgagauuuccauaugucauccauucugagacucguggucuucgcguuuuaauaucccuaaaucaggguucauucuauaauugguagcauaucauaauuuaauuggcaaccaguuuuucuuaaauauaaaauaauggcugggcgcaguggcucaugccuauaaucccagcacuuugggaggccaaggcagguggaucacuugaggucaggaguuugagaccagccuggccgacauagugaaacccugucucuaugaaaaauauaaaaaacuagcugaguguuguggcgcagaccuguaaucccagcuacucgggaggcugaggcaggagaaucacuugaacccgggaggcggagguugcagugaguugagaucgcaccaccgcacuccagccugggugacagagcaagacuucgucauaaaauaaaauauuucuuagauuugaugaaauaugauauuuuaaaaaauuucuuccguuuguguguuucaucagacuagauccuaagcucuaucaggacagggauuguggucuuucuuauacauugcugucucccaauucuuagaacagugccugguacguaguaagugcucaguaaaucuuugcugaguuaguggugggaggucuuucaaggagccccaucuugcuuuccucauuccaagcucuguuuguucauacauuaaacaaaccucuuccugagcguccuugcucccaucuugugccaggcccugggcucagcgaugagggcaugagcuuagaucuucccaucucccuccuggagcucuuggucucaugagggagauguggaaggcagggcgcugagcugcaggcccgggugauucugugugcacucacacaggggcccuguguagguguggugggggcggcaucucugagggagugugcaccgacccuguggguccuucagggcuacaugcagccgcugaagcagccagagaacuccgugcucugugacccuucacugguggacgagaucuucgaccagauccccgagcuccuggagcaccacgagcaauuccuggagcagguucggcacugcaugcagaccuggcaugcccagcagaaggugggagcccugcucguccagucggugaguggccccgcugcugccaauucccacaagcacaggcccuccuggaaggggcuggauguggccacggaccccacccccacccaucccaccuggauacugacucuguuuccagaucugaccauagaacuuggcuagacauugguacuuaccccagccccuggguggaccugaacuuggacacuccccuaccccaaagcuuggccagacucuggcacggacuccgaccccagccagacacugacucugauccuggacccuaccccgcuccuggcuggcacugacgugacucuaguccugaccccaagcuggugcggacgcugacccagaccucagauggaugcugguacugaccuccacccuaucuuuacuggaaccaaaauaacugcccugguccugacccuggacuugggcuggauguugaugcuggcugagucuugacuuuuucuccaucagauauuuucaucauaauagcauaccuguuugcuaggcauuguucuaaauguguuguaucuaucaacagcccugguaggagagugcguugguuacccugauucuaaagauagugacugagacauggagagauugguaaccugaugaaaguuacaguuaggaagugguggaggacucaacuccagaaagccugguuccagugccccggcuuccccuaccccauacugccucucaccacaggccagaucuccacuguacacuugucaagcucccacaauagcgagugagaucuuagaaaagguauugacuucagaauucaaaaagaacaucgaaagcaaaaccaauaagcauuuaauuaaaugccuguaaaacauagcaugccauuuucauucauuguuaaauuuaguauuuauaagaauuuaauuacauuugaaaaacuuccaguuccauuuuauuuugccagaauucccaagaauacaccaugaugacugauaaaucauagccaaaugcaaacuaaaugguuucucagagccacauaauuucaaaagcaaaauuguaaaaauucuugcaaaaauuuuacaagugaaaaauuauaucuauuucugugggauguauguuucaauauauuugcuaugcugugggguggggccuugaaccaucuuagaauguccuugcugacccagaaacugaugggaccagacaggggugaugggguuccagcuuggauugagugcugaugucuccagcccaucaucacucucagugucaguaagcucagcccccugccuggaccuugaugcugaccauggacuacggcgaagcccuggacccggaggggucagcacaggaugcugugucccagggugggggugguuggugaggguugucuuccucccuuugcuucuucacacccugcccuguucuguccagaggcaggggcacuuggcaccuuagagggacaggacucuggccgggcgcagugguucacgcuuguaaucccagcacuuugggaggccgaggcaggcagaucaugaggucaggaguuugagaccagccugaccaacauggugaaaccucgucucuacuaaaaauacaaaaauuaggugggcgugguggcaugcaccuguaaucccagcuacuccggaggcugaggcgggagaaucgcccgaaccuggguggcggagguugcagugagccgagaucgugccauugcacacuccagccuaggugacagagugagacuccgucucaaaaaaaaaaaaaaaagacaggacucugagggguacagaaauaucacuaauguggucacguagcuuauccacaguacaguugagacaggaacccagguuuccugguucccagacaaggcuucuuaccaauaaccuccauauuuaguccgccaucagcaucaagcagguauuagccaccagcuguauguccugcccugagcugggcuuuacugugggugggaugggagcacuuuucauggagagggagaacuuguccuaggagaucaggagaagccagaggccagguggcguaccaggcagagcucuagucagggaaaggaguacuuccgagaggaggcagaacuggagcacagcccugaggcggggcgagauuuggaugaggaagggcauuccugguggggggaucugcauaagcaaaggccaaauggcuagaaugagucugugucacucagagaauggggaaagggagaccugccuggcuggacuucgugaggguggaggucuagggauggaaaugcccaguuggaagugagagaaccaggucugagcucacaggauacauucaggucuacauaugugcauacaugaacagucacacccagauaauaugagcacucguauauccauguguacacaugcacauacgccuaaacacgaccacacuuagagccacaggacaugugccugaucccuuagagauuguaucauuucuaguuggagggaaaagauggugacucaugaaucagugaaaacuaggacagggugagguggggugagggacaccuugaggguccccaaccugccuccuccuccacaguucuccaaggauguccuaguaaacaucuauucugccuauaucgauaacuuccucaaugcaaaggaugcugugcguguggccaaggaggcgaggccugccuuucucaaguuccuagagguacugugggcuagggcagggggauggaggugacccucaccuugggccagcuuugagggccccaggagcucccagcguggguaccauagucccagccagugggccagccuccgcucucaggcugagcuggagaggcuugcuggggaccugucccuggacauagucuuccuggcaugucauuccucacaugaugcccauccauggguuucagcaaagcaugcgugagaacaaggagaagcaggcgcugucugaccucaugaucaagccugugcagcggaucccacgcuacgagcuucuggugaaggugggcauggaccugggugggcaagugggcaaggccuggaagcauggggggauacaaggaggucuaaggccccugccucguugagccugacaucagggucccuaggggacagguaggaaagauaguccucuuuggugucuacccauagucccuccugcuccagcagucuggggccccagggguagcuaagcagucaggucugcuccccauucccaccccaggaccuccugaagcauacaccugaggaccacccggaccauccacuccugcuggaggcgcagcggaacaucaagcagguggcugagcgcaucaacaagggugugcggagugccgaggaggcggagcgccaugcccgugugcugcaggagauagaggcucacaucgagggcauggaggaugugcgugcgcccugccccaccccacccuaccccaccccacccacaucuguguccacucggccucugugugcaucuguggccaccuggaaucguggcuguguccauguccggaaccacaguguguuugcauccaugucugccagccucuguggccacacgucuccaccugucuguucuuccacgucugucucugaccuuggguccuguggccuggcagcacaagggcauugagggugggaagcaugcugcuuccauuggccuagcccauggaguggggccgagggaucacugggauuuuuggaggggauagggauuaauaacuggccuucgagaugccuugucccuccugucccacagcuccaggccccucugcggcgguuccugagacaggagauggucauugaagugguaagaagugucccaguaucuguccggcuguccccaccuccucacuuuguccucucuucugcucacacccucuaccugcaggucucccugcucuuucaccccgaggggagcccuggucgaguccccacucugcucugacucucugggaagcuggggaagagcccucacucucccugggucucaguguccccuugggcacuaugggcaggggggugggcuucuggacuguguccacccagccugaauucugccuugggcuccacagaaggcgaucgguggcaagaaggaccggucucucuuccuguucacggaccucaucgucugcaccacucugaagcgaaagucaggcucccugcggcgcagcuccaugagccugugaguggcugggccgggguuuggguggugccaacagggggagcauuugucccucucugagccccacuccccgacccuggccagagcgccccauuggcuccccacagguacacggcagccagugucauugacacagccagcaaguacaagaugcuguggaagcugccgcuggaagacgcagacaucaucaaagguggguuugaugcuagggguucuggguguuggggucuuccucugagaagcccuccuggagggucugagcuccagccagucuggcugccuguccagcugcuuuuccacuuuugggccucgcucucucauccagugcaagggggcuggcaugaaggacccauuuggcacccauggagccagacagucuguccauguacacuuccuuccaacugggcagggaccuaggcuggcagcgggagcuggguggggguggugcacacagagcagcaucacuguaauuagccauugauucaucugugcaaaaucauuugagcgccuaauauuagaugauguugcacugucugguucagcgguuucacacacagggaacagacacucgcuugaguuacugcaagcaaaggguugauuggagccauccauguuguucagggcugagacuguugggagcugaggcagcuuccaggagccgcuccuccugcggcgucugucuuucuucccuucuugcugagucugcccuguucucacugcuguuagcuuucccugcuuccucauaacucccgugaucagacccaggcuggcuccuggcucagcuggaggggagcucaccuggagcuuggcccucaggguaacagacagguuugcucggccccuuggugaacccaggccugcccacuauguaggaauaccagcugauuauuacucuaauugguccaagucaauagaaugaccaccuuuaaguuaggugcccacuccugguccagucagcugugagcaagaauggggcagggucauauggaagaaaacauggcugcccagguggugaggguugggaugggacaguuucugucaaaaggaguagaucggcuucaucucuucaggcuguuuuaacaaaaauaccacagacugggcaauuuauaaacaagaggaauguauugcucaccguugaggaggcugggaaggccaagaugagggugccagcagaacugcaaggggccugugccucacagagggugccuucuauguguccucacuuggcaaacaagcuccuucaggccccuuuaucggcacaaaucucauucacgaugguuucccccucaugaccaggucaccucccaaagguccgccucuuuuuuuuuuuuuuuuuuuuuuugagacggagucucacucuguugccaagcuggagugcaguggcacgaucucggcucacuguaaccucugccugccggguucaagcaauuccccugccucagccucccaaguagcugggacuacaggugcgcaccacuacgcccgguuaauuuuuuuuuuuuuuguauuuuaguagagaugggguuucaccauguuagccaggauggucuugaucuccugaccuugugaucugcccaccucggccucccaaaaugcugggauuacaggcgugagccaacacgucagccagguccgccucuuaauaccaacacacucaggauucgauuucaaccugugaguguugaguggacacaaacauucaggcaacagcagagcuguucccagccucggccuggcaggaaacuccacugccauccaccgggcacacacucuucuucccguagacacagugagacagccucccuguccagcgugacuccaucuuacaguuacaaagcgugcccuccccuccucagcaggcugccucucacccccacgggguucuuggucacagggccacuucagacaggacuugccagucucagguuccaugucucuagugcugucaugacccguccagggcugccuuaccauucugcaaccuguggcccaaauauuaaauuuauauacaccaauaacacauucuauaaacuagauuggagaaaaacaggaaaagaaacucauuuaggaaaaagcaaaaagacacuucuuuucccuugauuucaagacacauguguccuggcccaaggguggagggacagcuccauguauggaccacugguccagaaugugcgucccaagccuuggguugagggcggcaggccgucugcaggaccagcugcuuggcaguguucagguaugggauaggaccauagaaauccagggcaccaugcacugcccccuccuuuguggggcgaugagucucuuggucagcacauuugacugccuggggcucugccugcucugucagcacgcccacgggaggcugcaacgccgcagcaguuccgugucagccagggccuguguaucgcagagccagccaccauuucauacuccaugcucuccugggaauucuccgugggccugacauccugcgccacauggcucugaaucaggccuaguccccagcucacagggcugggguuccucagggagcugccuguuaacuuuuuucccaagagcuugggguuucuaugcuuucgguuugucaggucucuccccggcccagcugcaggcuaugcagugagggaaggagagucugucccagccugaccuugucugucucuguaucaguccacggccuuccucucucccucuaggggcaucccaagccaccaaucgggagaacauccagaaggccaucagccgccuugaugaggaccucaccacccugggccaaaugagcaagcucucugagagccuugguuucccccaccaggucugugcccucugccugacacuggggagccagagggugggaggcuucugacccugucugagagauagacagcccugacauuugccugagggaagagacaucccuuucccucaucugaaggcaaaaaucgcagccucccugcguaugggggaaguaacauguuccaggucugaggguggagacauagcugcauccccaucagagggugacagaggccccaucccccauauaucaaaggaauccaggucugagggaggagacagucucacuugcugucuaaggagagaggcagguccccacacauuaagggcaggugcaggcucuggugagaugcuggggccugaggccugggcccucuuccccacagagccuggacgaugcacugcgggaccucucagcugccaugcaccgggaccugucggagaagcaggcgcugugcuacgcgcuuuccuucccgccaaccaagcuggagcugugcgccacucggcccgagggcaccgacuccuacauuuuugaguucccucacccugacgcccgccuugguuuugaacaggccuucgaugaggccaagaggaagcuggguaagccaaggcacauguuggcccucuccuccuagagcuuccaggcaggaggccagaggcaucucacagcugucugugacuucaggagccagaaccgcagugcccugugcuccggcuccaccugguggggaggggggcuucugcagugaaacaucagacugaauaauagcuguggccucccuggcagggaggggauuccauggauagggucucacugucugcuggaccugccccauagugggcaccgauagccaagacccucgccauacccucccuacacacacucugagcagggcuggaucagggaaagcgauugaucaggguucauggcuuagaagauccacagagaccucugggucuaaccccaagacaauacacaugggaaaagauugaggccaggagcaacugccuuauucuaauguggcugggaucaggccuuccccuaaagagacccugaggggcaggggaggaaggggaauggggcaggggcaggaccagggugagauggaugcuaugcuaagcaggguccgucugucuguccaucuccacuacagcauccagcaaaagcugucuagacccugaguuccugaaggccauccccaucaugaaaacccgcaguggcaugcagguaugucugcaucugggucacuuggguacauguuuucaaagccagcagguguucaugaauuuuuguguacgacauuguguauaugccgugaacauugcuauugcuccuuaugucuuggagaauucagcucucuguacaugugugugggugcugcauauguauuacauguacacauguauauggguaugcuucgugcauaucuguaucugugcaugugaacaaagguuauaugaaugaugggaaguagcuucauuuaugugcuuguaugaggcugcauacauauguacagagguuaccagcaucacauuuuuucuaugcauguauccaugauuauaucuggggauauguguguguacauguaggcaugaugccuguaucccauaggcaugagugcauuugauguguagagggucacaugggcaaggugcgguggcuuacgucuguaauuccaguacuuuguggggccaaguuaggaggaucacaugaaccuaaaaguucaagaccaggcuaggcaagacccuaucucuacaaaaaauucaaaaauuauccacguuuaguggcgcgccccuguggucccaguuacuuaggaggcugaggugggaggauugcuugagcccuggaggucaaagcugcagugagccaugaacccaccacugcaccccagccugggagacaaagcaagaaccaauccaaaaaaaaaaaaaaggguccugugccgcguguauguguacgcguguguagaaggguguauagggcauccacacacacacacccaugcaggccugccucccuccauucugccgggguuucccaggaguggggaaugcuggcagcaguuccuccauucaccuucuccuguccauuggcgccuccugcaguucuccugugcggcucccacccugaacagcugcccggagcccucgccugagguaugggucugcaacagcgacggcuacgugggccaggugugccugcugagccugcgcgccgagccggacguggaggccugcaucgccgucuguuccgcccgcauccucugcaucggggcggugcccgggcugcagccucgcugccaccggugaggccugggcggcggggugggcggcaccgcgggccugggagaaccaaccccugucccagcacacucucaggccgccccggcgugguugugggcggggcccggcgagugugggcggggucggugggcguguccaccaccggggccccgucuggcucguagcugcugucauccucacuccgucuucucgcagggagccuccuccgucgcugaggaguccuccagagacggcaccggagcccgccgggccggagcuggacgucgaggccgcugcagacgaggaagccgcgacgcucgcggagccggggccgcagcccugccuucacaucuccauugcaggcucgggcuuggagaugacgccgggccucggcgagggugacccccgcccagagcuggugcccuuugacagugacucugacgaugagucuucgcccagccccucggggacgcugcagagccaggccagccgguccaccaucuccuccagcuuuggcagugagcuuuggccaucuccuccaacuuggccuuggcaggcaggguggacugcccagaggagggggagaggagggaccaguguagggcaaaggcauggcgucagaccucaggauguuagcacacagagcaaugagggcaggggaugugacaccaaggauccagaggacagugggacagucaggcgggaucaugaagacccuggagcacucagcuaaggaagauggggugcugguggaguggggacccacgguguggccacugggucugaggggccaggcaagaucaaggauucuguagugcugagcugucggugagcagggcagcagggcagcagaccggagcaggccggggaagaacagcuuugagaggccuuccggaggggcauggccaggagggaugcauggccuagaaagauaucaggucccaggccuggcagagggaaauggagacagagaccuuugucucccucagaugaggagaccccgaguuccaaggaggccacggcagagaccaccagcucagaggaggagcaggagccaggcuuccugccacugucuggcuccuuugggccugguggucccugcggcaccagcccaauggaugggagagcccuucgccgcuccagccacggcuccuucacccggggcagccuugaggaccugcugagugucgacccugaggccuaccagagcuccguguggcugggcacugaggauggcugguagggacaggggagggacuagggacacagugccagaacucugagcucccugcucuggaaaucaugugguccccuggagccaaggcaggagggcuuugggucacaccucagggguacugcugaccagggaugucagugggucugacaaucccagggaggcugugggaccucaguaccuugggcaggcacccagcauugaagacguggugcuaggggcaaagagguggagggaugacuccaggggcuggugugccccaagcauuugucccaggugcauaccccgauccacaguguccacguguaccaguccuccgacagcauccgugaccgcaggaacagcaugaagcuccagcaugcggccucugugaccugcaucuuguaaggccccaggguggcccuuccuaucuagacucuucucagccacacgugcaggccuccuucuguucaucuggucccccugcucuacugucccuccucuguguggaggcuggaagccagaggccuggcccuaggcuagcugugccucuuacacacugugugagcucgggcaagucacccccuuuucuuagccucaggcaacccccaccuggagaacaaggggugggaagagguggccucucgggagccauacccauucuaucugugguuccccugguccugggugacccacuuuggcugccugaacucccuuacugcuuccucuuuucccuacccagguaucugaauaaccagguguuugugucucuggccaauggagagcuuguggucuaccaaagggaagcaggugaguaucugcccucccccacacccugccccuguccccuuacugguguuggggcucucuccuggagauguggcuuugggcaacucccaggcccucugugggccuugguuucuuugcuuauaaaaggggaauguuaacaucucauuucaggggagaccgaggcucaaauuuagaacuggagugaauuuccuguuuucuuuaccccacuccaggccauuucugggacccccagaacuucaaaucagugaccuugggcacccaggggagccccaucaccaagaugguaucugugggugggcggcugugguguggcugccagaaccgaguccuuguccugagcccugacacgcugcagcuggagguagcagggggugggggaauggaauuggugccaugggaugagcuagguccgugugacagggagauggagaccaugguaggggcauaagcagcauccagcagagggcuagggccuuccucugaccacagagugacgcuggccagucccuguccuccuucgauccucauuucuucuguagcugaugaggaauacaguaagugucccauauacauuaggaaucuuauucauccuccugcccacccuaucucucaacucagguuuuaggguccuuuggggauaggacaagaguccuuucugaugucaacauccauuagcauuagacucuggcauuuauugcugcacaugucacuugcacacaugucagaaguauccaggggcaacggguucccuuaauuucccucacuuauuccauuguuggcugggcaggaguccaaagcccuggguucaggccccagcucugugacugacuugcugugugaccuuucccuucuaggcuucagcuuccccaccuguccagggggaggccagugacugauuuuagaacccuuuaagcauugaaguucucugauccuuaaaucacucaaguuuaauggggaaaaagcaccuccauuguaauuccugagaacuaaguugggaggugcuggugaaaccaagcuucgaaagguuaaucagaccaaggaccaacgcuagugugaguugugagggauggacacuggugaagcuccaggcuagggugggccaagggaggcaggccugccaaugacccaucuucucccccgccuuccccagcacauguuuuacgugggucaggauucaagccgcugcguggcuugcaugguggacuccagccugggugugugggugacauugaaagguagugcccacgugugucucuaccauccagacaccuuugagcagcuggcagaaguagacgucacuccucccgugcacaggaugcuggcagguacugaccucaaacuaccacagcacccuccuuggagccuuucugcccgaucguagaggcggcugagccagggccagaauucagccccagcuguggucugucucccaccccaggcucggaugccaucauccggcagcacaaggcugccugucugcgaaucacagcgcugcuggugugugaggagcugcugugggugggcaccagugcuggugucguccucaccaugcccacuucgcccgguacugucagcugcccacgggcaccacucagucccacaggccucggccagggacacaccggccacguccgcuucuuggcugcaguccagcugccagauggcuucaaccugcucugcccaaccccaccaccucccccagacacaggugggucagugcaucauaccccaagcuagggaucauggacauuugguuuaggacuccccacuauccugccagaagagcuuucaagagggaggaaaagugucacauagagcuggagguggcauaugugacaggaaauacaccacggaaguguccaaaugaaaucuaggauaguugugugugugugugugugugugcgcaccugcauguguuguguguauauaaaguucuauccagagaaaugucaugagagacagggagggaacuauaaccuaagagguagaauaugucacaaauagaauauguauauagaaaauauguccuguuguauauauuuccuauaugcaccaggaaauagcacaggacuagaaaugauauauagggcaggaaguggaaucaggaagugaugcacagagcaggaaauagaaauagcaacagaaaacaacauagaauggcacuagcacagaaaauggacugauaauuagaaagugaaacagccgggugccaggcgcgguggcucacaccuguaaucccagcaguuugggaggaugaggugggaggaucgcuugagcccaggaguucaggacccagccugggcaacauggugagacaccaucucuacaaaaaauacaaaaauuagccaugugugguggcacacaccugugguuccagcugcucaggaggcugagcugaggugggagacucacuugagcccagggaagucgaggcugcagucagcagagauugcaccacugcaccccagccugggugacagagugauacccugucucaaaaaaauaaaaauaaaaauauggccgggcgugguggcugacaccuguaaucccagcacuuugagagguugaaggggguggaucaccugaggucaggaguucgagaccagccuggccaacauggugaaaacccaucucuacuaaaaauacaaaaacuagcugggugugguggcgggcgccuguaaucccagcuacucgggaggcugaagcaggagaaucacuugaaccagggaggcggagguugcagugagccaagaguaugugccauugcacuccagcccaggcaacaagagcaaaauuccgucucaaaaaaaaaagugaaacagcaggaaaugagguacaucaggaggccacaaccagaaaagucuugcuuuggcaggacaagaaaugauauucccaagaggaaguggcuguggaaaucaggaagcaauaaagccucgggucaggaguugucuggguucacagaagacuuaagcuaccugggaaagggcuguuggaaguaggaggcuuauuuaaugcaaggacguugcgugcaguaaucaagagagauagaaaguggcaucuuacagggcacuuacauuguaaaaagaaaaaaaucagaaguggcgucaccuugggaaauuaugugacuccugacuagagauuacagaugggacauaagaagucuggcugccaagaagugggcauuucuuucuaaauaaguuccuagcuaacagaaagugggauucccccauaggaagugugcacaucuuccuuccuaucuucuggggugugggaauucaggccccgaugggacagugaagccuccauucgcccccaagcugacagauccuccccucugcccccaggccccgagaagcugccaucacuggagcaccgggacuccccuuggcaccgaggccccgccccugccaggccuaaaaugcugguuaucaguggaggugauggcuaugaggacuuccgacucagcagugggggcggcagcagcagugagacugugggucgagacgacagcacaaaccaccuccuccuguggagggugugacccugucugccguggcccaggacucgcccgcccaccugccuucagccugcuugccucucccuagcccacacgcagacuuugaccaggaguauccagccaggggcacacaugugccugcgugggcucugccuugucuucgcggaagcauuccugauggaacacccacuggccagccaggccauggcuucucccgacccucuggcugccccggugcuuccagucaugaucgggugggggacaugugggcugaccaggaccucugacccuggagcuucuaccaaagacacagcugggucuggaccccacggggcuggggagggccaugugcaauauuuggaggguuuucuggagggcagcaggaaggcuggggaauuccccauguacaguauuuauguuucuuuuuagauguguaccuucccaagcacuuauuuaugcagugaccuggucaccuggggugggggugauuugaggaaaugacaugaggaaaagaaaccuauuccugcccuggggaccacccugggacucuaaccaagccuuccuggagggacccaugcgccccugagccccauuccauucauacagacacacacguacgcacacugcauguccaaggcccuaaacauugcccguugacauaaacuuuccagggccccagccugauggggcugcccucaguccucuagaucaagaugcugacuauuagggggcagugauugccaucuggggaccugucaggcuuugucauuucccaguuuguugguggugccuuuagugguucccuaauuugggaacacugauggggccuuggacagggcuuucucucagguaggagaaaugggcccaugaucuccucacagucgcccccaguccuuggcccugcuucccugugucucaugcacuggcacauauggucaccuuggagggcagaccuaggagccccucugaccacugaauccgucuccacaccccuucugccaagggaagccccuucaggaaggaccccccaaagcugaggggcugaauguagccuuuucaacagagaaggcucccacuugagagcagccucuaccugacccccuggaccacagagagccacucugacccucagcccccucgcuucuucagcuaaaacuccaaagguuugguuucagaugggguuuguuuuguucuguuugguuuugguuuuguuuggggugggugggucauugcggucuuagauuauguuucucuugcuaccaaacagucauguauuaacucucuuuggaugaugaaguuuaaagagucaauaaauagaaacaccagaugacugcauugguggccacaguggccuccugucagcaaccucagggcucagucucccuggccacaugggccuuccgacguccacacacuugggaagaagggaggccuuggagacccagaagagugcuggacggcgagguugccacgauuugcuguguuaccugggcagguggcugggcugcaguuuccucaucaggaaaauaaagggguuguaccaguucagugcuuuguaaccaggguuacaugguagaaucccuugcagaugacauguaaaugcagaaacaugauucguaacuuauuuacguauuaauugagagcuucugagucagugggccuggauggagcuugggaaucugaagcugacaugcuccagguaaagagccaggaccccuguugagccugucuacggcuccuccaggaaacaauguucuccagcaaagccucagcuggagaacccugaugaaggccaaggcccugcuccaacccucugaaguguuuggagcagggauagaauccaagucugucugauuucuggucugaagaggucugucauuaaaucagacacaagaacgcacaggcccagcaacaugggacuauucugugcaaggacagagagcccuccagaccagagugcaccugcagaacuagagguggccaucacuagaaggcaugucgugccucagcucugcuacacgcacgaacguuuccagccuaaaugacugacuuuugagucagccccugaaggggcaugcaagcucaugcucugcaaacuggcagcacaccucucaggggucugcuggguccucaacaccacaggacgggcauggaccgucuccgugcagcaucauuuuacuggggcuaucuggggaggaagggauucuauuaauaagcacagauauauuauggaguaggaggcaucauucauguggaauauauaacgaaacaaagcauuagaagaaacacaggcuuugaagcuggacagaccuuguuugagaucuugacuuugccgcuaacuagcuaugugccuuugggcaaguuguauccccucugagccuccauuuccucacgugugaaaugaggcugaugaucccuucccgaacaggacugcugcuuggcgugcacaggucuuuggauugcaagaaagagauucauuuugcuugugaacuagaagggugcuuauuagugaagaugugagcuggcagcaaggagcugucacagggcacuguggcccagacaucagagcugcaucucaggacaucuggccucuccacuugagucgccagugccucccacacugccagucaguugcuguuccacugcuuuccagcuucugcugccucagggccuccgccuccuccacucggaggacccugggcagacuucaguuuuagcacaagauacccaagaccagauccucaccacuuccccgacucaagugccucaguaagaaugggcuuggcccagcccacuguuacuuagaggcccacauuccagggcacuggccagccuguggacagcccggaccccaucagcugugggcagggaggcccuggaaugagcaucagaccccaggcucccggcccaggggaggcuccuggaaggauuaccuccucugaagcagugguucucagccugggaugcacauuaugaucaugagggccuaggccaauuccaagccaauuaaaucugaacuuugagggugggacccaggugucuauauguuuuucagaaaccuuuaguugaaguauaacauuuauacaaaaaaggacauaaaaaaggacccagcgugauggguauucauaaagugaacacacccaggucaaggaacagaaaaucucaucaccccagaagcuccccuuagaccuccuucuggucugcccuccaaggguaaccaccaccccggcuucugacaccaugaucuagcuucaccagccaagguagagaacugcugcuguaaagggaaugacuaugguuagccacuggugugggggaaaguggggcuuggguuugauguuaagagggaacgccagccuggccaacauggagaaaccccaucucuacaaaaaauacaaaaguuagccaggcgugguggcgugcaccuguggucauagcgacuugggaggcugaggcggagaauugcuuuaacccaggaggccaagguugcagugagccgagguuacacagcaccccauccugggugacagagggagacucugucucaaaaaaaaaaaaagaacagcucaaaccaaggcaaggagggguagaggagccuggugcaggcccagguggauggggaaagaggaaaaggcaggggcgccuagauugggagcuccgugagcgugggauuuuguucuuuguuccauccccaggccugccacagugcgugacacacaguagaugcucaguaaauauuuguugaauuaaaucuggagaauucagg

SEQ ID NO: 15299 - RNA, 152 nt, Homo sapiens
gaugggucaccagcagcuguacuggagccacgcgcgaaaauucggccaggguucucgcucuugucgcgucugcucaaaccggcacggucugauccggaaauauggccucaauaugcgccgccaguguuuccgucaguacgcgaaggaugucg

SEQ ID NO: 15300 - RNA, 50064 nt, Homo sapiens
ccuguucuuuuauugcuuacauuuucaaacuauagcccacaauguuaacaucacuuccccguuuucagccacuuuccccaacuaaugugcaagggcaaacugccagucuacucuguuguacagccucacuuagaguaugaacaucugcagaguugcauauaaauaaauucugacuuugguuguugugagaaccaugcuuaauaaugauguuggagauaaggguaagauaaggaguuucuaaaacugcuaagaucauaugcuuuggcugggucauauaauagguauauauuuaacauuuuaagaaacugacaaacuguuuuccaaagugguuauaccauuuuacaauuacaucaacgggguacuaguguuucaguuguuccacaaccuuaucaguacuuacuauagucagucuuuuuaacuuuagacauucuaauaggugugauguuguaaaucauugucauuuuaauuuccauuucucugauaauguugaucaucuuuucauauguuuauuugcaucuguauauuuucuuuggugaagugucuguucaaaucuuuguuuaauuuuuauuggguuuguuuuauuuuuauugcauuuuaagaguuuauacucugaauacaaauccuuuaucagauauuugauuuaugcaauuuucuucuagucuguggcuuauuuuuuuauuuccuuaauaccuuucaaagagcacaaauuuuuaauuuuaaugaaguccaaccuaccaauuuuucuuuuauggaucauauuuuuggugugguagcuaagaaaucuuugccuaaaaccaaggucauaaagauuuucuccuagguuuucuucuggaaguuuuauaguuuuagguuuuacauuuaaaucuguaauucagcaugagcuuaucuuuuauuaugguaaacagaauaagucagaguucuuugucccuuuuuugaacuuuuuuuuuuaacuguccuuucgccacugaauugccuuugcaucauugucaaaaaucaguuauucaggccugccacaguggcuuaugccuguaaucccaacacauugggcugagugggaggaucacuucuggccaggaguuugagaccagccugagcaacauaguagacccugucucuaaaaaaagaaaaaaaaaaauuucaacuagccaggcauugugguacauuccugcgguccuagcuacucaggaggcuaaagcaagaagguaucuugaacccagaaguucaagguuacagcgaacuaugauugugcuacugcacuccaaccugggaaacagagcaagucucuuuaaaaaaaaaauuaaucauauauguaugggucuguuucuugacauuuuguucuguucuauugaucuguuuguccagcuugaugccgguauugcacugacuuaauuacuguaauuuuauaauaagucaugacuucagguaguguaaguccuccaacuuucuucuuuaucaaaguuguuuuggguauucuagguccuuugcauguccauaugaauuuaaaauugguuuucuaccccaaaaagccuaucaggauuuuuauuaggauuaugaugacugcauagaucaacuggaagauaacauugccauguuaacaauauucaguuuuccaauccaugaacauaauauacuucuccauuuauuuaggacuuuaauuucucucagcaauguuuuguaguuuucaguagauagaucuugcauauccuuugucagacuuaccccuauuucauaauuuuggugcuauuguaaaugauuuuuuaaauuucaguuuccaauuguucauugcugauccauaaaaauacaguugauuguuguauauugaucuuauauccugcaaucuugcuaaacucacuuauuaguucuaguagcuuuuuuguaaauccauaggauuuucuauauaaccgugucaccugcaaauaaagacaguuuuacuuauuccuuuccuauuuggauuccuuuuuccuucuuacuauaaaauugcugaauagaaguggugagagucaacagaaauccuugccuuguucuugaacuuuuagcaagaaugcauucagucuuucaccauuaaguaugaaguuagcaguaggguuuuuguagaugcccuuuaucauguuaaagaaguuucuucuguuucuauuuuguuugcuaauagaaauggauguuggaucuugucaaaugguucuuuuuuagucugcuaauaugguguaauugcauugaugauuauucagauauuaaaccagcuucacauuccugguaaaccccacuuggguaaugauauauuaucuuuuuuuuuuuuuuuuuugagacggcguuucgcuuuuguugcccaggcuggagugcaauggcaugaucucagcucaccgcaaccuccaccucccagguucaagcgauucuucugcuucagccucccaaguagcugggauuauaggcauaugccaccaugccuggcuaauuuuauauuuuuuuaguagagauaggguuucucuaugucggucagguuggucuugaacucccgaccucaguugcuccacccgccucagccucccagagugcugggauuacaggcaugagccagcgcgcccggccuauccuuucuauauauugauuggaacugguuugcuaggacucugauaagcaugcuuccaucuccauucauuuccuuguaguauucuugucugguuuuguuacaaugcuugucuccaaaugauuugaaaaguauccucuccucuucaaguuucuggaagccuuguguagaauuguauggaauuucgucuuccugaaauguuuaguggaauuuaccagggcuguuaucugguccuggaguuuuuuuuuuuuuuuggaaguuuuuaaauaauagacuccauuucuuuaguagauacaggguuauuaagguuauucuucugagugaacuuugguaaguugucucuuuuaaggaauuuguccauuccaucuaaguugucagauuuauuggcacaaaguuguuuauaauauuccuuuauccuuugauuaucuggaaaauuaguagagauaucaccucauuccugauauuggucaugucuccucucuucugaucauucugcuagagguuuauuaauuauauggaucucuaugaagaaucagcuuuugauuuuauugauuuuucccucguuuuucucuuuucuauuuucuugauuucuacucaggauuuuauuauuucuuuucuucuguucaauuuggauuuaauuuucuccuuucuaauuuguaagauagaaacugaggucauugauuugagaguuuucuucuuuuugaauauuggcauuaagugcuaaacauuucccuguaaguauugcuuuagguccauugcacaaauucugguauguugugucaucauuuuuauccaguucaaaauauuuucuaauuuacauuuuuuuuuuuuucaaacagagucuugcucugucacucaggcuggagugcagugaugcaaucucagcugacggcaaccuccuccucccaggugauucuuaugccucagccucccagcaccaccacgcccagcuaaauuuuguauauuuaguagagauggggucucacuauguugcccacgcuggucuagaacuccugagcucuagcgauucacccaccucagccucccaaagugguaggauuauaggagugagccacugcaccuggccucuaauuuauguuuuaauuucuucuuuugacugauggguaauuaaaaguguguuacugaauuuccaaauauuuggagauuuuuccagauagcuuuuuguuuuuuauuucuaguuuauuuccauuguagucaaauaacauacuugaacccuuuuaaacuuuuugagcuuuguuuuguaacccaguauaaacguauaucuugguaacuguuacauguguucuuaaaaaaaagaauguauauuuugcuauuguuagggguuauguucuauaaaugucaauuaagucagguugguuauaguauuguucuagucuucuagacuggaacgaaccuuuuaccgguccauggccuguuaggaacugagccacacagcaggaggugaguggccagagagggagcauuacugcuugagcucugcguccugucagaccagcaggcagcauuagauucucagagaagcauaaacccuauugugaacuucacauguaagggaucuagguuggacccuccuuaugagaaucuaauaccugaugaucugagauggaacaguuucauccugaaaccuucccucaugguaccccaaggguccaguccauggaaaaauugucuuccaugaaacugguuccuggugccuaaaagauuggggacagcuguucuguauccuuacuaauguuaauacucuacugggugcccugugccuuaugaaguuuuuacucuuuuaggagggagcaggaguuauucucagaccugugugaguucugaggauuauuuuuccuaauccuuuuuagugcuucuagcccuagcuuuggguaauuucuucacauauauguacugaccaauacucagccaaagucuugaggaggacccucugcagauuuccuaaguucugcgcaucucucucuucuucauuacaguccccccuuaucugugggggauauauuucaagaccuccagugcaugccugaagucacagauaguaccgaaccuuauguauacuguguuuuucccuauacauacauaucuaucauaaagcuaauuuauauaugaggcacaguaagagauuaacaacacuaacuaguaauaaaauagaauacuauaacaauaggccagcagcacuacuguagugcuuuggggccaguauuaaguaaaauaagggcuacuugaacacaagcaccgugauauggugacagucaauugggauaaccgagauggccacuaaaugacuaauggacaaguagcuuacauagcuugcauauacucgacaaaggggugauucacaucuggggagacagacugaaacacuaaaaugucaucaggcuacucagaauggcacacaauuuaaaacuuaugaauuguuuauuucuggaacuuuccacuuaauauuuucagaucaugguugacuggguaacuggcaccauggaaagccaaaccacacauaaggggagacugcuauacuccgcauccugagcucucuccacuuuggcuuuacuaaauucccaguuucaucuccucuguucagggaggucaccaucaugugccuggguuucuucucccuaugucauaaccuaaaaacuuucuucauacaguauguuguaggaguuuguuuguuucccaucccccagggaucacuguccuucaugagugaugcccagugucuugaaaacuguucuuucauauauuuugaacaguuuuucaguuguuucugacaggagguuaaaucugaucccugauacuccaucuugccuggaagcacaaauccauuuuccugauauuuuuagcaucaucuuuuucuuaacuuuuauuuuaaguucagggauauaauugcagguuuguuacauagguaaacuugugucauggggggguuguacagauuauuucaucacccagguguuaagccucauacccauuaguuauuuuuccugauccucucccuccuuccacccucuacccuccgaaaggccccagugucuguugauccccucuauguguccauguucuaaucauuuagcuuccacuuacaaaugagaauuugcgguauuuggucuucuguuccuguguuaguuugcuaaggauaauggccuccagcucuauccaugucccuccaaaggacaugaucucauucuucuuuauggcugcauaguauuccaugguguauauguaccacauuuucuuuauccagucuaccauugaugggcauuuagguuuauuucauuucuuugcuauugugaauagugcugcaaugaacaugcaugugcaugugucuuuauaauagaaugauuuauauuccuuugguuaacaucaucuuugauaacuuacucauguuguauuuggagugauguccacugugauuacuucucuguccaguggaguugagagauucuauuaguaaauauugaggagcugucuuccucuguauuagguauuaccagauucuuuaucuggauucucccuuccucguaaaaacaaaagcuaaugcuuuauuaaguaccuccuaugcaccaaacauguguuagggguuuuaaauauuuuacuucauuuaaucuuuaugcuaacccugugaagaaguaacugucuucauuagagagacgaggucauugaaauugaggaguuaauuugcccaaggucacacaacaaguaagugacauagucaacauucaaacccaaguuggccagaccccaagacccugcuuucuaccucaugauugugccaugaagcugagccccucagagguguuuuuaaugaguacaagaagauggcucccaaaaccaacucaaaaagaucaucuuuccugccucugcaauaagaguaagcauuuuggccgggcgcgguggcucaugccuguaauccaagcacuuuggaaggccgaggcagguggaucaucugaggucacgaguucaagaccagccuggccaacauagugaaacccccgucucuacuaaaaaaaaaaaaaaauacaaaaauuagcugggcaugguggcacacaccuguagucccagcuacuccggaggcugaggcaggagaaucgcuugaacccaagaggcagagguugcaaugagccgagaucacaccauugcacuccagccugggcgacaagagugaaacuccaucucaaaaaaaaaaaaaaaaaaaaggaguaagcauuuuacaacaucuaagaaaggguaaacguuaguauggcuagaaagaauaguuuugauugaaguucugucaagugacaagaagaaaaggagagagcaguccuuaagagacagaggaagcaugugauuuuagaaaugcugggucaagaaaacaguguaacaguucaguuaagagaguggaagaggaaaaaggaagaaauuauucugagaugacaugcuuuggaaagcagcuagagcaaugcagaagcauaugacagugaccgcuauugcuggcacugcagccuucuuacugccuuccaugggaauccaaaaaucaacuccaaauaaaggaggaaaaaaggaauguuuaguaucaaccggguugccaagauaaaauguuuuggauugauucccagugucaaagcacaguacauguauauuuuuggaaacuuguucuacccacauuuuuauaaauguauggguguuguguuuuguuuugauuuuuguaauacccacuguuuuuuuaaaugccuguaaacuuuccuagaauaugaaggcaaugucuucuaaguauauauaauacauuucaaguuaauuuuauggcaauuucuagcaugauucuuuuauguggcacaaugcccuguuggaaaacaauagaaucauaagucugugauucugaauauuaugcuccuaacuagugaguggcaaaagacucaguaucaugugagacuguuuugccaccgaacugacugaugauagaugaauaauuuguaagagauagcacaggauuuccucacucagcuguggagaauuuucaguaaaguuaucaaugagaauauuucagcagcuuugaaaugguggcaauaaauaugucaggaaaaauauauaauuuauuauucuggaacucuccacaauucuguguaaucuuuucccuuuuauuuuuauuugacacauaauauuuauacauauuuaugggauacagaaggacauuuugauacauguauacagugcuauagaauuguauuaggcaaacagugguuaagaggagagucaguuuuaaaacuucagugauaauuacucaagagaaagccauuuaauucaugaaaaaguagaacuugacagcuaggcagccuguacuuuuggacucaucauauccugacuucucuccaguggccucuuccgcauucccagggccaugcacuuggccucuccuuuuaguauccuucacucuagauugugaaccacuggaaggagacacuguguccuucguuuucuauccaucaaagaggcuagcguaguuuucuacauacaguagauauuugauacuuuaauuaauuaauguaauggcucuccuaugaaggccaauccugccuguccauucuuuguaaccuuaaauguguaaacauuggugcuuuuguauguuugaauaugggaaaaagcagccaaauaagugcuuggguguagcgggcaagaaacaaauauuugaggcuguuugucucuucuuuauuagguuuuuaauuuaaaaaguaaaacgugcauauucuaauaguucaaagaguauagauguauauaaaaagcaagucagucauuuccucuauucuccagucuuuauucuucucauucugccuuccccugucagauacguaugcucauauaaauauuauuuauauucacuauaucacggacagugcucuagguaagugccuguggaucuaacucauuuuuuacacucaaugccauuucaauuaauaaaugccuuuuagcuaugauggguaauauaccuugaaacuggguuaaaaaauuauucuccuuguguuacauuucagaagagagugugcuuuucacguuuguucguguguaugguaaaauauacaaauuuaccacuuuaaguguaaguuuaguggcauuaaguacauucacaucauuguggaaccauccccaccauccauccaucuccagaacucuuuuuuuuuugagauggagucucacucugucacccaggcuggaguacaguggcaugaucuuggcucacugcaaccuccgccucccggguucaagugauucuccugccucagccuccugagcagcugggauuacaggcaccugccaccacacccagcaacuuuuuggucuuuuuuguuuguuuguuuguuuguuuguuuguuuguuuuugagacggaguuuugcucuuguugcccaggcaagcuggaguacaauggcacgaucucagcucacagcaaccuccgccucccagguucaagcgauucuccugacucagccuccugaguagcugggguuauaggcaugcgccaccacacccggcuaauuuuguauuuuuaguagagacaggguuucuccauguuggucagacugguuucgaacucccgaccucaggugaacugccugccucggccucccaaagugcagggauuacaggugugagccaccgugccuggccuaauuuuuguauuuuuaguagagauaggguuucaccauguuggccaggcuggucucgaacuccugaccuuacgugaucugccugccucggccucccaaagugcugggauuacaggcaugagccaccgugccuggcccauuucuaguauucuuuucaucuagcaaaaguaaaacuuucuggccauuaagcaauaacuccccaucaugcagccucugacaaucaccauucugcuuucugucucuaugaauuugacuacucugcauaccucaaauaaguagaaucagaguauuuuaucuuuuugugacuggguuauuccacuuagcauaauggccucaaagaucacccaugucauauguagcaugugucaaaauuucccuccuuuuuaagacugaauaaacugggcaugguggcauguuccuguagucccggcuacucggggggcugaaguaggaggaucccuugcauccaggaguucaaagcugcaaugagcuaugaucgcaccauugcacuccagcuugggcagcagagcgagacccugucucuaaccagauagacagauagguagacagacagagaauaauauuccaucguauguauguauaccacauuuuuauuugguuugugguauauacauacauuuuacuuauccauucaucucucaauggacauuugaguugcuucuaccuuuugugaauaauguggcugugaacauuuguuuacaaauaucuguucaagucugugcuuucaguucuuuuggguauauacccaaaauggcauugcugaauuaugugguaauucuguguuuaauuuauugaagaaacauguuacuguuuuuccauagcagcuguaccauuuuacauuccuaccagcaguguauaaaaguuccaauuuuuccacauccuugucaacacuuguuauuuucuggguuuuuaaaaauauauauaacagcauccuaaugggugugaaaugguaucucauugugguuuugauuugcauuucccuaaucauuagugauguugagcauauuuucaugugguuauuggcuauuuacauaaauuauuuggaaagauaucucuucaaaucuuuugcccauuuuuaauuggauuauuuguuguugauggucaguuuuagggauucuuuauauauucuggauauuagucccuuuuaagauacauaacuugcaaauaccuuaucccauucuguggguugucuuuucacucuauuguucuuugaugcauacauauuuuuuauuuugauaagguucaauuuaucuguuuuuuucuuuuguugccuaugcucuugguaucauauuuaaaaaacucauugagguggggggauugccugagcucaggaguucgagaccagccugggcaacacgguaaaaccccaucucuacuaaaauacaaaagauuagccgggugugguggcaugcaccuguagucccagcuacuugggaggcugaggcaggagaauugcuugaaccuggcaggcggagguugcagugagucaagauugcgccacuacacuccagccugggcaacagagcgagacucugucuccaaaaaaaucauugccaaauccagugucauaaaguguuuccccuguguuuucuuuuaaaguuucauaggcuuagguauuugauccauuuaauuuuuucuguguaucguauaaggugagauuucaaugucauucuuuugcauauggguauccaauuuuuccagcaacauuuguugaaaaacuguccuuuccuccacugaguggucuuggcauccuuguugaaaaucauuuaaucauguaugugaagguuuauuucugggcuuucuagucucgaacucaauuuuuaaaaaaacuuuuaagugcaagaguacaugugcagguuuguuauauagguaaacucgugucauggggguuuguuuuacaaauuguuucacuacccagguacuaagccuaguacccaauaguuauuuuuucuaauccucucccuccucccaccuucugccuucaaguaggccccagugucuguuguuccccucuuuguguccaugagugcucaucauuuagcucccacuuauuagugagaacaugcaguauuugguuuucucuuccuguauuaguuuguuaaggauaaugggcuccaguuccauccauguuccuacagaagacaucauucuuuuuuguggcugccuaguauuucaugguauauauguaccacauuuucuuuauucaacuugucauugauuaguauuuagguugauuucaugucuucgcuaguauaaauagugcugcaaugaauauacacgugcaugugugcaugugucuuuuuuuuuuuuaagacaaucuugcucuguugcccaggcugcaaugcacuggcacaaucuugacucacugcaaccuucaccucccagguucaagcaauucucgugccucagccuccugaauagcugggauuauaggcauaccaccacgccuggcuaauuuuuguauuuuuaguagagacaagguuucgccauuuuggcaccacccacuuuagccuuccaaagugcugggauuacaggcaugagccaccacuccugcccaugugucuuuauaguagaaugauuuauguaccuuuggguauguguccaguaaugggauugcuggguugaaugguaguccuguuuuuagcucuuugaggaauugccacacugcuuuccacaguggcugaacuaauuuauacucccaccagcaguguauaagcgucccuuuuuuccauaacgucaccagcaucuguuauuuuuugacuuuuuaaauaauagccauucucagccaggcaugauggcucacuccuauaaucuuagcaauuugggaggccaaggcgggaggaucacuugaacccaggaguucaagaccagccuaagcaacguggugaaaccccuuaucuaccaaaaaaaaaacaccaaaaacaaaaauuagccaggugugguggugcacaccuauagucccaucuauuugggaggcugaggcaggaagauugcuugagcccaggagguugacacugcaaugaaccgugauugugucacugcauuccagccuggauaacagagcaagacccuaucucaaaaaaaaaaaaaaaaagccacucugacugaugugagaugguaucucauugugguuuugauuugcauuucuuuagugauauugaguguuuuuucacauacuucacgaacuuuauuuuuuuucuuguuuuguuuucuauuuuuuguuuuguuuugagacagagucucgcucugucaccaggccggagugcaguggcacaaucucggcucacugcaaccucugccucccagguucaagcaauucuccugccucagccucccaaguagcugggacuacaggcgcaugccaccaugcccggcuaauuuuuuguuuuuuuguuaauagagaugggguuucaccguguuagccaggaugaucucgaucuccuguccuugugauccgcccaccucggccucccaaagugcugggauuacaggaaugagccaccucacccggccggcaaccuuuauuuuuaaugaguguuauuaaucuauaauauggauacaucagagugcauucaaacauuccccuguugauggacauauagauugugucgaggcguuugucacuacaggcaguguugcaguaaacaucuuaaaauacauagucuuacaccuuggugcuuuuauuuccccaugauguauucauaaaagcggaauugcuagaucaaugguauguuuaguuuuuaauuucagugaacagguuguuuuuucaaaaggauguaugaauucacauuucuaccagccauagaugaaauccuguucuccacauccuugguagcacuuagcaaccuuuuuuuuuuuuuuuuuuuuuuugagacagagucacgcugugucgccccagcuguagugcaguggugcaaucuuucuuggcucacuuagucuccaccuccuggguucaagaaauucucuugccucagccuucgcaguagcugggacuucaggcaugcaccaccaugccuggcuauauuuuuuuucuauuuuuaauagagaugggguuagguuucaccauguuggccaggcuggucucaaacuccugaccucaagugauccaccuaccuuggccucccaaagugcuuggauuacaggcgugagccaccacacaccuggccugaaaccuuuuuaauguucacuaacaggaucaguuaaaauuuagaggcccuugucagucaguacuuaacagugaaaagugaaaggauacugauaaauauuucuuacauauuugacagaaacuuccuucuugauuuaaaaaaaaucucuguccuggccaggcacgguggcucacaccuguaaucccagcacuuugggaggcugagguggguggaucacaaggucaggagaucgagaccaucguggcuaacacagugaaaccccaucucuacuaaaaauacaaaaaauuagccgggcgugguggugggcaccuguagucccagcuacucgggaggcugaggaggcagagcuugcagugagccgagaucacgccacuacacucaagccuggcaacagagcgagacuccgucucaaaaauaaaauaaaaaaaaaucucuguccuaggccuggugcaguggcucacaccuguaauaccagcacuuugggaagccgaagugaguggaucacuugaggccaggaguucaagaccagccuggccaacauggugaaaccccaucucuacuaaaaauacaaaacaauuagccaggugugguggugggugccuguaaucccagcuauucgggagacugaggcacgagaauucuugaaccugggaggccgagguugcagugagccaagaucacgccauugcaguccagccggggugacaagagcgaaauuccaucucaaaaaaaaaaaaaaaaaaaaaaacucuauucuuucauaacaugaaaaauguaagugcgaaagauagucauuucuaugcagaguuaaaaggcaaauuaacauuuugaaacaaucagguuuuaaguguuuuuccggcuuucaaccauuuucuugaaguaaggaaacuagccaaugguuucuaauuuuucuuagcuuaaugcagauaccgaaagagaagaaggcgaagaguuugaagauaacauggauguuuucgaugacagcaguuccagcccuucuggcaccuuaagaaauuauccacucaccugcaaaguuguuuauuccuacaagguuuguauuucuccaacauaauguuauuaaauucugauuaacucugaagauacacaugacuguauccauccagucucucaagcuguacuuagcauaaaauuguuauuagguuaauauuggggcaacauaacagaauggugaugaguuuaggcucugacuugacgucuuucacuugcuacuccgucugccuagaacucuuuuuuuccccaaaucucaguugguuguccccugcuccucauugaagcucagcucaaauaguuccuucuuaaggucacccauaaccaccuaaauaaauaaccaacuccucagucacuacuuguuaucccauugccucuuuuauuauauagcacuucugcucagccaaacuuaaucuuauuuauuuucauauuucuuugaugcuccacuaaagguccaugaaggcagaaauuuugucuguguauguguaccuugucugugugucuucagccccgaggacgauguccagccauagugggucaucaguagauaauugugggaugacuacaugaauguuggaagggaggcgugaauacaugaaucuucucuugccccuguucugguggaggcaugugugagaaggggcaaugcggaaggcuaucagaagggaagguccuggagagagaauccaccugucaugcaccagauucacuccuccgccacaucccuguguagccaaaagguggcaguguuugguaaccucaauaucagugauucccagacuuguuuugaguuuaacauccuuucauuuuauauuuaaauucauaauacuuccuguucauugaaaguguuagcauuuuuuuccaauguaaaucguuuugauaaucuuuugaaaauuuaaaaucaucuucucagauacuuggaaagguauuacaggguauuauaaaacuagcauuggaauuguuuccugauaccaccucccauuauauuuacuugaacgucccagaacuaaaauuuaaguuccuuaaauagagagauuccuaagugucugagugauuuuaaacaguucacauucauucaacauucccucuguuggcauaucccaggcacaucccugcguuaaauagacuaugaacaucuauuuagucaguuaaucauugaauaaacauauagagugcccaauaugugauacacuggggggaugccagaaugaauaugacaucucuccccucuaggaauggacaaucuaugaaggguuaaauauuaaacuggaaaauagaacaagugugaaaagauuuauaguaaagguagagccacuaauucuaccuggaucauugggagaaauuuuacagaugagguggcauuuaaaguaggucaugauuuaagaccuuucuagaugcagugagaagguagggagaggaaagagccuucuaagcaaagagaacagcagguauagagacagagugugaugagagugugggguguucaggaaauguuaaauucagugguguaggagugggagaacagaggggcugugcauaaagguguuuguugucagauaguaaagggccuuggguaccagacuuagagguuugguuuuuauccuggcuaggaagauccuuagauggccugaaaucagauuggacuuuuaagaagcuaaccuggucaugguauagauauucuagaggacagauuaggauacagagggacugacuuuaagccuaaucauaauucuuauaguccagaccaaaaaggaggccucgaauaaucuggugagaacaaagaaacuauauuuaaugguuagaguuggccgggaaugguggcucacgccuguaaucccaacauuuugggaaaaugaggcagguggaucacugagguuaggaguucaagacuggcccaaccaacauggugaaaccccaucucuacuaaaaauacaaaaauuagcugggcgugguggcgggcgccuguaaucucagcuacuagggaggcugaggcaggagaaucacuugaacucaggaggaggagguugcagugagccaagaucgcaccauugcgcuccagccugggugacagagcgagacucugucucaaaaaaaaaaaaaaaaaaaagguuagagucaaaagccuuaagaauguucauaacuuuugacccuauuagcauccauccuaaggaaguaaaucauaauauagaaaaguuuuggacacaaaaauguccuuucauauaguacugcuuuauaauguauggcacuucugcccagccaaacuuaaucuuaguuuucauauuucuuugacuccccgcuaaagguccaugaagggagaaguuuugucucuguauguuuaccuugucugugugucuucagccccuaggacaaugcccagcacguaguaggucauuaguaaauaauuguggaaugaauacuugaaugauggaaggcaugaacaaaugaauccuucccuugaccucauucugauagagacaucagugaggauaauagagcucaugacuggaugcaauggcucaugccuguaaucccaacacuuuguggggccaaagcgagaagaucacuugaagccgggaguuugagaccagccugggcaacaaagaaaaaccuggucucuacagaaaaauuuuaaaauuagcugagcaugguggcacaugccuaucguccuagcuauucaggaggcucaggcaggaggaucacuggagcccaggagaucgaggcugcagugagccaugauuacaccacugcacuccagccugagugacagagugagacccugccucuaaaaaauaaauuuuaaaaaaauuuaaauuuggcaguucaaugagaauaauuaaacuagacauucauauacuauagccauaacauauaauauuaugaaacuuacugaaauuuucaucaagaguuuuucuauauaagaagaaacccuuauguccuaauauuaaauuaaaagguaggauaccaaauuguauguaccguaagagcucaauuaugcauauuuuccagcuuuucuacgaugaacauguaugauauaaucaggaaaaacauauuguuuuaaaagaaauacaggaaauuuggagagauacugguggaaacggagcucugguugucacuggauacuaggacuuaaggagacaguaugagaguauguguguauuuaauaaccauuuacugcucacugucuuuaguugggguaagugagaagaaauguagucccuaauuauuucuaguaggaagcucacaaggacaaacucauuagagcaucaugguagucaguguuauggggacgcucagagagccuuuuaagaacaaaaugggggcugggcacgguagcucacgccuguaaucccagcacguugcggggccaaggcgggcgaaucgcgaggucaggaguucgagaccagccugaccaacauggugaaaccccgucucuacuaaaaauacaaaaaauuagccaggcaugguggugugcaccuguaaucccagcuacuugggaggcugaggcaggagaauuucuugaaccugggaggcagagguugcagugagccgagauggcaccacugcacuccagccugggcaacacugugagacuccgucucaaaaaaaaaaaaaaaaagagcaaaaggaggagcagcuuacucaucaugaguagucugggaaaacauaugcgcucagucucaagucaaaaguaaucguaacuacuuaucuaucuaucuaucuaucuaucuaucuaucuaucuaucuauuuauuuguaaucccuucaauaacccuaugaggaagauauuaucaaacaccccauucauucaacaaauagugcuugagcaccuuccauguaucagugcugugggcuuuucuaggcucugggauauagcauugaucaaaacagacaaaaaucuuugcccucauugagcuuauauucuaguacgaaaaaagaaaacugagguucaaagguaucuuacagucacuugcccauaaaaauauacugaagcuggacuuaaacccacaguaaucuaagucugcucaucagauaggaaagagggaacagagccugauggacggaagaacaccuauaaaagcacagaggcaaggaagaacaugguaugcucagagaauagaaauagugugcaggggccaaagcgucaagaggcccacagggaccaaacucugcagggucuugauagccaugcaaagaacuugaccuuguuagguggaagaauuggucaucacugcuuuaggaugggaugaucaagcuagugucugcuuacauuggacaacuagugcugcaguguugaaaaacuugcauggaccuccaugguuuuuguuuguuuguuguuguuuuuuuuuuuuuuuuuuuuuuuugagacagggucuugcucugucacccaggcuggagugcaguggugugaucucggcucacugcaaccucugccucccugcaaccucugccucccugauucaagugauccucccaccucagccucccaaguagcugggauuacaggcacgugccaccacacccaccaauuuuuuguauuuuucauagagacaggguuucgccauguugcccaggccggucucaaacugcuggccucaagugauccacccaccuuggccucccaaagugcugggauuacagacgugagccaccucacucagccucuccauagcuuuuuauaagggcagcaguuuauuuaaaaguguacuaccucccugguuugcugucacauacauuaacgucuggucguguugauacuuuuuaggucuugccaugaaaaacauuuuuauuacaaaaaugccuuuugcuggcauauucaaggcauagugugguuucagaguagugaaggaauuccauuggaaaagcuaucaaggguaaaugagugggguuuuuuccucaauauuauuuuucugucucagggagcuauggcaacauccagaaucuggauuuugaugaaauguuuuaauguucauaaaaugggaaauugaucuugaaaaugaccccuuuuuugccuuauuuuuguuuguguaacuuggaguuaauuuuacauuuugagauugugagauuuuaaaaacuuuaugguuuuaggugaugguuuuaacccaucuugggacuuggggaaagcuuuuaagacuguuuucuagagagccagaagccagcaggccccugucuauuacacaugacaggcaagacuguuaggaagcaaagccacacggacuuuccagccccucuguggagccucagagcguuuacagauuuggcagucucaagggcaacauguggguggcugaugcugguggauugcugcugucagggauaauaaaaccauuaugguuagcagcuuguacgguagcacgcaaauggaucagcucagucuccacacaguuaaguuggagcauaagaaauccaaaccaugacugaucucaaucauuuccuuuccuacaauuuuuuucuuuuggccacugcuuuacagugauuccagaucaauccuaggcacugcacccacuaucaucaaauucacguacauaguucuuugcauuuucacugcaugcuuguccaugggagcccucugguagcaguuccaauucagugccuucucguuugccuuugcuucccaaaucaucacaguucugugcuuauccaucccacauugacucacauccuccagaaaauggcaggauugucauuucaaagaaauggaggcaucaaguugaauaacuugauacagaagcuggaguuggaacccagguccucuacuuccaggaagugcucucuuuuuuuguuuguuuuuuuagagacagggucucgcucuguugcccaggcuggagugcaguggcucacucauggcucacugcagccucaaccucccaggcucaagcgauccucccaccucagccucccaaguaguugggacuacaggcauguuccaccaugccugacuaauuuuauuuauuuauuuacuuauuuauuuauuuauugguagagaugggggucucgcuguguugcccaggcuuacauguucuguucauugaacgucauugccucuugaggauucaguuucuugaguuuuuguuaugguuuuauucuguuuaguuuuuuaaaguaaaacuucaccucauuaugaaaguuuuacagcauuuaaauuuuuauguucaacauguuucucaaaaucauuucaauauuuugauccccaguuuuugucaugaucagcucacaucugcuccuuaucuaaccuuuuuaauuuuguccaugaccauccuacacugcaggcuucucaaccagaugaguugaccauugaggaacaugagguguuagaagugauugaagauggagauauggaagacuggguaaagguauauuccuuugcucauaucgcccuuucuugugacauuuuuaggaguuuguuuuggucuuuguugugcccugucuaaauuguguguguaaacuuguuuugucacaugucuuuuacccaggcucgaaauaaaguuggccaaguggguuaugugccagaaaaguaccuacaguuucccaccucgaacagccuccugagcaugcugcagucccuggccgcuuuggacagucggucacacacguccagcaauuccacggaagcagaacucguuucaggcagccucaacggagaugccagugguaaagacugaaacaaggcacucuuuauuuggucacguuugaccuaaacuguauugcccuggaguaagccuucaguaggauaaaaagcacaacuuuccuccuguccuauaauaugcuuuucuuuauauggucacguuuguccugcacaguagaacccuaaaguuaaucauucaucagugaguaaaaaaauuacaacuuuaauccuauucuguaugaugcucuuuuaguugucaugugagcauaggggugguugcaaaagcaaccggcuguuaauuaucuuaccagauuuguuuuucucuugcucccuaguauguuuugugaaagcacuuuaugauuaugagggccagacagaugaugaguuaucuuuuccugagggagcaauaauccguaucuugaacaaagaaaaccaagaugaugauggcuucugggaaggggaauucaaugggcguauuggaguuuucccaucggugcuaguggaagaacuuucagccucagaaaauggugacacuccauggaugagagagauucagguaccugagaggggagacaguugaauuaaaagauguuuaaagaaaauugcucccaaagggucuguggauccacacaaaagugggcugcagucucugccuuacccucaccgguccuugguugccagugucugcacaacugcauuugggaaaccagagacuugucagucagucccuuguggaauguggccauccucccacaccuccaucuucccacauucucucucuuccuugaauugguuaaccaaaaugccaaauuauaugugacauaccaaagaucguuuugguggagagaaagaaacaaaccgaagagggaaggcguugcucugugguuaauuuacguaguaaaacucuuagcuggcucucucucucccucacugucagagccuccuugccuaguccagguccugccagucuauuucagagaauuaaugagccugccagagccccuaauccccacucaagugacccuagacuuaguucaucacagggaaacagccuuuaaaggaaccucuaauucagucagaguuuaguuuguccccucagggaucuaucacugcaggccagacagguagaggaagaaggaacguguuugccgaucuuguuugcguggugauugugaccccuuagccuaacaugcacaaaaccuggggaagucagaaauucagcaaaguauuuuaucuucaccccaaaaaauccaacuuguuccuuuuguuguuguuguucuuugcuaaguuuacugaauugacuaauuugguacauuuucaauagaacccuagagaguagcuucacuugauaacuguuuaagauaaacuaaaaucaguaaugugaugagaucuguaagaggaaaaagugaagugcaaugcaaaauuggagcuugaggugguuauuuaaugcucaguugccucuaaugagguugacaaguuucaacaaucagcuuagcuuuagagaaaaggcaugaguacagagcagucagagaagcagccaggcucuccuuccuggaggggagcaccggguaaccucgcuucccuuugcugcagaucucuccuucccccaagccacacgccucccugccuccacugccguuguacgaccagccucccagcagccccuaccccagcccagauaagaggagcucccuguacuuuccccggucuccuucagcaaacgguaaggguucuccugggcaugggucuaaaugcauuuucacuucagaaaccuacauauucgccugaagggcaaaaaaaaacugcauuugcuuuuuuuuuuuuuuuuuuuuuuuuggagacagagucucugucaccugggcuggacacccaggcuggaguucaguggcaugaucacggcucauagcaaccaauuccugggcucaagugauccuccugccucagccucccuaguagcuaggaauacaggcaugcaccaccacacacagcuaauuuuuguauuuuuucuggacaaaggguauuauucugucacccaggcuggagugcaguggugggaucauagcucacugcagccuugaacuucuggccucaaguaauccucccgccucaguaucccaaagugcugggauuacaggcucaagccaccaugccagccuugcaucagcauuauugcucaacaacucaaguaaaaugagcuucuuugguuuucucccuuagaaaaaagccuucaugcugagucaccaggauucucacaggcaucaaggcauacuccugagaccucauauggcaaacugcgaccuguaagucucugaucuugcaggauuaucgaaugcauaguucuuccaaauugaaaguaaggaauuaauguuuccccguggccccuguguuguuacugacuaugccaaacaaggaugaacuggguuugggaagguaaaaagagcuauugaaaaggaaggccauagaaaucaacucaucucgggacauuuaaucuacacuggaacuuuuuucacugagccacagugagauugcaagaugauggcuaugaaagugauuuagaauagaacaaacuuuaugagcauuaaagcgggcuaauugugaaacacuuuuuucaguaagcauuuaauuuuccaggccucuauuugccucuuugaggaauaccaagaugaaauaauaagcuaacuucauggccuuaaagagcguuuauucuccgggugaauauauuauugcaaaguuaccucuccucacccuucacucuacugccaucugcauuccacccaccacuguacuccaaggucauaacuugcacgguaauccagucggauacuuugcaauuuuauuuuccuugaccccuauuagcuuuugauaccauuccuuuaccacuggcuucuuuuggcuucauucauucagcaaauauguauugagugccuucuuaaggacuugagucuuuaucccaaaugagacaggaagccauuguaaagugguaagcuggacaguguuguggcuggugcauuuuuaaagcaucgcuauggcagcuaagaggcggauggauggaggguggcagaaaggauauagggagcgauuaggaggcuggagcagcauccaagaaagaagugguggcaagauggacugguggguaagagugggaagagagagcagugggcugaugugcuucucuacauuugccucguuugcuuucuuccucucugguccuaccuuucuguggaccuuugcagccuugccgccaccugucucugcugauaauucucaugguucugucacugggcugcuucucuugaaguuguugaacgcacucuugccgaaugaccucaucuacuuccacagcuaugauaaccauuuauaugccagcaagucucagauuuauaacugccaauccgaucucuucucuugagcuucagauguguggauaucucaguuuauauaucccagauccccaaaacucagcaaaaaugaguuauguucccuuccagacauguuccuucucccauauugccuaucuugguaaauggaacccccauccuacugguguucuggcaucauucuuaauaccuccugccccugccucccacagucauucccaaauccugccagguauaccuugcagagagcucgcaaaucuuuccacuucucuacuuccccuacugccaguacccucguuugggcuauugucaacucucauucagaggauuacaaaagucuccuaaguugccuucuuacuuggacucuugcuugccucugauccuuucuccaguuguuaccugagucaucuuuucgcagaucugauauugcuuaaaauccaccaaaaacuccucuuuugccuacagaauaaagcacagauuuauuuuuuucuucuuaaagcagauguuuaaacaugguuuaacaaggcccuucacaacuuaacccuagccuaccuuucuagccuucucuuuuguaacucucuacccaagacacacugaaauguuucauuucucuaagcauugcucucccuugcuuccagccagaccuuugcuuuggaggaugugcuaggaucuuagucauaggacuugugcccaugagguuuuuagccuaggcaagaagcugauuugugggcuugauauuucauugagaacaacugcuucucaguguaggaaauagugaagacuagguugaaagcacgugcucacaacauuucugagaccccuagggugcccauguccuuggacagaugagugauuagguuuuggggaugcuucagauacugagucaggaacugacugacaaacuacguaauuguuuccugcucagguccgggcagcucccccuccaccuacacagaaucaccgaaggccagcagagaagauugaagauguggaaaucacacuggugugaugaugggcuugcccauccauuacugcuacaaucaaggccaggcuuggaguuuggccagucuuguuuuuuaggcaccuuugcaugaugaugacucuugaacagagcaaaaaacaaggaggauuaugugugacuggguggccugguagacuccucccacguuuugaauauuucgugccuuuuuuuuuuguugucauuuucuaugucauuucuccuaccauagcacaaauccuagcggacccuaggagcaaagaggggggcagcccucaugccuaacaguggucuguuuuuauaugagacucaagaacaggccucauuccagggcacagucccuaaauuacugaucaugugcacucguacaguauauuacugugaccacaaggauguggcaaagauucucaucuuucuucaaguggcuuuugcucaucugauugagaauuaaucagaucauguuggcuacauaaggaaacagaaggagggauuucaggagaggcuggcuccuccccaagguuaguccccagacugagaaagugaaaccuuauugggaaaaauuggacugcccugaauuuagcaccaauugcauuaacgcacaucucuuccacaacuaacagacuuaaaauaacaguguccuucguauuaauaucugugccauucauuuagaauuagcagagcuaauauggaggggcugaacuaguagccacaucuuguucaucacauagacuaauagaaaggaggcuguggcuaaagcagaaauggaacuuccggaucugaaauuagccaauauaauguucuuuuguauuuggguauuuuucaucuuaauuuuuacagcauauacucuucuuaccaguauccuuagaauccaaaugucuagauaaguugaggacacauaccugcauuguugagcuucucuacuggggacgccccggcauuauuuuauucccaagccagcagaccggcccagacagccaggcuguggcugguccagaccaacugcuaugguggaaaaugcagcuuccaggucccacuacccugacauuuccguggaaggaagaaccugguggcucguggaggaaaccagcuuucuaugagaaaggacugaaggauugcgcacccugcacaaguacagauugaccaggaaaagacaagugucuucugugugucacagggaaagccaggaguggccuucucugcaggccagcaagccugcagcagcaggugcccccacgucaggugcugacugucugcuguccgcuccuguagaagguagggagcacaauaccuagggacuaagggauguucgccgguugugguuuguuuuuuuuuuuuuuccuugguuaagaaaucaaauuugcagaauuuaaucuacaaguuguauuaugcuuugaaaacuccaucccuccuaagaaucuuaaaaaacuugaaaugcucgccaaauguccccaugggauuuuugaccaaaaguaaggugauaacugaagaaauuuuuaguucuuugaucacuucagugacaauacccauuaaugaaucuucuccaugauuugggguuuuuuuucguuguuguuuuuuacacuucuuaaccuguugaucuauuugaggucuuuuguguuuaucaaacuuauucuuaaguuuaaaaaagaaauuaaaagggugguuuuuuuaagauuuuaaaguuugcuaacauauuaaaaaucuucaaaugcuuauuaaauagagcaguucuugccacccagucuuguauucugucuuuagcuagccaaauuguccuugaauuuggguuuuccacaaccucaaaggguuauuugaaaucuuuuguuguauuuuaaaauauuuuuuggaagagcugcuaauuuuauuuuaaaaaacaaaguugugaaaacaugccuccuuuuuaaaaaauaaccccuccauccaggauauggaauccagcaccacagugcacaggucagggcucggagggagccucugugcagaugugcuuucuuuacaguggcuguaaaaaguuuguauuuauuauguauaaaauguugaauaauaaaaaaaauggaauuauguuuucuaaguuuuaauauagaaagguuuggguaaacagaccuuuccaaaaggcccaugcuucuuauaaaaacauuccugggcccuccuuuaaaccagcuaacagacagagagaggagaaaguaaauuaauccaucuaugagacagacagucccugaagcccccaugugcuagguguaauauccuggguacuagagauggcaguaaauagguuacggucuuugcuuuucccaugggaaaaaaaagaaauacgugaggacaguacugugggacaugugcuagaagggaggggcagauagcauagaggcagcugaggagggagcucugauucugcugcuggaggggugagaggaaggucacugaaguccccuugccggaugugaccacuggcuuccaggaagcgggcauucuggaugccucuccccuuuccuaaaccuccacccuaaggaguaaugaauugugugaaaggagauuuucucggucccagggguggauggagcauucuuagucaaaggcugagucccccuggcuuccagccagccacacugaggaccaggacacagccuguuuggggaagggccccacaagcucuccucuuuccuggagcuggggacaugcaguaagcauuuuuccagacauuauccugugcauaagacucuuaaguguacacacugcuuguuuacauaaaaauguguucagccgggcgcaguggcucaugccuguaaucccagcacuuugggaggccgaggcgggcagaucacuugaggucaggaguuugagaccagccugaccaacauggagaaacccagucucuaccgaaaauacaaaauuggcugggcaugguagcucaugccuguaaucccaguuacucuggaggcugaggcaggagaaucgcuugaaccugcgaggcagagguugcggugagcugagauugugccauuacacuccagucuggggaacaagagugaaacucugucucaaaaaaaaaaaaaaaaaauauguuccaguauaaauguuggguagauuccuaaguguggaauuugagggucaaaaagguauguauuuaauuuuguuagauuuugccaaauuggcuuccuauaaggacuauauccauuuacacucccaccaaccgcauauggacuuaggagccaggaggucuggguuaaauccuggcucugccacuugacagccauggggacugagccuguguccucaucuggaaccugagaauaagacugugguuccaggaaggccauauaaagugugccacaggcuggucaccacgaacucuucucaccaccaccucuccucaccaccaccucuccucaccaccaccucuccugccuuuucucaccaccaccucuccugccucuucucaguguccuucccuccagaacuaggguccuugauagucuuccaggcccauaguaacgcacagaguugucauaaggcccaagggaaagaaugugugugaagugcucuaccaaaaaugugggaagggcugucaggacacgaaaugucauuuccgucuucugacuucccugccagugaaagcugcuuucgguacuggagguuccgucugugaccaagggcaaagcucagcuaacugccucaccccagcgucauagcuaaauuuuggucuccuucaucacaggaacugacuugaugcaugaugcaaucaacccacagguucucaguacaccaccuagauccccuuccucucugacccaccaccccagccacauucacaagccagagacccagugggagggcaucaucuggccuuagcccugccacugcuugauggaagaccuuucccucuuagcugccacauccucaauuguaaaggaauggaaugauggcugggcacgguggcuuacgccuguaaucccagcacuuugggaggccaaggcugguggaucaccugagaucaggaguuugagaccagccugaccaacauaauggaaaccccgucucuuacuaaaaauacaaaaauuagccagguguggugguggguaccuguaaucccagcuacucgggagacugaggcaggagaauugcuugaacccaggaggcagagguugcggugagccaagaucaugccacugcacuccagacugggugacagagcaagacucugucuccaaaaaaaaaaaaaaggaauggaaugagguuaucucccagggcuuaucuaacucucaugcccuggaugaguuguuucuagauacagagaacaucacacaaaaaaggucacaauauuugaaaccagacuuacuaagacacagacuucuuuggauggcaagaaauugaaaagaaagcaagccacuggacucucccgcugggaccugggacaaaacaaaccuuuauccucuagauugcaacugcaucccaggcugcucuauccacucacugccugaagaacccagcugcagcuuuugguuuuguggccaaugacugcccagcccucucccaguggccuuaggaugaaauccagcugcucugaaucuucgcauuuauuuuguucaucgugaaguuguuuuucaugacagaaauauaacuaaauuacagaaauuuuagguuagaagggggaggauuguaauuuauccccaaauccugcaacuuuuaaguuuccuccuagacucuuccuguguuugccuuguuacugcuugaucugccaagaaccaaaugaaugccaaagagcaucuuguuccuagacuauuuucccucggucccagaggccaaaaaacacacuuuugcugugucuguuucugagagcucuggucugggaauauuuuccugaaaaaaaaaaaaauuuuuuuuuuugagacggaguuucgcucgucacccaggcuggagugugauggcacuaugucagcucacugcaaccucugccuccuggguucaagcgauucuccugccucagccucucaaguagcugggauuacaggcaugugccaccacacccggcuaauuuuuuuguauuuuuaguagaaacgggguuucaccauguuggccaggcuggucucaaacuccugaccucaggugauccaccugccccagccuccaaaagugcugggauuacaggcaugagccaccucgcccggccuuuccuagaauguuuuaugcugaaacauugacagaaaugaacccagggacagggcucacagcccuucuacacugcgcauagaacucacucuucaccacuugcuccugugaggaacagaaaagagcacagccaaaggaaauguauuccaguccccaggccaccucagauuagcugugacuugaggcucaucccuucaccuucuggacccugcuuuccucaucuguaaaguaggaacaagcagauagugcaacuucuaagauccaggaggaugaaauaggguaauguacagauaagcugaaaauguuugugaugagugaaugugucuccaguggaagagccuguauccaggcauggauaugucugaaucucacagauggguccacgucugauggugucagaucucuccagaaaccaccucuauucaauucagcaaaugugcugccccagguaguguucaggucucuggagccuugucacugaggggcuugcaucuggugggagacacucagcgcaacagcagacugaagccagggacugagagaugaccaaggggcaguaggagcacaggauaggggcaucugucauuucucccucccuggggucucaggcucacuaaggccugagauugggcagggcaggcagaggccaugguccucaugccuacagaacagcucugcagaagagccaugucacuuuuggggaggcuuggggcaggaaguuucacagguggggauaugagcgccuggaagucacugugaccugcccaagaucucccaggaagacagaacuggagaaccuagaacuaggccuccagaagcccuggccagccccuuugcagaaucugaauccaguuuuuagaaaagcaggaaucagaggucuggguucuuaucccagcucugcucugugacccgaaggagcugccccaucucugggucucaguuuuuauacccaugagugcgggccacuccagauuugaccuaggcacccgaauucaggcaggcagccccugagcaccagaguucugaaaaccugggcagugacugcugagagccuggaggagcugucaacaucuauuuucaccucucugcugaacgggacugaagaggcuggagggaggaacagccuucccgcugacaugccccucugaacuccucugcucagucugugagcuccucuuccuccugccuaccucauucccgggaacuccuuggccuguuucuggccuuacagacuuguuccuccaggaagcacccccuccuacugggagggggaccuccaagcaaguuaaggugaacaugugcucccugagagaggcaacuccacccgauggcagcagcgugugugguaagauugacgcccauaaaguagaagggaagguuuugggggagagaagggcucacugucccagagaucagucagaccauuuccugagcaccuccucugggcucucuaagcagucuccacuacaacccugugaaaugagggagaaacgcaauggcgcagcuggccucccaagauucaaguucccucacuccugugucccugcaugucccucacuucaagggauacuaaccguccaggcucaggacccagaauagaaaagggugaagauguagggagggagucagguuagacacaaggcuagcaucacaccucuacccccgugguagcaggcagggggcacacacacccugggggagggggcaugccccgcagcccugccuaacugcgagucugaacacguugcuuuaaaaagaguauguguaaugcagccacaguccagcugcagggcuucucugagcucaguuuucucaccugggaaacaugguagcuacauggcaauguaguugggaggaacaaauaaugcugcagaaagggugcagggcagggccuggcaccuccuaagggcucagucacgguggcuacaggagugucggucuccccagccaugugucccuggaaacgggaauggccucaguagacuaggcagcuggugaccccugguggcugcugggagccagggcaugagggcuggggcagaguagaaggcugaguaucgaagaauguuggagcccaaggcucuuagaccguuagacuggcugaguccuugaauaagagaauuuuguuguuguugagauggaguuucacucucguugcccaggcuagagugcaauggcgcauucucagcucacugcaaccuccuccuccuggguuccgugauucuccugccucagccucccaaguagcugggauuacaggcaugugccaccaugcccaacuaauuuuguauuuuuaguagagacaagguuucacuauguugcucagguuggucuugaacucuugaccucaggugaucugcccuccuuggccuccuaaagugcugggauuacaggcgugagccaccgcauccagccugaauaagagaauuuaaccacuuaauaaacauuuccugagucauucucugugccaggccugaucccaggaaauaaucuauucccauccuggccucuuccaagaguuccuugacuuaaaauggaggaggcagauacaaaaggggagcucagggacagaggaggccucuacccagccuggcaggcgaaggaaggggaauccugaaagaaaaauuugaacugggggcugggagggaaggagaacauucugggaagaaagaaaagcaugucugagaugcacucaugauagcaaggaaauagccaggcacgguggcaugcaccuauaggcccagcuacuggggaggcuaaggcaggaggaccacuugagcacaggaguuugagaccagccugggcaacauagugagacaucaucucuaaaugaguaaaugaaugaaugaauagcaaggaaaugaagaugaagcugagaggccagcagggucacauccaaagggcuccagauuucaugcugggguugcggguggucucugaaggcagcaggggaacuccaaaggauuggacuugugaacacgacacccuagaaagucacccuguugggccgagcauggugcugugcaccuguaaucccagcccuucgggaagaccaggugggaggauugcuuaaacccagggguuuaaggcugcaggaguuugaggcugcacuaagguuuuuugugugucucaaaagcaacaacaacaacaacaaaagucacucuggccauaguaagggaaaggauuggauggggagacugcaggucuagaagguggcccacaguggcaggaggguggaggaguacuagaaccagcagcacaaggucccagggacauggggugcaggaggaacgggucacuugcaggggagaugauggccaggaggcagcuagaccaaaaguagugaguggucugggagucagcagaguguagguguugccauuuaaccaacaccgucuccacaggccugugcccaguccuagguugguaaaggaaguugguuugccccaacucugcccugugggcucugccuuguaagcaaagccccaggcccagaucuggcccacagcugcccucccccaggcacagacacacagaggccuugcucugccccacccugggcacuaccccuggaggaagaacgcggacccagucuaagggaggcccuguggaccaaggacuuugauaucacuaccuggguuuuuaggaucuucccaccgggaccccucugggcugccucccugcccucuccucagagcucccccagccccuccucagcuucagucuacccugagugccugaagcaggugggcccaacauguugcuuuggccucaggaccagguuggaccaagagucacauccauggcucuuugcugccucagggccuuucuuccugcuguuuccaugguuagacuugagcagcaccugucucugcaggcagagacucggcuggcugccucagcucuguauggaaggaggaagggggccaagccuggaucuuccagagcccacuagcccaaaggucucuguaccaugaaugcugcaaagagguaggcagacgcaguucagauaucauuuuuuucuacuuugggagaaaaagugaggagauagagauaaaaauacaaagaaaaacuagcguaaucccccaacccauacuucauuuuuaaacaaacaggccagguccugccaggccuucuuccccauuaaaucccaaggccagcuccagucccaaccccaaccccugcauggcgccgaaggaagcuucaggcuucgggcaagagcuccagcccaggcaggcaggucguggcccuacugccagagcacaaccuuccugcccugguccacgcucaccauguggcucccggaguagcaccaggccacggcguugacggcagcgcuggggaaagggaggggcaggcuucaggggggcuucaggaacugcgccugcaaccuggcucugccccgacugcuggaccuggguaguuugaggcccucucuugagccuguuuccucaucugucaaguuagcucacagggcuguggaaaggauggaaccaagugcguguggaaaguaccuugugaacugcaaagggcucuggucggguggaagguggagggacaagggcuggggacuccagggucccaguaugucagaaccuggaaucagccuggcaggacuggggccaggcagguggccagguggaggccaugcucaccaauggggucccuguagucugcucuccaguuucccgguguccacaucccagauguaaagggccccaucacaggagccugccagugcauagcuucuguccgggcuguaguggccacagcagagcaagaaaacggggggucagaggggagggcacacacaggguccggcagggcacacuuggacacaggcauaugcucucacggacauaccugaacacagcuuugguccagucagaaccacacuugaagccaucggcccugaggacagacagggcuggggucagaacagaggucaucacuagucucugcccucugcagugagcuuccagagcuuccucuuugucgagggguuugguaccucagcaggaccuggucuggaggggccuccagggagggcuccaagagggucuauuacaggagaagagaggcucagcugucccagcaaaggccacagggucagcaggcaugaggcugguaccugaacaccuggcggauguugcugacacgcaggucgaugaccuugaguguguugucucgggaacagcugagcaggugcaguuggucguggcugaggcucagggaggugacccggcccugcacagggaugaccugggugcaguggggcccccugaggaacaaggacagagacagggaugaggaacagccuagccaggccacuccugacaggaaggggccaggcgcagcagccuuccuagcuaaccaaguccggaggaaccccagggcccuggaucgcugggguaaaggcugcgagugacucaucucccuucuccccacugcagccagcugccuccaucgaggaacuuagacagacuuugauuugaaagcuggagccuuugaaaccuuugggucacuaaauaagaaccauaucaucugagcaaugaagucucgucuuuaaaaaauaugagagagagaaggaaggguugcaaacaguaauugcuggagaucagugaguaaaggcuugaggcaggccuagcacuggcucuagcuuuguuuuuuuguuuuguuuuguuuuugguuuugguuuuguuuuuguuuugagacaucucgcucugucgcccaggcuggacggcaguggcgcaaucugggcucacugcaaccucugccucccggguucaagccauuccccugccucagccucccaaguagcugcgauuacaggcaucugccaccacacccggcuaauauuuuuaguagagacaggguuucgccauguuggcuaggcuggucucaaacuccugaccucaggugaucugcccgccucggccucccaaacagcugggauuacagguaugagccaccacgccuggccucuagcuuugcuuuuacaaacaauucaagcccaaaguuagggucuuugguuuaaaaaacagcuaaaagaauuuuuuuccuuuugauauaaaagugguaacuaaauggaaaaagguacaucuccaucuugguugcaagguccaggcggaguccagcauuggaccaagagccaugaagacaguggcacagcuuccugcgggagcugagcccagccgagaggcacuagcuggcagugccagccccacagccuugccugcccaaagugccaccaagacuccuccugccauggccagagaaaggaacaagaacuugggagcccuguccccagcccuccccaaguccucccccagccugcgccugucaccugcugucccagaaccggaucuucuggucauuguggccacuaaugaugauaugguccccacacaccacgucauuacaguaggaaaggacauugaugguccuggagccuggggaccaagcagcagaccccagggccucagaggaggguugucgggagccaccccacaggacauauggagaagcugaggcccagaacccaguguccucccaagacuagaacccaggucuuccgcuucccagcacagggcucacccacgucuuuuuccuacccacagccugaggucaccaagaaaccagacagaaaacaccacugggggauaccauuagggaauuggagggccuugagagguuucacccccaaaugccuaugaaucucagagccacucccagagagcaggugaggucccuugugcccuggccuggggcuccuggcugguggggaggagagguggggcuggggcucgggcucacaauaggcacggccgaggucccacuccuucacuguccggucgcggcucccagucacugccuggugccucguuagcuugaauuuggcagcugucaccuuauccuuguguccagacagugucuccuguaccccggccccagguacggaucaagaguuuggccaagaccccauaacaggcccccuaguccugagguaugaccucugaccuccaggcagccuccccagucaggccucaccuuggacugugccucccccaccuuccagagcugggcagccugguuguaaguugcugcuaaaaccugguagcccuggagaaaugggagaggaagugagaggugcuaagccggaggcaacauucuucgggccacagaaugaggcuaggggcugccucacaguuucccacggcccaggucaccaaggcaggcaaaggagccuccggcccaaggaggaggaucuguguaagagcccaggggccugguucuaggguauccauguugcgcccucaggucccacagcccccaccugcccaguguggagaucagagagggcacaaucccaugccacuggggcagaguuccucaccgaggggucaaaguccacacuggugaugcugccaccagcucccuccagggucugguuggccuccaggcgaccugggaggaccaggggaagggacaguugaaaugaggucuuaaccucacaaaauggaggaauugggauugagagcggaagaucaguucccgccccaccccccgacacauccccagguuagaagacagaaucgcugggucuguucugcgggccugggcuggagacuacaccuccccuaacugcuggcacugggucccagggacagcuagucauuucacagaccaggcuagagaggaccagggagaagggacuauguagagcacgcagcaagccaggaucaggccagccagaaacuugccuuuucuaggaagcccccaggagccggcucugacuccccaggacacccccucuccagagcacagagcuugggacaaggccaacaguucauacuugucucuuaccugaguucugagagcucaagugaugcuagaagagggucaccugguagacucagggaccugcucuucaagggccugucccuguaggaccucaugauaggggacccccaccaauccccaucagggaccaucugaacucagcccuccccauccugcaaaucuggacccuaggagccaggaggcuccacccuucuucagaacagugagcccagagucucacucuuuccaaggcauugucuagucacugcccacagaauauuccagauagagaaacacaaagagauccaagaccucugcccaccaaggagugagcugaggagagggucuggagagaagcaccaaguuggccggcaggggagggcuccuuacuucccacaacauuccagagguggaucaggcggucagccccuccaguggccaggaggcugcuguuggggccaaaacgaacagcauugaccucagagaggugggcauccuguggggaaaggggagguuggugccccggcccuccccgcgcaugucucugugagugcucacgggcccucuuaccggugccugugcagacacagccugcugcagacgugguaucucccuccccaguuucucuguccacacucugaguuucaaacccggccccaccagguguucucaccucugccuggaccccugcagcagccuccgugcuaugcuacucuacucuccugccuggccuccuggccucccagccuccucucucucccuccccggcuuaugcccacaucauaacaugcuugaguggcucccaccacaggcugugggaggcagccuccugcuccugcugaggagcccagccuugcuucccuggccucuugggaccaccccuggugccgagaccaccccugugccugcacucucucaccacugccccacccauguggcucagcuccucccuuaccagcacauccugagcccggguaggaagucgggcagccacacacacagggaugaucugguaucgcugcucaggggcucccccaauugagugaccucuccucuucuuaaaacugggguaagguggguuggggucaggagggcauucagcaaguccuucucaggugggagccuccagcuccccugaggcaucaaccauaggaagcagacauggcaggcggcagaacauggccccaaggagcagcgagagcauuccccaacccagccucgaccccagggguugguguggagacgggguggggagcacacagaggcagacacaggagcaggguaggguuggugggugcaaagaaaccucagggccgggguuucaaucccagucuugccacugcuuggcucugugacucugaaugagucccugacauuucagagcauuuuucccaauugaguaggagcuccugcccugccugaggcuggagcucuugguccccugugacgaccuuggaugaagacagacccuugugaggacagaaccuggaagacagcugaaccggggccggggcugaggccauucaccuggcuccugucuccaaggcccaacagacucacaggcagacagcugcacaucacagggauggacaggucgaggcacagacacagaccaagccugggcuggggagcccgacacacacgugggugcacacacaggcacacacacacuuacuccagaagccccuucaccacauccacacagugggacagcgucagggagguggcugaggcagaccugagacaaaaccaagagagauaugcuaagggacuggcugguguguguacaaauggcuguccaucaucuccacacuuugccagagaccuggaggcuuguaaccucucaagucugggauaagaacuugacuucuccaagaucaggagaccagggugacccagaucagucccaggaaggucggggcagcaauggauuugguaaugaaagucucccaaggucucccucaugaugggaagaacugccuuacccuacuaguacccaccaacaaaaguuccugggaagcugagccggggccuacagggaggagagacgcugaagguucccccaggcuggggaugggaggaggggggagccuaggcucacugggugaccucagcaaugcccaggagaggguguguccuacaaugacuuggcccacaagggcucccaaggacuuuggggacuggcaucucaugccccuccccacgguuucuucacugccccaaggccuggacaccagggaccugcaaggaaagacugagaagagguguuaggcuggggaauggcgcccagagcgggcagccucaaugacaggcaaaucaagaaggauggaggagacccugcggacaggcacccaaggucugaagccccaaucaggucccacaagugugagcacacaucuacacaugcuuauauauucacacauacagacgggcucagucaagcuuguacacaccuguggccucaugucccugcggaugcacaugcuugcacaccuauggcugcgcacacaugccuggcaugacugggcucugggcuuugcccacagguucucuccuggugacagcuauucagaagccugacuccccacccccagagcucugaucccaagaaggagggaaaggguugaggguagggguugggggggugagauggaacugaccccaaguggcuccagacaauggaggucagacuagcccugggagaucugagcuuucuggccucuccucaagcccccucccaacccaagagcuggcuccaagguccaagaggaagacccuggcagccucugggguggggcucagcucagagcucugagacugucaccuggguccucaccugaagggccucuuccacuucucacaagcuuccuucuccaggggcucuggcucaggggccagagccagagucucccuucucucccucaucccaucgccuaggguguccgggccccuaggagagguaaugaaguucagaaaggccaagggaccaagccagccccucccgaccccagcacaggauacgcugaagacaggaauucccagugaugaggguucuguguggguguacacgugcagcggucacgcaugcaggcuccuacgaccacacgguccucugcaggugucucgugggcuccgaccacaugggggccucaggacggggcugugcacaaguacagucggcagccugggucgccgcaggcaggcggggcgggaggcagaacgcaagggucggaccggcccauccccacucuuacucgcugaugcucacgguccgcuuggcagccuucuucagcuccugggacacccgcgccugcuuggcccuuguuggguaaaaagcauccugagacccuggcgcggcgccucgcacgcaggcggggcuagacccggucccuuccuccagggggcggcugcugccccccucccuuccagacaccggcgaggcccgacuccucccugcaggggcggggccuuuccucaggaggggcggggccugcucccucaccgcucccggcgcucguugcgcagguugcgcucggccgcggcgcgcgccuugcgcugcacgagccucuccagcaggucgcgcgccucuuccuggagccugcgcagugccgccucccggagcccgacgugcgcgcgcagcgccucguaggcugcccgcugcaccgcauucugcgcccgccacuccuccaccugcugggccugcugcgcccgcgccucucgcagcugcgccacgcgggccuccagggcugccagccuggaggacggaaagagcggauagcgggucccaagcuucccccgucacugcccagugggaauaugccucggagcagagacagaccugcccaugccaaacgcggcuagccggguggcuaagccaggucucccccaagccuucgcccucagagcccagccguucgguccucuggcaccaaccgauggggucggggggacguagggaaagaucucggcccgcgccauuccccccgccucccguauaguuggccccgggccucccugaggugggcgcggucccucccgcccccgcccgcgccucaccugcuuugccucugcugcagcuccgacuccagcgugcccagggccgcgcccuucuccaccaccugguaggccaucugggggcggacaggugggcacggcggcgcugaggccccuccaggccuccagucccuccggggccgaaggcgcuaagggagucggcugcucaccugcccgcccccuuccugaaaagcaagcugagccccacacagguuugggaccuugcacagggacgcgcugcuguuuguggagcaguggaaggcccucgggcucuggagucagcccugggucccaauccucgccgugccgcuucguuucucugcgacccuacuaggaaccucucuggcaagagcaacccgcuccacugccucgccugaagagugggaagccagcgcuccgcucccagcaccaugcauaaccacugcgaggacuccucgcgcagaggcugccaaaugcccauccggcccucgggcgccaugauguucccagcaggcuacacgcuccuuccauccucaccacaccaggaggcugguacugccacucucacuucacagacaaggacaccgacagagagguuuaagugucuugcccaaagucacguagcuaagagauuugggcacaagccaccuaccuaacugcaucacccuccaggcuggucaggggaaugugaguucuguuccccaccccucccugcuggcuuccuggccucacccaacccaggccugcccaagcacaggucucagcagcgagaggcccugcgcagaggcacacaaggcuaagaucaggcauggacucggggagccagggcccagacucaauaugggaacagcgcuggcagcccaggagagugggugagggucauuucaucugcacucccgccucacucgucaugccuucaacccagagccaagcagggucggugggagagacagaccccaggcaaggcagcucccaccagugugacaagagaacaugagggccagaggcgccucuggcccaggccaaggcugggggcucuuguugcuaaucuguuccuguguucucacgugggccuggugaggacagacugaggagcacgguuggcgcugccaccugcacugacaugacgcgcuaugugagugagucugcgaagaaggaaucugcacaugcggguuggggcaccuuuauucauaguuggccccauuuauaacauaauucuuuucaccacugagcaaucugaucaccaccuccacuuucucacuugucacuugcuuucauuuauguuguguuguaccauucaauauuuuauuguaugccuuucaaaauucaaguaguagaaguggaaaacagauuaguacuugccagggguuagggaugguuggggggagaggggugaaugugacuaaaaagggguaauaagaaagagaucuuugcaguggugaaacagugccauaucuugaugguuacacaaaucuacacgugauaaaaugacaaaggacauauacacacuucauaccaaucccaguuuccugguuguggguacuauaguuauguaagauguagccagcaggagaugcugggggaaggggaugcaggaacucuggacuauccuuccaacuuccugugaaucuauaauuauuuuaaaauaaaaaguuaauaauaaugauaaaugcuugugauguguggaacuacuagagaaauuuuuacaaaagaaaagaaaaggccgggugccguggcucacgccuguaaucccagcacuuugggaggccaagguggguggaucacgaggucaggagaucaaaaccauccuagcuaacauggugaaaccccaucucuacuaaaaauacaaaaaauuagccgggcaugguggcgggcgccuguagucccagcuacucgggaggcugaggcaggagaauggcgugaacccgggaggcugagguugcagcgagccgagaugacgcgacuguacuccagccugggcaacagagugagacuccgucucaaaaaaaaaaaagaaagaaaagaaaaagccuccucacugcccccauccucuggcgcauccaauggguacuggcugguguguguccugggaaggagugcugggggccagggaaaguaucucaggcaaagggagcugggagcucagagaugagcguggcaggaaaugcgacaagagccuggggagcucgacgggggagccaggcuaggagcuuuggaagaucuacagcgcacuaaccauggggacagagguaguaagacgggcuuuuacuuuuuacucuauggcuucuauucucuugacuuguuuacaagcauguuuuguguauugcuugucuuuaauggagaucuuucuuuuuuuuuaauuaaaauaugucacucugaaagcuguauggagaagggacagggagugcuaaaggaguguuccagggcaggaugaaaguuacuuguacuaugucagauauggugcaagaaacagagagacauugauggauuuggagauagagucaacaugagcuugugaccagcucaggauggagggcugggaagagucagaggugccccugcauuuccagcaugugugagaacgacuggggggcagucacaggaagacaggaaggacagcccaccucauucaucgcuuagucuacaaauagucauuaguauggaauggacuguggacacaggcccuaaggauauagguuugccucggaggcaaacgaagacaucccagggcuuggggagcucacagcccagaggcuggggguggugugggggucagauguuugagaaucaccucucaaacaaauauuaaauuggaccuacaacagcagcucuagggaaagguucucaaaugaguccguaccuaugcccgcauuucuguugggcaggugacuugccauucugugacuggauguguauuuccugggcuaucacagucucuuucagaggacuggaagccccauggggccaggucuuguuuauuguugcacuccccguacuuuggauauagcaacugucaacagauguugagagaaugaauggagagcacagaaguugauuugugugagaagggcucaaauccuggcucuaccucuccaagccucaguuuccuccucuacaaccauaaaguugugaaggauuaacugagacaauguuuagcccgaugccugcaaggagucaacucucaaaacggugugggccaaauucugggggagauggugagccugauuuuagaugugaucuccaaaaagcagcugagcaagagagucaagcucagaaaagaaggcucggcuagagacagaacugagaguuggcaaacagaaaaaacgggggucagugaaccccaagaacacccacauuugaagggacaggaauagggaggaggggaaggagccagugaaggaaguucagaggcaacaaucacagaaaugagagggaaaccaggagagcauggugaaagagaagccaagagacacuguugcaaaggggcagggaaggcgguagugucagguggagcguccacacucugccaaugcgcuaaaugaaccuaacuucuguagucugcaaauguauauugagcaucaacuggugcuaggccuuggggauggcugggcgaggggugagccauggaguagugagcagagcaggcuaaaccauguggaagggaaaugggcugccaggcccuugcacaccuaacucccuccagcugcuguuggagcccacuucauccugggcugcccagggcacucugaccccugcucagcuucaggucagggccuggcacacacuagggcucacucaaugcuugcagcacugggcuuggagaauucagcaaacacaggaguacccgucacuggcuggcucccuuggaccacaucucucuaccccauuuucagaccccuucccaacuuaccucaccacagaccagccggagccccuccuccuccuccugccacuucacccucagugcgaccagugaugggacuuggucugagucaagcucugacuccucccugccaaccaaucagaguggugcucaaugucccccgguucacccaagugcccaaaggcacccaagugaugcuacaugaaaagccuaaaacaagagccauuaacuucguccugggaagauggaagccagcaagccaguaaaggaaaaggcaagucucuagaaaugagcuguccaugacuccucugcucuaagauuccccuaggccuuggccaaggacccuucucaagaagcaccucccagucaggcgugguggcucacaccugugaucccagcacuuugggaggccgagguggaaggaucacaagaucaagagaucgagaccauccuggccaacauggugaaaccccgucucuacuaaaaauacaaauauuagccgggggugguggugcacguuccaggaggcugaggcaggagaauugcuugaacccaggaggcagagguugcagugagcugagaucacgccacugcacuccagccugggugacagagccagacuccgucucaaaaaaaaaaaagcaaagcaccucccaacucugagccccaaccuauuccugguucucaucuuuacucccucuuugcaacagguagcaagacccuuucuuuaggcaucaggcaaggaacagggaaauggaaaaagacugagaaagggaaaagacauaaguauaggggugggacgggaaggagaugggacaaaugcagagagauggacaaagaaagguggaggggaaagagauucuaaacagcuguccugugggaaggccaagggccugccucccccaccacccccaccaccuccaccacccccaccaccccugggcagcagccaagggcugaugaggcacuagggagagaaugaacccagcacaggcagcaggggcagggccccagcacaggcagcccuuugugaccacggacccacauacacuuaccaggggcccugguggguggugggagugacacuguuuggcuccggcugcagcuucuuugagaacuuguccagcagcucagccuucucuaagagaugguuaucuggagagugcaagagagugagccuggggcagagacagauacccagcagcccccuggcaugcaauuuaucuccggcuaaaagggcugaaggagcccagagaugcuagggauggggaagcuucuggcaggcuggccucugcccugugccugaggggcaucugugcaguucuacaggaccuucagcccuagcaguguccucauagcaccgguccccaggcccacguggaagaggaccugcucucccagggacagaaggaugaccacugcgggguacugcccgcugaggguccugagggaaggaaggggccugggauugauucaucccugccucagagcaaggcuuagccccagaaagugaugaaauaaaccgagcucuaccugucaauggccuuuggcaagucacuuccccuccaagggcucuagcuuucugcacuuaaaaauaauccccagccgggcgcgguggcucacaccugaauucccagcgcucugggaggccgaggcgggcggaucacgaggucaggagaucgagaccauccuggcuaacacggugaaacccccaucucuacuaaaaaauacaaaaaauuagccaggcgugguggcaggcgccuguagucccagcuacucgggaggcugagacgggagacaggcgugaacuugggaggcagagcuugcagugagcggagaucacaccacugcacuccagccugggcaacagagcaaagacuccaucucaaauaaauaaauaaauaaauaaucccaacuuccccagcccugguguaagguacccccaggccagaauagaaaguccuugagcaauuauccagccgacauucuggagguuggugguuugacccuggaacacccucccccaucaacagucacuuccucuuuucucaccaguuccaggggaggguggggugguaaguccgggccuagcucccuccucaucaacuuccuucccacacucagugcccugucaccuugacugaggcccugggccuggccuaguucucaugaaaaccccaccucagcccccaggguacugcagcacccagcaaaccuaaagaaggucucuauacccaauuaacaaguaagaagacugaggcuuagcgaugugaucugcccaagguuucaagacuggcccuucagucugauuucagcccuccagaucucucuagucccucagacucacagcucccugggucggggcggggggcagggguugggggggcggugacccccucccucaaacuggacgguuccacugucugucugagcaguggagaaguguggcugcuggaggugggggcuggccucgcaacccugaagguagaggaccagcagccuggaagcuugcagagaaauuuuccuggcuaagagcagauuugauuguggggguuuggccaagauuagccccagugagagagccgcagggauugugguuagacuuccaaccacagacauacaaucgcaggcggccagaggugcgacacacaggcacaccuguucauccccucuugaaaugccacacccuauccugaccagcugcccagaaacaauucugagaguccgacuucgcugggcucagccagcauccaccagcagcccggggcccccugaugcccccucaggcuggguaggcugacagggagguguuccauaagccugugccagcgucgccugucagcggcagagccugagaugcacagccuccuccuuagagguuccgagugucgccccucuccggaugggccaauaaguggcugcucuggacaagucccgcguucuuucacugcgcuaccgagacuaagugcacugaucaagccccuaccccggggacugcccggguggggaggcaaaagagacccugcaaaaccaacacccgaggacgcacuugcgucucggaagcccagcuugugggaggcagagcccguccugaggggcgacgagggcagggggaccaggaggggcucguccagguucuaaccagagccuggauggcaaggggcggaguccuggcagucgggaugggcguaacgcacaggcucaaggcauaaggcacagcgcacucgggucacaggcggaggagccagccaaacccucuccccgcgcccguagccgcguccccucagccgccauccucucagcaccggggcgcacucacaggccggcaccagcuccaggaaaagcgccuuuugcguacggucccgaagccgcagcugccgcacgauguggcguuuccagcgcgcugcgggggcaccggggacgcccggccccgccauggccgcgcucucccgccuagcggcgcguuccucccgcccaggacggcgccaggccggggcggggccucgcggggacuccgugacgccagggggcgggcggcggcggggaauccccggcuugucccaagagggcuuuggcggggaggaccgaaggccgacgccgggaggaucugccuccgggaggagccgccuccgggucugaaccgccggggccccguccgaaauguucaccuaagugggggcuccuguggcugcgagggucauaagcaggagcgaggu

SEQ ID NO: 15301 - RNA, 8866 nt, Homo sapiens
cuagguucuuauuucugcuuugucccugcuaguaggaucuuuguuucucuaucuguacagggaggggguggggccagaugcccuuagucugaggggucuuuaguucugcuguggggaguugaggggaguguuagggaccaggucaugggguggcuggcuccaggcaggugcccugaccccucccccaacagccaucaggggguagugaacaaaaagucuggugugacucuuuccaagugcucccuuccccgguugcaggagucuagaucaauccugaguuacuggaguccccuuagggcuucugacuugcugugugaugcaggggugccccgugccccccacaaccucagcugcucugucugcgaggggcacgugugagauccaggccugcccagugcccuguguaaugaugccucacauucccacgccgcuucucaguuugucaagcgccuucucguacacagucucaccuucuaugcccacucuggcuccugcuccgugaugccccauucuggaacugggacccagagagcagccagaccuggacucuggccucggggcucagagagacaucucaauucacuuccuguggaggggaccauaucuggggcaggggacugcagugggcagagcaggggucaugcuuugccaaagcuguuuccauuguuugaucuuccaugagaaucaaaacuugccaaaccaucauguaaagauguuaccuuaacacuuuuuguuggaaccaugcauuuuuggacaguguauuccucccugccccagucacccccaccaguuauauuuuuaguuacuuaucugggggugaaacuggcacauauacaacucuuuucccugccacaauucucagaggauagguauuauuauuccagaugaggaaacuggggcucagagaaggccugucaccggcuucuggugacacagcuaggaaaucagagggccaggauuugaacccagcuccacaggcccuuugugcugcuagguuguggguccuccccagacuccucucccagagccccuccagcccuccugggcucauucuucugcucuggagcagauggggcccuucucggcugcuuagggguguuuugagaaggauaugaaugggcuuugucacguuugagagguuuucaugagacccagagccagagauacugaaauuccugggagggguggcauuugcaagggcaaauuaaugaugaguagaaugaggugauacccuucuacccaccugcuggcgagguagccuggccuaaaccuaggacccaggggaugagcccagggccuggcugccugccaggucgcccaccuuuacugacccaagauccaaaagauucuugguucuucuguguuuggcucugagugaugguuucauucuugccaucugcaccucucugaguuuuuaucucucuggcagcucucuaggguggggaaguccuucuaucagucugcccucacugcuaccuccuggccuugucuuuuuuacccuggacuggaugguggguaugagagguuugcugcccugguaccugcuaucugcugagguguguuuuauuggggcccuaaaaaggcaggagccaccaggccagugcugccaccucuuuuccucguggcagauccaagaggauacaguucacaaagcaaagcaggcuuuggcucuaaugggguccccuuuggguuuuaucugauacccacacugccugagugucccacccaggcaguguggguaucaaguaaaacugcugaggccuggggaggggcagugaccugccuagaguuagaggcagaggagguagauagcagagaaucagagccugggcauccugagcccagagccagcccccugccaccuacucauucccagacacuuuucaggagugugguuuagaagggauggggugauuaucugacugugccucccacacugcagauggaaggccuggagaucuaaggucauucacacaggccucaugaggaccugcagcacauuguccaggauucacuuugcaggaugcccuuuagggucacuugccaucauagcuccccgcucacccccacucauuuuuaaaauguggccuaauuuacaaacaucucagugcuuuaagcacuucaggaagaaacaccucuauuugugaagcaccgugacaaauccucgacuccucguuuuuuucuuagcacauuuaagaaaaucuguuccacccuagagcucuaggcuggugaggcuaggaggcaccuuaggguuauccauucugauucccuuuucuggaaauggaaaacuaaggaccagagaggaggaggcagcggggcacagacaggaacggaggugggaggaggcugagaucugcgugcuggucaggaugaccguggcagguucuuguugggcccuguuaguugcucauccagaggagcucaccacagucacugcgacagacugccacacucacccuggccuggccucagagaaguugagcuacuggccucaguucacacagagcagauggaggaagagcuggcacuaggacccagggggcaggggggagccucccuggcuggaagggauggcaggagcgcuggugcagguagcuauggagcucuggccaacucugccuggggagguaagagagcccagagcccugggccagaugcucuugagagccuagucuaguccauagcaggugugcgugugugcgugcauguguguguguguguacacgcgcguugugugcaugcugagaaggggugcugguggacaagggccagaguguggggcuggagggagucccgguucaagcucccagguaggagugagacugggguggagauuuugcccacaucuggccagcuugugaaccuugagccuuguggguuggaucggcuuccugcuggguuugcacagcccagugggaaugggguuggguguguguaggcuuggugugccucuagcuuggugggggaugcaagcugugggcaucucugagcugcuguggggcugucaucccugcgaguuagucucuugauugucaugggggugugugcccaucuuuggaucucugggguauugcaugggggcgucucuggguuguucuggggacagcgugccuguguguaaauacuguagguuguugcagagguguguaccugugaguaugggaggugguggagagaagggguucaccguuaacuuccagaauuccucuucuugcaccucguggcccuuccucgcagagcccacucugucuuggcaucuccucaccccuuucccuguccccgcuggggacuugccccucgcgcgcaggguccccucccagggccggcgggggcgggcgcuaggacccugcgggguggggcggggcggggcucggagauccgucagcuucaccuccgcagccuggaaaaucccgagccgcggccgccgagcccccgagcccccgagcccccagccuagccgggaggggcgcgcggggcuggggcccggggcggggccgggcggcgggacccacugcuccucccaccagagcccccgcgcggccccgggucucccgggcagcugcggcggcggcgcuggcaccccggccccggcgggccccggcggagcggcgggcaaaggugagcagcccggccuggagggcgccccuccugccccgccacccgccccgcgcccgcccggcgucgcugcgaguuaguugagcaggucgcuccgcgggccccgccgcaccgucccuccccucgggucccggccagucccugggucccgacgggcgcccgccggccaccgcgucccauacgcaguccccacgccggccccagggggucuggggcgcuccucgggagggggaccccgaggcuguccagcgcccguccgcccuucccuggggccagccccuaccucucuccagcuccccacccgccaggaccccgaacagccccacccgcgcccccagcgcacugauucccguccccaaaccggucuugcaggucccaggaagguggcgucagcaucugcagccgcgucgacguugucggagccuccgcggaggacccaggagagccggacuaggaccagggcccugggccuccccacacuccccauggagaagcuggcggccucuacagagccccaagggccucggccgguccugggccgugagaguguccaggugcccgaugaccaagacuuucgcagcuuccggucagagugugaggcugaggugggcuggaaccugaccuauagcagggcuggggugucugucugggugcaggcuguggagauggaucggacgcugcacaagaucaagguaggguugcccgcuauaccugcagccuccacugcacccuuacugccucucucccggagucuccugguccucucuccgggcuagacaccuggcuguauaucugggcccagagagagucuccuuccagggaccgggaggagacacagucugcugggccaagccccaucacacagaugggccaaccgaggccuggagagcaggagugacucacccugccucucucagcuggaacccaggcuucugcaugccccugccuguuccagggaucugggcugcugccaggcccuucuaggagaguggucucccucagggaccccucugcuggggaagccugcaccugguuccugacuugaguuacuccaggugggagacugggcccuucucucccugauuccugguucucagccugagcugggucuccuuccccgcuuucugcacccuggguugcccaggacccgauuccuuacugcccgaugcccugcucuugcucuuucccuucccucccucccuggcugcucccuuagccuccugcagggacucaggauuguggcuggcagauccugaaggcagggcuccaauaccccugccuugcacagagccaggcuacaggugggcuggggaaggaaggggccuggggucaagggaagccaacauagggagcaguugcagacacaucagucgcucacagccaucuccccugcucuucccaaccccacaauucuccucucuuugccgugcagggcaggcuugggguuugggacccugggaacgcauaucccccaggggaccagauggggcaggggcucgugaagacucugguuuaagggccucaauagcugcccccaacacaucugauguugcugugggugcugcauuuccagggcugguagguccccuugcaaugggcucuggcaauaggcugugcccuucgccuuccucuuccuugccuucucccuucugcuauccuccuggaaauguggaggaguccacccuccccuucugccugggaccuagucucagacuuaguucaggcauguaucuuggccccuuaccaagaccugagaugucugaccuuuccccucugacccugagcccuucugccucacuuugucuuaaucauuuacauauaguucuguccauccccacacgauuaucugcuuuucacuuucugccuccccuucuccccucugacucugucugcaccuuggccaucugacuguuuuucccucuggguuuccaugugugucucccacuuugggauucgcugcccagggccucagaaccugugucugagccugaggagcagggauggggaaggcagcuggcaugucccagcugguuguucccugagagcagggacaggucuccuauccuuuuuucuuuuuuuuuugagaagccucacucugucucucaggcugaaguguaguagcgagaucuuagcucacugcaaucuccaccucccagguucaagugauucuccugccucccagcaguagcugggacugcuggugcacaccaccacacucagcuaauuuuuguauuuguaguagagauaggguuucaccacauuggccaggcuggucuugaacuccugaccucaagugauccacccgcuucagccucucagguccuguccucuuugcguccccagcauccaacacaguuagagcagggauauugguggaagagaggggggaggaaagaaccaaggaacaaauugaaugaaaggugagaagggaauucacgagagccugacugugaccugggaaaggcuucaggcgggcagugcacacugggggagaaguguaguuuccccaccaagcuggcacuccagaaagucagaggaggaggggucugaacugaggccaguacucccacccucugugucaauagggcggagcuaccuccuccaucuggcuugguuaaugaauaaacccuacccagcccaggccuggaauuggugggucuggggccaggcugacugcaacagaccacucguggccagaucagacuugucagguggccuuccuuguggguggcggggacuuggaaaaacugggguguuguaggcuucuggacaggcauacacccugggcagccaggacccuacccuccuuuucuuucagacugaacagauguuggaggugccaaagagcccuugguaaucccuaugucauaccccuccugccccugggaugcaggcaaggauacuggggcucagagaggggcagggaccugccuagagucacacagcugucucagcagagcugggucuggaacccagaucuacagcaucuuggcaguccuccugccuugcuucucccugcagggugccuccccagcuuugcucccuacaauggagagaggguggggagaggaggugagcagagcccagacccaggaaggaggcugggacccugguuaugggcaccccaaggugccagcucccacuccugauccucucagcacagcuaguuggagcucugggagagauggacagaggccugugagcuucccauccccaagauugcaggacucccagguuccaugcagauaaucccauuucugauaaugagagcccugcucugagccaagcauuucuccccaucaucuaauuuaccccgaggcuagucuggggcaguguagucuugucucuguguuacaaacaaagaaacugaggcugagugagguaauguuauuugccuaaggucaugccacagcugaggcaagaguggaacccaugccagccuggcuccagagccccugccccucuccacaugggcucgcaucuuagucaacacuguggccuuuaaccccaucaauaacucuuugaaggccuggaggacgcguuguucucaucauccuauucuuguuugauggaugagaaagccgaggcccacaaaggggaguggcuugccaaggucacccagcaggucuggagccagaaucccuggggaugacugggucacuccaggaggcugggacucaacugcagguguuugcugagcuucugccccccuuucccccuccccucuccugccucagccugcucugggccuguccccagagcugggaaagccagcugaccccuggacaugccccgugcuccugaucccagggugggggugggacuccaccuagcuaucuaccugauucaauuccucuuccucaucucucuuccccuuaccuggguccagaggucccuggaagccacuguggcucaaggcccaguaguuggagccaggacaaagagaaaggggcuguuggaggccaccuccaccccuucccucccuccuggccuccagccugaccuggccccagggcugcacugugcucugaauacuggaaaagagacagacacuaccuccugacaguucagucccugucccagggacagaugcugaauguggauccuggguacaaggcagggggcagcuuggagccugaacucaggucucucaaagcccaggucagcuuccucauggcaccuguauuggugugagaaacgggagaccaagagcuucugucagucauucaaccagggccagcugggguccaguccuggcuguugcaugugaccuugggcacauuccugccccucucugggcugcuugcccgucugugccauugggcccucuuggcuccaagagccucugaacucagcacccagcuggggagagaugaggagcaggcagacagcagaggacguggccugugaggcccuggccuggaugcucacgugcucuguucuccugaggcuggccgcaugagaggcaggggagaccugcguaucuccucagaggucuucagacccugguggagagaggacagacaguuccaggugaccuccuacccacugcacaggcagccuuggggcaggaaugaggccugauaagagccugagcccaugacaggagagaccuggcccuggagcaggugugggaggggguguggcugagagccugaggcucugcuggccacaggaagcugggcaguggggaccugucuccucugacuuccuguccugcugcuccuccccuuccccuuugggaaaagcucaggcggccccucccagcccugucucacuguccaccuaccccacaccacaggccaccuggguuccagacaccaaagccagugcucagcucaugaccccucagcaccucacccucucacccuaugaaaugccagauggcucaggggucuccaaggcccuucccacucuuacuagucucugggacuuaaaagggucauggggaaggucagggccacgugugggacaggucuccuuaaucccaucaagcagauguggaaacugaggcucagagcaggaauucacuugugcacagccaaacagccggacauggcugaagcuagaucaggaccuagguccuugacucgccaaggcugagaucucgccacucccuugggcuggguuauuaacaugauugggcccgugggucucccugugcugugucauugugggagggcaccuuagaggagacccagcugggcaagaguccaguccucacuaugugacuuugggggucauuucaccu

SEQ ID NO: 15302 - RNA, 9368 nt, Homo sapiens
auuauguuuucagaaaugccagaugguaauauauugcuguuuaacauauuugagacaauuuuaauuuuucugugacccuugacuucuauaccucaacuuuuuuuuuuuuuuuuuuuuuuuuuugagaugaagucucgcucugucgcccaggcuggaguguaguggugcgaucucagcucacugcaaccucugccucucggguucaaacaauucuugugccucagccucccaaguagcugggauuacagugcacgcacggcaccacaccccacuaauuuuuguauuuuuaguagagacaggguuuuaccauguuguccaggguagucucgaacuucugaccucagugaucugucugccucagccucccaaagugcugggauuacugacgugagccaccaugcccagccuauaccucaacuucuaccuauguccaccuggcugcccauaaauuaacccaauagcugucacuuaagccuacucaguaugugccaggcuuuucccuauacaauugugaacaauuuucuagugagcaaacugaagcucaguaagguccagugacuuuucccaagguugugcaagagauggagcucucauugggucccauuggccugacccuaaagccuggguucuuuuccaccagaccuaaucuccaucgagcuggccuuauccuaagaaccacuugggguaucuauaaaauccagaugcccccuggugaugagcaauucucuagauuuugaugaaaguugaauguguggaugcuggaaugaguaaauuaacaaguaaggagaugaaugcaagcaggaaugacuaaauggacagacucagggagccuugaagaggguggggucuggaagggaaggaagagaggaaggagaauagcuaaguagggagauuucacucagugcuuaccagagcgcguugucuacccuguaccgaagacagaggcuguggggacagccuaggggccuggaucuauugccuacuuagagagaggccaacucagacacagccguguaugcucccagcagcaacggagguucaggcaagaugcccgaaggagggaagggugacaagggcaguggggagacuuggagaguuugugcagaggggaggaacacaccuuucuuucuguauuguauuguauuguauuguauuuuuugagacagagucucgcucugucacccaggcuggagugcaguggcacgaucuuggcucacugcaaccucugccuccuggguucaagugauucuccugccucagccuccugaguagcugggauuacaggugcccaccaccucgccuggcuaauuuuuguauuuuuaguagagacgggguuucaucauguuggucaggcuggucucgaacucuugaccucaggauccacccaccucggccucccaaagugcugggauuacaggcgugagccacugugcccggccacaucuuucuuuagaaagaucaugcuggcuccuguggggaaggcaacuugaaggggaagaaauuggaagagggaagacuugacacuaaacauagagccauggucaguaaguuuuuggagggaccuuuaccagagagggagaggaagcaguauccauuauccacucuuuagugacagagcccaaaggaacagcucuguaauggcugggggugggggcaagggcagcaaugaacagaggaggcgagggcugcuccuguuguugagugccuuccaggacacuaagugcuggucuggcugcuccaacaugggaaacuuucauguugucucucagaucuaagggucucucugcauuuuuaaaaaaauuauuuugaauuuuuuaaacuucuaucguuuuucaggugguuuugguugcauagauaaguucuuuaguggugauuucugaauuuuagugcaccagucaccggagcaguguacacuguacucaguauauagucuuuuauuccucacccccuccucaccuugccccacccccagucuauaucauucucaucugcauuuguuuuuugagagguagggugaggucugcugcauuagcccagagacagcugaggaggcuggaaaggaaaauggcuuucagagaauagggaaggaaaaagucugaggaagcaaaacuacuuaaaaaacacugcucuuuccauuuccguaucauuuaaccaaacaccauccuguggguucugucacuugauccucaugcugaucugagaacucggcagagcugggucacugccuuccccaaggcuaaccugguuucuaagcuggcacaagaccccaggugaucuaucaucuaaccacagagcccuugcuggacagagggugaagacauuaugugucccuggcucuguucagggaagcagaggauagaccugaagaauuuaauuacuugucauagauaaagccuagagaaaaggugagggcgcaaaguaucuccuccaaauugggaagacucccccagggcucacucacuaacgccaguucuccugagccuuuaaagccugggggugagggagcccuccuggucaacccucucuacccuagccucagggagcuucagggccccagcauugaaggaacagggucugaccucauuugccaccguaggguuggggagacugaggcaggaggugaaugggcucccagcuuggagcccuuuccccucaggacuugguuucccuacccuagcuccgccugcagggacagaaagacauggucuggaaauggaugccacuucugcugcuucuggucuguguagccaccaugugcagugcccaggacaggacugaucuccucaaugucuguauggaugccaagcaccacaagacaaagccagguccugaggacaagcugcaugaccaaguacggcuggagugugccucugcuaaggagggggcuuguucuaacagggaggagaaagucaggauggugggagagggauugaggggucagauaccuccacauccugaaguuuuccugugggagaagaugaagguggaguaggaagaguggcugaggugauuuuaggggggcccuccccggagguggauaccauguugacaaugauauugagucgucauucgaugggcaccugucaguugucauguguuuuuuguacaaaauuucauauucccagggguucuuggauguagguagaugauauucuccacauuacacaaguaagugaaaaugaggcucacagaagcacaugggcccacacaggagcuggacaugaauggccccuguggagggguaggaauaggaguggguuaggcuccuccuuuggugggugacagacuagggagucgcuggcuuuucccacccucacuaagugccauuuccauggagugccaagggagaagaggaggaggcccuucuggcuguaauuugaggcacaggggcuggacauucacacagucuauauacauguaugccaggggauugcagccuuauuagacucaaugucucccuuuuaugacagauuuuuuuuuagauucucuuuucuauccugcaaugaaauucaaagaaccuauuuguaugcauaauuuuugcaaauaucaacauaaugcucuguaauauaaaggagaaacacacagaaaguaacuuguaauaaaauaauauauauuucaauaugucaguucucugguaugacuacauuagaaggcauuaggaaauagcacaugcuugcuuuugucauaaaaucauuauaaguggggagcuacaaaugaagauugauacagguauauucuauuggugacuuaaacacuauaagauacuauaauauaagcaauguugcuguugaugucauacuuuucuaaaauagugaauaauucuaguagaauaaaccacauaguacagccuucuauuucaugguauuugcaguccuggaaaacccagucuagauuaaaaucuugugaaaacaugaugugccuauauguaagauagagauacauuuaaaaaguagggcuuuugcuuacuuuuuuuuuuuuuuuugagaaggagucucacucuguugcccaggcuggagugcaauggugugaucucagcucacggcaaccuccgccuccgggguucuggugauucuccugccucagccucccaaguagcuggggcacccgccaccaugccuggcuaauuuuuuuguauuuuuaccagagacgagguuucaccauguuggccaggguggucucaaacuccugaccucaggugguagaccugccucggccucccaaagugcugggguuacagcuacgagccaccacgcccagccuggcuuuugcuuacuuuuuccagcaaauauuuucaugggccuacuaugugucuggcacuggccuagccacuggggacacagaucuuacuacaugccaagaagaauaaauauauucaaacuccauuacuccauggcucgcucccucucuuccuuugcucaaaaugucaccaauguggcauuuccuaaccuauuuaaaauuucagcaauuccacauuaccauuuccugcucauaucauuuaacuuuucccauaucauuuaucauauccugacauaccauauauauauauuuuuuaaguuucuuacugucugucuccucugaccagaaugaaaauuccaugaauacauauuucugucuguuuuguucucuucuguauucccagcaucuauaaccgugacuggcauaaaguaggugcucaauaauuuuuaaaugaguaagugaaaggacuuuuuaugaaguguuacauaccucauaaaugauaacuauuauucccaagacaggguuuccccugggcucccacaguccccugaucacacgguuguaauuguguuuccuccaagaaagggguuccuggaggccuaggagagagggaccaucaucugggaaccugaguguucucaggacaaccugccuagggcagaggaguaagaaccaaaugggggagagacacgagguggcaggaggaggaggguauggggaggcacuuaguccugugucuuccccacccagugcagucccuggaagaagaaugccugcugcacagccagcaccagccaggagcugcacaaggacaccucccgccuguacaacuuuaacugggaccacugcggcaagauggagcccgccugcaagcgccacuucauccaggacaccugucucuaugagugcucacccaaccuggggcccuggauccagcagguagggugucuccccccgacccaccccagcagacugccaucccccucagucacuucaaggcgauggcugccagcaucccuggcugagaggagcccugccuccccaccucccacccaggugaaucagagcuggcgcaaagaacgcuuccuggaugugcccuuaugcaaagaggacugucagcgcuggugggaggauugucacaccucccacacgugcaagagcaacuggcacagaggaugggacuggaccucaggugagggugauugaguugggguuaggaaaaaggagauugagguaggguuuggaaaaucuucaaggauuugggguggggugaagauuucuggggguggccagaaaugagcuuugggcccaggggcugaaagucuguguccaccaugccucucccugcaggaguuaacaagugcccagcuggggcucucugccgcaccuuugaguccuacuuccccacuccagcugcccuuugugaaggccucuggagucacucauacaaggucagcaacuacagccgagggagcggccgcugcauccagaugugguuugauucagcccagggcaaccccaacgaggaaguggcgagguucuaugcugcagccaugcaugugaaugcuggugagaugcuucaugggacugggggucuccugcucagucuggcccugaugcugcaacucuggcuccuuggcugaguucaguccucccagacuaccugcccucagcuuggauaaccaggcugggcucagcucagcucccacaaaugacagccccuuaagcaugcuucuauuagucaccuaacccucugucacccagucuguugcugcuccaugguggggccaagagucacuucuaauaaacagacuguuuucuaauaauuccaugucuguggaauuguuuugguugugaguuugugggugggugggagacagauucuacggcuucuggauuccuucaaauuagagcaacuagaccuguguuugaaucccagcucugcuacuuugugaaaaugaaacaguugcuucacugcucuaaaccuuuguuuccuucuggauaaaaagaggauaauaguccugcccucaggcuugugaaauauacaggagcuguugccuagaaagcccgugagcccagugucugcacauuaauagucuucagggauccuguuguuccuguugccccaagugggagccagguccugagcuuauuugucuuggucuccaaacagccuccugguccuccagcccuugugccuggcucugugcucggcucuguaacaggaaagcugggaaugggaguccaggaaaggauucagauugccagugggaugaaaaaaauucacagugggaugaaaaaaacgugaugcacauugaaggagcagaguuggggccugggacucucagaggaaaaacagagccaauuggagagggcaguguaggggguuucuggaguggaauacucaagagccuggaacugguucagcgcuuugguguccuggagguguggcuggaagaguuagaaacccuuaagggcuucccggggucaggagccucuggcaccuuugucuccuccugggauuggcagauaugccuaucuugaggggguugcucugucuuugcaaagcccucgggagcugggccuaaguuaucucugggucucccaacaccccuuucccuuuggauaagucuuuguuugcacacuccuacuacaacuguccccagagaggcccagguaagucucugagaacacccugcagguagguggcccagcuaggacuagaacccaggugugcagacucccaguccaggucucucccccacuaccaaggauuccccucacaucaggcucaucuuuucuuauacuaaaagguggcugaugagaacgguggcacagauuguaggaugaguuauuggguucuggaggcacuguuggguggguggguggaucucuuaguuauuauauuuaucuaguguggaaggccccacagagccccuuccacgucccaggcucugcuccagcuggguuaagucaaugcauauuugaaauagaggaaggagcucgagggacugacccgggcuccgucaacagguucaacguagcaaagugaaaguucucucccagguuaaagggauucucccacggcggcccaggagaugguggcggcgggcgcccggcuggaggccugcgccuuuaaggagccagggggcggaggggcggggcaggaagacgacuccccggagacgccgccaccggcuaggucuuuuuuugggagggggcgggccagacccuuuuaugggcuccgcccccuuugcggcugccgcgucccccuuccgcccucggcuggaggggaggaagcuaggggggcguugcagcggaccccgucugggagcuccccgcugggcguccggcccgcggaggcgcgaguuugcugacucggagggagccgcuggggcgggggcgagugcuaauaauacccguucguuccgcagccgcgcuuuacaguuuacacagcugucaccuucguuucuccuuaauuaauaauaaaaauagccgccguucgggagcgcgggcugggcgccaggcccggugccgagcgcgguacgagcucggcccccagagccggcccucgccacaggauccccauuuuccagagcgggaagccgacgcucaaccccgcgccgcgacuugcccgaggucacccagugggccagcggcuccgggaccgaggcgcggggcggggugaggcgaggcgcggugcugcccccggcuccccggggcggcgcggggcggggcgggcggcgcggagggcgggggcgcgcgcggauggccaucuuaaguggccgccuggagcccagggccgcuguccggggaagggggcgccggagcagcccgggaggugggggucugcgugcggcggccgggaucccgggagggaacuuucuacuagacgggccagggauccuccuggcuucggacugcugaacccccucaaggcccggccugcgggugugggggguggugcuggggaacuuggccgagagggggaagggcucugcggggcugggaggggcugcgugagaggcucgagaacgucgcaccucgucugggccccccgccagaguaagaaucuucagaagccugguuagccagggaaucuccccgcaggcuuugccgggggacgguucccguggaguuggggguucagaucuaagagggggcugcauuucgcaggaguugggggccccgcccgcuuggguggagggaagaggauggguagggggugguccuggauccuucgcagguuuggggaacucgaugcagccaagcuguaagggggacgagaggaagagccauggaguggaaucagaccuuuauggggcuuaggggucauaucauugggagaacugagaagcgcugaauucuccagggggugccuggaucccgaagugucggggccaggauggggggacucggauuucgauggggauuuggggacuggaucuccucgggugaaugaugggggcaggaucauuguggggucugggaggucccgggcccuucgggaaggugggggcaccguccccgcaggaggagcugggggcaggggcggcccgggcugcgggccgagcggagggggagggggcggcagccggcccugcgcuccgcuccugccccucccccgccgccucugaacaaacuuuucuuucucuucaaguugaggccggcgcugcaggcagcggcggcugcgcggugaacgaggcggccugcgcggcggagugcugagucccgauccccggcucuguccggcccacggauccucaagcccgggccccgggcccggccccagccucagcccugagcgucucggggcggauggcgcggggcggcgggggcgggcggugcugagcccugcgcgggccauggccucggccugcggggcgccgggcccggggggcgcccugggcagccaggcccccuccugguaccaccgcgaccugagccgggcggccgcggaggagcugcuggcccgggcgggccgcgauggcagcuuccugguccgagacagcgagagcguggcgggggccuucgcgcucugcguccugugaguggggcgggggcuccuugcgggcuggcguggaccgggagcgcgggcacggccggguguggaaagggcccgggugaggguu

SEQ ID NO: 15303 - RNA, 29101 nt, Homo sapiens
accuagggaucacccuuccuuuuacuuuuuccccccaccccccugucaggcucaggugagaagccgaggccaggcuguccaaagcucuuuucauguguaacaguucugagucccuugaccuccccccuuggccugacucuggucucgguuccacuaagacagaguccugucaucuuucccuaccaucccccacuggacugucucucucagaaaccccaggcagccuugccuccugaccuaacuccuggagaugcugguguucuugggaggaauuucuccugcaucuuacaugcuagaagccccuggggcaggagguagggggaggaauugagaggaggaaaaacaugaacuagacaccuagagaagaaggaugugacuuguaguauccuaugucuaaauuaggaauaugaaucugguuuuucuacaagaaguuugagaucacagcugacuguguuccugaugcauccaccaaacccaguuccaucugugggccucccuggcucugucaccagccguugcacccucccaaucacaggagucacaaaccucagacaugcagcuccuguccacacuuaauauaugcaugcauuggaucacccagcccuggucuuucugccuccauggauaacugcaugacccugagagaaaaccuccuuagauuuagcauccuagguuccucacacgccucacccugaauccuggcccucccgcagccccagcgccauuugucccaucagugacaagauucauauucugauguagacucuguugccagagccaguguugagccaguccgccucuuccccgggaagugccugcccuucccuccuguuaggguuggcucucgagcuugugugccaguuccuggguuggccgugagaguucuacagacaaggaggaagugcucucgguguauuuccugugguggguucacacgcagcuagacacagcuaacuugagucuuggagcuccuagagggaagcuucuggaaaggaaggcucuucaggaccucuuaggagccagguaggagucugggacuacuagugaaccuagaccuguggcucuggccagaggggcuaggaugagagacagagggugugauggugggugcugggagauguagccgaccuuggggcugguggcugggggaguggguagccugggaaaggccaggauguggacggacugguauggcauugagccugaagugguccaacuugggguuccccagugccuaggaaaguuguccccuugaaugucagugugaaggugaaggaggaagcagaugccuguucauauggaaacaaagaccuggcugugaagaggggaggcggacaccaaaguccugacacuugggcgggacagaauugaucugugagagacucaucuaguucauacccuaggugacccuggggguggcauggggguagauuagagaucccagucugguauccucuggagaguaggagucccaggagcugaagguuucuggccacugaacuuuggcuaaagcagaggugucacagcugcucaagauucccugguuaaaaagugaaagugaaauagagggucggggcagugcuuucccagaaggauugcucggcauccugcccuucccagaagcagcucuggugcugaagagagcacugccucccugugugacugggugaguccauauucucucuuugggucucaauuuugccuucccuaaugaagggguaagauuggacuagguaagcaucuuacaaccauuuguggucaugagagcugggguggggaaggauugucacuugacccccccagcucuguuucuaagugcugaaagagcuccaggcuaugcuacgggaggagaagccagcuacugaggaaaagccagcuacugagaaaaagcgggagugguuuaccauucuccucccccaccuuucaccagagaagaggacguugucacagauaaagagccaggcucaccagcuccugacgcaugcaucaugaccaugagacacaacuggacaccagguaggccuuggggcuacgcaugggcaggcgggguagggugaggucuaugaacagaauggagcaaugggcuaacccggagccuucacuccaaggcaaaccacccagcgcaccuggugcuguugcuuuaagaaccugggcagauauuguagcucuggcuccagucuaaagcuucucuguacucuguucaauaaagggcuaaggggugggugcugaggggucccucuucccgcucugauucccuggcuagaacccagacaucucugggcuggaguuacauccuuacccgggcagcccacucugucuccagagccgcugaccuguaacuguccuuuccucagaccucagcccuuuguggguccugcuccugugugcccacgucgucacucuccuggucagagccacaccugucucgcagaccaccacagcugccacugccucaguuagaagcacaaaggaccccugccccucccagcccccaguguucccagcagcuaagcaguguccagcauuggaagugaccuggccagagguggaagugccacugaguaagaagcacagugguggagggugggcuaugggcacagagguucccagggucggguugacuccugagcgccaguccccuucugcccauguaccaccagcugagccagcugggcugagcacgcaccauucucccuccccaacccagugucaugggugcaggcuuggcgcagcucccaagaugcucccuaucaaauaggacagagaacucaagacauaaguaauggucacaggaccucccagagccuugguugcaguggaccccaaggccagccccuccacccagagccugcuggccucuggccaucucagaggagcagcagccauccagcacugccuuugucaccugggcucccaagucaccgaggcugggcacuagaaaaggucauccugaggagacagguucagaagaggauucaucacgugaaccaaggaccauuccucacauuccccguguuuagggcuagggccucucggagacaacugcacuucuguaacggacguucccaccuagguggugugcagagcaguucucuagguuccagaugcauggggacuggggggagcuggcagggagggcacagcagagcaggguaggggaagggccugcucuucugaagagcuaacugcugccugugucccuagauggaacgcugagcuuauccuguguggccugcagccgcuuccccaacuucagcauccucuacuggcugggcaaugguuccuucauugagcaccucccaggccgacugugggaggggagcaccaggugagggucgcagcagccaggugggugggaaggaggccuucugcggccuucucaugaccuuuccuucccuuccgcuccagccgggaacgugggagcacagguacgcagcugugcaaggccuuggugcuggagcagcugaccccugcccugcacagcaccaacuucuccugugugcucguggacccugaacagguuguccagcgucacgucguccuggcccagcucugggugaggagcccaaggagaggccuccaggaacaggaggagcucugcuuccauauguggggaggaaagggugggcucugccagagcagccugugaacuaaugcccagcauuccucaaggucagccagacaaaaaggaacuuaggucuugggcagaggagguguagccuggggcaaagugaugagaugucccuccuuuccuuggccugauccuugucugccuucacuucccuaggcugggcugagggcaaccuugccccccacccaagaagcccugcccuccagccacagcaguccacagcagcaggguuaagacucagcacagggccagcagcagcacaaccuugaccagagcuuggguccuaccugucuaccuggagugaacagucccugacugccuguaggcugcguggaugcgcaacacacccccuccuucucugcuuugggucccuucucucaccaaauucaaacuccauucccaccuaccuagaaaaucacagccuccuuauaaugccuccuccuccugccauucucucuccaccuauccauuagccuuccuaacguccuacuccucacacugcucuacugcucagaaaccaccaagacuguugaugccuuagccuugcacuccagggcccuaccugcauuucccacaugacuuucuggaagccucccaacuauucuugcuuuucccagacagcucccacucccaugucucugcucauuuagucccgucuuccucaccgccccagcaggggaacgcucaagccugguugaaaugcugccucuucagugaagucauccucuuucagcucuggccgcauucugcagacuuccuaucuucgugcuguauguuuuuuuuuucccccuucacucuaauggacuguuccagggaagggaugggggcagcagcugcuucggauccacacuguaucugugucauccccacauggguccucauaaaggauuauucaauggaggcauccugacaucuguucauuuaggcuucaguuccacucccaggaacuuugccugucccacgagggaguaugggagagagggacugccacacagaagcugaagacaacaccugcuucaggggaacacaggcgcuugaaaaagaaaagagagaacagcccauaaugcuccccgggagcagaggccacuaauggagagugggaagagccuggaaagauguggccucaggaaaagggaugagagaaaggaggugguauggaagacucagcaggaacaagguaggcuucaaagagccuauauuccucuuuuucccacaccgaucaagucaacucaguacucacgggagaaaaauagacuuuauuuacaaguaauaacauuuagaaaagauccauccccggcccuuaaaaaccuucccaucacuccaaaucccaccccagugcaagucuggggaagguagggugugagcugcugcugaaggcugucccccaaccccacuccugagacauagggcccauccguccugggaaagagcauccucuggcaggugcucccaccaggucagacccaguccuggacuucaagagugagggccccugcugggcccagccaccaggacagcaggaaccagggccuacuccucuuauggucccuucuagauccagaggcuaagaggaagacuggccaggcccaaggacccagccaucaaaaccagccucaaaucugguugugauggagaagugacuuugcuuuaagaaaaaaggaggcaagguagggagagcgcccacacuguccaugcuccaggcccccugggccagcuccgagaaggcgccagugaaggaccagggaccaggccagggugcgggcaggcaucacugucucuagggguuuggcuacuguuggccugggagcugagagaaggcacugagagggacaguaggcggaggaccaggugaggucagcaucggggacacagguggggccacucacugguacuggcccuuuagugcuuugccugaaagagacacagucacauggccagaugagaacuugcgauacuagccugcacccacuggcugggaagaucucuuccugcucccacgccccugucuggauccccucccuugugagccccaggguuaucaguugcuggcugugccugagcagcucugggugcucuccaugagaauggggccaucugucuucucuccuuggagaggagcuaccaggacagggacaccucuuaccccacacccuccagcagccuggcguggccccaucuuggaugcuacuugguggggcggucuggggggugcccaugcucucaucggguuucccucccccauccugccagugccucuaccuugcccuuggcucgagggguggcaccaauggcggcagcaguggcggcgcuggcuguggugguggcaaugcgcggagaacggcggguuccacugcgaguguugggggaagccuuggacagggccuucuuugaggcuccccgccgcagaaggcuguucccuagcuucuuggguguguugaggaugcugaaggccaucgacuggcgccggucagccugcaaggaagggcugucagaccgggagacccaaugcugccuucccaggccagcgugcugugccacgcucuaucagcaaggucccgccagggcgucgcuucaucccccuucagccccagccucaccuguuuaguagaagcuggagcugcuuucuucugggccucaguagugcucuguuugcgcccuucaugucggucucggggagucauggggcgugggaaacagcugguggccuucuuagacuauggagaagaggacaguuaggcagacaguagcaagaggagucacaucugaagccaggugucuuguccucucagagcugaguggaccuuguaagucaacgugcaaccugcuccccuucccaacucugggccagauccuucccuucccaacaguucccauccaugggucaggcccuuggagagagggaaagagagggggaagugagggaaggagagagaaggcucccuuuaguccuuggugagcugggccugaccugagcacagugcuggaguaacacccaggagccaccgcgccuaccucaggaguuccagggcccugguggggcucuagggagacccguuugcgcugcugccggguggugaugccagugcccucggcuaucuggauuggcugcaugcuggcucggcgcagggucucuugggggucuccaguuuucaucuccucaucugugauggugcccaggcucagggaaggcugcauggguggaagagguggucaguggaccauagcuguauggagauggaggaggaccuggggcugucccagaacucuacacucgcccgacacuuauggucgggacccuuccugccucacgagguagaaagacacaaggccuccuuuccuguucugcuuucuaccuaagcccugggcaaauggccacaagcagugcaguccugaccagauuccucucugagcuccugccuaccccaagggacuucaccccugagugcccucccagcugucuguuccaccuggaaacaugagaaggucacccucccccuccucggccagucagugauccagggcccuagugcucaggcuagaucagcaggugggauuccaagggagggcagggaugggaggcccugcacagugaccccaggccucacccuggacuccaggggauagcaggucuucagauguggggggcacacucgauugcgcugcugcagcucugcaaugcgguuccagucauccagcugcucaggcucauccuggcaagugcccauguagaagcuguuccuuccuguggaaggcagggaagugggaacaaaugagccuggagucggcaggucaccuccuggcccuggcaucuugccagccuuugcugccaccuaccccauaaacuugaagcccagcacaccagucugauucagugccgcaggugcaggaguacggcacacagacuauuucuauccuaggggcuugcucaccaccuucucccuggagagggcagaagaggucacacgcagagacugcuacuacaucuuacucaccugccaaggcuugguggccaacacccagaggaacaaauuaaggaccgggaauuaauucccaggggcucccuggugcccaaaggacaagagcuuccaagaagagucuggccagccuggccuuuccagcagcccaucaccgccugagaagggcauggaggacuccccacagcuaagugucacaauugugcugggaaucccgggcccuuaacucuggcuaagagugcccccaacacagccagccccuagaugggcagguaaggaaggcccugaggcugcaggaaggaggggcagguggagcuggaugguagcaaggaggccagccuuggauuuuuaaaaagcuuuccucuuuucccugugccacgauccaccuuccagucuaauuuugggguauaguaagucccuguaguccccucaccuggaggggccccacuggacaccccggccugggaacgacgagcagaacugcgagugguggggcgguagccaggcaagcugagcagggcugaguugccauaaucgggagaacccaggcgagcuagagacugaguagaggagguggcucgcaggcuagccugggaagcaggagcagaccgcgugcuguagaacgaugaguuggcgcugucuggcucuuccacaucuagcuucuggaagacagagugaaucuguugcaguguacagucccuggcacuguacagaagcuucccauucccuuccgaagcccucagaucccacggcacauccauguauucccaacugcuuugcaaagguccuuaaagugugugucugcaagaaaugggccuugucgacagaagcccucacaagguggugcugauguugucaagacucuucuacgcauuuuuuucauggagucuauucauaaugcuuugagguagggaaugcagaguguuuaucggcccauuuuggagaugaagugcaaagaaauaaagugacuagccccaaaucacacugcuaggaaguaucagagcuggggcuaggccccaugucuccugacuagucaggcucaucccacagccucugcugucccucaguccaaacuuccagggcccuuaccauguuccagaacuuccccaacuucuugguagcagggggcacccuaaacacacagguccccccugcuguaccaggggccccucuccccuccucccaaaccuccccuucaagauguggaaacaaaggcaagggccuguagccugucaggcaguccacugggcagcaacaaugccucucagcugcauggggcaugcugggaggcacaggaugggcugcagcuucgccacguucucucccuucacccugcacaggcucagugcuacgcauggagagaaugcuagccuuagucaggaggcagggaucuaauccuagcccugccuuuuucuucagaagugcccuuaaccaagucacugcccuuuuuaagaccucucagcuuucccacuguaacauggacuggcugcucaucccucccugcuccugacugagugcccagugcaaagaugcccuugagaggaagugggaauugcugcccugcagccccugucccagcagccugaccuuggucauggugauguugaugaucugcguggugcgccgacgagcggagcgggucuuacgacccgaguccaggaagacgucucccagggaguccaggcugcucuccaggggggccugacuccgagcagggaugggagugaaguagagacucuccagggauucuaccuuggggggcaggcgcugggagauaggugaggcugguucuccagggacgcuggugccgucuggcuggguacgaggcagcuugcuauggaaaggaaaccugcugagguacaguccuucacgcuagaaggcauuuuguccagcccuuuuugaaagugaccauuucccauccuuacuacaagcagaugaggucaagcagcccaucucucugauuuuucagagguaccaaggaaagcacuugaccugggccuuccuuucaguccacuccccuggcuucuccuaauagcuccucauaguggcaaugcccagacccagaugucccauccccaccagaugcccauggcugcuucacagcaaacacgucccaaucuaagcccacuucucuguucuuccuccugcaucucccauuucagugaauaggaacgccccccacucaggcccccaagccaugaacgugggcauaauccaaugucguccugcuuggcgagcccaaucaccaagcuuccugaacagcuccuaaccacaccccacuccaugcucauguccuuucccuggucugcuucaucuccucucaccuagacucaucauggcacugacagaggaagaugaguggugacaagccaagaacucaggccaggcugcccagggucaaaccccagcucuaccacuggggaaccuugggcaagugacugccccucuaugccccagauucaucuguuaaaggagacagaauaaaccuaccucagaggguuguugggggacaaaucagguauaauugucaugagugcuuuaugucuagcacaaaauaaguaaauguaaguguuuaauaaaaacauuuuuccagucuuaacuucuauacuagcuauuagaauaaucuuuuuaagaugcaaauuaaccauguacucuucaguuucaaauucuuccaagguuccuuuuuuuuucuccuaaaccuuucaauuacagccaccaagguuuccucaaugccuuuaggaucaagucuuaauagucggucuccaaugggccuuccuggccucacaucucagcuuagucaggcucuuucacagccucuguucacacugcucuucucgucaaccuggcacacacaccuauggaugcuuucaagacucagcaggagcgauagcuuccacgaagccuuucuugaccacuugcuuuuuauuccaacugugcccuaaauagauaucugguauaauacccguuuuucguuauucuucucuaagaauaaauuuagaucacaucuuauuuaucucacuaggauacagccugauaaacagcaggcacuccauaaacagacauagggaggaaggcugccuccugaccuggugauacugagugggguccccuccucgcagcucagauccaggcugucaauacucaaguccagcuggggcuuagccuggggcucacggcucuuuaaagcaucaguugccaccuggaauuugcccaggucucgaagcugcuggucugcaugggcaaccugagaaggagagggccagggggagagugaagaaaagccuaaggcagcaguggccuaggaggagagggcacagggguccaguggaauaggagugaggugagucugccagccaaauucuuaccugugccuccaggcugcgcaccugggcaguaagguggcggcaggucuguucagccuccuuggucuucagcccagccugcuguagcucauggcccagccguucagcuucagcucgcagcucuuuguuuuccuucugcagcugcuccaggcuccgcagcugcuccugcagcucuugguucugcugcuucuuggcaucauaauguguuuuggcuuucuccaucugugggcagagagggugggugggugggguagagguugaagggcaggaggaagguggcaugggcuggggcugggcuccuuaccugcagcuuauagugcucagcugccugcuccuucuggcucaacugggcuugcaguucauucagcugggccuggaggcgcugggccuccugcuggcucucgccucccugagccuggacagccugagaagaaaggccacucaggaaagcuggucuggccgcucuacccaaguccgcuuaucugcaccagccacuggggcuccacaggugcuucagacuccugcacuuucuuaggaagcggaagaaaaccacaccaccccaaauacucucugcccgacuacagucuacuaaaccugaagcccacaugcccuucaguccacauccguaguggccuuucccugaccagcuccugcccuaucuuugccuucuuugagaccagacacaaagugucacacccucuuugcaugcacaaucucccguaggaggaagggaaccaauccucagggaacacccaggugcagagccuuacucuaaggcacuuggcaugugagcucucuuaggacaggggaacuuguuucuccucaaagccacucugagaagucacuucacccucuuuucagaggaggaaacugaguucagagauuuaagcaaauugaccagaguaacagugacuaaauggcagaguaagauuugguccaccuaacuccaaaagcccaugggggcuuauuuaugaugcccacacugccuccuguccagaccauaacuccuuaagagcagggccugauucucuguccaucugcaaggccaacaagugcuuugcuguagauagaagcauccccccuuugccucuccuaacauaggacaggccccacaaggaguagaauaaacauuuguuuauugcaaucaagacaugcuguggcaccaugguaugaaggugagcaggagaaaugaagcucugagcucccaacaacuccuaggagccaccagggcuuuagugagucccaaugccacuggugcccaauuccuuugccccugacugaaggcugugaagccuagaacugcaaaaagcaaguauuaaaccaaagaaggugacacaguugaaagcauuaagaauguuauuaaacugcacuguaauauucaacacuggugacacucucguucuuucccugcccagacuaucuagacuuacauuguccaaaagaacuuuaugcaaugguggaauguucuguaucugcgcuguccaauacagcagccacuaaccacauguagcuacugaacaggggcacaguguagcuagugugauugaagaacuggauuuacuuuaauaaauuucaauaaccacacgugacuaguagcugcugaaguggacagugacaguugagagaugggaaccacccugguugucucucgagagcucccagaagacacaugcaggggcuucuaagccacaggcuuccuaggagggcuaccuggaaugcagggugccccucuucugccccgacaccccccacggccccagagcuuagagaauagcuucccucccuuguccagaggccagacccauucccccagcugccccaccuucagcuucugcugcugcaccuugcuggcuuggucagagucagccaguuucuuacucaguucuuccaccuggggagggaagaggaggacagaagacucaggaggacuuccccuggauguucauccuggauguccacccaucaugggguuucccagaccaggauccccaguguuccuagaauaaacucaggcccuuucucuggccuccaauuacggaacagccugcugcccaggcugcuuggcagggccugaaugaggcaaccuaacacauagauguugccagggccaacuguucuugcgucuacccugagccugcagagacagaggccugcccaacccccgucaccuccaaaaucaggagaauugacucuggggagccgacaccucaccaccaccuugcugccgccacacucugcagccgcaaccuucccaggaccuagucuguaauucuaguagacauacucaaugaauucccaugccucccucccagaaacugccaaagcccaagcccacagaugcucagaccucuucccaacauccacaggccguuagggcuggugcuagcagcauggcugcugugguuagcauuggggaacagauugcuggaagacaagagcaggggcagcacauguacuccaaagcccaccccacuccuacaaagaggaagagcacagggaguaggggaaaagagagaacauaacagccccaugcacccuuggcugcuccaagcauucugggaguucaagcaugaccaggcagcacaggggagaggcaagggcuccauugcuaacuguuugcuauucacuuugauugucccccacuaucacaggcuccuuagaggagggcccaauuuuucagcagcccugggguggcuggguaggagagugauggagaaagggugcucuauagccucgaugucucagaaacaccagcucuauagccucgaugucucaggcaacacagagaugauucccaugagaaagaggcagccagaccaugugacccccacucccccgcccccaucugguauagaccccuccugcuccuucacccucggucuuccugcuacagacaucucuaugcugugcucgggguuagagccccagaaagugaugggcaaguguccuaagcccacaauccucccuaaccugugggggcugccucgcauaucaccuucaaggcuuccauaaagcuguacucugggaaaaagggacaccauguuaaacaaggccgacacgguaauucugcuguuccucuuagucggguauccuuaacuagacacaguacuugggaaguucucgaaucccaaggauugugucugucauugguucagggugggaaagaugaagccagugcuaccccuugucccugauaggcaaaugagagaaggugcagaaggguggagaggccgaccugggaugggugggaugaggccugagagagcccagcacaccacacuccugggcagccugggccuggauuccauggcuugacccugcccccuucacaaacaguucacaacaggagcuggcggaggcaagcugcagccgggcucaugcaccaagacuggucaccguuuaagcagccagcauuuagcgaggaccucaggcauuaccugcuuaguuugcucucucugaaauaccucuagcugcuccaccuguacaugggggaggagcaacagagacagagugagaugaggccaaagaagcaccagcccugcugccaggcugaccucacugaggcucugauacuuuccccuaaggagcuagauugacaguaaguuuaaaaaugccaguuaggcugauucuaauccccaguggcuccugaggcauccagugcaggugugccucugaacaggcugguggucaucacaacuugacucucuagugacagagccuucaggggaggggaggccacugacauuuucuuuaggaugacaggggcaacagacuugaacuccaccagccaccucuccuuuucugccacccagugaaugaggaaaggcaagacacuccaguguaggagcuagaggcccuggacacagaggaucgauguccccgcgcucucagcuccugaucuuugggagggugguugggcugaguaccuuaccugggcagugaguuucugccucucuuccuggaaccgcugccucuccuccaggaccuugaccuuggcacccucauacuuggcagucaucaccuccagcucccgggcagugcucugugcuucucgcugcaccucagccagacgggucucagcaucagcacguacggcugccaacucuuggacauacuucucccgggccugguccaacuccacuuccagaaacugccggccaagguuggcccgcucacccagcccccgguucuccucugccagcaggccaugcgccuucuucagcaugcucagcugcucugcauagcuggccuucucugcccgcagcugcugagcuguucgcuccugcucugccaccuucugccgcagaggaaucagcuccccaagcucccgcugggcccgcagcagcucugcccgcagucccccagcggccugcuugcucugcuccagcuccucacgguggcguuucucggcagcggccugcucggccugcagcugcuggcagaggugcuuagcuggcagcagcucacucaccagggccugugugcuggugugcucgagcugcaggguggagagggccugcucuuucuggaagaacuucuccugccacgccuucaauucuuggcccagcuccuccgcacgcucagccugugaggucagcuccugccgcagguucucugaagccacccgcuguuucucagccuccucccggaggcucugcaccuccucccgcagagcagagcugcguucugcagcucuggcacuguugcuggcugucucugccugcagcaggcgcagccucuccuccagcuucuggcucuucucugacucggccaucaccagccgcuucaacuccuugcucucccccuccuucuccaggaccuggcgauucaggauggacaccuccuccuccaagcugcugaugaggcuauuuuuccucucagccucuugccggccccgggccaccugggccuuccacucaucuucagccuugcuguggucuuguaccuuggugcggaaggcagccaacucccguugggccgaggcuaaggcacucugacugugcccuagcuccugggccuucuccucuaacuggcccugcagagucuccagagcacugucccgcucagcccgggaggcccgcucagccucgaggcugcguuccaggcugucagccugcuccugcugcuucuggcauugcuguuccagcuugcucaccucugcccgcagugccuccagcuuggggccuguuggcucuguccugccagcagccucagauugggcuccugagccagaugcgugcuccuuuucuuucuuagccagcuguuccuucaguugcuucacgguuugccgaaguuccuccagcucuuuuaucugggcugccuccagaccacgaagcuuggccaacuccugguccuugccuuccuuuuccgucagggcaugagccagugccucuugcaggguagcgaacuccacacgcugcucguugagggcguucugcagccgcaucucaagcucugcucuggccgccuucuccagggcaaggucagccugggcacggccccgcuccugggucagccgcgccaccucccuuuccugcugcccacgcuccuccugcugcugccccuggcucuccaucagcgcggcccgcagccguuccagcucauugcccaucugcucugccucccgcuccauagccugcagcgcugccugugugcugcagaacuggcgucccuguugcucuuccagccacucgggcugucugucuccugcccucgcaggcuccuugacuaacucccgggaggcuguuuccugcugcucaccugccuugcgcaccaaggucuccaagcgggccaccucuuugcugguggcagccaucuuuuccugcagaguggagaggucaucugcaagcuucugggcccugacuuccuucucuuggaccugcuggagugcucuggccagguuggcauggagcucagcuaguucguucugcugccggcuuaucuggagcucgcugugggauucuaugccugccaccuucuccuuugccuccugcagcuccuggcgggccuucucacauuccuccuucaaagucaucagcuguuccuggaacauggcgccauacugugccuccucuugcuggcuauccucauaccgcucacgccaggcagcuacuucuuugacgagcugcucacacucacucucagcugugugcugggcagccauggccucugccagcucccgccgcaggacuucagucucagccugaugggccuccccaagcugcuguaaucgagccuccagccccuugcgcccagcccucucuucuuccagcuccuuucguucccgcuuaugcugcuccaccaggcuucgggucucugccuucagcucagagauacaacgcugcugcucuuccagggcaucugcagcccugcgcuucuccucuucaaggcugcccuuggugaccuucaaggacucuuugagggccuggagcugcuccuggagcugguccuucuccugggccacccuuucuuucucaguugcuuuuugcugcucagaccgcagcugcaacucuagcucugcaaccugggccugggccucaugcuguuccuggcgggcugucucaacacaggccuggaguuccuccaccuuccggcucagcucugccuucucccgcugggccugugucacugaggucugggcacugucccgggcuucauuagccaccugaaguugcugcugcagaaucuccagcuuggcagccuucuccuucuccagugccuccagcugcuugagagccgcaucccgcucccuuaaggaggccucucgcuccucugcagcaguggccaguugcugggcaugguccugccuaguugccuccugcuucuccgcuaccuccuucaacugcugcuccuucugcuucaggcuacugcuuagcugcuccaccugguggcggaggcccugggaggccuguucuugcuguuggagggucugugcuagcugggccugcuucucuuuggccugcugcuucaggccagccaguucuugauccuguugcuggaugguggcauugaguguggugagcucagaggucagagaggccaccugggcagucaaccgggccccaugagccugggaggccugcuccagcucuuccuuggccuggcugagguuggagauggagcucugcaggucagugaucaggcuagacagcugcugcuuuucuucuucgaaguggccccgcucagcaagcagcuuggcuuccugcuggccucgcucagucuccagcaucucuacccuggcuuggagcuguguguuguuugcagcaagaguggcugccucuugcuucaagguuuccagcuggugguauaaagagacaaacugggaucagcaugacuccucagucaucaagacuccucuggaaauggaggaacaccaggaacccaaauguacugaaugugaguccacaccaaccagcagcacacaggucuuucugugcauuccuaccugcaagacaucacccagcaccucgcccuucuccugggguggguuauccugcagcugggacaaguguucuuccagcugugaaaguuuucccugaaggauuucguucuucucuucaaggcauuucugggaguaaaugagacccaugugaacagagagggggaacaggcaccagauuaccacacaagcccucauaaacaucagcaaacauggggcccaucaucuuguuaccaagaucuccuuuugcccuggccuagaaaaaagcagaaaccauggaacugggagcaugagggaccugauucucuagaccuaguucuaaggcacaauaaagucauaauguaaccugcuuacuacuuccccaaggcugcugaguuuacuucaaauuuccuuaccguauacccuuccucagauaagucuugaguccuagauuauccaaaucaccaccagcugcccaccauccucugggcagcaauaccacuggcagcagcugcagcaacccccagucccaaacccacuucuucaccacuguucacuaagcaccuacaauaggcuaugcuggguucaucccuaauuuuuuuuuuuuuuuuuuuuuuuuugagacagagucucgcucuaucgccuaggcuggagugcaguggcgagaucuuggcuuacugcaaccuccaccucccagauucgagagcuucuucugucucagccucccgaguagcugggacuacaggcaugcaucaccacacccagcuuaugugggaggcagcuacuaccauuccucuuacagagcaagaaccugaagcagaugcuaagugccuugaucaagggcuacaugguuauuaguaaguggccaaauuggguucuuaccaauaguaacaaucacaacugguucacugagagcuuacuuuacacuacacgaugugugaagugcuuuacauacguuuucucauaauaggugaugaggcagcuacucguuacuacucccauuuuagggaaaggaugcuuagaaaaacagacugauuaacuuguccaagauccacaucuugugaacagcagagauaggauugaaagguguacuauaaagugagggcauugacuggggaaaaaaaaaauaaguuaaaaaaaaaagguguacuagacugaagcccacaaucuuucaauuacagcacacuauugaaccuugaagagaaagcaacuuaauacccaaaggcccagaagagcacagugguaaacuggacucagcuuugcacauguggucaagacuguggcugugaccccagcagaggguuaccuuguccugcagggcugcgcugagcuccuucuccagcugggccugcuucucuagccacuccugaguggccuugcugugcuccuccgucagcucauugagggcauccuguagcugcugcagaugacuggcaaacucccgcagcugagacgggcaagugagaauccccaucacccagagucaacgcugaccccaccacugcugucugcucccagaaccccaggggcuggaugccuccaauuauccugccaacccucuacaaaccaaucacagccaucacaccucuaauucagaacuacaaaucaacauuuagggucacagcccaguacccgggaagccgccaauuaugggauaaggaaaggggcaaaauaugcaggucucuggagagacugaagcauaagacaggugcugggacauucuucucaacccucucuuggggagccuuccagaccaccucagcccugaggggccuccaugcacacaccaccuuaacacccaccuuaaaggaaaggucuccauucuccuccgaaagcugguugauuuugcgauccaucuggcucuucucugucuucagguccuggcacugcuucaggguuucaugcagccgcaugguaaggcugcgagggagggaagcagugagaagagaguauggguuccuggcugggugaggggaggggcuggggccugggaaggaaugcagggagagcuguaccucucauucuugucacgcagcuccucaagcuccuugggcuccagugggcuggccgccugcuucucauucagcagggcuaggcggucaaugcgcugcugcaucauggcuaucugugcaucugcccagaguggagggaggaggagaggagaaucagaacuaugugcaugagcggaacuaugugcacagaacuaugugcacaaggggaagggaggagacggcauagggaagaggaggaauaugguauccaaucuaagggaaagagaagauggggacaaagacagaaccuagcuuccaggaggucagccugaccacaggcccagggcugagcucucagcuccaggggccagcagaggggacaacaugggaggccaggggacauccuuccggcaagucuauucacacaucugccagugugccagccaccuacccuucucggugaggagcuugcgguucucagcuagcuccagcuccagcucaucccuauuacuucucucaucagcaagcugcuucuucagccgucucaucuggaacuguggggucugcaggauaucacccaugggagaagcuggagaaccugagagaaagcugaggagggagaaggcccauaugcauugguaagcgccuaagaucugaagcaaucagcaacaggcagcaguaagggagcggggucuauggaagugcgcacuagcagcugggaggccugugcaccuggguuguuugcagugcuaccucaagccucaugacaugaucuugggaaaacuuuucuucucacugccuuaauuucuuugucagaaaaaaaaaaagugauauauucuccuuggcucugcagagaugugcuaagagaagagacuucauuguagucuccgaggaagaaggguauuccauaaacagggaacagcuuuugagggaggccuucugcacaugacaaaucccaaccacuucccccaguuaauacugggugaggugaggagaucccagaucuaccggauacucuaagcacucccagaggcugguuaacaucuuaacucuagaaguuaggaaugugaggaauggauggaugcugaggcccuaucccaggaggagaggcccagaacauacuuguucccacuggaagaggaggcaaccuucuguagcucuaggaagcgaaucucccucuuggccugguggcuagguggggagagcucuucagggaaugugcuagaacagguagaaggcacaggagcuggggguaagaaauagacaaaauaaaucaacaaagguuaguaagaagguguaaagauuugcaccuuuaugcaauuugagaacucgccuuagugggaguauauccauggauacuuauauguaaacuaccaaggaaggcacugggcagaaccugaaaccuggugccuggguuauccagaguuccgugucucuaaccaaaaugaagugcagggcuuccauuucuacagagcaucauuacucagagcacaguggagugacgguguccucuggcucagaaacugcaccaagugcucaagcuuuuuccucgaguccacacugcagagacggcuuggggagcccugagcaggaucuccuugcagcccccaacaaccuuuccuaucagagccauuggccaccauuuggaauucauccccccugaagccuugcaccuccaaaaugcccuccuccucaaaacccuucucuuuccgugguuuccgugaccccuuuuguaggacucuccuaccucuaaucacccauucuuaagucuccucaucugcuccucccuccucuacccacccucuaagcucccagagaucugauggggccucuuggcucugcccauagugcccacggcuucaguggccauccaaugcugacuugcaaaccuaucuucugguccagagccugcuccugaauucuggacucacauuucuaacaucuccaccugaaggucucaugaggaaccugaauacaaggaacaucaaacucaacggcuagaacucgccuagaccuccuucuuacauuccuaucauccaccagcugaccucuucaucagaagaccagcagaacgaucacucuuucuacuguaguaccagccgaggccauugauauauuccguacuuagauuccuuaucauuauuuccugguuuauguaucugccuuuccaccuagaacaugcacuacaugacgggaaaaacauuuuuuaaaagacugugggccgggcgcaguggcucaugccuguauuccuaacacuuugggaggccgaggcagguggaucaccugaugucaggaguucgagaccagccuaaucaacauggugaaaccccgucucuacaaaaaauacaaaaauuagccaggugugguggcaugcgccuguaaucccagcuacucgggaggcuaagcaggagaauugcuugaacacgggaaguggagauugcagugagcugagaucgcaccacuacacuccagccugggcgacagagagagacucugucucaaaaaaaaauaaaaauaaaaauaaaaagacuguauucucagcuucuaagccuagaguaaugauuguuuaaaaaauaaaaaacaaaaguagguaugaucacuuguaaauauccuacauaacugcugccaggcagcaaggaggagcuccauaggaacugagaugauacaacauggcccagaaaucgaccuacuccauuacacacacuuuuccugagcaucaacucugccuuguguuggggacagaaacaaacccccaccauacuugacaacucaggauccuaguauuccccauuucagagaugaggggauucucaggaguguguaccuacuuaccuuucuguaggaaguucucuagguccucauuaagguuuagcccguccucaugguccagcacaaauuuaagaaugacagccaacucagccugggccacagggagaaaaagagcaucacuuagguguuaggccucugaagggauggcugccaggagcuccacccuggcagugccaguccccggcucccucaugcccuaggagccugcuggaucccauucucccucucagagcugagguccuaugacccagccaacaacauucaacuagagauauguucaccccacuuguccccuucccucccaccuccccucaagauguaccgaagucagaguuccugacugacuuaacuccugaccacaagugaagugacuguuaaggaaaguaacacaaucagaaaguugcuuuuauuguuauuguuguuaagaaacaagaucuugcucugucacccaggcuggaguacaguggcacaaucauagcucacuauaaccuccaacuccuggagucaacuccuccuccucagcuccccaaguagcuagaacuacagacacacacugccacacccagcucauuuuuuuuaaaaaaaauauuuuuuguugagacagggucucgcuauguuacccaggcugaucuugaacuccuggccucaagcaauccuccugucucggccucccaaagugcugggacuauaggcgugagccaccacgcccggccaggaagcuuuuauauauaacuauguuggccucuuccagaugacccuaccagaggaaaggaugagauaaaugaagugaaaguucugugggggaaaaaaaacacacacacacagaaacacauauaggaacagagaauaauuucuacguauuauccuaaaacacauuacaguuaaacauaugcacauaaaaaaggacuugaaaguacauccuuuaaaaaguuagcaaacucugggaaugaguuuaucggcaacuguuauuuccuccugcaugcuuuucaacguuucccagacuuucuaugaugaauggcaauaauugcuauaacuguauuuuuaaaaaguccaguaucugcuguucaaagaaaaacaagucaggugaggugaagcaugggcuaggccugcuagguggcauggaggcacaagggcuuaccugaauuuuauauucaaacuguucccagucccugggacuuuuggagcucaugguagagugguauaagagcagcauggucaucuagaagccaaacaggaggcagucacugaguggggcugucucucuucucagugcccccauucugggcuguucuggggacucugagcuauuccggugacucuucuaaaaguccuggaauucagcaaucccaggccaccauccuuaacagcuccaggaaacacuuuuuuuuuuuuuuuuuaauuaaggauaguguacacuguacaaaaagcugagcgccaagauuccugcauggcucaauuccuggacucauggaacccugggugugaagcuuuagguacccucuauaggccagcacccagaaagagcagagggaaugacuuaagacugagcuauaauaaaaauauggugauagccgaaugagaccugauuucugccaggucuccaccgaggcccacaguaauggucuaguaaaccauuguuuguuucauaaucucugucauaagaucaugggcuccuagaauccuugggcuaaauuagccucugucucaagacagguggcugccugguucuaccuccaacguacuagagccccagaaauaaagcacccaucaucuccccuuggguuaagagaaggcccugcagggucccucagguaccaucaccccaacccugcccugccuccccagucugguauuccauagguaccuucgccaguuccagcucugaucccucuagcaccuucugugcagauaccaggcauucuggggaagagggauguuuucgauuuucugcaaugacaacaacguagaaaacagggugaacuuccuggaaaccauaccugagaucccagaacacugaaaucuggggagcagaauggcuaucucugguggggcuaugagauguaggccuccuuacuccuauggccucuuuccccugccuuacaauuuuccaucugaagucaguucuauccugggucaauccaagggcuacagggauaauggaagaagaaagcagccucggaauucacagcaacucugggucaugauguugcacucucccacccacucaccaacucucagcaccacagaggaagagcccagagaugccaggucacuuuagaauccuguuccaacugaggucacagaguaaaccuauagcugagucagaaaaggacaacuagggauacgugacucuuauacugcccgagggucugggcucaaauuacuaacaccuuacuuuaucuaaauaaagccucaccuuuccuauaauucucuagggguggagauggcagcuagcuccccaugucaaagacgaggacucuguggucuaaggcuggacaaggggaggggaacugaaaagcacuguacuagaagcuuugcauguguucuuauuuaauccacccauccacuugaagagcaguuaucuccauauuauagauagggaaccuauguccagaaaggucacacaagcagugaggggggucaagaucaaccuuaaugugccucugccccuacaccuaucgccuaagcaauuaauucaaaguuaucugggaaaaacaguuuuucuugcaagggaaagagacucauucucucuucugucuccuugaaguucggggaaacagaaacuuaaggugcucaaagaguuaaaagugacaggucccaaaaaguaaccuucuggcuccaccuagaucuccgagaagggcucugggacugaagggacacucuucuuacaccaacugaugaaggcaucacaagacccaggggaucugaaccagcuguuuucaucuuuguguuaaagaguggggagccuugaaauuuuucuccuccagacacccaugaacuaguuccucuggacucuccaaucccacgagcugaggaagcagcuucuucauagcuggauaagaaaggugcuuacucugcagaaaacugcacacaaaguccagucucucugacaccggcugcuucaagauuugcugucccucuucagugccauggcuagaaaaagagcaaguauuaggaccagaguauucagcaaucuuugccuccuugcugcugcauuucauaguaccuccccauuccuuccagucuugaucucugcuggaucuggaagagauccagaucagauccuggaggcaggugacagauaccaggacaccauuuauccagauggaacuguguggugggugggaagaggggacuugaggcaugggguucuucuggaaaagauggcacucugccacccuauuugcaaacauaaaaaagcucuguggaaaggggccgagaggagacggaggcagcacagaugaacgggaagcuauauuacaccaucuggaauggcucaacucuaaacugucaggaagccuggagaacacaccuagguuaagagugagagaagaccauggggagggaaaaacauccaagaacugaaagaacaggaggaaacaaggcucugaagugacagggugaaguucccccacuaggcugaaggcugagauggcaaaagccucccagaggaggaucccagggacuagaguguuguuuguuuguuuguuuguuugagacagaaucucgcucuguugcccaggcuggagugcaguggcacgaucucggcucacuauaaccucugacuccuggguucaagcaauccuccugccucagccucccaaguagcugggauuacaggcauggaccaccacgcccggcuaauuuuuguauuuuuaguagagaugggguuucgccauguuggccaggcuggucucaaacuccugaccuccacccaccucagccucucaaagugcugggauuacaggcuggagccacugcgcccagcuaggacuaguauucuugauuagugguucuugucuguacuugcuuaacuggaagagcgggcagugugaagagagccaugaggagagggagacagcagggggagcucucacacagcccaggaggcugaggcaggagaacugcuucaacccaagcgacagagauuacagugagcugagaucaugccacugcacuccagccugggcaacagagcgagauucugucuccaaaaaaaaaaaagaauacuagucccugggauccugcucugggaggcuuuugccaucucagccuucaaccuagugggggaacuucgcuggauccccuagcuaacugcaguuccauuuucagaagcagcaggugaaauaccacuucaaguuagaaagcugaauucucuaggcuacagugggagauccugauuagugggccccuugcuucucagaaucuacacuccuaguucuuagccaacuuucuggagggcagggcaggcccagaaccuuccaaugccagagacauccugcaagcauaagcaucauccaagccaagacuaugaguguaccuccccccauaccccaugugauuacacaggcuucuuccaagugaaucccucccagaagcacucugucuggauaguuggucugagaucagagacuccuacaaagucuugaggagaugcuaaucucuuacagacucccaaaugagccauuuucccuacccacccacaaucuggaauguugugacuccuuggcucaguguagagcaauauuuaccucagaguauuccauuaacuaaaauaaaaagagguucucaggugaaauguuuaaaaaaugcuggguuaaacugaacauuuuuuauagaagaagauacaacaugcauuauuuccuaaaccuauuugaccacaaaacccuuuucccccacccccuacaaagccugguguaaguaaagcugcauggagcauacuuuggacaacaguaguccuagagaaauccagcccauccuuuaagacuguguugaagucucaucucugucaggaagccauccacaacuccugccagucaugccucggcuguccuccaggucuuccugcagcacucaugaaugcaacugcaccauuuacaacugcccacuccaacugcacuagcugaaagccaggaauaaaguaggugcucaauacauaugggcugacugacaacugagggaugcuuuuuacugagaagagcagaaauaaaagucagcaagacaaaaaugucagaccucuaaguuuucuggcaaaaugccuccacuauacucuguuauucaagcuucacagcuaucaaacagacgggacagccuuuuuugcuuuagacuauucacgcacagaagaaccaaaagggaaacuugucagagggguugaucccaguuaauuuucccagagagaaggccaaguggccaagcaguuaaacccucaacucccacagcuuauuuuuuuuuuaauuuuuuaaagaauuauuuuucucagggugccccuuguccagugugcagacaggagccacccaacucccacagcuucuaucuacccuccaaccuugccauccucugcugccuucugcugagaacuaggcugcugauuuagguuggcaccaguagcgguaucagaaauguaagagccagaacauauuaacuaagaaccuccauuucccaaaaggaagcuggucugcauuguccuggaucugagauggagauuagcauuaaccugggauuucaauaucgccuaccuccaagccccacuucuacugcagccuagguucaggcaacacccuagaagacaacuugcaaaugagcaucuugaauuuuuggcccuuccuaugaaaauuuccuagcagguuauaaaccuacaguggcuaacccaaggacaacacacauccuuacucuugggc

SEQ ID NO: 15304 - RNA, 45838 nt, Homo sapiens
cucaacauggcggcuacacgucgccugucagucugugaagccuaccccgggcgugggccgcagcgucgaguaacgucauucgaaccccgucgcgccccuuugugcgucacggguggcgggcgcgggaaggggauuuggauuguugcgccucugcucugaagaaagugcugucuggcuccaacuccaguucuuuccccugagcagcgccuggaaccuaacccuucccacucugucaccuucucgaucccgccggcgcuuuagagccgcaguccagucuuggauccuucagagccucagccacuagcugcgaugcaugugaucaagcgaggugagggggggacgaggugggcgagaaggaaggugaggggaugcgggcugccgccgccggagcugaugcccagaccgcccgcccgccuucgcugcuucccgccuuucccgcauuucccgccgcggccuuccgcccugucagcccgcucggccuucugucuucagucagccugccccgaaccuccuucgggccuucaggcugcgcccccucggcuuugucauccugccgccuuucaaaaggauaacacuuaccccguaucgaguagugacugcguacgccgagcacuugccaggcacuauuuuauuccucccugcaagccucugagagaugauuagcuuauuacagaugaggaaacugacgcucagagcgaggugucgccgacugacccaaagucacccauaggugacaauacgguuugauuugaaaaccgugggguuggugagcugucuuaggcacagggucggggggcagcuaggaaagaaggagggggccucucuacccuccguaggcacuugucaguuuacugaucucuuuuguggggugaggauaggaguguggcguggaaaaaacagaucccagacagacagcacccucgaguuccuuucccuucaugggaagagaugcugaaucagagaaggguggcugagacaucuucugacaagauggggacugggaagagucaggaacucguauucuuucucaacaguucuuuuucauuagacuugccaagugcccgcuuugugcccagcccuuugcuuggcuuugugagauuguaggaggagacagucccugccuugggaacaggcuucaucggguuggaaaaacaagagcaacauacuuuuaacaaccgcaugagauacguaugaacaaguuuugaguugaaccuacuugccuuuguuaaagcaauacaaugauuucaaaauuguaggcacuuaguaaauacugguuaaucgacugguuguuucuauuuuguccucuaggcugugaacauuucaaagauggagacuuguuugagacagagucuugcucugucacccaggauggaaugcagugguguaaucauagcuuacuguaaccuugaaguccugggcucaagcgaugcucuugccucagccucucaaguagcugggacuauaggcaugcaccaccaugaguggcuaauuuuuaaaaauuucugguaguaaaggagucuugcuguguuucccagucuggccuugaauuccuggccucaaaccauccucccuuccuuggcuucccaaagugcugggaauacaagcaagauggagacuuuucuguucacguuuagcacaggaccugacaugaacagauucuuaaagaaugaaugaaaauaguuguaucaaaauguaggacacgaugaaugcugugaauaagcagguaguugauuugguuuaacuacagccaauguccagauugguuuaacuacagacaagaguuggaaagguggacaguaguggccuuucuuguuuuugguaucuugagaacaucauucugugaauuuuccuagcucacauuuuagcugaccaaagagcaaaauaacauagugcacuuuuauugauccauucauaagagugagagcugagcaucuauuuuuguauuuuuauuuuuuuacauuauuauuuauuuguauuuuuuuagagaaggagucucgcuauguugcccaggcuugucuugaacuccugggcucaagcauucuucccacuucagccucccaaagugcuuggauuacagugcugggagccaccgcaccuggcuugagcaucuauuuuuuaaaucuuuagauaugggagagauguuuaggauggucuaugauaagucaguaacaaagaugaauugaaaauguauggacuuagaugaccagaauggguaaaauucaacccuguguugaauuuugaacuuuuagagucuacuucuaaauacuuucguuuaaaaagugcuaccuuggccuggcguggcagggcaugguggcucacgccuguaaucccagcacuuugggaggcugagguggguggaucauuugagguguggaguuugagaccagcugggccaacaugguggaaccccgucucuacuaaaaacacaaaaguuagccggacgguagugguuugcaccuguaaucccagcuacucaggaggcugaggcaggagaaucgcuugagccugggaggcagagguugcugaaaucgugccauugcacuccagucuaggcgacagagugacacucugucucaaaaaaaaaaaaaaaaaaaaaaaccacaaagugcuagcuauaacuagcucuaaaaagcagagcuuauuuucucauuccuucauagagcacaauuugauccagaugguucaugcuguagauucugccauuguagcauucagcaagacuuaauauacaacauguacuuagauuuguuuguuucuuuuuuuuuuuauauuucuauguuucuauauuuuaauguuuuuuaauaugcauaggguuuuugguuuucuggacuuuuuuuguacccccuuauuuuuggcaugucaguggaauagcagacuaacuccuacaguuuuuguuaauuuucuuugagauggggucuugcucugucauccaggcuggagugcaguggugugaucucagcucacugcagugucugccuccuggguucaagagauucuccugccucagccuccucaguagcugggacuacagaugugugccaccacgccuggcuaguuuuuguuauuuuuaauaacaagggcaacuggaaguugacuuugaaguaccuacugaauaugcuaaugucuugcuaaacacugugagggcaguaauggagaaggcagcucuaucuucaaagaacuuaaaauuguuagggauuuaggaacaauccauaugaaaauuauuagauagaagagaauaguagaugaguuuuuuucaucugcuaucuugagcuauuuuuccuaaugggagaguaucauuccucaaggagauuaugguuaaaaaaauaaacauugagaaccauugcaguaaaugacaaaguagcuaacugaguuguaaacuguuuuggaauuuaguguaguauuuucaaaacuuuggauuguaacucacaguaaaaaacaaaacauuuuacagacauguguauauauguggauacacauaaaaugauacaaaaguuuacgaaauaaugucuuugaaagcauccauuugcacucuaaucuuucuuuuauuccagauucuuucccuaucccugccucccucccucccuuccuuccucccuuucuuccucccucccuuccuucccucccuccuugcuuccuuccuuccuuucucccucccuucuuuccugcccuccucccucccuccccucccucucccccucccuccgucccuuccuccuuccuuccuuccuuccuuccuauuccauucacagccugcuaauauuauuuuacaacucuguggauaccgugcuguucaccgggauugcagugaugaguaggcagacaugguuccagcuuccaaagauccuacaaucaauugagaaagauagacaaauaaagaaguaauaugauaaaauaugauaaauacucugauagguaaaguauaggcaguagaggccauucauucaguuauucauaaagcauuuauucagcaccucuuugugcuaggaaccguuguaggcauuagagauucugcagugaacaaagcuaaauuacauuucucauugaguugacuucuuggugugggugggagugguaaguguauauaagaaauaagaaguaaacauaauaaucaguuaauuucagauacugauuaaugagaugauaguaaaacaggaucaugugauaaagaugaaugagaaaauaaccuuggauuggguagccaggaaaggcuucucugagaagccaacauuugagcugaacccuaaauaguauuaagagcuaguaaugugagaucuguggccugaacauucucggcagagggaauuagaaaguuuguauccuguggaaaaggcacgcauccuuggucuuacaggauuagggaagucuuccugaagagagaagaaugaaagacaguuuauagccaagaggaaaucacacuaguaugcuagaggauuuuuuaauuuuauuuuuuauuuuuugagacggagucuugcucuguugcccaggcuggagugcaguggugugaucuuggcuuacugcaaccucugcuucccagguucaggcaauucugccucagccucccgaguagcugggauuacagcauacccagcuaauuuuuuuuuuuuuuuuuuuguauuuuuaguagagaugggguuucaccauauuggcuagacuggucucgaacuccugaccucaggugauccgccugcuuuggccucccaaagugcuaggaauacaggcugagccaccaugcccugcuggcuagaggauuuuaaaagaggaaaaggucagugugaguuaaaagugguugaggcagguuuuauggaggugugagauuuggagggugaguaggaguuagauguauggaaagguggaagaggaaccuuuaggcagaguaagguauaagcaaugauguggauaugggaaugggaagcccucuugggacuuauauuucacagggaacaguugaagagaucuggggccaaacuaagaaaggcuuugcuugagagaagaggauaauguaggcagugagaagcagggauuagugaugugauaaaaucaacaucuggcuugaaaaacuaaccaaguggaaugacagaauagagaacugugugucauuggaccuuuagaucuuuagucugccuccuauuuucaagugugaguuaagauaauuaccaaugcacuuuuuuuuuuuugucaguuuccugauugacuucagaacuucuggcaguuguagaauuuucuuuuugcuaaguugcuuuccccccccacugcauguauaauugcagaacgcuaauguugcuuugcaguuaccugccugcuuaguuauccaauugcuagagcacugagguuucagucccagugccagccaguuaauuuaccccauuucagaguuaaaugcugcagaugugagccugaugagaaaauuaucacaauggugaucagaaagagaggggcuaacauaucaguguagaagaaaaagcaacuuguucuagugauaauggguuaauagugaugucuuauuguucauuuauucuucaucaaauguuugagaacuugccuuguucuaggcacuaaauuugagaauacagaugugaaucagagggccaaauaaauguaaacauauuuagcauguuucuuauugguuacuucagguugaguaucccuuauucaaaaugcuugggcccagaaguguuucggauuuuggauuuguuucagauuuuggaauauucgcauuauacuuacugguugggcaucccuaaucagaaaauccaaaaucugaaaugguccaaggaacauuuucuuugaacauuguguuggcauugaaaaaguuuuggauuuuggaguguuuuggauuuuggaauuuuggauuaaggauacucagccuauaguuacaauggauuguaggugcacaaaagagacaaaaacuaaaucagugugagacacuaacauuuauugagugccuauuguguaucacauacugugauuuuuuuuucccccauaggagcagcuuuauuuuauaacgagguauaguuguaacuaugccaaaguuguuacaacaaaagcacuuuuuaccuuaucuaauuuuauugucacaguaaacugauuaggcaaguaaaauagauauaauaauuaaccccuuucuacaaaugaagaucugugaaaugacugauuguguuuuguggcuugucuaagguuaaggcuguuuggugguuggauauauucacuauuccugguaagaauaaauaaaggucggaugagcuacuauuugagguuaaacuaagaguaguaagacuuuuuugucuagaaggacaaagauauaaucuaaguccaaaaucaugaaaaauauuagguaaaauauauaguaugucagaugggguaagugcaauggagaaaaagcacagaaggggaagggggauaagaagagcaaggguccuauuuggggcauugcaauuuaaaauggaaucaucagggaaagccacauugagaaggugaugacauugagcaaaagaccuaaaggagauauauagcaagaaggccaaguugucaagguacaauaggaaggaaggugggagaguuggaggugaaauugggaagugggugcacaggacaagugguauaggauucuguggauuuuuuuuuuuuuuuaguuggaguuucauucuuguuguccaggcuggaaugcaauggcgugaucucagcucacugcaaccuccgccuccuggguucaaacaauucuccugccuuagccucccgaauagcugggauuauaggccccugccaccaugcccagcuaauuuuuuguauuuuuaguagagacgggguuucaccauauugaucaggcugaucucgaacuccugaccuccagugauccacacccccccccgcucccuuggccucccaaagugcugggauuacaggugugagccacuaggccuggccuguggauuguuauaacaauuuugacuuuuauucuggagaucauaagccacuauuaggaguuuugaaggagguaaugauaugauucugaguuuaacuuuuaaaggguaauuuuggcugccaugugggaugggggaaaaauuuaggaaauuauccguaaacgucugucuguauagaauucauacucuuugaaggugacaucagagaagacaaucucuucaugaaucuuuugagggggccucaaucuuuucugugaaauagcacuucauguuggucaauuuacauguuaauuacauuugauucuuugacauuguagucuuaauaauugcuaacaugaauuuaauaauugcuaacaugauuugauucuuuagauggccgccaagaacgagucauguuugacaaaauuacaucucgaauccagaagcuuuguuauggacucaauauggauuuuguugauccuguaaguaaauaugguuuuuaucuuggguuccuucuuucauguguuucuuuccauuugucucuuaucccuggaccuucauucaccugauauacuuugguauucuggcuaugcccuucgauauaaaauuugaauucauugcuuaaaacauuuuuuuuuccuuaauuuugguucuguccugugaguucucacuuuucagagaacuaugaaugugaguaaagaggaaaauuugauauuaacauuuaauaucagauauuuccuugaguaaauuguuuuauucauuaguggaaaagccuaggccaggcgccguggcucacgccuguaaucccagcacuuugggaggcugaggugggcagaucaccugaggucaggaguucaagaccagccuggccaacauggugaaaccccgucucuacuaaaaaugcaaaaauuagccgggccugguggugggcgccuguaaucccagcuacuugggaggcaggagaaucacuugaaccugggaggcagagguugcagugagccgagaucgugccacugcacuccagccugggcgacagagcgagacucccucucaaaaaaaaaaaaaaaagggaagccuagaguaaagcuuguuuuggaauugugguuauuuagguagggacugguuuaaaauuuguuuuuuguuauuuauguaaaaagauuuaaguaauauaaaguagauuucauggacaauauuuaagucaagaacaaacuauucauaaaccaguugcucugcuuuucuccuuauccuuuauaacuucuguauucuagacucucaucaucaguuaucuggacuguuuucuguggucucugcaguguccuggacuuccucuaaucuuacccucuucaaacucgucuuccaccugacuucuaaaaugaucuuccuuaaaugagaaucucuaagaacucuuuuuuucaaauccacccauauuuccgucuccuuauuuagguaucuuauccgcacugcuaagguaucuuagguaucuuauccguaaaaccugugcucaucucauagcuuuaaucauauaguauggaaauuaauuauggaucuuuguccuccccuagaauugaggaugggcuguguaucuuauucuugugauauccucagugcuugacauguaucuaauuagccacuugaccaaaguaaguuuggucaagagaaaaugauuuuauguaucuugaaaauauguuuauuguaaauucucuuuuauauugaggacuuaggcaauaauuagaauaguagaauguuagaguuggaaugaacuuaagaguccaucccauuucaucuuugguuuauagauaagaaaguuccaaagagagaggggagugacuuaaguuagugggaguguagggagaagcaccuaggucucuugacuccuacauguucuauugccucaugcaguaguacauuuuagagcgcaagaauguugcagcauccucaaacuuccuaggguagauucuguugaaaaacugucggugcacaucuguaaucccagcacuuugggagacugagguaggcagauugcuugggcucaggaguuugagaccagccugggcaacauggugaaacugcccaggugcaguggcucaaucuuggcccacugcagccuccaccccuggggaucaaaugauucuugugccucagccucccucagcugggauuacaggcaugugccaccacgcuauuuuuuuuuuuuuuuuuuuguauuuuuaguagagacaggguuuugcuauguuggccaggcucgucuugaacuccugaccucaaguuaucuguccgccuuggccucccaaagugcugggauuacaggugugagccacacugugccugcccucaacccuguuucuacaaaaaaaaaaaaaaaaaaaaaauugguugggugugguggcgcauaccaguagucccagcuacuugguggugggaggaucgcuugagcccuggagguugagguugcugugagcugagauugugccacuguacuccagcacaggccacagaaugagacccugucucaaaaagaaaaaaagaaaaacugugugcuguuagaucuggcacaguuagcacacagaugguauuuuauucugaguucuaauuguuugccuuauugcucuagaaacuauuuagaagacuucacugcucuuauacugaacacaccuuaucugcuggaucugggaagaaagugaucaggagcaacuugggcuuagcuauauuauaauuagaauagauugcagacuguuaaaauaguuacacacguaugugucuuuuuuugaggggaguaugcauuguucagcugggaaacacauuuauuuucuguuggauuaagcgguuucuuaaagauucaauaaauaaaccacucacaacuuagaauuuguuuuucuuaaaaauguaugcuaauacccugugcauuaccugucuuaaaaacuggaacuuauaauguggccuugaaaacagugaaaugcagugagguuuaaugggauuggggccagaagacuuguauaauaauauaaccuugggcaagucucaguaaccugagccucagguucuucauguaaaauagguauaguaauaaucaucucacaaagugauugugaaaugucagagauuaucaaaguugauaauuacuuaucaacuuugguugagaaucauuugaaccucgggggcggagguugcacuuuguaauuugugaagugcuaaagaaaguugucauuaaauuaucauaauucagccccagaccuaauuuauacuucugucuccuuuaauuggccugauuaaaguuugauucauuugcuuuucuguacuuaccuuauguggaauuugggaaaaguaaguauggagcuggagcccugaucacuuagggagaaucugaaugaaaaauggggaaacccuuauauagaaucagucuguugggagaauuugaaugaaaaauagggaaauauagaaucauuaguauguuuucagcuauuucccugugagacuaaucgauuuaaaggcuauacuuagauuuuuuuuaaugacacuuucauuuuauauguaguauacauuuucugauaguucugcuggauuaugcauucucauuacuaaguuucccacugcccaccauucugaaagauaaauuuucagagaaguaaguugucuuguucuuuguuugagacagggucucauugugucgcccaggcuggagugcagugccaugaucauagauagcucagugcagucuugacuuccucagcacaagcaauccucccaccucagcuuacccuguagcugcaaccacagucacuuaccaccaugacuggcuaauuuuuuuauuuuuaguagggauggggucucauuauauugcucagguuugucccaaacuccugggcucaagcgagccuccuaccuuggcgucccaaaguguugggauuacaggugugagccacugugcccaaccugucguuuuuauugugaugugaauuugauuguuuucuuuuuucuuuccuuuuuuuuuuuuuuuuuuuugagacagggucucacucugccacccaggcuggagugcaguggcauaaucacagcucauugcagccucagcuucccgaguagcugggaucacagguguguaccaccacacccagcuaauuuuuuuuauuaucuguggagauugggggcggggcaggguggucuuccuagcuugcccaggcuggucucgaacuccuggacucaagccauucucccacauuggcuucccaaagugcugugauuaugggugugagccacaacgccuggcuuuuuuuuuuaauagugucgugaacugcuaagcuuaagugaucuccucaccucagccacugaguagcugggacuauaggcauguacuaccacaccuggccaugaugguuuucuuaauuacucuuuuaaggaagcuauuguuucuugggaaagcucaaguaauucuugguuuuauuuuuguaggcucagaucaccaugaaaguaauccaaggcuuguacaguggggucaccacaguggaacuagauacuuuggcugcugaaacagcugcaaccuugacuacuaagcacccugacuaugcuauccuggcagccaggaucgcugucucuaacuugcacaaagaaacaaagaaaguguucagugguaagucuggggugaaaaaguaaaaauuuaguacucucagaaaaguaauaaggguacuagaaauaaaucuugacuguuuaaagaagcaaauauggcuagaugggguggcuuacaccucgaaucccagcaauuugggaggccaaggcaggcaaaucgcuugaguccaggaguuugagaccagccugggcaauguggcgaaaccccaucucuacguuuuaagaaaaaucuaaaauuauaaaauagacuaggugcaguggcucacgccuguaaucccagugcuuugggaggcugaggcagguggaucgcugaggucaggaguuugagaccagccuggccaacauggcgaaacccuuucucuacuaaaaauacaaaaaauuagcugggcgugguggugggggccuguaaucccagcuacuggggaggcugaggcaggagaauugcuugaacccgggaggcggagguugcagugagcugagacugugccacugcacuccugccugggcaacagagugagacuccgucucauaaauaaauaaauaaauaaauaaauagcaaauauguaaauuagugggaaagagcagacuacaauuucguauuucuccaugcugccuaucugcugcauaaaaagguugauggaucuuuguucuuuuuuucauuuucucuuuuuaaaauuuuuuuauuuuuuuugagauaaaguuuugcucuuaucgccuaggcuggagugcaauggugugauuucggcucacugcaaccuccgccucccggguucaagugauucuccugccucagccucccgaguaguugggacuacaggcucccaucaccacgcccggcuaauuuuuuguauuuuuaguagagacggguuucaccguguuagccaggauggucucaaucuccugaccucgugauccacccgccucggccucccaaaguccugggauuacaggcgugagccaccgcgcccggcccaggaaucuauuuuaaacuacaagaacuuauaaucacuuuaacucuagaagauuguuuccuuaaaugaggcauuacauauuucuucaacauauauguguuuauugagcacuuuauaugcuaggcauugagguggguugagaugacaaaaaggguugagaaccacuguuuucaacuauuaccuaaagauugaauuagcuguuaaguggucuugauauauuuucauuuuuuguuguauuuuuuagaugugauggaagaccucuauaacuacauaaauccacauaauggcaaacacucucccaugguggccaagucaacauuggauauuguucuggccaauaaagauguauguauaacacuuaucugguggaaauuuuuugagagucuuuuuuaauaaugcacacauuuuagaaaauuuaaacacugcaaaagauacagguaaauacuaauucuguuuccuacccugauuccugauuuuccucucuagaaacaacuuuaucauuuuaaaauguauuuuuccagagcuauuuuguacauacgugugugcauacauguguauguguguacauacauauuuuucuucucagugguacuguacugugcauacaguuuucauugauacuuucuucacuuguaaguauaucuuguuuguucuauaucagccuuuaugaauuuacccuuuuuuauaacaguuguauaacguuccauuuuguagauauauugucauuguauguauguguaagaauuccuuuagugaucaauauuuguuuuucaucuuuucacugcagugaauauucuuguaugguagguguuuugcucauagaugaauauaucuguaagauaaaucccuucaguagaauugcugagccaauguguauaugaauucaaaauuuugauaggcauugccaaacugacucccaaaaagguugcucagguaaaauuuuacaagcucaugcucagcaacuuaaaaauuauccacuuguguuugaaccuguuucuuaacuagaugccagaggacagaagggaaaagauguagccuagccagcccuuuuacacacaggauuuauuuaccguguauaucuggacagauuagagaccaguuuuaacuuuagguaauauaaugauuaggccgggcgcgguagcucacgccuguaaucccagcacuuugagaggcugaggcggguggaucacggggucaggagauccagaccauccuggcuaacacggugaaaccccgucucuacuaaaaauacaaaaaauuagccaggugugggagcuggugccuguagucccagcuacucaggaggcugaggcuagagaauggcgugaacccgggaggcggagcuugcagugagccgagauugggccacugcacuccagccugggcaacagagugagacucagucucaaaaaaaaaaaaaaaaaaaaagaaugauuaauugacuaucucucuaaacauguaucugauguuaaagagacuaggagaaaacugaguuguuuguguguuguuaauuuguguaaucucgaagacaaguugaagacaaaaauacagcagcagcaacagcaaaaccugugucuaaaaauauaccuauugauagucaaguauuucaguucucuaauauucacacugggcccauaccugccuuuggcaacaaagaugaccuuaaaauuuuaagagaaaaggaaagcaagcuuucguauagguuuuucuaguccuuagauauggaucauuauguagaaacacugucaguauuuugaaaaccuggcuccuuuuuuuucucuccaaaaugauuauuuguacguuauugcuuuuauuuuccucugaaugacuuuguagccuacaaaaacucuguaacaaggaccaguuaugcucuaaaaucuuacuguuacaauaguucuuuguuggaaacuuguuaaaggacuauagauuuugaagagccucagaauuaacauaagccugcuuccugucauuguuuauuauauauacuguuauauacaguuugaaguaggcuagcuuuuaaaauaaauauauauauauauuaguaaauaugugguaccaauacuuuuggauuaauagccaaucuaaaaacauguuuaaggaugauaauauagucccauuuaugcucauguuuuuucccucuuucaaaacauacuauaaacauaauaguaaaaguuuggaaaaucacauuuaaucucacaacauauauuuauguauuaucuucuaguguuuucauauacauguuuuuaaaccuaauuaggauacuuaauuuauauguauuguuucuuuuuuuuagaauguuagauggacuucuauucuacaguaauaaugcuuaguguuaucucauuguauccuguguugauuuuaguucuggagucagggccgagagauaagagauuuugugaaaauaaguaauuauuuuaauuuaauuauggguucuuuuucaccccuaucagcgccugaauucugcuauuaucuaugaccgagauuucucuuacaauuacuucggcuuuaagguaaauaauggguuucaaguaugugggaauuuauacuuaaaucaugaaauaaaggauuuuguuuauguuuuggugacaguuaucaaggccauaaguuguuuggaguugagauggaccuggggaauuagugggguuaagguagcaguggugguuugaauuaaggcaaagguagcuuaucuauuugcaguuuuugaauuuuccacauauuacuucuggauuaccugaggaguuaugcagauaaauuaccauaaguauuucauaacauucuaaguauuuuugcguugauaggcaguauaguauaguguagugacugagaacaugaaugucaguguccaccugaauuccagucucugcucuauuucuuauuagcaaguuauuuaaucucucugugcuuguuuccuccauuuuagaauggggagaauauaaaauuucaacaacaaauuuaauuaaaaaaaaauuuuuuuuuugagucugugucucacuguguugacuaggcuggagugcaguggcgcgaucuuggcucacuucaaccucugucuccugaguauaagcaguucuccugccucagccuccugagugacugggacuacaggcacacaccaccaugcccagcuaauguuuguauuuuuaguagagacggaguuucaccauguuggccagucuggucuugaacuccugaccucaggugauccacccaccuuggccucccaaaguccugggauuacaggcaugagccacugcggccaauuuaguuuaaauuucaauuuaaagugccuauaacaggcugggcaugguggcuuacgccuguaaucccagcacuuuaggaagccgaggcgggcugaucacucgaggucaggaguucgagaccagccugggccacguggcgaaaugccuucucuacuaaaaaauacaaaaauuagcugggcaugguggugcaugccuguaauuccagcuacuuggggggcugaggcaggagaacugcuuauacucaggagacggagguugcagugagccaagaucguggcacugcacuccagccugggugacagagugagacucugucucaaaaaaaaaaaaaaaaaaaagugccuguaacagaccaggcacugcucuaaacaacauauacacucauuuaauccgcugaggaaucccugauguauauguugcucauuuaauccccaugaggagucuucaggggauuaaaugaguguaacgaguguauauguugcuuagauccgugccuagucuguuacaggcgcuuuuuaaguguuagcuguugugaaguugaugaugaugaugaauacuacaacuucuguuaauguguguagagcuggcuuuuuccagaaauuuucaugcagucucugccgaaacaaaagugccagugaggaggcugagaugggaggauuccuugagcuuaggaguuugacaccagccugggcaacacagggagaccaugucucuacaaaacguuuuaaaaaguuuuuuuuaaaaaaagugccaaugauaauucuggcuaacaugacgaaacccugucucuacuaaaaauagaaaaaaaaaauuagcugggccugguggugggcgccuguagucccagcuacucgguagccugaggcaggagaauggcaugaacccgggaggcagagcuugcagugagcugagauugcgccacugcaccccagccugggcgacagagcgagacucugucucaaaaaaaaaaaaaaaagugccaaugauaauguuccagaugaagcuaggaagaguaaaugugcuauucuuuucauuugaaauuuuauagaaacggcgaagauuuaaagagauugccuuauuguggaugauauauccacugcgucuuuaaaaacggugcucugaaaauuuuuuguuguuucucucuuucuagacgcuagagcggucuuauuuguugaagaucaauggaaaaggugagaaaugaacauguuugucuguuacauuuucuacucauuauauugaauguauagcuuugagcuauaagucuuaauauucuugcuuagacucuagauaacauuuuggacuuuagguuuaguuuguggauaauuguccuguuuauuaguauaaaguuuuucuaguuuccuuuugguguccuuuucugaaauucaaauacguaucucaaccuacuuuuucugacgucucaucaugugaaaacuccucuuuugucuauaguggcugaaagaccacaacauauguugaugagaguaucuguugggauccacaaagaagacauugaugcagcaauugaaacauauaaucuucuuucugagaggugguuuacucaugcuucgcccacucucuucaaugcugguaccaaccgcccacaacuuucuagguagguguuuugaguagggaaauacgccuugaccugaagaaacugggcaguuaguucaucacauaaaaaauaauuuaaugaccuuuuaguagcugccugcucugauuaaaugagauuuagauucuggaaagaucucugacuguaaugugguaaaugaauuggagaaaaggcaaaugcuuauaacaaaaauguucuaaaauugauuggauuguggugaugguuacacaagucuaugaguauauuaaaagccauugaguaguacacuuuaaauggggaauuauauuauuugugaauuauauuccuuuuuuuuuuuguuguugagacaaagucucacucugucacccaggcuggagcgcaguguugcgaucuuggcucacugcaaccugugccuccuugguacaagcaauucucuugccucagccuccugaguagcugggauuacaggugcccgccaccacacccagccaauuuuuguauuuuuaguagagaugggguuucaccauguuggucaggcuggucuuaaacuccugaccucaggugauccacccgccuuggccucccaaagugcugggauuguaggcaugagccaccacgcuuggugugaauuauauuucaauaagguuguuuuaaaaagaagguaagugccaagaacuaguuaggggacucuuauagcaguuuauauaagaaauugugguagucuagauuagggaggugaaaguagaaauugacagaagcagauagaucaaaagauauuuagggccaggcaugguggcucacaucuguaauuccaacacuuuggaaggcugaggugggaagaucacuugaggucagaaguucaaggcugccgugagccaugauuaugccacugcacuguagccugggcaacacagugauaccuugauuaagauaaaaauauauauaaaagauauuuaggcugucaaauugacagaauaugggucaagaaugguucuugcauuuauggauacaguaaguaacaggauuaaugaugaugccauuuguugagaaaaggaacacuaacggucugguaauacauuaaaaaaaaaaauaugccauuaucaaguugguuuguuucaggaauucaagaacaugguaacaucaaaaaauacauuaauguaauucauugcauuaacauuuuaugcaguuuaaugcucuuucauaauaaacacuuuagcaaaauugauauagaaaauaacuuccuuaauuuggcaaaagauacccaauaaaaaccuagauguaucgucucuuuuuucagcaugguaguggaggccugagccagcauuguaaaauaagaaaaagaaaagauuggaaaucagggaacaaaacuguaaugauuugaagaaaugauuuuuacauaggaaacucaagagcaucugcagacacauuauuagaaauaaaagauuucagcaaaauaucuggauauagguucaauauacaucaaucaguuauguuucuguacuuuagcuguuagaaaauuaagucuuaaccuacagccaugcauuacuuaacgauggggauauauucugagaaauguguuguaaggugauuuccuugugcaaacauuauacaguauacuuagguaagccuagauuguauagccuacuacacacauaggauauauggcauggccuguugcugcucauagguuacaaaccuguguagcauguuacuguacugaauacuguaggccuuuguauuaccaugguaaguauuuguguauccaaacauaucacaguaaaaguacccuauaaaagauaaaaaaugggccaggcgugguggcucacgccuguaauccuagcauguugggaggccgaggcgggcggauugccugagcucaggaguucgaaaccagccugggcaacauggugaaacccugucuguacuaaaaauauagauauaaaaaaacuagccaggcauagcagugugcaccuguagucccagcgacucaggaggcugagacaggagaauugcuugaaccugggaggcagagguugcagugagccaagaucgcgccacugcacuccagccugggcaacagagcgagacuccgucuccaaaaaagaaagaaaagauaaaaaaaaagauacaaaaugauacaucuguauaggacaguuaucaugaauagagcuuguaggacugaaaauugcuaugggugaguuagugagugaguggugaaugaauaugaaggccuggcugggcguggugggucaugccuguaaucucagcacuuugggaggcugaggcagguggaucacgaggucaggaguucaagaccaacagggccaacauggugaaacccugucucuacuaaaaauacaaaaauuagcuggguaugguggcaggcgccuguaauccacuacuugggaggcugaggcaggagaauugcuugaaccuggaaggcggagguugcagugagccaacaucgcaccacuacacuccagccugggcaacaggagcgaaacucuaucuuaaaaaaaaaaaaaaaaggaauaugaaggccuaguacauuacugacgacuguagacuguacaaacauugugcacacuaaauuuauuuuaaaaauauuuucuucaauaauaaauuaaccuucgauuacuggaugaccacugucguauguguaguccaucguugacuuuuuuuguuuguuuuuaagacagagucucacucuuuugcccaggcuggagugcaguggcaugaucuuggcuuacugcagccugcaccucccagguccaagugauucuccugccucagcuuuacaaauaguugggauuacaggcgugcaccaccacacccagcuaauuuuuguauuuuuaauacagacgggguuucaccauguuggccaggcugaucucaaacuccugaccuugagugauccgucuuccuuggccucccgaagugcugggauuacaggcaugagcuaccaugcccgguuuuuuaaguuuuuuagaaauuucucuaaaacaugauuaaaggacauuaaauaauaaauaaauggaauagauucaauuuuauaaaaaugucaguuuuucccaaguuaaaauauagauucaaaguaauucuaggcaaaaucucaacauacugauucuaaaauucaugugaaagagcaaaagacugcccaaaaaugucaggucgaaauuccuggaaccuguaaauguuaccugauaaggaaaguggucuuuguagagaugauaaggauuuugacauggagagauuaucuugaauuaugugggugggcccuuaauccaaucaaaaguauccuuguaagagagaggcugagggagauaacgacucacagaaggggagaaagugauguaaagauggagggagaaauuggagucauguggccacaaaggagagcaauuagccacuaaaagcuggacaaagcaaggaacagauucucccucaaaaccucuggagggagcacuccaaaaaaaaaaaaaaaagugaguugcagacauugugacucuugauaccuccacuuaccuuuuuuuuugagauggaguuucgcucuugucacugaggcuggagugcaguggcacgauuuuggcuuacugcaaccucugccucccggguucaagcaauucuccugccucagccuccugaguagcugggauuacaggcacgcgccaccacacccagcuaauuuuuguauuuuuaguacagaugggguuuguccauguuggccaggcuggucucgaacuccugaccucaggugauccaccugccugggccucccaaagugcugggauuagaggugugagccacugcgccuggcccuacuuccacuuauaucucgauaggagaauauauaauaugaccucagagcaaaacaccauagagcaaaacauuggaaaaauugacuacaauuaaaaacuucugugugaaaggcaauggaagggcaccguggaucaauaaggccgagaggcgagacaaagagggcaaaaaucuucuuuauugagcucucgggcgagguucacugguccgcagggggagggccagggaagucucgcugugccaaaggugcagcgugcuuuuauggaugcugggugaggaguggucaggguaggggcagggucgguugaguuucacgcuucugagugugacacgcccuagugggcaugugcguuagucgggguggcaggaacaggaaaggugaacccggaaaugcugagucaggguguccgagguggcgaucgccaucuuggagucuucaccggaguccaaucacugugaaccaaaaacgaagucaaauaacaaguuucacacuuugggaggccaagguggguggauuaccugaggucaggaguucgagaccagccuggccaacauggcgaaacccugucuuuacuaaaaauacaacuauuagccaggcgugguggcguaugcccauaaucccagcuacucaggaagcugaggcaugagaaucauuugaaccugggagacggagcuugcagugagccaagaucaugccacuguacugcagccugggcaaaagagugagacucugucucaaaaacaacaacaacaaaaacacccaaaaaaacaaguuucagacugggagaagauauuugcaacauguuaacuauugagagauuauaagaaaaacaaggccaggugcaguggcuucugccuguaauuccaacacucugggaggccaaagcaaaggcuggcuugagggcagaauuugaaaccagccugggcaacauaaugagagccugucucuacaaaaguagaaaauuagccaggcgugguggugcacaccuguagauuuagcuacuugaaaggcugaggugggaggaucgcucgagcccaggaggucaaagcugcugugagcuaugaucaugccacugcacuccagccuggguaacagaguuaaacccugucucaaaaaaaaagaaaagaaaagaaaagaaaaacagaaagccaaauagaaacaugggcaagggcuauaaacaaauaaugcauggaagaagaaacuugauuggcuaauaaacgucugagauguuaaacugugcaauaggaaaaugaaaauuauguauauauauauuugauaaaaaugaaaaggcugacaauuccaagcacugauaagaauguggagcacaaggaaaucucauacauugcuagaaauagauuuguccauccacuuuggagaaucuuuaguaaagugaaacguguauaucuuuugacccagcaguuccucuccuagguucauauucuacagaaaugcuuagagauaaacacaagguguuguguucaagaauuuuuauagcagcauuguuuggaauugcaaaugaauuggaaauaauccagauguucaucaacaggcacaugggacaaauguuuugguauauuuauacaauagaauaccuuauagcaaugaaaauaaaguuuguuuacauauaucaaaaggauuaauuucuguaaagcaauauugaauuaaaacaaguugcagaaugauaaacagauaugcaaccagaaaaauucuaaguguauaacauguaaaaaugucauaaaggaaaugcuugaaaauguuagaggauugcaaugaggguauauuuguggugucuaauuuuuugagguagguggcaaguacagaguauuuguuacaucauucucuauauuuuucugaaugucugaauauuuauauaaacaccuagucaauagauagaauccauuugcaugauugaauauucaaggcagugaagagauuauugauagaguaagguuccugagguggggagcaggaugagauccaaagugagguaaagggguugucuuuaaaaagacuguaaaggagcuaugauuuugguagacguaucaaagaauugguugacaauuggagagauuauuuucauaaauguuuguuuuucuuggcuuacuaacaaccugaaaagacggugauguauguuuaugaauaugcaugagaaaaugugaaaauagcacguuugcagucuggugaaaauguaagccaauauuuuagacuuaucuauaagacuuccuacuaggcuuauuuacuuacuaucuaggggaggcagcaagaugauuuuaaaaugauauuucgauauguuuuauugugucauguacaguaaaguggguuuucuucuuugaaaaucauuuaggaacuuucuaaacuucaacucuuuuuuuuuuuuuugccuuagugucuuuguguugaguaaucauuuuugugacucugcuucauuuccuugcucuaaguugagacauuuuuucccccguagcuguuuucuucugaguaugaaagaugacagcauugaaggcauuuaugacacucuaaagcaaugugcauugauuucuaagucugcuggaggaauugguguugcugugaguuguauucgggcuacuggcagcuacauugcugggguagguuucugccauuugacuuuuaaagggggauucaagucuaaaagcaaacagauucaugguugagagggcauaugcuauuuuuugggaguccugggucucuguuaaauuacuaaauggcuaugugacuuggagugagucauuuuacuucuggcuucauuuucaucuaugauauuagauauuuagauuugacuagauaaucucuagaauccuuuuuagcucagguuuuagaauucuggcuuauuuuagcaguaauaagagcaguuaucauugauugauugcuuacuguauguuaaguuuguuauaaauguuuuacaugagguacucauuugacccuuacuacaacgcuaugagguaacuaugauuauagacucaugccaggaauuuuauuccuuaaaauaaccuugugaauaaagguaccauugucuaauuuuacaagugaggaaauugagacuuagaaaguuguuacuuucugagaucaaucacuuaauaugugguagagccaggauucaagauuuaugcauugacacuuuaugauguaaacuuuagcccuuuguuaguuuacuguucaaugggagucaagauaauaguuuuggauuuaaauccuagcuccacuacuuaacuaguaauguggccuagaguuaguuauuuugugucugaguuuguuuccuuuucuguaaggugaagaaaauaucuaacucuguagaauaaaguuccagaaggaaauuauuccauuauguuguguuuuggaggugcugugauauauacagcacuuuacacagugguagagugagcuauugcucacuuaucuuucuagacuguuuaaaggcuuguguugggaucagaaggguuaaagaauuugaugaaguaucuucuagucguaggagucucuauuuucuuaacaucauucuagaguccacuuauugcugagaaucuccuuuuaccuuauuuauugcccugauauagcuaucgcauauaauucuuauuguaaauugccuugauuucuuuugggaaaaaggcauuguaguaguguuuauauucuuuuuuacucuacccaaaguguaucuuuauauaacgaccuuuagaagauguagaguuuaaauuuagcuaccuugauuuuggaucccuuuggccuguaauuguuacaucucauuauaaauuagaaaugccaugagguaacuuaguacauaauuguaauuuauucaacauuuuguugauuuuauuugggcauuuuuccaaagcagaaguagagauggagagcagguaaaacuucauagauugcuaccuagaaauuaggcaucuuuuuugauaaaagaauggggccauuuuuuucuuuucuuugcugagugcccucugucauuucuaucauggucucucuuuuagacuaauggcaauuccaauggccuuguaccgaugcugagaguauauaacaacacagcucgauauguggaucaaggugggaacaagguaugcuccaugaauugaaaguacuggaaaucagaacuaaaggugauuuagucauauacacuuaagaugguucauuuauguguaguuucuaauuaccuuuuuuuuacuuguaaaaucaauuugaggagguauaauuauuuuaauaugcauauacuuuaaauguacaguuugauggguuuugacaaauguauacacuuguguaaucaccacauugauaaagagguagaacauuuccauuaccccaaaaucuuuucucccucauauaccuuuacauucagucaccccugucaccccuacccacacauacuuuaucccuggcucuagacagccacugaucuauucagcuuucuuacaugauaguucguuugcaaagaauuucucaaguuguaauucauauaaauuuguuacuugaaaugggguuguaacaugugcucuagguuuuucuuucguuuuuuuuuuuaucucucucuuaucacccaggcuggagugcaauggugcgaucuuggcucaccguagccuugaccuccuggacuuaagugauucuucugccucagcccucccauguagcucagacuauaggccugugccaccacacccagcuaauuuuuauauuuuuuguagaggcgggggucucacuuucuugccuaggcugaucucaaacuccuaggcucaagcaaucuaccugccuuggccucccaaaguguugggauuauggguguuagccacugcaccucgccuagguuguucuuaaaacaaaaacaaaaacuaccuggaauaacaaaacucucccuaauuggcuggaugcaguggcuccugccaguaaucccagcacuuugggaggcugaggugggcugaucguguaagcucacaaguucaagaccacgaguucaagcucacgaguucaacaugacgcaaccccaucuccacaaaaaauacaaaaauuaaccgggugugguggcgaacgccuguaguuucagcuucucuggaggcugaggugggaggauggcuugagcccgguaggcaggagguugcagugagccgagauuauaccacugcacuccagccugggcgguagagcuagaacuugucucaaacaaaacagaacaaacaaacaaaaacucucccuaauugauagaagaaacaguaaaguugagagaauuggguuguuuaccuuauuuuaucaacaggaugguuuacaacuagagucugccuuuugugacuguaggcacacuaaucgcuuguugguuuaugaauuucucucugauggacuuuggggaccuugauaagacagaucaacuuuuugaccuacaauaagagcauggcuuauacugucaaagcaacuuccuuugggcuuuauguacaugucaugugguguaaagagagcugggcuguugcugaagaggaggcuccaucuguaguucaucaugucacuuuagaaaaguuaaucuuguuucacauuuuguuuauaucauucguucguuuuuacucauagaauuguaaaauauuacuuuuacaauuauauauggaaaacuuacacuuuuauaauacuuuuauuuauguuauuuaauucauuguagugaaaaucaaaggagauacuauaaaagugcuuugggagacaugauguuucuuuguuucauuuuuauucugaagagaauuaugauuuauuuaccacuagcguccuggggcauuugcuauuuaccuggagccuuggcauuuagacaucuuugaauuccuugauuuaaagaagaacacaggaaaggaagagcagcgugccagagaucuuuucuuugcucuuuggauuccggaucucuucaugaaacgaguggagacuaaucaggugagagauagguacuuguugguaauagcaacuugauucacaugagcuuucucuuuuuuagucaucuuaagucaugcuuaggaagagcccauaugugugugaugccacagaaggcauucugaacaaguuaagagaugccgugcuugucuucuuauauuucuauucucuaaaguagaugcuuugugaccuaaaugcuuaaaaggucauguauaaacaggcagaccuagauguuugggccugaaccugaaaaugauuauuucuacagcaaauuuccaagagagcuuguaaaagucaccuuaugcuugcaguguuucuaauggauuaugguuggcuauuugaaguuucuuaugagugauuuuguccuuuccuuuuuaggacuggucuuugauguguccaaaugaguguccuggucuggaugagguuuggggagaggaauuugagaaacuauaugcaagguaugggaaaaauaugaaagaaaacaauaauguuuuaaucaugguuucucuuauuucagggguccaaauaucaaaaguacuugucaagaaucuuuugaagcaucuaagagaaaaagugacuaauaauuuuggucagauuugcuuccugacucuucaccaaaauugaguugugucuucuucuuucuuaaaacuuuggaauguauaaauagguucuugggauuuuuaauugauccuuuuaaaauuuaagaugacuaguaggguuauuauuuugcucugucauauaguacuuuugauaagcuaugcuuuauguugcauaaaggaaucaugagugacuaggacacauaugucaguaguuuauuaaaauuaaauaggucaggugcaguggcucacaucuguagucucagcacuuugggaagaugaggcagguggaucauuugaggucaggaguucaagaccagccuggccaacauggugaaacccugucucuaguaaaaauacaaaaauuagcugggcgugguggugcacaccuguagucccagcuacuugggaggcugagguaggagaauugcuugaaccugggagguggagguugcagugagcugagauugugccacugcacuccagccugggugauagaacgaaacuccgucucaaaaaaaaaaaaaggaaaaaaauuuagcacagucuuaagagauuuggcuuccuuaguuuuuacuccuuuuuauuaugaaagauauuauugguuuagugggauugcgaucaucugaaggcaccuaaaacugccucauuuuccccuauggcuuuagcuagaguaaaauaaauaucauauuccuuuuuuucuuuagcaaaacuuagagaaaauuuaagaguuuucauaacuuuauauuuuaaugucuucaaguugucuacaauaaaguuuuuuuagggaauauauauuaaauaauauuaucugugccuuucaguuaugagaaacaaggucguguccgcaaaguuguaaaagcucagcagcuuugguaugccaucauugagucucagacggaaacaggcaccccguauaugcucuacaaagauuccuguaaucgaaagagcaaccagcagaaccugggaaccaucaaaugcagcaaccugugcacagaaauaguggaguacaccagcaaagaugagguagguagaaaaaauucuuccuagaguacuaagaagagaaccuuaggcaguuauuauuugugaauuccucacuugauuucacuugagauaagugaagggaguuugcauaguuguaagcagaagaacacuguuaaaggcagagagcaaaggaaggaaaggguaugaucugugccuauaaauguuuuuuagucuaagccgugugggaaagacacaguuuuuucuuauacacacaucacuguaauaacauuuacucaagaaaaauagaaauauacaguuauguuaguuuaggacacacacaaaaauguguuaggauguacauucaauuuaaacuauguaagccuugagccuggaaaguggaggcugcagugggcugagauugugccacuguacuccauccugggcgacaaagugagacccugucucaaaacaaacaaacaaaaaaccaaaaacaacaacaacaaaaguauguaagcuuauaaagagaguccuuucagugaauggugagaucaaauucuaaucucaagucuguaaagagacuucacagaagaaucaaggcuagaaaugggacauggauuugguguuuuaaaaaaaaguuugagagaggagcuuuccauuuggaaagaguggucuguaugauacaccagagacagggcuggguuuuaugcaguguggcaaguaagucuguuuugauggugcaaguagauuaauuauuggaauauggagagauggcuauggcugggggaagggagauagaagguagaagcugacacgucacggauagguagcccuuguagguuucugagaggaaaauagcaucaaaauguuaagaugaaaaggaagguucuugcuucugguuacagagugucuugcugugagaagggauuagagguuagccuagggagauuguuguacuaguuggaugacaggcugcuuugaucuuggauguaaacuauggaaacgaggaaggaguagauccucaauucuaggaccuuaaaaaaaaagacaaaugaaaagucaggaaguaaauggaaagugaguuaaauauacugcuaagguuacaguuuaauucaaaauuuauugugcaguagcuauauguaaaacacaauguuaagugcucugagaauauaaauaaauaugcugcccucuggaaacuucuaauuuaguuggaagacaucgacauauauugagguaacuauuaugcaagacagauuauauuauagaggcuagagugacauuuuuaaaauaaaaaucagauaaugucauuugucugcacaaaacuacucuuuggcuugcuaacccaugcagaauuccuuuuuuuucggggggcgucaagauuucacucuguugcccaagcugggcuguggcucacugcaaccucaacagaguucuuucuuuuugcaaauugagcuauaauucacucuuuuuaaaauguacaauucaguguuuuuuuucuuuucuuuucuuuucuuuuuuuuaguauaucugcaagucugugcaaccauuaccacuaucuaauuguaguauuuauuuauuuuauuuuuuuuuuuuugagacagagucuugcucugucaccaggcuggaguguaguggcucgaucucggcucacugcaaccuccgccuccuggauucaagcgauucuccugccucagccucccgaguagcugggacuacaggcgcgugccaccacacccagcuaauuuuuguauuuuuaguagggacgagguuucacuauguuggccaggauggucucaaucucuugaccucgugauccgcccaccucagccucccaaaguguugggauuacaggcgugagccaccgugaccggccuguaguacauuuuuaucacuguagauaaugaaacccuuuauccauuagcagucacucccuguucccuucuucccucagcccuugacaaccacuaauauauuuucugucucuagauuuguggacauuguggacauuccauaggaauggagucauauaauauguggccuuuugugucaggcuucuuucacuuaacauguucuuuuauucauguuguagcauguaucaguacuucauuccuuuccauccagaguucuuacagugcccuacaagguccuacacaacuggauaacccaccucaucugcgguuacuuuccccuuuguucacuuugcuccaacccuauuaauuuucuugcuuuuucucaaacaugucaaccaugcuccuaccucaggauuuuugcuccuucuucccucuugaauguuaaaaugcacccccucuucccauagccacaugauuugcuuucuaaccuguucaguucuuuguucauauguaacauuuucaaugagguccuucuugacaauucuguuuaaaaauuauacccccuucaucuuuauccccaguacucucugucuucuuuuccugccuauuuuucuuccuggcauuuauuagacuucugugauucaagcuauauuuaaaaaaauggguauuuggcaacauguguagaauggaguagaugugaagggcaucaagaguucaacugggaaacuuucaguaguccaugugagagaaguuaagacuuuggcuugggauagucauaaucaaaauggaaaagaaaguguauucauucaacauuaucaagacuuacugugugccagauguguugcuagugcuaaacauauaaauauaaauaagaugauccuugugugaagaagcucacugccucguguaguggagaaaucacuggaagagcuuuuucagaaaucacaaauugagauccauuguugcuaagggcuugucagaauaucagugaaggugagguggacguguguguuuugaagaacucugcagugauggaaauguucuguaucugauggcuauugagcacuugaaauaugacuagugcaacugagaaacucaaauuuuauuucauuuuaaauagauauauguagccaguggcuaccauauugcagggcacucaucuacugaauaaugagauagguauauguaaaaagcuaauuauaacauagugugauauaugucugguaauagagcuguguacuguggaacauaggguucucucucucucuuaccuauuuugcugaugcauguuauaacuaacacauaugacuagguauugaagaaauagaaucagugggauuuagaaauggacugaugaaugaugaagagggagaagucaaauauaaaaauuuaaaauuuuaaugucugaguauuagaggcucacauggugguguaauugacacaggaaguagaaauaaaaauugugugauucuugaccuguuuuuugcauuccagguugcuguuuguaauuuggcuucccuggcccugaauauguaugucacaucagaacacacauacgacuuuaagaaguuggcugaagucacuaaagucguuguccgaaacuugaauaaaauuauugauauaaacuacuauccuguaccagagguaugaauagauuucucugcuuauugguaauuauugaaauccaaauugaaaggaaucaaucaugaucuucaagucaucauuuaaaugguuaucaauaaaaugguuugagaaaaagagguagucugucucauuugguacagaauguugcuuuuccuguucaguaauguuuucuccuuuucuuuaaaaucuguugacacaaaggcaugccuaucaaauaaacgccaucgccccauuggaauugggguacaaggucuggcagaugcuuuuauccugaugagauacccuuuugagagugcagaagcccaguuacugaauaagcagaucuuugaaacuauuuauuauggugcucuggaagccagcugugaccuugccaaggagcagggcccauacgaaaccuaugagggcucuccaguuagcaaaggaguaaguauauggauggaauuguuuuugccugugaguaccuguagugggcugaauggugaccccacaaaaggauauguccacauccuaauuccuggaaccugugaauuuaauuucauuugguucaaaaaaagguauuuugcagauguaauuaagaaccuugagauaaggagauuuaccuggauuauccaggugagcccuaaaucuaaugacaguuguccugcaagaggcacagaaggggaagcaacgugacuauggaggcagaaauuggaguguuacaaccacaagccuuggaaugcugauaaccacuagaaguuauaagaggcaaggaacagaaucucuucuagugccucuggagggaguguggcccucccaacauguugauuuugggcuucuggucuucagaacuaugagagaauaaauuuuuguuaaguuaccaaguuuuuaguaauuuguugcaccagccauaggaaacuuaaauaccuuuguccucuggaguaaaaaggauacucuguuuuaaucucuuauuuagaacuagucauugcuaaaauaauguaagagggaugcugccaauguuaguuuucuguggguuaaaacauggcauucguuaucucacaguuuccacaggucaggaguccagacuuagcuuagcugggccuucuuuucugggucuguguucaagauguugguaagggcugugaucucgucugagacacagaguucucuuccaagcuuaccugguuguuggcagaauauauuucaaggacucauggcaucuugcuucuuuaaggccagugggagagaccaucucucguuucaaaaggggcacagucuagucucuuuugaggguuuucaccugauaaguuagguccacauaggauaauguccucaccaccccccugucccgcuuuuuuuuuuuuuuuuuugagacagagucucacuuuguuacccaggcuggaguguguggugugaucuuagaucacugcaaccucugcuucucagguugaagcaguucugcugccucaagucucccgaguuaguagagaugggguuuugccauguuggccaggcuggucuugaacuugugaccucaagugauccgccugccuuggccucccaaagugcugggauuacaggcaugaaucacugcaccuggcguaaucuuccuuuuauuuaacucagaaucggcugauuugcaaccuuaauuacaucugcagaaaccuuucaccuuugccauaaucgcuggagugacaugcauccuauucucaagucauguccauacucaaguggagauuauaaauagccugugcaccaaggugugggaaucugggaagcugucuuagaauucugccuuucccacugccuuuauuaucaguacuaugauucuuuacuauauaaaauguuaauuucauuucugacauuccugcugauauuagaaaaucuaaugugugguuauuagaaaauagguguuuuuagcuaaguaaacagaucaagggacagaugaaggcacugaagaaaguaacauuuuuaguguuaaaaaaagagaaugugucagccacacccuuuuaugaauguuagaguuuucugguuuguagauaugacaugggauaaucaguuuucuuagccugcuucugaucaauaugacuacauggaauuuuguccaggaaaaucucuggagcuuguauuccucauagagguugauuagaagacagcauuuguugggauguggggacauggcagcuagucauuuguggguuuuuuuuuuuuuuggucauaguuuuaacuugcuguagaauaaauuugaguuguguauuccuuagauucuucaguaugauauguggaauguuacuccuacagaccuaugggacuggaagguucucaaggagaagauugcaaaguaagugaaaagauguaaaguagcuuugaaggcagaaggguuuagguucaccuucuggaucuucagaaguuagauaugucauuuuaacuucuuaaacucauuuauuacaaauggggcuaaaauggccuaucucacaaaacuauuuugggaaaaaacuucguaagauaauauauauaguaaccuggaaguugcuuggcacaaugaaagcauuucaguaccugguaggaauuacuauuauuaguugaucuuauuuuagggacuuaacacaccuagauuagguaauuuucuuucucauuaaggcuuuuuuccaacuaugauuuuuuuuuuuaaauguuuuucauucuuauuuauuucccaauuuaguuacaucgggcauauaaauggcuuuuguuugaauugauugucauaggaauaauggauuuuggaagaguuuuuggaggguaauguguuuagacuauaugaaaaaaaaauuuuuaaauugaguuuuuguaggccuuucaaacuaauaagcauaagggauucgaaggcagacagaauguuuugcagagugaauaacaaagcaaauuguuuuuguuuucuaucgugaugacuuugucauuuauggguuaaugcauaugcaaagugauuaauauuuggagaaugaagcaguagcuuuaaaaugcucuuuaaaaaaaauaaccguuugccuuaaaauuguuaaauuaaaauuguuuuccuacucaaauaauacauguuagaaaauuuaggaaaacauagauuuggaaagagaaaaugaaaauuauacuaauacugccucccccagaaaaccugugugcaucuuagugucugucauccuuuagguuuucuuccaagaguacacauacauguguauuuacauggaaauucaacuuuuaagaaaauggaccuguacuguauuuauauauauauauauauauauuuuuuuuuuuuuuuuuuccccucaaaauacuauggcuuaguuuuuuauauacaugacuuuuuuucuaauuucaaaauuaguauaugaacacaaauuuauuauuaauaaagcucaaauacagaaauaaaauagaaaguaaaagcccuucuucauacuucugccaaccauuugucucagaaaacaaaccaaaaaaguaacuuauucuuuuucccagagauaagacuuguuaaugguguguauuuuucuagaucuuuuucaguacauuugcagauagguacacauacacgguuuugucauauaaaugugaucaaacuugauguauucugggcugggcaccaugacucacgucuguaaucccagcacuuugagaggcugagguggguggaucacuugaggucaggaguucaagaccagcuugggcaacauggcgaaacuuagucucuacuaaaaauacaaaaauuagcugggcgugguggugcaugccuguaaucccagcuacuugggaggcugagacaugagaaucacuugaaccuaggagguggagauuacagggagccgagaucaugccacuguacuccagccuagguaacugugacucugucucaaaaaaaagacuugauguauucugagacuuguuauuuagugauuuauuuuggagcucuuucucuuuuaguaccuguaggucuaccuaauguuuuuaauuauuauagacaauuccauaguuugaauauaucauauauguaggacuuuucacaacauuuaccugucuguagacagaugauguugcuauuuuacagaugaggaaguaaagacaugaagauaguuggugguuugcuugauaccucacuacaaagugacagaguaagguggagaaccaccccccaaaaaaaguaaauaaaaaaauaauaauaacuaaaaaguagagaacccaguuguauuagucgauucucacacaguuauaaagaacugccugagacuggguaauuuaaaaaggaaagagguuuaauugacucacaguuccgcaggguuggggaggccucaggaaacuuacaaucauagcagaaggggaggcaaacagguccuucuuuaauacggcggcaagcaaagugcugaguaaagggagaaaagccccuuauaaaaccagaucuugugagaacucacuaucucaugagaacagcaugaggguaaccuccucugugauuaaauuaccucccgccaggucccucccguaacguggggauuaugggaacuacaguucaagaugagauuuggguggggacacagccaaacuauauccaguuguacagacuccgucaggauaugaggcuguaugcuaagcacuguaugaauccauagguauagaauguaggaaagacaggcucuuuguguuuuaaaaacuugagacuaagaaaacaaguaguuaagguauacggaaagguacaggucagagaaaauguuugcagaguagauauuuguauuugacauuuguauuugugccugccugaugaggaaagauguuuuaaaauugcuaucaauuaggcugagcuuugaaggugagccaggggcaguugggagauuucucagugugucagauaguguauuuucucuuauuagucaaaagauguuaaccuucuugcaggaacuuauaauugaagaauauacuuugagcauaauuucuuccucuuuacaggauaauggagaauuguggugauauuucucugauucugaacacuuucucaucauuauuuuuccagaaggggccuagcacaaugauuuuauaggcacuuggaaaagagugaggguuggaugaguguaaccuaauacagguggggagcgcuucaacagugauuugaauauuucccuacgcaagauaguguaucaaguguuaugauuccugagugccacaguccaaguggcauaaaucaugguaugauaaggauagccaacaauaaaaauuguacuaauucaguuuaggagucaggcauuuaagaggagagugggcuauaauagcacccauacuguggaauugccucccuguaggaguuuaauuugaaagucaacgugugaguucaaugcauguacgauguuacauuuacauuuacuacauuuaucuacauuuacuacagugacuuaaaguagcugcuuuccuggcagauuguagcuuugggacuaguaccugauaaucuccuuuucuuuagguaugguauaagaaacaguuuacuuauugccccgaugccuacagcuuccacugcucagauccuggggaauaaugaguccauugaaccuuacaccagcaacaucuauacucgcagagucuugucaggagaauuucaggugagcaguucacaaccagccuuacagggagaucuuucaaaagccugauguugggaguaaaugcucacucauguuuaauuugcccauuuucuuaguuugggugcaaacuuugauaaagacagucaucuucaucucuaauauuauuauuuguuauuaauauuucagcacaauaggcauuuaauaaauaaucuguugaaagaaugagugaaugagggucgaguaugaaaguaaguuguugauaguuaaacaugauguuuaaccauuauguaaucauagugauauauucuauaacuucucccagaugcuuaaguuaggauacucaaaauguauaaagaaguaucauuuaaggcagugguucucagacuugguuaccaauuagaauuuauggugggugagaccagugguuuuuucuuuguuuuuaagguucccagguaauucuuauguguagcuaggguugagaaccucaauuuaaaagacuauuugugaauuuccagauaucuugaaguaaaguucuguaaaguucgagaaggauacguuuccaauuuuuuuaaccuaaguauuuauagauuuacccaucuuaggcgcuauucuuuucacuuuugcaaacgccauauguuucuuuuuuaaugaaaauauuuuuucagcuuuauuaagguauaauugacaauaaaaauuguguauaaaaccaagguauacaguguaaugauuagauauguguauauauuauauaacgauuaccacaccacaauguuuuuguugucgauacuguuuuugagaaaaugucucacuuugucacccaggcuggagugcaguggcaugaucuuggcucacugcagccucugccuccuggguucaagcaauucucaugccucagccuccugaguagcugggauuacaggcaugcugcgccaccaugccuggcuaauuauauuguuucuugaauaacagaugucaagaucuuaaaggaauauagcuuucgugugguggcauugaugucucgucuuuauaaaagauagaauuuaccaagcaaucuagcauuaaauaacucuuaagugauuuuaguuuaagcuucaaagcuguagucuuuucuaagcagucacuguuauuuauuucuucauacauuuucugcuuuuccauucagauuguaaauccucacuuauugaaagaucuuaccgagcggggccuauggcaugaagagaugaaaaaccagauuauugcaugcaauggcucuauucagguauagaaugaaaaugaagugugcucugcaggggcugaguuggacauugugguaccuccucacucaugcuagacaauggagagaaugacuucauuguguucaucuagguuuugcuuguguagcucuguucaccucugcauuguugugcuaggauuguacacaucuuuacauaacccuuaccaucuuguuuuuaugcaauaauauaaaaaaguaguucucaauuuuucugcaucuuagaaucaacuggggagcuuuuaaaauccugaagcuuagguugcauuccuuaccaauuaaaugucuaggaacaggaaccagacaucaauuuuuuuuuuuuuuuuuuuuuuuugagacgaagucucugucgcccaggcuggagugcagugguggaaucauggcucacugcaaccucugccuccuagguucaagcgauucuccugccucagccucccaaguagcugggauuacaggugccugccaccacgcccggcuguuuuuuguauuuuuaguagagacaggguuucaccauauuggccaggcuccugaccucaggugauccgccugccuuggccucccagggugcuaggauuacaugcaugagccaccgugccuggccucagacaucaauaauuuuuaaagauucuuuuggugauuccaaaguauaucaaaauuugggggaucauagauagaaagacugaaauuaagagagucaagcuuaauuaaaaaucaugguugacgacugauaguccaaaagacagagucacaaaucguguaaauauuugcaacuaagagucaagaggcauuuauuugcagauagaggugucuggcuaaauguuggucugcuuagcaacacagaugaagaguccuauaacaguuccauauuuaaugacagaaacuguagcauuagccagucuguguguuuuaaugaaaguuaacccuaggccuaagaaaaccugauuuuggauuccaaagggaguuugaaauccuagcuuauuuaaaggguuuuaucucauugcuucccuuggucccugugaauuacagcccuuauuuuuuguguuuucugcaaaacucaagggucauuuauugcugcuuagcucugacuuuuccuuucuuuaagugccucuagaagaaugaauguuugggucauaaaucaauuaaaaaauuaaaaaauugguuuaugaccaacaaaaaagggaugcugaaauuacuaucaccagauugauauuugguugguuagauggggguuuuguucaacuuucuaaauagucuugguaaacuugauaaggaucauaucauaugauacugaaugguaaggucagaucuggcaggaaguaaaaugaagaucaaagcuugugucacuauucuauuaaucauacacugcuuucuuuaacuggaguaaaguaaacauuggguuuuccuucuuuagagcauaccagaaauuccugaugaccugaagcaacuuuauaaaacugugugggaaaucucucagaaaacuguucucaagauggcagcugagagaggugcuuucauugaucaaagccaaucuuugaacauccacauugcugagccuaacuauggcaaacucacuaguaugcacuucuacggcuggaagcagguugguagagaauaucaaggaguacuuaauugccagcuugagauauuuuggcauuggaaugauuuuauguuuuagccaccuauuaaauauuaucaccuagaaguucuuuaaguucaaauccagaacguuaaaaccaacccaugguuuuuguaccagaacagggucuugccuuggauuuucuuguuucuguuagguuuauuuccuucuuagguuugaaaccuuguaguuaccugugaugcuuuccuuccuuuacuguccguacaauuaccaaguuguguugauuguuccuuuguauuauuucuuaaauaucuuccuuccuuuucugcugcuguuauucuaaacugaccuuauugcuucuaggaucucugcucccagccauuuugugugcauuaccaccauuccucagauaaaacuuugcacacgucaacccgcuauucaaaaacauccauuguuuucucacuuuauaaagugaaagccagcuuacuuagcuagucguugccagcuguaaagucuggugauuuuggauuauguucuuauucccugauaauguauuggguauuuaaguagaauuauaaauuuguuuuuuaauuuaacauuuauugaacaucuaguaugugccaggacugaggauacugaauagaagaugaugaucuuuaucuuugaagucuuauagucuguuguuacacagagacacagucuagcucucuaaacaguuauaaccuaaggcagacauauugucuugggcaaaccuggaagucauaugcauaaaaacaaagacaaaagaauaaaaauguuugaccuuuccaaagagauaagccuguuuuaggagugaaaagaacaggauauuucugucugacucacaaagcauuuuugagaguacuccuagaggagauagaauuccaaguuuaaaaaaaguuugaucugguucaugggaauguauuuuauuuuauguauguauguauguauuuugagacagagacucacucuguugccccggcuggaguacagcggcaugaucuuggcucacugcaaccucuguccuggguucaagugauucucaugucuuagccuccugaguagcuaggaucacaggugugugccaacacaccuggcuaauuuuuguauuuuuauuagagaugggguuuugccauguuggccaggcuggucucaaacuccuggccucaagcaauucaccugccucggccucccaaagugcucgaauuacaggugugagccacugugccuggccaggaauguauuuuauuuuauuuuaauauuauuguuuuauuuuauuuuauacuuuuuuagacggagucucgcucuguugcccaggcuggagugcaaugauacagucuuggcucacugcaaccucagccuccugaguagcugaaauuuauaggcauguacuaccccucuugggggauuacaggcaugagccacagcgcccagccaggaauguauuuuuuuguuuguuuguuuguuuguuuuuucuuuuuauuuauuuauuuauuuauuuuuauugaucauucuuggguguuucucacagagggggauuuggcagggucauaggacaauaguagagggagggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacugaucaacaggcucacaaggcagaagaauuuuucuuaguacagaacaaaaugaaaagucucccgugucuacuucuuucuacacagacacggcaaccauccgauuucucaaucuuuuccccaccuuucccgcccuucuauuccacaaagccgccauugucaucuuggcccguucucaaugagcuguugggcacaccucccagacggggugguggccaggcagaggugcuccucacaucccagacggggcggcggggcagaggcgccccucaccucccagacggggcggcuggccaggcggggggcugaccccccaccucccucccggacggggcggcuggccgggcggggggcucacacccccaccucccucccggacggggcggcuggccgggccgggggcugaaccccccaccucccucccggacggggcggcuggccgggcagaggggcuccucacuucccaguaggggcggccgggcagaggggccccucaccucccggacggggcggcuggccgggcugggggcugacuccccccaccucccucccggacggggcggcuggccgggcggggggcugacccccccaccucccucccggacggggcggcuggccgggcagaggggcuccucacuucccaguaggggcggccgggcagaggcgccccucaccucccggacggggcggcuggccgggcugggggcugacuccccaaccucccucccggacggggcggcuggccgggcugggggcugacuccccaaccucccucccggacggggcggcuggccgggcggggggcucacacccccaccucccucccggauggggcagcuggccgggcggggggcugacccccccaccuccuucccagauggggcggcuggccgggcagaggaccuccucacuucccaguaggggcggccgggcagaggcgccccucaccucccggacgggguggcuggccgggcgggggcugacccccccaccucccuccuggacggggcggcuggacaggaauguauuuuaaauauugguguggaaugucuaguauucucacagaguuucuccuaauaauugucuuuacuuuccuuguaggguuugaagacugggauguauuauuuaaggacaagaccagcggcuaauccaauccaguucacucuaaauaaggagaagcuaaaagauaaagaaaagguaucaaaagaggaagaagagaaggagaggaacacagcagccauggugugcucuuuggagaauagagaugaaugucugauguguggauccugaggaaagacuuggaagagaccagcaugucuucaguagccaaacuacuucuugagcauagauagguauaguggguuugcuugaggugguaaggcuuugcuggacccuguugcaggcaaaaggaguaauugauuuaaaguacuguuaaugaugauaaugauuuuuuuuuuaaacucauauauugggauuuucaccaaaauaaugcuuuugaaaaaaagaaaaaaaaaacggauauauugagaaucaaaguagaaguuuuaggaaugcaaaauaagucaucuugcauacagggagugguuaaguaagguuucaucaccccuuuagcacugcuuuucugaagacuucaguuuuguuaaggagauuuaguuuuacugcuuugacuggugggucucuagaagcaaaacugagugauaacucaugagaaguacugauaggaccuuuaucuggauaugguccuauagguuauucugaaauaaagauaaacauuucuaagugauuguaugagauuaauuuugucauuuacuuucauauaaaagucaaauuugaaaaacacauuuucuguucuuugagaauucagggaggaaauuauaugccuuuuucuuuucuuuuccuuucuguaguaaaauauaccuaauauacaauuuaccauuuuacccauguuuaaacauaaaauucaguggcuuaagcacauucauaguguuauacuaccaucaccacuauuuguuuccagaacuucaucaucccaaacagaaacucuguaucaauaagaacauuaacucccccuuuccccuccaagucccugguaaccucuauucuacuuucugucucuaugaauaugccucuucuagguaccucguauaaauggaauacaugucuggcuuauuucauuuagcauaauguuuucacaguuuauccauguuauagcauguauccaaauuucauucuuuauguauaccacacuuuuuuuuuuuuuuuuuugagacagagucuugcucugucacccaggcuguacgaucuuggcuuggcucaccacaacgucuaccuccuggguucaagugauaagugauucuugugucucagcuuuccaaguagcugggacuauaggugcgcgccaccaugccuggcuaauuuuuguauuuuugguagagaccagauuucaccauguuggccaggcuggucucaaacuuguggccucaagggaucuguuugccucggccuccuaaagugcugggauuaaaugccugagccuccacaccuggacuaccacacuuuguuaauccacuuaucuuuugauggacauuuggguucuuuccuccuuuuaaggaauuuugacuaaugcucuugugaacauuggcuuaaaaguaucuauugaguuccugcuuucaauuuguuuggguauguauacaggggugaaguugcuggaaauuauggugauucuaucuuuaacuuuuugaggaacuaccaaacuuuuccacagcagcuacauuauuuuacauuuccaccagcaauacaauaggguaccauuuucuccacaucuucaucaacacuuauuuuucauauuuuuguuuuguuuuguuuuuugagagacggucuugcucuguugcccaggcuggagugcaaugguaccaucauagcucacugcagccuugaucuccugggcucaaacaauccucccaucucagccucucaaagucuugggguuacagguguaagccaccacacccagcucauauuuuuuauaauagccaucuuaaugacuugacaauuucauuauaaugugucuuggugugggucucugaguuuauccuacuugggacuuccugggcuuauuggauuuguagauucacaucuuuuguuaaauuuggguuguuuuuggccauuauuuagauaauuuuucuuccccuuucucuuuccuuauagggacuuccauagugcaucuauugguugacuugacgguguuccauaggucuguuaggcguuguuuacuuuucuuuauuuuuucuuucuauuccaagacuugauaauuucaguguccuaucuuccaguuuucugauucucucuucuuccugcucaaaucuauuguugugcuccucuagugaauuuuucauuucaguuauucuuuucaacuccagaauuuuuauucuucuuuguaauuuuuguc

SEQ ID NO: 15305 - RNA, 1012 nt, Homo sapiens
aaugggugaggauggaaauacaagcaccuucaacaucuccugcaccaaguucuuccugguggguuucccuggacuucgagagugguggccccuucugguccugccucuugucuuccucuuugugaccaucaucucugccaaugcccuggucauccacacagugguugcccggcaaaaucugcaucagccuacguguaugcucaucacugugcuccuggcugucaauauucgugcugccacagccgugaugccuaaaaugcuggagggcuuuguauauuaugcuaaccccauaucgcugcauggccgccuggccuagguguucuuuaucuacuucacccuccuccuggacuacaacuuccucuggccauggcccuggacugcuacguagccaucugccacccacucugcuauucugaccugaugaccucccagcugcugggacugcuggccauucuugccuugacacagagccugggagugacagugcccuugguaguacuaacugcaaaagcccgauucugccggacagcagugauucgacacuucaccugugagugcauugcacugcugagcauagcuuguggagaccugaccuucaacaacuggcuggggcuggcuauguguuuggucacuguaaucucugauauggcccugcuggggaccuccuacacccacaucaucuaugcugccuuccggaucucuucuuggggagcccaagccaaggccuuacacacguguggcucccaccuacuggucauccucuccaucuacgucucuggucuuuccacuuccaucaccuucugaguagccaagacugugucccagaauguccagaaucuacucagugccauauacuugcugcuuccaggagccuugaauccugucauuuauggggugaggacuagggagauccagcaacauguagaaaagaugcucugugaaaaggaaacagcccagaaggcuggggagaagccaaagaggcugcagaacaugagacuggaaaccgccaggg

SEQ ID NO: 15306 - RNA, 1030 nt, Homo sapiens
cuccccuaccccaaaucucagggucaugugucaggguccuucugcuauucuagaaagcaucaauccucuucugcuggaagugcuuuaggaggcucugacggaucugccuagacuugaugcaauacacaaugggguucaugaagggugggaccaagaaguguagguuggccaugagcacugccagagcaggguagucaugcuucuuuacucggugcaagacagacagcccguuugggcaaauaaaagaugagaacaaugcagaggugugagacacacguguugagugccuugagccgcuccccaggugaugcaaugcccagcacaguucauaggaucagggcauaugaaagcaugaugaggaaggagucaaggcacagugagaagaggauggaaaccaggccaaccaggcuauugaucugggugucugagcaggccaaccccacaaggucacagugcaggcaguagcagugacagagagcgcugaucuugggaaagagcagcugcugcaggaggauaggucccgggagguugagcagaacagcccucaccagaauggcaguucccaccucggcugugacugagcagguaaugauuauggcauaaugcagagggucccggauggcaauaaagcgaucgaaggccauggccagcaguacaccggacuccacauaggugaagguauggaugaagaacaucugugcugcacagagaucaaagggcagcucacgagcucccagccagaagagacgcaccauaguggggaagguagaggcacagaggcccagaucagaggcugccaacauggacaggaagauauacauggguucauguaaggcuggaucuguguggaucaggaagaggaugauauuauuacccaggauggaaaccacacagaagagguugauggggauggaaacccaaugaugagaggcuuccaggccuggaaaaccagugaggaggaagguagacugaccagaagugcugguguugcaggagaacauagagauuccaggcaguaguuguccacccu

SEQ ID NO: 15307 - RNA, 1084 nt, Homo sapiens
gauacuuuaaucaccaaggcauucaauaggauccuaauauucccaucuucuguaguaguaguagaagcgagacacuaaggugucucacuugccaccuugugagaacauacagaggacccuugaacagaucucuuuggucuuggcuccauagacaaggggguugacuacaggugguagcagcaaguagguauuagccauaaccacauggaggagggaggugggaccacccagccuaugcaccaccgagagcccaaugagggguacauagaagaccagaacagcacagaggugggagaugcagguguugaaagccuugagugcugcccuccgagaggacagcuccaaaacagcccacaggaugaggauauaugagaagccaaugaagagagaguccacacccaugacugagaggaugaugaagaguccauaaaccacauugacccuggugucaguacaggacagcuucauaauaucuuggugcagacagaaggagugugugacaguauguguuuggcaguaggacaaccacuugaggaugaagggcagugggaagaagaauacaaacccccuggucagggcagauaguccaaucuuggccacaguacacccugucagcacagaagcauggcgcaauggguggcaaauggccacaaagcggucaaaagccauggccagcaggacagcugacuccacggcugacagagcauggauaaggaacaucugggccaggcaaauguugaacucgaucuccuggaugcccaucaggaaaagacuggccaucuugggcauggugauagaggagaggacuaggucaauaguggaaagcauggccaggaagagguacaugggcucaugcagucgccucuccacacgaaugaugaggacaauggucagguuacccaggguggccaaggcauacauaaaacacagugggaaagccagccaaaaguguaugguaggccccaggccagggauacccaccaaaaggaaguaugcugcguggaccagauuuccauuugaaguggcuaugauagggaccaagagcuggggcuucugcauacaaaauccagggucuaggaaagua

SEQ ID NO: 15308 - RNA, 1072 nt, Homo sapiens
accagcuguuucaauaaacaacaguaacucacaguacugaaugaucaaacaugggucagggaagacuugguaaagaaggaguacacucaaacuucccuaaauuagcuuagaaagaaaugcuuugagcacagccuugcgaauuuacuuggucuuuacacuguagauuaugggauucauuacaggagggauaagcagauaaacauuggcaaugagcaugugcacaaggggaggggcaugcuuuccaaaucugugcacuggugacaaacugaucauggggauguagaagauggcaacugcacugaugugagagacacagguaccaaaagccuuuuucugcuccucuggggaggcaaugcagagcacagagcggacgaucagaacauaggagaugaggaucaagacagagucuaagccagcaguagagauaacaauggccaggccaaaugcacuguugauccaugugucugugcaugagagcuucaucgcaucaggguggaagcaguaggaaugguggagcacaugacuacggcagaaggagaggcgcuuaaggagcaggaguagaggcacuagagcuguuguuccccuaagaacaauugcaaagcccacuuuaauaauccgugaauugguuaagauuguggcauaucucaguggguuacagacggcaauaaagcggucaaaggccauugccaaaaguacugaggacuccaugaaugugaagccauggauaaagaacauuuggccaaugcaggcaucaaaacugauuucucgagcauugaaccagaaaauacccagcaugguggucaauguagaaagacacagaccuagguccaugaaggauagcauggagagaaaaugauacauggguucauggaggcuugacucagugaugaugacaaacaggaucaugccauucccagagauagcaaugacauagagacaacagaaugggauggagguccagaucugacggguuucaaggccagggaugccaguaaggaagaagacugcaggguggaaaauacucugguugaaggauggcaugaugagcgaagaagcagaugucuuugaggaa

SEQ ID NO: 15309 - RNA, 1033 nt, Homo sapiens
aauacuuuucaauggacucaucaugcaccuucccaauucuucugaaauugcgauuaccaccuucuuucugauuggaauaccagggcuggagcaugcccauauauggauaucuguccccaucugccucauguacuugguagccauccuaggcaauugcacaauccucuuuguuaucaggacugagcccucacuccaugcacccauguacuauuuccuuuccauguuggcugucucugaucugggccugucccucuccuaccuacccacuaugcugaggaucuuuguauucaaugccacaggaaucuccucaaaugcucgcuuugcucaagaauucuuuauucauggauucacagauauggaguccucagugcuucucgucaugucuuuugaccgguuuuggccauaugccacccucugagguacauaucugagguacuggugagcuguauccucaccagugccagaguugccaaaauggggcuguuguuucucauuaaaagagaaacaacacuaaacucauuaaaagaaacaacuaacucaugcuguuaguacucccauuuccuuucacucuuacaagguugacauauuguaggaaaagccuacucucucauuccuauugucuccaucaggaugucaggaagcuggccugcuccgacaacacugucaacuucuucuaugguuucuuucuugcccucuguaugaugucagaaaguguguucauuacugugucuuaugugcucauccugaagacgaucaugggaauuggaucccauagggagcggcucaaggcccucaacaccugugucucccauaucugugcugugcuuaucuucuaugcgcccgucauugcuuuggcauccaugcacugcuuuggcauccaugaacugcuuuggcaagcacagguccccacuggccaugauccucauugcugauguuuucuugcuagugccaccucuuaugaaucccauuguauauugugugaagacacagcaaauucaugaaaaaguuuuaggaaaacugggucuacaacaac

SEQ ID NO: 15310 - RNA, 942 nt, Homo sapiens
cuuaucucccacauacauuaagcaacuuccccaagaucuucucccagauuugucgagucuuuacacaguacacaaugggguucauaaggggcggcaccaacaagaacauaucugcaauaaggaucacaacaagagggcuuuugugcuuggcaaagugaugcauggcagccagggugaugaugggcacauagaaggugagcacagcacagaugugggagacacagguauuuagggccuuaagccucucugccaaagaugcaaugcugaguauagucuucaagaucagcacauaagacaaaacaaucagugccaaguccagcauaguacagagagcaaugaagaagccauagaugacauuggucuuguugucagagcaggccagcuucaugguauccugaugaagacaguaugagugagaaagaagauucuuuugacaauauuuuaaucuccuuaaggugaagggaaauggaaucacuaagagaaugcuccuaauggcuaaaauaagucccauuuuagcaacccuguugcuagugaggauagaacuguaucuuaagggauugugaauggcaagaaagcgguccaaagacauaauuagaaguacugaggauuccaugacagugaauccaugaaugaagaauucuugagcaaagcaggcauuaggugaaauucccauggcauugaacaagaagacccucaacaugguaggaagggaggagagggacaggcccaugucagagacagccaacauggcaaggaaauaauacaugggcucaugaagcgagggcucugucuuuauaauaaagagaauggugcaguugcccaugauggcaagcagguacaugaggcaaauggggauggagaaccaaaugugggcauguuccaguccugggaucccaaucagaaggaaaagcuugacuucggaguuauugagaacagacauaa

SEQ ID NO: 15311 - RNA, 962 nt, Homo sapiens
uauuaaccaguccauggugcuggcuucagggaacagcucuucucauccuguguccuucauccugcuuggaaucccaggccuggagaguuuccaguuguggauugccuuuccguucugugccacguaugcuguggcuguuguuggaaauaucacucuccuccauguaaucagaauugaccacacccugcaugagcccauguaccucuuucuggccaugcuggccaucacugaccugguccucuccuccuccacucaaccuaagauguuggccauauucugguuucaugcucaugagauucaguaccaugccugccucauccagguguucuucauccaugccuuuucuucuguggagucuggggugcucauggcuauggcccuggacugcuacguggcuaucugcuucccacuccgacacucuagcauccugaccccaucggucgugaucaaacuggggaccaucgugaugcugagagggcugcugugggugagccccuucugcuucauggugucuaggaugcccuucugccaacaccaagccauuccccagucauacugugagcacauggcugugcugaaguuggugugugcugauacaagcauaagucgugggaaugggcucuuuguggccuucucuguggcuggcuuugauaugauugucauugguaugucauacgugaugauuuugagagcugugcuucaguugcccucaggugaagcccgccucaaagcuuuuagcacacguuccucccauaucugugucaucuuggcucuuuauaucccagcccuuuuuucuuuccucaccuaccgcuuuggccaugaugugccccgaguuguacacauccuguuugcuaaucucuaucuacugauaccucccaugcucaaccccaucauuuauggaguuagaaccaaacagaucggggacaggguuauccaaggauguuguggaaacauccccugag

SEQ ID NO: 15312 - RNA, 956 nt, Homo sapiens
uucagcuuugcuucuggcacaguuuuucuaagacaagauuucuuaucugcuggcucuucacacaguauacaaugggguucaucaauggaggcaccagcagaaaagcaucagcuaugaggauccuagugauugggaaacuguguuuggcaaaccgguagaugacagcuagggagauaaugggcacauagaagaugagcacagcacagaugugggaaacacauguauugaggaccuugagccuuuucuuucaugaugcuaugcucaacacugcuuucaguaucaacauguaggacaugaaaauaaaugucaagucuaggaugccugugagagccacaaauaagccauagaugauguugaccuuguugucagugcaggccaguuucaugacaucuugauggaggcaguaggauugggacaggagguucuucuuacaauauuuuagauguuuuagagugaaaggaaaugggaggaucaacaaaacauuuuugagagaaaaagcaagcccaauuugaaugacucuggcacuggugaggauggaaguguaucucaggggguugcagauggcaauaaagcgaucaaaggacauuauaagaaguacagaugacuccauagcugagaauccauggaugaaaaacucuugagcaauacaggcaucaggggaaauuccuggagcauugaacaggaaaauccuuaacaugguagggagagaggagagggauagucccaggucagagagagccaacauggagagaaaauaguacaugggcucaugcaaagaaggcucuguuuuuaugaaaaacagaaugguacaauucccuaggauagcaacaguguacaugagacauauggggauagagauccaaauauuggcaugcuccaaaccugggaucccaaccaaguagaaaauagagauuuccauuucagagguauugagaauggacaucccaguauuugag

SEQ ID NO: 15313 - RNA, 1459 nt, Homo sapiens
gauuuggcuccuguggcaagacagcuugcucccagggagaagcuuccucugaguagcaggagaccugcugcggugggggcugggcuccagaauaugggaaauaccugcuacgugaacgcuuccuugcagugccugacauacacaccgccccuugccaacuacaugcugucccgggagcacucucaaacgugucaucgucacaagggcuguaugcucuguacgaugcaagcucacaucacacgggcccuccacaauccuggccacgucauccagcccucacaggcauuggcugcuggcuuccauagaggcaagcaggaagaugcccaugaauuucucauguucacuguggaugccaugaaaaaggcaugccuucccgggcacaagcagguggaucaucacucuaaggacaccacccucauccaccaaauauuuggaggcuacuggagaucucaaaucaagugucuccacugccacggcauuucagacacuuuugacccuuaccuggacaucgcccuggauauccaggcagcucagaguguccagcaagcuuuggaacaguuggugaagcccgaagaacucaauggagagaaugccuaucauugugguguuugucuccagagggcgccggccuccaagacguuaacuuuacacaccucugccaagguccucauccuuguauugaagagauucuccgaugucacaggcaacaagauugccaagaaugugcaauauccugagugccuugacaugcagccauacaugucucagacgaacacaggaccucucgucuauguccucuaugcugugcugguccacgcuggguggaguugucacaacggacauuacuucucuuaugucaaagcucaagaaggccagugguauaaaauggaugaugccgaggucaccgccucuagcaucacuucuguccugagucaacaggccuacguccucuuuuacauccagaagagugaaugggaaagacacagugagagugugucaagaggcagagaaccaagagcccuuggcgcagaagacacagacaggcgagcaacgcaaggagagcucaagagagaccaccccugccuccaggcccccgaguuggacgagcacuugguggaaagagccacucaggaaagcaccuuagaccacuggaaauuccuucaagagcaaaacaaaacgaagccugaguucaacgucagaaaagucgaagguacccugccucccgacguacuugugauucaucaaucaaaauacaagugugggaugaagaaccaucauccugaacagcaaagcucccugcuaaaacucucuucgacgaccccgacacaucaggaguccaugaacacuggcacacucgcuucccugcgagggagggccaggagauccaaagggaagaacaaacacagcaagagggcucugcuugugugccagugaucucaguggaaguaccgacccacac

SEQ ID NO: 15314 - RNA, 897 nt, Homo sapiens
gcgaauuucuuugauuuugauacuauagacaaugggguugaccacaggaggaaaaaagagguaagcauuggccgugacagucuggaaaaguggagguaaaugccguccaaagcggugcaucagggagaggcugaucaugggcacauaguacacaagcacagcacauaugugcgacacacauguguugagugccugccaccgcccugcuccagaagcuauuuccaguacuguaugaagaaucagcacauaagaaaccacaaugaacaauaaguccaguccaaaugugaagguaaugacaaauagagccaggaugcuauugggacgugugucuccacagggcaauuugaucagaucugaguggaggcaauaagagugugugaggguauuguggccacagaaaggcagacgccucaggagaaagagcagugggagcauaagcauuacacugcgcaaggcaauggcggcacccgucccagaaaugcaggcaauugucagaaugguuguguagcgcagugggcuguagauggccacaaagcgguccacugacauugccagaaggacaccugacuccauaagagugaaagagugcauagaaaacaucuggagcaggcaaccaccaaaacugacaucguuaaugccaaagaggaauaugcuuaacacagugggcaugguggaagcagagacaccaaguucaacaaaggccggcauggccagaaaauaguacauggguuggugcaaggaagagucaauucggaugaugugaagaaugaugccauuucccggaaagaugaugguguauaucaggcagaaggggauggauauccacauaauguucugccuccagucccgggaugccaacgagagugaauguuguaggugugaauguuauggaacguu

SEQ ID NO: 15315 - RNA, 974 nt, Homo sapiens
cuugaaugcauauuuuugagggaaaggaaauuuaacauuccccauuggaucugcuuguucuuuacacuguaaaugaugggguucaucaccgggggugccagcagguagauauuggccaugauaacauggaccaguggagaggcaugcuuggcaaagcgaugagucauagauacaccaaccaugggaauguagaggaccaggacagcuagaaugugggacaggcaguuauugagggcacggagucgcucagcccagguggcugugcccaagauauuuuucagaauaaguguauaggagaucacaaugagcagaggauccacgauaauaaugagcaaggcaagagcaaauccauaccagcuguugagccugaugucagcacagaccaggcggaucauauccugguggaggcaauaggagcgagagagaaggugggaguggcagaaaggcagucgcuugaguaagaaaagggagggaagaaccgccagaacacagcagcaaaugauggcuaacccaguucuaccaaugacuucauuggugaggauggaggcauaauggaggggacagcagauggccacauagcagucaacggacauagccaggaggacagaagacuccauaaaggagaauccaugaaggaagaaaaacugagcaaaacaggccucagagcugauucuacgaacguugaaccagagaagcugcaugacuguggguaggguggugagggugagacccagguccgucagggccagcauggagagaaacagauacaugcgcugguggacagauggcucugugcgaaugacagugaggauggugguauugcccaugauggagaugguguagagacagcagacggggauggagauccagaugugggaggccucaaauccagggauguccgugaggaugaaguagaugccuucuugugugguguuagucaccugggacaugacugaugaaugugucuucagauu

SEQ ID NO: 15316 - RNA, 973 nt, Homo sapiens
uugaaugcauauuuuugagggaaaggaaauuuaacauuccccauuggaucugcuuguucuuuacacuguaaaugaugggguucaucaccgggggugccagcagguagauauuggccaugauaacauggaccaguggagaggcaugcuuggcaaagcgaugagucauagauacaccaaccaugggaauguagaggaccaggacagcuagaaugugggacaggcaguuauugagggcacggagucgcucagcccagguggcugugcccaagauauuuuucagaauaaguguauaggagaucacaaugagcagaggauccacgauaauaaugagcaaggcaagagcaaauccauaccagcuguugagccugaugucagcacagaccaggcggaucauauccugguggaggcaauaggagcgagagagaaggugggaguggcagaaaggcagucgcuugaguaagaaaagggagggaagaaccgccagaacacagcagcaaaugauggcuaacccaguucuaccaaugacuucauuggugaggauggaggcauaauggaggggacagcagauggccacauagcagucaacggacauagccaggaggacagaagacuccauaaaggagaauccaugaaggaagaaaaacugagcaaaacaggccucagagcugauucuacgaacguugaaccagagaagcugcaugacuguggguaggguggugagggugagacccagguccgucagggccagcauggagagaaacagauacaugcgcugguggacagauggcucugugcgaaugacagugaggauggugguauugcccaugauggagaugguguagagacagcagacggggauggagauccagaugugggaggccucaaauccagggauguccgugaggaugaaguagaugccuucuugugugguguuagucaccugggacaugacugaugaaugugucuucagauu

SEQ ID NO: 15317 - RNA, 957 nt, Homo sapiens
cucguaccugccugguuuucaccccauacacaauaggguucauugugggaggcauuaguagguagagauuagccauaauaauauguauguguagaggaauggugugucccccaaaaugguguguaaagaagguaaagaaggcuggaacauaggugaggacuauggcacagaagugggcagugcaggugcugaaggccuucugucgagcaucugcugaugauagacucacaacugcuugaagaaucauaguguaggagauuguaaugcacaggauaucaaagcccccaaucagcagggcaacuaucaaaccauagauggcguuaacccugacauuaccacaagauaucuuggccacagacauguggucacaguaggugugggguaugacguugcccuugcaguauggaaggcgcuuggugaggaaaguggaagggauaacaagcaucacaccccuaagaaaagugaggaacccagcuuuagcaaugacugaauuagugaggaugguggcauaacgcagagggaagcagauggccacacagugguccagggccaugagcaugagcaccccagacuccaucccugugaaggugugcacaaagaacaucugggcgaggcaggcuuuaaaaucaaucuccuugagauuaaaccacaauaugaagagaguguugggaagggugcuggugcacaugagcacaucugugaaggaaagaagggcaaggaagacauacauaggucuguguaaggccucaucacaguagaugagguacauaaggccgaaguucccuguaauagcaaugcuguacaugguacacagugggaaggagauccacaaaugcacaucuuccaaaccagggaugccauuuaggaugaaugaagcuggaguuaggcuggugccauuuagaaaugacauaaugacuguuggaaguucauuguauagcaguuauagcauugccucug

SEQ ID NO: 15318 - RNA, 1181 nt, Homo sapiens
aggcaaggagauugauccugcaagagaaggggguucaucauggcggaugaccuaaagcgauucauguaucaaauguuacaaaguguugaagggcuccaugcuauuguugugucagaguuggaguaccuguuauuaaaguggccauugauaaugcuccagagcaugcuuugagaccugguuucuuaccuacuuuugcccuugcaacagaccacgggagcaaacuuggacuuucaaaaaauaaaaguaucaucuguuacuguuacaccuaccuggugauucaguuaaaucauuuaccuuugguggugaguuucauagccagcagcaaugccaauacagaacuaauugucagccuagaaaagaaacuuacuccauuauuugaagaauugagacaaguuguggaaguuucuuaaucagacagugguuucaauguguaccuuaucuuuauuauaacaacacaauaucgauccagcaaucuuuagaccauaauacuuuuauccauguccucaagaaagggccucuuuuuccaacuuauacugaagagcaagcauauagauaaaauuuauggacggauugauuguuauauuuucugguguagggucuuuucuuauuuagugagaucuggggauaccacaaaaauaguucagucugucacagcacccauggaguuaguccagccaccaaauauggaugagauucuauuccguggaucagaaucaaacugguacauugauccauuugagccauuaagugcucucuauuguacaaucugcccaggccugcagaaugaagcagauuuuuuauugcgaauaauaaugagauauuuuucuucagauuauguuuuauuucuucucauugagugugaggaacauaaaauggcuuaguaaaagcaauaaaaucaguacagucacuagcuuuccuuuguacuuauuacuuuaugauauagaugaauauuacugauugguuugauucuucucagagggugcugcucuuuaaugaaaauaaaaauuauagcuaaugguuuuuccucaaacucugcuuucuauaacuaaucaguguuuuaauguuuguguguucuuuauaaaauuuaaauguaauugguuacugaauucuguuuccaauauuaguauuauguaaacaugauaguauaaccauuuuuucaugugaguauacauaaaauagua

SEQ ID NO: 15319 - RNA, 950 nt, Homo sapiens
uaugacaacacaccgaaaugacacccucuccacugaagcuucagacuuccucuugaauuguuuugucagaucccccagcuggcagcacuggcugucccugccccucagccuccuuuuccucuuggccguaggggccaacaccacccuccugaugaccaucuggcuggaggccucucugcaccagccccuguacuaccugcucagccuccucucccugcuggacaucgugcucugccucacugucauccccaagguccugaccaucuucugguuugaccucaggcccaucagcuucccugccugcuuccuccagauguacaucaugaauuguuuccuagccauggagucuugcacauucauggucauggccuaugaucguuauguagccaucugccacccacugagauauccaucaaucaucacugaucacuuuguagucaaggcugccauguuuauuuugaccagaaaugugcuuaugacucugcccauccccauccuuucagcacaacuccguuauuguggaagaaaugucauugagaacugcaucugugccaauaugucuguuuccagacucuccugcgaugaugucaccaucaaucaccuuuaccaauuugcuggaggcuggacucugcuaggaucugaccucauccuuaucuuccucuccuacaccuucauucugcgagcugugcugagacucaaggcagagggugccguggcaaaggcccuaagcacauguggcucccacuucaugcucauccucuucuucagcaccauccuucugguuuuuguccucacacauguggcuaagaagaaagucuccccugaugugccagucuugcucaauguucuccaccaugucauuccugcagcccuuaaccccaucauuuacggggugagaacccaagaaauuaagcagggaaugcagagguuguugaagaaagggugcuaac

SEQ ID NO: 15320 - RNA, 1018 nt, Homo sapiens
aacaacucuaaagguggaucuaauccuuuuuauucuuacaaccucuucagcagguuuuggauucccugcuugaucuccuugguucucacaccauaaacaaugggguucagagcugggggaaugagguggugcaggauguugagcaggauggggacaucuggaggaauucucuuccuggccagguuagugaugaccagaaccagcaggacugugcugaagaagaggaugaggaugaagugggaaccacacgugcucaaggccuuggccacagcacccucggccuugauccuaagcacaacuuucaauauaaaagaauaggagauaacaauaaggauaagaucagagcccaacagaguccagccugccacaaacugguagagcugauugaaagugaugucaucacaagagaguuuggacacagacagguuacugcagaugcaguucuugauuauguuuccugcacaguaucugagccuggcagaaagcaugggaacaggaagagaaacaaaggcauuccgggcuauaacaaagaccacggcccuagccacaaacuggucagugaugauagacggguaucucaauggauggcagauggccacauaacggucauaggccaugaccaugaacgugcaggacuccauggucaaaaaacuguucaugaugaacaucuggaggaagcaggcugggaagcugaucgaccugaggucaaaccagaagauggccaggaccuuggggaugacggugaggcagagcacgauguccagcagggagaggaggcugagcagguaguacaggggcuggugcagagaggccuccagcuggauggugaucaggagggugguguuagcucccauggccaggaggaagagaaggcugaggggcagagacaaccagugcugccagcucuggaaguuggggaagcagaugaggaggaauucagagacuggggcaguggagucauugcugggagaugccauguaaaguuuccugaucaaucuggagacccaguguaccuuaa

SEQ ID NO: 15321 - RNA, 1021 nt, Homo sapiens
acccugaaguccagcuggugauaacuauacucagguaagcucaaucugcuuggggcuuagaaucaucaauagccgcuccuagaucugcuuggucuccaugccauagacaaugggauccagugcugggggaaagagcaaguagagauuggcaaggaugaccuuggcaguagaagcugugggugcuccaaagcgcugcaugaccacagaaagaaagcccaguccauagaagaagaggaugacacagacaugggcuguacaugugcugccugcuuucgcacguuccucaggugaaggaaaaugcauuacaguccucacaaucagcccauaagaauaggcaauaagaccacaucccccccaccaagaaagauugccaccacaaaggcauagagguuguccacagugguggccucacaggcaagcuucaccacugccauaugcucacagaagguauaggcaaucaugugugagccaugguagugcagccuaugggccaagcuuggaaaggagauggucaaucccaccccucacaacaccaccaggccuccaaucuuggcaacaacaacagguggaaggaugguugcauaacgcaguggguugcagauggccacagagcgguccagggccauggccacuagcaccccugacuccauggcagagaaugcauggauggagaacaucugggaaagacaggaaugcgagcugauggcuguagcaccaaaccagaaaauggccagcaucuuaggcaguguggagagagagaggaccaagucgacaaaggagagcauggcaagaaaaagaaacaugggcuggcgaaggcugcauucuguccggaugagaaaaagcaggacaccauucccagucaaugacaggaaaaacauaaagcaaaagggaagugagauccaaauguggguggcagucaauccugggaugccagccaggaagaaaguaugugggaagagaacagaauuauuggaaaaaaaccaugguuaucaugucacauggaagaacaaagugacauugc

SEQ ID NO: 15322 - RNA, 1021 nt, Homo sapiens
gcaaugucacuuuguucuuccaugugacaugauaaccaugguuuuuuuccaauaauucuguucucuucccacauacuuucuuccuggcuggcaucccaggauugacugccacccacauuuggaucucacuucccuuuugcuuuauguuuuuccugucauugacugggaaugguguccugcuuuuucucauccggacagaaugcagccuucgccagcccauguuucuuuuucuugccaugcucuccuuugucgacuugguccucucucucuccacacugccuaagaugcuggccauuuucugguuuggugcuacagccaucagcucgcauuccugucuuucccagauguucuccauccaugcauucucugccauggagucaggggugcuaguggccauggcccuggaccgcucuguggccaucugcaacccacugcguuaugcaaccauccuuccaccuguuguuguugccaagauuggaggccuggugguguugugaggggugggauugaccaucuccuuuccaagcuuggcccauaggcugcacuaccauggcucacacaugauugccuauaccuucugugagcauauggcaguggugaagcuugccugugaggccaccacuguggacaaccucuaugccuuugugguggcaaucuuucuuggugggggggauguggucuuauugccuauucuuaugggcugauugugaggacuguaaugcauuuuccuucaccugaggaacgugcgaaagcaggcagcacauguacagcccaugucugugucauccucuucuucuauggacugggcuuucuuucuguggucaugcagcgcuuuggagcacccacagcuucuacugccaaggucauccuugccaaucucuacuugcucuuucccccagcacuggaucccauugucuauggcauggagaccaagcagaucuaggagcggcuauugaugauucuaagccccaagcagauugagcuuaccugaguauaguuaucaccagcuggacuucagggu

SEQ ID NO: 15323 - RNA, 5578 nt, Homo sapiens
guuugggggagcagcagcugauguuuauuagagaccaguaccccuaugccagaucuugggggcuuugcccccggaaucuuuugcuucagcuucagucgucacugucgaacucugaggauagacccugcagcaggggcagggacauggagugcccgucggggucccuggggcccccacccugggcuccugguggagggcugcgggggcugaagagccaguucucugccaggguuggggauagucacagcuugacucauggcuggucuuuucccccccuagcuuuucccucugguccucugugccaucccaauccccuuccuagggccuccucauuccaucucacccuccccagucucccucauuccaucucuuucaccagagcccugugcugaguaauggauuccucacauacuuaauucucaugccuucucccuccuucacuuugucccucccauccaucucaucaucauuuccccuaguaguaccugacaguaucuggggcccccuccagaagggguuucggcccuuguaggagaaucugguggguuuguccucuggcccuuccuggggagguggcguagguggggcugggacaggugggggcacaucagcagcuucaguuguaucagcaggugcugaugugggggccagaggcggcaugaugcugagguugggucugacccaguuggccccauggggcaaugggucuuuagugagaggcuucuguggucccagcacgcccuuagacugcagugaaaacuugaggcaggagaaggcaacagguaaugaccgaaguagccggaggagcuggggcucacgggcuguagacgucagccccagcugcagccaggaacaagagaagaccugguagaugacauagaugcugugggugcuucggagccagggaagagucugcuguaggcucaccugcccugguggcagcaacaggaaggcaaccuucuugcgcaggucacccauauguaggcggaucuugcagggcuguccauccaacauucgcgucucuucauaggcucucucugcucggccauuuggugaguauucccgagugcagugggcgaaggcacccucagauccugccugcuccaggaggcuugguaguggccccacugguuucagugcccuccggcccugccgaccuggcaaagccaggcggguaugggcugggcgggacuguuuuaccagcacacccaguaggucauagcaggcugcaucugacaggaaagguacugcuacugcauugggcccaaagugcuccucgaugaccugcagguggccaguuuauaggucagggacuuagggucagaaguuaacugguugccuacuuuaaauugacccccagguucacguucaguuacaucucuauaauguguucagauuuaugcuuucugcuuaccucccagcucuccggcagcaaaaccuugaauguuuacgugucaaacuaucuaaguacugggaaaacauaaaagaaugagacuuugucuuuguccuaauauaguuuagucuacuggagaacacaaaaauguaaacagucugcuauguaaaauauuaauagagagcaaggugugaaggagacaggaagugauugaacagucuuuaccuuucauggaaagaggaucaaggaagguuucuagauggugauacuugaguuuugaagcaauuaucuagguaggagaauggucaauucaggcauaagagucggugaaaaaacuugaauuuacaaaucaaggggggcacauuuaggaacacauaauuuuauauugcugguauguaugguaugaggagggaaaggcacacaggaacuagauuaugaaaggcuuguguguaugucaagugaauuuuguccugaaggcagugggaagccgccugaaggccucuggguaggaggaacaggaucagauagguguuucugaaagcuaauuuuuuuuuuuuuuuuuuuuuugagucgguucuccuucgucgccuaggcuggaguacaguggugcgaucucggcucacugaaaccucugccuccuggguucaagugauuguccuggcucagccucccaaguagcuggaacuacaggcacccaccaccacaccugguuaguuuuuuguauuuuuaguagagaugggguuucacucuguugcccaggcugguuuugaacuccugagcucaggcaguccgccugccucagccucccaaaguguugagauuacagaugugagccaccgcgccuggccagaaagcuaauuuuuaauaggaagucauaaaauaagaguauugcaauacuccaggcaaggcauaauaagguccugaacuaaaauagugagggaagauauuagagauauuuagguuauagaauuaguagaacuuagucacucaggagguagggaaaaaagaauccucggcugugcacccuggcucaugccuauaaucccagcacuuugggaggccgagacagguggaucaccugaggucaggaguuggagaccauccugaccaacauggugaaacccugucucuacuaaaaauagaaaaauuagcugggugugguggcacacgccuguaaucccagcuacucaugauacugaggcaggagaauugcuugaaccugggaagcggagguugcagugagccgagauggcaccacugcacuccacagagucucaagaaaaagagaaaagaaucuuuaaggauucuucuuaggugacugguuacaugggugaugucuuuaaucaauaguagguuacgcagaaauagauuuggaauguccauucuuauaccauaucucuuaccucauaguauaugccuucuacccuagcugcaagggguaguucuuguagggaauuugaggccucaucuuuauaauguuaguuacgguauacuuucagggauuuuaguuaaucgugugugugugugugugguuuguuuguuuguuuguuuguuuguuucaucauggccuuuuugggguugguaacccuggaaaguuuauuucaugacuaauugggaaaccuauaagagccucucuaguaauuguacuuaaguaugguuucaacccauucaggauuuuguggcugauguuucugguucucugcucuacuagggagcaagggcacacagaauuuccucuuugggcaucucuuauauuugagcccagugcuuacagugcuguacucuacucccuaccuccaggaccaaauuucgcacaucuaugccccuacugauggcauugcccucuuuguuggccuucugguagaauucaccaguggcuccuuaaggcugaucugcuuuuucuacaaagcuguuuuggaaguacugccuccuagcauaagaggaagguagcuaacuauggaguugcaucugcaccuuggauaagcugagguagcuuguagacuacugucuugucaccuggcugaaggaauaacugauguucuuuuguggucugcaugggacaguuucccaucauuccuucuccuuugcuucacuggaaaacacuuccuuuuggguggggcucugagaaggaccaguugcguuuccagggagagagcagaacacugguggguugacauuuuuggaugcaaugcuuugccccaugaccaugaaaucagaggcaccaagcaugacaucagaaucucacacuaacugcuccuuuggugucaaggauccuacacaaauaagacaaaugggagugucucuagaagaggccccucugauaggagugugacauuuaauauaucuggugcuuauuauccaaguuucugcuaaaagggugaaucucugguuuagcuggaggcucuuuauuccccauacgcucuuccuauaugcugacaggcauuaaguugucuaauucuaacccuccuuaaccuugacagccacagugguuauccuaaaauaggaaaaauaaggagcucgguucuuuguuagggagacuguguucuugguagaaucacuauuuaagacuacuaugugcuccuacugaacuucugcuucuucauagaaauuauauggaccuuaggcccacaaauuuagguuuuccaggggcaucccaggaaagugaugguggaauauuguuuuccuagaugucucuugguugcuucaaauucugaauguggagcucuugagccacauucuguuuagccaaauguuuuuaccauauguucaguaaacuguccgugguuuuggacacaggaaaccaggucacuuaaaggugaccuaauccuugaauuugccccguaaugccagugauuuauccugcauaucucuaccccgauuuuccugacaauuuucaauuuaaauaggauagugaguuuuucugauacucagagauggcauagcuuucuaauagugggagacuguuuauuuucaaucuaauucugcuugaucuaguccaggaccaaccuucuacacugcugaaaccaguugcucuaauacuugggaagaccuugagcucuccaguuuuugcuucccugggaagcuggccuuugugguaagcagcuacccuauuuggaauggaagcagcaugccauuaaaucuucuuugagugugguaggcacugcuuuaagauuuuuuuuuuuuuuaagccugguaggcugacuucuaugaauguuuuaaauucaccuuccuucaaaucacauagaaucugauucuaaauucucugaucugaaauuuccagucugcagcugaaaagugauuugguaggauuuguuggauaucugcaacccagauacagcugagauuguccugcuccuuaaaauauacaaauuugccucaaaauccaaauuucuuauuuuguggaaguuaagguggaggagaucugugaaagaguuucagauaaaguucagauucuauaggaagcugguucuauaggaaguccugguucuaagacuagccccuauaucucuuuggcuuuauuuuuaccacugcuucuuugaacucugcucuagaagauuauuaggaguucucaaauaugaguuguucuuuuuccucuccuuguuuuuacaaauacucuacauuuaauuacuauuaaauuacuauacacucaccacccucccaugcucauuaauucagguauuuauuaagcacuuuuugucagguucuccucucccucuuugugugaauaacuccugcuugccuagcuagaaugucacucuuuccaggaagccuuccugaucuccugucucaccccugacuuagcguaucuccucuuugcucauaauucccuauacguugcuuuucagugaaccuuuuuuacuguuuuuguaguugucauuaaauggggcgguucgugccaauaacuuuacugcagugccuggcacauauggaagcagugaguaaauguugguuauuauuguuuucagacuucccaccccuuccuacucacaagcugcugagacccaugcaggucacacuucguugcuuccucuuuagccuccuuacuuuaccuaccuuauccuugaugaggguccagguggcaucagcuucauccagugucagcagguuggggguacccaccaacauggugggguaugggagggauugggcagggcaguggcugcugcaggaaccccaggcagccca

SEQ ID NO: 15324 - RNA, 1817 nt, Homo sapiens
aaaacugcaacuguguguucccaugaggaaaguguuuaaagagcaaguggucagaaggauauuucuaugugucacuggaggcuagaacccaggacuccguggaaacuggagaaauuguacgauuccagguuccaacauuugucuuauuccuuguaacugccuucccacauccaaccgcuuccccaucccuucucacggagucugguucgggugaaauuacuuuuauugauggugagcgcaagcaggugugagugacugcaccucuuucagaggacacaggacugggcuuaaggaagggagggccagagcgcccgccuugguggauguaggauucgcuccuuauuagggcgugagugcuacauucugaaaggauuuauuuugggacaaggcacaagcacaggggaggcaggcaacaccagcccucaggcuacacucuccauuuggagcagagcuucuucggcagccccaggucucccgggaucuuccucgguguccugcggaggcucuggcuccagcgugggcuccagcgcaggcugggcuuccggcugggcuucagcgcuccggccaggcccaaggcgaggcggcuugaccggggugggcgguggcgcugcagggccuuuccggcccgaaagggcccuucggaggcucuguaccuucugcaauccggugcgccgcagccgcugggcccuggacuccaccggcuccucguccgagcucucuccaacuucggccuccagcugcucugggcccagcucggacugguccgccgggcccaagggcucuggugccuucuggaaagcgcuggcugggacuucacccuccuccugcaugugacggacacagcacugauccuggcagcuccuuacccccagcagcccgaaacucacuccuuaauuacacaagggaaaccuuuuaccuccgcagccagagucuggggggaaaggcaggcgugggaagguaaggggagggaaagcugcgugcgaacugcaaaacgcuguaaaguaggugaggccuggugaggggcgagaagaggauagugcccgcagucacggaaugcccuuucaaccaccguuauuuuagggauuggcugggacucagaccaaauucugcggacguggccugagcuagagcugggcgggcuuggauuggccaggcggggcucaggcgugagagggagggauggggcugggucuugggaagugggugcggcucugugagucuguuccacagcaacagacggcgggaggggucaggaaugugggugugguagguggauggaagcggggagcccccagcugguggcccacaggccggcaaaggccucggauuggggaccguuugaggucacugaccuugaagagcagaacguggagcuucccgcgcgccaccagcagcccgugguuggccuccagccgcugcaccugggcugcgcggcgcaccgcgcgcucuugggcggcguuggcgugcgagcucacgcgcuccgccuuggccagcagcugcgccaagguguugcugguggugucguggcugcgacucagagcgcccaggccgcucuggaugcggcgcacggacccugccaggccucccugccuucgagccaggccucccugccgcucccgcagagucuccagcauggaggccagcuucuccagcagggucaccaccgucacggcgugcacgggaccccccgccggcgccucgggcacaggcccccgcuccaacgcacucucccucaugaucccugaccgcucugcuccgucugccugcaacugcuggccgcacuacggucaggggccuccuuucccuggcuccucccc

SEQ ID NO: 15325 - RNA, 930 nt, Homo sapiens
caagguguugcugguggugucguggcugcgacucagagcgcccaggccgcucuggaugcggcgcacggacccugccaggccucccugccuucgagccaggccucccugccgcucccgcagagucuccagcauggaggccagcuucuccagcagggucaccaccgucacggcgugcacgggaccccccgccggcgccucgggcacaggcccccgcuccaacgcacucucccucaugaucccugaccgcucugcuccgucugccugcaacugcuggccgcacuacggucaggggccuccuuucccuggcuccuccccagcuccagcugugacucaggcaggcggaguuggccuucuggggcggcgggagggcgcgagggcguggggauguuggcagcggggucucuugaaagcguuucgccuuccgcugucccgcgccgggggccugcugggaagccuguuggccccaaaucggcccccugcaaacccucucacucugaguuugaguuacccuccuccgcuccaauucccuggugugccuguuucaguucuccacugcaaagggcgagucacggaaauuuuuauuucaugcaucuuagugggcgcagagacuguguuggcacggcaaagagauaaccagaggggccuccgucgccguccacuuucggccucccacaccagugaagauugcccccaggcuggaugcaggcgacagggaggcccuggaacauucugcuuacagaucgcgaacugucaaggcccgaggccccgcuuugugacuuggacaggcugcucauugugggcuggcgggcggggcauccucugguguuuuccuaauagucaucuccaggguuuagccucaggcuucguuuccugcuucuuuauuucguccucuuggguagcauuaucugguuucuuuucucuaguuuucug

SEQ ID NO: 15326 - RNA, 930 nt, Homo sapiens
cagaaaacuagagaaaagaaaccagauaaugcuacccaagaggacgaaauaaagaagcaggaaacgaagccugaggcuaaacccuggagaugacuauuaggaaaacaccagaggaugccccgcccgccagcccacaaugagcagccuguccaagucacaaagcggggccucgggccuugacaguucgcgaucuguaagcagaauguuccagggccucccugucgccugcauccagccugggggcaaucuucacuggugugggaggccgaaaguggacggcgacggaggccccucugguuaucucuuugccgugccaacacagucucugcgcccacuaagaugcaugaaauaaaaauuuccgugacucgcccuuugcaguggagaacugaaacaggcacaccagggaauuggagcggaggaggguaacucaaacucagagugagaggguuugcagggggccgauuuggggccaacaggcuucccagcaggcccccggcgcgggacagcggaaggcgaaacgcuuucaagagaccccgcugccaacauccccacgcccucgcgcccucccgccgccccagaaggccaacuccgccugccugagucacagcuggagcuggggaggagccagggaaaggaggccccugaccguagugcggccagcaguugcaggcagacggagcagagcggucagggaucaugagggagagugcguuggagcgggggccugugcccgaggcgccggcggggggucccgugcacgccgugacgguggugacccugcuggagaagcuggccuccaugcuggagacucugcgggagcggcagggaggccuggcucgaaggcagggaggccuggcaggguccgugcgccgcauccagagcggccugggcgcucugagucgcagccacgacaccaccagcaacaccuug

SEQ ID NO: 15327 - RNA, 4596 nt, Homo sapiens
ugucagagaucagaggaagaggaaggggcggagcugcuuugcggccggccgcggagcagucagccgacuacagagaaggguaaucggguguccccggcgccgcccggggcccugagggcuggcuaggguccaggccgggggggacgggacagacgaaccagccccguguaggaagcgcgacaaugccccgcuacggagcgucacuccgccagagcugccccagguccggccgggagcagggacaagacgggaccgccggagcccccggacuccuuuggaugggccuggugcuggcgcuggcgcuggcgcuggcgcuggcgcuggcucugucugacucucggguucucugggcuccggcagaggcucacccucuuucuccccaaggccauccugccagguuacaucgcauagugccccggcuccgagaugucuuugggugggggaaccucaccugcccaaucugcaaaggucuauucaccgccaucaaccucgggcugaaggugagcacugaaggggcugcaguggaggaggccgaaaggagugcuggggcugggggcuggggcugaugcuggugcgcugggcucagaaugcaucccugauggagaggguggcaucuacaauccaucacugaguuugcuccccuuuggggacacccauggcuacaugccaccaucaccccauugugaccuuugugaaguaagaaaauaaugcagacagugccugaggaagucagcuugccaagcaaaggccucaugccacaggccgcugagcuaaagaagaagcgauggccuggugcugccugaguuacagggcaauaucuggaaggcaaaggugugcacugagcuuggugcacugaguccugcccagccccaguuuggaaauggaggcccaaggggugguggccagggguuggccugguuccucugcucugccucugauuucucaccaugcgcuccucccacugcagaaggaacccaauguggcucgcgugggcuccguggccaucaagcugugcaaucugcugaagauagcaccaccugccgugugccaauccauuguccaccucuuugaggaugacaugguggagguguggagacgcucagugcugagcccaucugaggccuguggccugcuccugggcuccaccugugggcacugggacauuuucucaucuuggaacaucucuuugccuacugugccgaagccgccccccaaacccccuagccccccagccccaggugccccugucagccgcauccucuuccucacugaccugcacugggaucaugacuaccuggagggcacggacccugacugugcagacccacugugcugccgccgggguucuggccugccgcccgcaucccggccaggugccggauacuggggcgaauacagcaagugugaccugccccugaggacccuggagagccuguugagugggcugggcccagccggcccuuuugauaugguguacuggacaggagacauccccgcacaugaugucuggcaccagacucgucaggaccaacugcgggcccugaccaccgucacagcacuugugaggaaguuccuggggccagugccaguguacccugcuguggguaaccaugaaagcacaccugucaauagcuucccuccccccuucauugagggcaaccacuccucccgcuggcucuaugaagcgauggccaaggcuugggagcccuggcugccugccgaagcccugcgcacccucagguacuuaucguccguggaaacccaggaagggaaaagaaaggugaaugaaagugaagggagaagggaaccuggggcauugucucugauugcucuagcaugaguccuuagugcucuucauuuggcuccccuaaucugacuccuccuucccuuucuacuguuuugccgcaccaggcuuuuuuuuuuuuuuuuuuuuuaguuuaguuuuuguagagacaagaucuugcuauguugcccaggcuggucucaaacaccuaaccucaagcaauccucccgccucggccucccaaaaugcugggaccacaggcaucagcuacugcuccuggcccucccuuuuuuuuuuuuuuuuuuuuuuuuuuuuugagauggaaucuugcucuguugcccaggcuggagugcaguggcaccaucucagcucacuacagccuccaccuccuggguucaagcaauucugccucagccucccaaguaccugggacuacaggugcacgccaccacacccagcuaauuuuuguauuuuuaguagagaugggguuucaccauguuggccaagauggucuugaucuccugaccucaugaucugcccaccucggccucccaaagugcugggauuacaggcaugaaccacugcacccagcuuuccagcccucccuuucuacucuuaucuccagccacccuccuucaaaggucuggcagcauaaccucucuaugccccagcugugucuuugcucauguuggcccucuggaaaugauuucccccuuuuuuuuaagugcuccaguuuuucccaccuuauccaucccaugucaucuucccucugugugguccuugcuucccauucuagcuaacucuuaucccucccccauacuccuggagcccucugcccucagagucuuuugugucacacagacccaauaauuagaacuguuuggucucuggcuagacugugagcuccuugcagguggggaagaugucauguaugcuuuuacccuccacccaaaugcccagcacaggaggaccaggauuggaacaaguguugaccucucauguuuacuuuguuucagaauugggggguucuaugcucuuuccccauaccccggucuccgccucaucucucucaauaugaauuuuuguucccgugagaacuucuggcucuugaucaacuccacggaucccgcaggacagcuccaguggcuggugggggagcuucaggcugcugaggaucgaggagacaaagugagggccaguagugggaacacgguggugcugggggacaagcaggcuccuguugagcuggagcaccucugggcacagaaguuuuauuuuccuggcauucccaacaaguguucccuggggauucagcucauggucacuguugaaagccuucauucagucccccuuucucuagccagggcugccuggaccccuggaugcccugauuaccauccuuaauucucccuacuaggugcauauaauuggccacauucccccagggcacugucugaagagcuggagcuggaauuauuaccgaauuguagccagguaggacggagaugagggugggaauagggacagggugagugucugaaggcugaaaauucccuugagcaucucaccaucccuguugucccauggaguggggaggcuccucacuagaacagguuggagaaagagggcauccuaucuccccagaugucuuccuaccccucccuagaaucuucugaauguaguaccuucuggccagguaugagaacacccuggcugcucaguucuuuggccacacucauguggaugaauuugaggucuucuaugaugaagagacucugagccggccgcuggcuguagccuuccuggcacccagugcaacuaccuacaucggccuuaauccuggugagugaggcagaagggagccucccuuauccuggaguuggugggauaggggaaggagguuggagccagagccugcaaagcaugggcaggauguguggccccucccuggaguuacccuugcuccuugccccuccagucagccccacauccuugcagguuaccguguguaccaaauagauggaaacuacuccgggagcucucacgugguccuggaccaugagaccuacauccugaaucugacccaggcaaacauaccgggagccauaccgcacuggcagcuucucuacagggcucgagaaaccuaugggcugcccaacacacugccuaccgccuggcacaaccugguauaucgcaugcggggcgacaugcaacuuuuccagaccuucugguuucucuaccauaagggccacccacccucggagcccuguggcacgcccugccgucuggcuacucuuugugcccagcucucugcccgugcugacagcccugcucugugccgccaccugaugccagaugggagccucccagaggcccagagccuguggccaaggccacuguuuugcuagggccccagggcccacauuugggaaaguucuugauguaggaaagggugaaaaagcccaaaugcugcugugguucaaccaggcaagaucauccggugaaagaaccagucccugggccccaaggaugccggggaaacaggaccuucuccuuuccuggagcugguuuagcuggauaugggaggggguuuggcugccugugcccaggagcuagacugccuugaggcugcuguccuuucacagccauggaguagaggccuaaguugacacugcccugggcagacaagacaggagcugucgccccaggccugugcugcccagccaggaacccuguacugcugcugcgaccugaugcugccagucuguuaaaauaaagauaagagacuuggacuccagaccccugugugacug

SEQ ID NO: 15328 - RNA, 6765 nt, Homo sapiens
aguuuacagggacugagugguuauuaugugccgacacagaacuagccacuuuacauauauuauuuaauagucaguagguagcaucuuuuauuagcccaauuuuacaaugggaaaaaauagggaucuugcuccccagacguuagcccucaucacucagcuagaaaguggcagaaccuggaguugagcccuguuuuuaggcccuacaaccagcauuuggagacucgguaccuuucauguugaaaaauccccaguggcccauuaaguggcagcucauauaaggaccaccuucccugccccaaaaaucaagcucuagucagaugauugcaggcugaucaaagcccagaagacugucugggagcugcaguauccaugacaaagggcaaagucaugccugugaggaucccugcacuaugggaaucugcugagugggucuuccccuuccuccagccuuccagagguggggaaaauccugaaaaauucugguuuccuuggccaaagggcauacaggugaugacaccuagcccugacuaaaccaaagugcuguuagggaucuuucuugugaccucuccacaagguucagauuuaggcucaacaccugggugcagcaggagcuuugggaaccgccucaaccucuuauccaccugaguucagcacauagcacaagaugcuccagugcuugugaaggaaacccagacggggaucaugcuugcaguuuugggcuggggcuacuaugcuacccaagaugagggaacuggagucuagaugacacuaucuuaagccucagaggacuacuuuucucaacucuauacuucucccaugcagucaaauuucugcuuaaaacacuucucagcuccuucuccagagggcaaaaguccuuaaccagccugcagucuucaucuagccacucccucuucauuuuucauuccaagcaauuccucccaguuccuacucagagccuucauuauaugcuagccucucugccugggaugcucuucccuuuacccugccuguuugucaucuacucacccuucaggucucagcuuuuuuuuuuuuuuuuuugagauggagucccgcucuguugcccaggcuggagugcaguggcgcaaucuuggcuccacugcaagcuccgccucccggguucacaccauucuccugccucagccucccgaguagcugggacuacaggacuacaggcgccagccaccgugccgggcuaauuuucuugcauuuuuaguagagauggguuuucaccguguuagccaggauggucuugaucuccugaccuggugauccgcccgccucggccucccaaagugcugggauuacaggagugagccaccgcaccuggccaggucucagcuuucaaacugacauccccauuuccaccccaguccaugccagaugccccuccuuugugcucccacagcgcccucuguacuucuguauccuaauacuuaucacuguuuuguaguugccugguuacuucuuucccucaguaggcccuaagcacugugggcagggaccguguuuuauucacugauguuuccccagggccuaacgcagucccuggcaaaugaaagcacucaguaaauauuugcuguaugaaugaaugcaugaugaaggucagcaaacccaacccccucuggaucuggugcucuuaagauccauagcuaucuuggugcuggcuaaaggacaaagcuuuggcuccaacugaggcugggagagaagacugggccuucaaaccaucucugaaaccugugacuucagcugccuggccccagcucuuuugacuugauaggguucugguguuugauuagacugagcuugucuccacccaggccacccuccuagaguccccgacaaauugaccucgcugggccugcuuuuaugaaagguuuauuccuagugcuagaucccaaucuucuugggcucuaagcacaauuaaacugggugggugggugaggguaggccuauucagaugcaaggccagcaauggggcuccccauuauccccaccccuuuggucccaguccccuucucugcaaugggcacgcauagaggagagacaaaggguauuagacgcaacaucauuggcccaggggaguccgagaagagcugccauuggcugacagggcauuuucaggcucugucauuggucagggagcacaccccagccugaagagugaugccauuggccagggagugguuuugucauagccguuggcugugaaguggaaggaaaagaucugggaaugaagcccuguggccaggaagauagacagggcagcaacuucugggccuccaggcccucuucccaccauagcaaugugggcaaaacuggugucaggccccagccagaaaaaggagcccaagccagagggcaagugacaaaggauguaccauguccaaucucccacacccuggggcugcccuucccaaugucuuucuugauagccaaguugggcugggagcagcucacugcuccucuagccaggaggguuucucagcuccuggaggccgcagcuugauguugaacugcugcagggucugcuccagcuguuucugguucccagcaaaguaggcggacacagcauuguggaagagcagcagcugcuugugcaucaccuugaucuggggguccagcagggucagcuaaggcuggacucaggcgcccuucuugagggucuaugagccugagcccaggcacagaccaggggcacaaggacucugcucugauggugcuuuugggguaggggcugaacucuacccagggagucaaaggagaagggucaguaugauggaagaaaccucacuggauuugugggccuaggguuuuuguaccccagcucagggggugauuuuucccaguuauguuccugggaccagcagccaaauccuccaacaggaaagggccaggaauuggagggagggugaucuggaaaggcccagggguugagggggugaacacucuacuccccagcuaggcugcauuuccucauucaauaauggggagggucugaggggaagguuaguguuacagauggaaaggugggcuagggucaagggggugggguuggcaccuuguuuucuuccaggaacuugagcuugauggccacaucuccccgcagcuucucauacuugucccgaugggccuggaaaguggccugggcacucucaagucgaccacgugucccugcaucccgggggccuagacucagcuccucuaagucuguucgguaggcaucauauuccagccuggggagggggugauaaaggcuggucuccacuccuuuauccucaacacauacucuccuuuccuuccugaauucuuaugccccuaaugcccaaauuuccacccauaccagccaacuccccaaacccuaagcccugccagugcccacaccuggcagccucauacuguuucacagucaugagcgugucuuccauggucuuggugaccaauguguugaugcuagagacaaagaaguucacggcuccuagcagcguuuccccauucuugcauaguaguuucugugucucugcauuguagccaaauuccuccugagggcagaagggaggaacagaccuugaauaacacucccuaccugacugaagcuguagagcccuucauuccccuccuccccggggaggacacagccagcaaaacuggaacaaccaaggacugccuccagcaaggcucucuuagccggaaaguuagugggaucacccuggggauaccugggguaggaauguggguggugggcauucuuggguaaguucacaagacuggaacagucugagagcuaguguggcaagcaggggaggggcucugauuaggcugagcacgaaggcauucuccccagugcagagagggguuauuugugaggcaccuagugugcccccucccccacccccuccaacuucuggaccucuguacaaacccuuaggcugccuccacaggugagugcugcuggggguagggcugggcccacccugaagggguucucccugugggcugcaggagggagggaggaugaggaaugacugccugggagggcccaugcccaguucccccacccucuuuggucugggugaggcaccugaagcucuggggacuucuggcugaggucagcaaaggcaucacccagugcaugcugggucugcagcaggcuguagaggugggcugucagugcccggcccagcugcaggacacucucauacuugcgcuucgucucacgcagcaacucaaucugcagcucuagcuccagguccacaguccgugagccucgaccaaaucguucugauaacaguugcuuugugcacugauugggaaaugggggaauaaaucagagacccuaacagccuccccacacaacagguaucuaccccagcaccccccaggcuccuacucucagccacagaugggauauuacgaucacgaagaaaagggaaaaagguacccauaaggaguuuuggggaagggagaggugcuuaaauccuaccuuauagguguugaugccccauuucuugacgaugucaaacuuuucuccagcaaugccccgagccaccucaucuccagggccagaaggaguggugcugugagauggauggcggccagacccuaaaggaucaaguucucugacaccagccucucucagauacaccagacaccucuguggccccacccauacuucucuucgagcacaugaaauugacuucccugaaggagaugcuagagacaacuggaugcuccugcuuacuaggaggaacucggacuuugcgcggugagaaccaaauccugauauacauauggccuccuuggggguuagaggagggguuugcagggaguuguugguguacaggggcagaggaaacagaagaaaauacacugaguuugggggcagcaggagucaaggauggugggucaugauaacaagaaaccugguugcauucccauguggaaucuuagugugagauucagggcuguuuguuccucuaaacuuuagaaucuaaaaauucugagaagcuucacaaaguuccaacucagccucaagcuguagagggggggcauuccugugaagcaggucuuaacuugacucaggugguggcagggaaaggacaaaugagccauuucaggggcuaaguggcaaaagggaaauggauggacaacgcugggaguugcuuuugggcugaggagaguccaugagguuccuacaagcagaaguucccaagaucuccagacauaauucaagcuuuccuagacauauccuaugcuuccccaaaccauuccuguccccuccuccacccaagauuccuguuucugaacauucauaccuguggggaugaguccaucaccagagcccccauagccaccagacacaaugcugguuucauugagguuggguccugacaccaucaccugcuggagguccuauaggccagagaagagggguugcuucaggaacauaggggcugcagaagcauuuuggaggugggaacaaguuuggauucaagcaucauaaagauaguacacaagggaagucugcacagaaucaaaaugauacguaaaaagaaugaagggagucagauaagucaggggaaggcuacuggaauggagggugagaaccuaggauuuauaaauuggauuccuaaauugaaacaauuagaagaaucaaacagaagcaccugcuccagcccaucaucuucaggaagcugccuggcuucgccguucccguggauagggaucuccauuguggcugccuucccuaggaucccguccgucauggcuaggaaagguauuggaguaaaacucuccaccccagcacccugcaaagcccaacacagaaguucuggacacuggccagcacucuagaagaaggaggccuccucugucauuucuuuaaaggcugucccaggguuugagugucccagcguuuggccaucauuccuuucuucagauauauguauuucuccccuccaaaacgcacauuugaaacaggcacaccaaagcacggugucuucucacaagcccccaaccucaccaggacucuggugauuauuucuacacucauucagcagacauuuagugagugccuacuaugugucaggcacuauuugugacaaugaaaauacaacagugaagagggaaagucugcucucuuagaacuuaucuccaugcaggcguguuuaugcugaggagaugaacccuuuccagggcucaggucuucaccccccuauucagguuuguucuccauugcuuggccuuucacauuccuuuagcguuucuucccccuuccuucagggggucuccccuccuccgucucauacaccucgucuuccucgggcccuccccaccaggccuuaguuagaucaguggguguauguucccagucucugguaaaagccucucucucccaggauaucggugacccuuccacagucaguuaugucucccaggugugugaguccccgcccccacccccauacaccuggacaucagguguguccucauccuuccccggggcucggggcaucuugcccucuggacagguuugugcguucaacuucccgucgcccaagcauguuccucucaccucgggccgggccgcucuuccccucagggcgccaggcccgggccgcgcggggaccucgggcuccaguucccgucgcgauccuagcagcaggucagggacucggcggaaaugacguccucuccgggcagaagaagccggccacgucgcagauuauaagggcggagcugacgucg

SEQ ID NO: 15329 - RNA, 6765 nt, Homo sapiens
cgacgucagcuccgcccuuauaaucugcgacguggccggcuucuucugcccggagaggacgucauuuccgccgagucccugaccugcugcuaggaucgcgacgggaacuggagcccgagguccccgcgcggcccgggccuggcgcccugaggggaagagcggcccggcccgaggugagaggaacaugcuugggcgacgggaaguugaacgcacaaaccuguccagagggcaagaugccccgagccccggggaaggaugaggacacaccugauguccagguguaugggggugggggcggggacucacacaccugggagacauaacugacuguggaagggucaccgauauccugggagagagaggcuuuuaccagagacugggaacauacacccacugaucuaacuaaggccugguggggagggcccgaggaagacgagguguaugagacggaggaggggagacccccugaaggaagggggaagaaacgcuaaaggaaugugaaaggccaagcaauggagaacaaaccugaauaggggggugaagaccugagcccuggaaaggguucaucuccucagcauaaacacgccugcauggagauaaguucuaagagagcagacuuucccucuucacuguuguauuuucauugucacaaauagugccugacacauaguaggcacucacuaaaugucugcugaaugaguguagaaauaaucaccagaguccuggugagguugggggcuugugagaagacaccgugcuuuggugugccuguuucaaaugugcguuuuggaggggagaaauacauauaucugaagaaaggaaugauggccaaacgcugggacacucaaacccugggacagccuuuaaagaaaugacagaggaggccuccuucuucuagagugcuggccaguguccagaacuucuguguugggcuuugcagggugcugggguggagaguuuuacuccaauaccuuuccuagccaugacggacgggauccuagggaaggcagccacaauggagaucccuauccacgggaacggcgaagccaggcagcuuccugaagaugaugggcuggagcaggugcuucuguuugauucuucuaauuguuucaauuuaggaauccaauuuauaaauccuagguucucacccuccauuccaguagccuuccccugacuuaucugacucccuucauucuuuuuacguaucauuuugauucugugcagacuucccuuguguacuaucuuuaugaugcuugaauccaaacuuguucccaccuccaaaaugcuucugcagccccuauguuccugaagcaaccccucuucucuggccuauaggaccuccagcaggugauggugucaggacccaaccucaaugaaaccagcauugugucugguggcuaugggggcucuggugauggacucauccccacagguaugaauguucagaaacaggaaucuuggguggaggaggggacaggaaugguuuggggaagcauaggauaugucuaggaaagcuugaauuaugucuggagaucuugggaacuucugcuuguaggaaccucauggacucuccucagcccaaaagcaacucccagcguuguccauccauuucccuuuugccacuuagccccugaaauggcucauuuguccuuucccugccaccaccugagucaaguuaagaccugcuucacaggaaugcccccccucuacagcuugaggcugaguuggaacuuugugaagcuucucagaauuuuuagauucuaaaguuuagaggaacaaacagcccugaaucucacacuaagauuccacaugggaaugcaaccagguuucuuguuaucaugacccaccauccuugacuccugcugcccccaaacucaguguauuuucuucuguuuccucugccccuguacaccaacaacucccugcaaaccccuccucuaacccccaaggaggccauauguauaucaggauuugguucucaccgcgcaaaguccgaguuccuccuaguaagcaggagcauccaguugucucuagcaucuccuucagggaagucaauuucaugugcucgaagagaaguauggguggggccacagaggugucugguguaucugagagaggcuggugucagagaacuugauccuuuagggucuggccgccauccaucucacagcaccacuccuucuggcccuggagaugagguggcucggggcauugcuggagaaaaguuugacaucgucaagaaauggggcaucaacaccuauaagguaggauuuaagcaccucucccuuccccaaaacuccuuauggguaccuuuuucccuuuucuucgugaucguaauaucccaucuguggcugagaguaggagccuggggggugcugggguagauaccuguuguguggggaggcuguuagggucucugauuuauucccccauuucccaaucagugcacaaagcaacuguuaucagaacgauuuggucgaggcucacggacuguggaccuggagcuagagcugcagauugaguugcugcgugagacgaagcgcaaguaugagaguguccugcagcugggccgggcacugacagcccaccucuacagccugcugcagacccagcaugcacugggugaugccuuugcugaccucagccagaaguccccagagcuucaggugccucacccagaccaaagagggugggggaacugggcaugggcccucccaggcagucauuccucauccucccucccuccugcagcccacagggagaaccccuucagggugggcccagcccuacccccagcagcacucaccuguggaggcagccuaaggguuuguacagagguccagaaguuggagggggugggggagggggcacacuaggugccucacaaauaaccccucucugcacuggggagaaugccuucgugcucagccuaaucagagccccuccccugcuugccacacuagcucucagacuguuccagucuugugaacuuacccaagaaugcccaccacccacauuccuaccccagguauccccagggugaucccacuaacuuuccggcuaagagagccuugcuggaggcaguccuugguuguuccaguuuugcuggcuguguccuccccggggaggaggggaaugaagggcucuacagcuucagucagguagggaguguuauucaaggucuguuccucccuucugcccucaggaggaauuuggcuacaaugcagagacacagaaacuacuaugcaagaauggggaaacgcugcuaggagccgugaacuucuuugucucuagcaucaacacauuggucaccaagaccauggaagacacgcucaugacugugaaacaguaugaggcugccaggugugggcacuggcagggcuuaggguuuggggaguuggcugguauggguggaaauuugggcauuaggggcauaagaauucaggaaggaaaggagaguauguguugaggauaaaggaguggagaccagccuuuaucacccccuccccaggcuggaauaugaugccuaccgaacagacuuagaggagcugagucuaggcccccgggaugcagggacacguggucgacuugagagugcccaggccacuuuccaggcccaucgggacaaguaugagaagcugcggggagauguggccaucaagcucaaguuccuggaagaaaacaaggugccaaccccacccccuugacccuagcccaccuuuccaucuguaacacuaaccuuccccucagacccuccccauuauugaaugaggaaaugcagccuagcuggggaguagaguguucacccccucaaccccugggccuuuccagaucacccucccuccaauuccuggcccuuuccuguuggaggauuuggcugcuggucccaggaacauaacugggaaaaaucacccccugagcugggguacaaaaacccuaggcccacaaauccagugagguuucuuccaucauacugacccuucuccuuugacucccuggguagaguucagccccuaccccaaaagcaccaucagagcagaguccuugugccccuggucugugccugggcucaggcucauagacccucaagaagggcgccugaguccagccuuagcugacccugcuggacccccagaucaaggugaugcacaagcagcugcugcucuuccacaaugcuguguccgccuacuuugcugggaaccagaaacagcuggagcagacccugcagcaguucaacaucaagcugcggccuccaggagcugagaaacccuccuggcuagaggagcagugagcugcucccagcccaacuuggcuaucaagaaagacauugggaagggcagccccagggugugggagauuggacaugguacauccuuugucacuugcccucuggcuugggcuccuuuuucuggcuggggccugacaccaguuuugcccacauugcuauggugggaagagggccuggaggcccagaaguugcugcccugucuaucuuccuggccacagggcuucauucccagaucuuuuccuuccacuucacagccaacggcuaugacaaaaccacucccuggccaauggcaucacucuucaggcuggggugugcucccugaccaaugacagagccugaaaaugcccugucagccaauggcagcucuucucggacuccccugggccaaugauguugcgucuaauacccuuugucucuccucuaugcgugcccauugcagagaaggggacugggaccaaagggguggggauaauggggagccccauugcuggccuugcaucugaauaggccuacccucacccacccacccaguuuaauugugcuuagagcccaagaagauugggaucuagcacuaggaauaaaccuuucauaaaagcaggcccagcgaggucaauuugucggggacucuaggaggguggccuggguggagacaagcucagucuaaucaaacaccagaacccuaucaagucaaaagagcuggggccaggcagcugaagucacagguuucagagaugguuugaaggcccagucuucucucccagccucaguuggagccaaagcuuuguccuuuagccagcaccaagauagcuauggaucuuaagagcaccagauccagaggggguuggguuugcugaccuucaucaugcauucauucauacagcaaauauuuacugagugcuuucauuugccagggacugcguuaggcccuggggaaacaucagugaauaaaacacggucccugcccacagugcuuagggccuacugagggaaagaaguaaccaggcaacuacaaaacagugauaaguauuaggauacagaaguacagagggcgcugugggagcacaaaggaggggcaucuggcauggacugggguggaaauggggaugucaguuugaaagcugagaccuggccaggugcgguggcucacuccuguaaucccagcacuuugggaggccgaggcgggcggaucaccaggucaggagaucaagaccauccuggcuaacacggugaaaacccaucucuacuaaaaaugcaagaaaauuagcccggcacgguggcuggcgccuguaguccuguagucccagcuacucgggaggcugaggcaggagaauggugugaacccgggaggcggagcuugcaguggagccaagauugcgccacugcacuccagccugggcaacagagcgggacuccaucucaaaaaaaaaaaaaaaaaagcugagaccugaagggugaguagaugacaaacaggcaggguaaagggaagagcaucccaggcagagaggcuagcauauaaugaaggcucugaguaggaacugggaggaauugcuuggaaugaaaaaugaagagggaguggcuagaugaagacugcaggcugguuaaggacuuuugcccucuggagaaggagcugagaaguguuuuaagcagaaauuugacugcaugggagaaguauagaguugagaaaaguaguccucugaggcuuaagauagugucaucuagacuccaguucccucaucuuggguagcauaguagccccagcccaaaacugcaagcaugauccccgucuggguuuccuucacaagcacuggagcaucuugugcuaugugcugaacucagguggauaagagguugaggcgguucccaaagcuccugcugcacccagguguugagccuaaaucugaaccuuguggagaggucacaagaaagaucccuaacagcacuuugguuuagucagggcuaggugucaucaccuguaugcccuuuggccaaggaaaccagaauuuuucaggauuuuccccaccucuggaaggcuggaggaaggggaagacccacucagcagauucccauagugcagggauccucacaggcaugacuuugcccuuugucauggauacugcagcucccagacagucuucugggcuuugaucagccugcaaucaucugacuagagcuugauuuuuggggcagggaaggugguccuuauaugagcugccacuuaaugggccacuggggauuuuucaacaugaaagguaccgagucuccaaaugcugguuguagggccuaaaaacagggcucaacuccagguucugccacuuucuagcugagugaugagggcuaacgucuggggagcaagaucccuauuuuuucccauuguaaaauugggcuaauaaaagaugcuaccuacugacuauuaaauaauauauguaaaguggcuaguucugugucggcacauaauaaccacucagucccuguaaacu

SEQ ID NO: 15330 - RNA, 553 nt, Homo sapiens
uuuagaaauguauacuuuaauaaguauaaaguauauaaacaauuagguaagcuuguggagaaguugaccaagauacauaaauuagaaaauacaaguguccaucuaaauuuucuauauuucauuuuuuucauaauauuuauuaaaggcguuuaauguauaguuucucaucugccauuuugggaguccuuuauuguaaagacaauucuauuguuugaugacaaacagcaaccaccaugguuauucaggaccuccacauuggauaaauucaauuucuucuugagacacaaguuugcuucuguauuucugagguaauguuuuuauuauuucugcagugucugguggacccugauacauuagcaaaucuggugauguaucccuuagaauguugugaaauuacagaagagugagaugguagcccugcugaucucaaagcuucugauacauuggguuuaggauugucucuucugucaggaaaccuuauuaauggagugugugguuugacuaccugaacgacccuacuggcagacgccaucuugcugccaaucgucacccc

SEQ ID NO: 15331 - RNA, 553 nt, Homo sapiens
ggggugacgauuggcagcaagauggcgucugccaguagggucguucagguagucaaaccacacacuccauuaauaagguuuccugacagaagagacaauccuaaacccaauguaucagaagcuuugagaucagcagggcuaccaucucacucuucuguaauuucacaacauucuaagggauacaucaccagauuugcuaauguaucaggguccaccagacacugcagaaauaauaaaaacauuaccucagaaauacagaagcaaacuugugucucaagaagaaauugaauuuauccaauguggagguccugaauaaccauggugguugcuguuugucaucaaacaauagaauugucuuuacaauaaaggacucccaaaauggcagaugagaaacuauacauuaaacgccuuuaauaaauauuaugaaaaaaaugaaauauagaaaauuuagauggacacuuguauuuucuaauuuauguaucuuggucaacuucuccacaagcuuaccuaauuguuuauauacuuuauacuuauuaaaguauacauuucuaaa

SEQ ID NO: 15332 - RNA, 5792 nt, Homo sapiens
cuggacuacagccuguuucaaaaccuccauccccuuauuagaggcauccaacuggcucagggcauagaaccuaugaucucccaauggguacugucagguauuccuggaaacaaguacaagaggccauaucuuuauaccugggcacauggcagauaccuuuugggggaggccuagaaucuaucauucaaacucaccuucccucagcaccuugccuauagcuuucccaggacaugcugaucugaguccacugcaaggcagagauaguggacagacucuuccgccaaugaacagcccaaugcccccaagcccacauggcaucaacaaguuguuuaugaacagagacccagcucccucacuaccccuccaaggacagaagcucagaaucuauuaaaagucauuaaauagccuaugaagcaggccuguugaaaggucuagccucucccagaggcuuccuuagucaacaaauccauucuuuaccccucagccuccaaccagccuagggaagaucuucaaaaaacaauaaggcuuacaacacauaauagucauagcuaguuuacugagcaccuccuauguucccagcccuggcuacagauuucuccaguuaacccacacaaccacccugcaagacaaaaauucuaccauuuuccaaaugaggaaugugauauacagagauuaaaugacuuuaagugccucuggguagcaggccaagaauuaaauccaggucuaccugauuccaaaaucugugcucucagcuauauacaucccaaagucccacaggacaauagguguugggaguggcuugaugcuauaugguuccaaaaauggagaugaggggagaggggaaagauaaaccacuagaaaugcucgguauggggacaaccaaacagucucaaguugguggcucagacugaugucuugagccaagauguugguggacaaccaguugccucagagucaaacagcaacagcugccugucugcaaccuugaaggccugggcaaacugaagcugaaggagcagaagcuaugggugagcagaggaagcugaucuguagacagaucagaugacagcagaguggagauggcaggacaggaaggccauguggcuucuuaguuggaaagaagagcaaaaccuaaagaugccuugaauuccaaaccaucuaguuuucauaacaccugaagugucaugagacagauauccccauguucucacaauaaacucuuuauuguuuagcuagccccagugacuuuaugcaucuuauaaccaagaagccuucaguagagcaagucugagccagagguuuuaucacacuuuguccucaggguccaccaggaaccaggucuuggcucacagccaggcuggaaacagucuucacaguucugagccuggaguuugagaucugccuccccuuucaaggaagauccagaggucaccugcgcuuguagagacauggcugaagcugcaggccugaaagcugagccuugggcccuaccagagggggcccagucuuuuggaaaucaaacaagaagaaauggcuguuggucagguccuaggggcagaaaagacccagugagaaccaaauccucaucccaacuccuuaaaacaccucccucuauguacugccucugcucacaaagcuucccagggcucccacuuccguuggggagcaaaaugucuguuccugugccuaaagccuccuuccugaacaccaguacccugaauagggccacaugagacaaaaacagguacagaugucuuggggcccucaccuuggagacaaucuugaagccuagcuuggucacagcccgcagaaagguucgaacauccucaaagcggcugcugaccucagccacuuucaggagaccccugagaaagacagaaaguucuguguaagugcacagacucaugcaugcacacauacauacaugcaucuguguccugggggcucuuacccuggcuucaguacucuauuugccuccucuaggaagucccugauguugguucccaucagugaaaggcaaaacacagccacauccacagacucauccuccagaggaaccuguggagagugagaguguuguauaaggcacacagugcagaagaagaaagccagcacugagauaccaggaugggaaaggggaaggaaggguuagagauuagcauacggagguuggcccuagagcacaagccagauaacauagggguuuaccugggccaugucacacacagugacccuaggguccagagaagccaagucaaagcaaugcacaggguuccggauacuugaagccaagcggcaauccccacagccgaagucagccaccacuagggaugcaggccugagaguggaaggcaagggucacauauuggucugaucugagccuaugacugacccaccacauggcuucucacagucccugacccccauucaccgcuggcgaagaucccuggcgaugcgguccacuggcugcaguggccacuucuucacuuggcucuggaagccgcggugguagagaagaaaagccucagggucuuccuggaagagacgcugugcagcacugcugggcccugaguacaacuguucauugagguagcgaaaucgggccccauccagccgcugugccaugcgggcucgcaaagccccugcccgagccucauggcugucuguccugggaacaggagacaccucugucuucucugugggggccucagcuggggccuggucuggcaccugagguggcugaaacuuguucuuacaucuucucuuguucuuuugccgguuccgccacugcuugcggcuuaauguaugaggggguuuaggggaaguggacccagggcuuugcuuugguggaucauuuguaguacuacccuuccaggcuuugggaccuacagggagggagaugggaaggugcacaugaggcaagaucucuuacauucggagucacggcaagucaucccagccauaccucugucuuugagaucgugacuguggccugcagagaaguacuucuuauugccugaguacaccauuagccccaauccuaauggcaguggauaaucacucuuguauguagaaccagcugaccccccgacacacacacaccaacacacacacauauacacauccaaugguaccuguuuggucaacauuguccaggugcugggcugaauuuauaggggcauguuucuggcauuuccucuuucuuuucucaucuucagcagagucacugccaacaagagccuguuuguggcauuucuucuuccuuucuacuucuuccucagagucacugcaaggugggcccuguuuuugacauuucuucuucccuuucuucccuacuucagcagaggcacuggcaaaugaugccuuuuuggggcauuucuucuuccuuuccuccuccuccuccucagagucacuuauacauaggcuggggggaugcugggaaagagaugcugccucuagggcccguaauguggccaagagcuggcggcgcuuggagcccuggaggaaaacaggggaugacagugggccuaaagagaauggaugaggccuggagaacaagaagggagagauguggaccugauucagacuggcagaagcaucugaauucuucccagucaagccugccagaacccagaagaacuuuuaugucaccaccccaacuucugggaagcuggagagcagagaaaccaccuaucccacuuucuucaauguguaaaugagcuaauggagguuuccccaaaggaaaaugcaaaggccacaagcaacaagaccaaggccagagaccaggaauuccaacccuucaccuugagcuuuugccuagagcugauacauuucuguaagagguaaggaggcuucugaacacaggagacacaugaucacacacguauauuaaauauuuaacaugucucuagcugcaguguagaaaacaaacugaaggggagaaauugcagacagagaggccagcggcuuggacaaugguaauggggcuaggggaugaaaaaggaggaaacaaagcaggccgauuccauguuggaggcagacugaaggguaagaaaagccugaggaagcagggcccucacaucugcagaggcucaaaggagaagauguauugucgggaaggcugauucuguguugcaguccuaccagguaauccuaggccaggcacuuacccugauucuaaguuucccacacccuccuuugaacaaugauacugacaacucuuacugucuccaauccauccuccacacuguaaccgacgacccuuucaaaauacaaaucugaagaaauaauuccauugcuuaaaaccuuucauuggcuucuauucucaauauacgcaaaacuucuaccucuugaacuugaacagcauauaugccccuuucauuuacuauguauuucaaccacaaggaccacuuguguuugugacucugacagaacaugcucucuugucccagggcccuuguacguacuuuuuccugucugaagaacccucuucgcuucaccaacuucuacucaacaacucucucugacccaacgucaguuucuuuuggaaguucucggaucuucagaucaggacucgcccuuaacggugccacaggugucccuccccgcaauacacacagcgcugggauccaccaauguccgcuucgcggccugaaacagcucccauugcucccgcgagucacucaccuuguuuugcgaggaggccgcaggcggaggucgugagauuacgggcccaaggcccgcggcuacuggggccgccucggcccacucaggcucuucgaacaugagggucgggagggcagggucgccgaguccccgcucuucuccacgugcacagcgcuccucuggaagucggagcgcucagaccugccagaaccgacccggaaaccaaagcgugacagccagggguugcuagagcggccggcgcggcgcagcgaaccaucgaguuuagccaggcgcggcuagaagggcagggaggcggugggaggggagggacggaggcccgcgcugcccaagagcgccacgggcggggcggggccggcggcgggcugcgggcgcggccggacgggaguuccccggagaaggauccugcagcccgagucccggugagugcgagaggacccgcgcccccugucaccccucacuucuccugagucccaaguaaggaacggagccaacccuggggaggacccccgguccccucucccagaguauacggagccugaaccuccccacuucccccaacucuguucgcggauagggucuaguugccugcucucggacauccguucagcagacacuaccucuucgucacccccugcccacccugacccgccuuuaccucgcgucuagaggacacagccagggaucaucccgcagccccgaacuccuucacagacccccacuagccggggacgcagcucaggcccccuacccccaacacaaacacuucucuccuguagaggauaaagcuugggguucauccuccuucccuggaucacuccacaguccucaggcuuccccaauccaggggacucggcgccgggacgcugcuauggacgacauuuucacucagugccgggagggcaacgcagucgccguucgccuguggcuggacaacacggagaacgaccucaaccaggggugagcugaaacgguugguggaugagaggaaggcuagagaucuccuggcuacguggaguggagugcucaugucuggugguggcggcugccuuugcuagccaguguaaugagugcuaagcauagccuguggggggcagaggguuuucaca

SEQ ID NO: 15333 - RNA, 5792 nt, Homo sapiens
ugugaaaacccucugccccccacaggcuaugcuuagcacucauuacacuggcuagcaaaggcagccgccaccaccagacaugagcacuccacuccacguagccaggagaucucuagccuuccucucauccaccaaccguuucagcucaccccugguugaggucguucuccguguuguccagccacaggcgaacggcgacugcguugcccucccggcacugagugaaaaugucguccauagcagcgucccggcgccgaguccccuggauuggggaagccugaggacuguggagugauccagggaaggaggaugaaccccaagcuuuauccucuacaggagagaaguguuuguguuggggguagggggccugagcugcguccccggcuagugggggucugugaaggaguucggggcugcgggaugaucccuggcuguguccucuagacgcgagguaaaggcgggucagggugggcagggggugacgaagagguagugucugcugaacggauguccgagagcaggcaacuagacccuauccgcgaacagaguugggggaaguggggagguucaggcuccguauacucugggagaggggaccggggguccuccccaggguuggcuccguuccuuacuugggacucaggagaagugaggggugacagggggcgcggguccucucgcacucaccgggacucgggcugcaggauccuucuccggggaacucccguccggccgcgcccgcagcccgccgccggccccgccccgcccguggcgcucuugggcagcgcgggccuccgucccuccccucccaccgccucccugcccuucuagccgcgccuggcuaaacucgaugguucgcugcgccgcgccggccgcucuagcaaccccuggcugucacgcuuugguuuccgggucgguucuggcaggucugagcgcuccgacuuccagaggagcgcugugcacguggagaagagcggggacucggcgacccugcccucccgacccucauguucgaagagccugagugggccgaggcggccccaguagccgcgggccuugggcccguaaucucacgaccuccgccugcggccuccucgcaaaacaaggugagugacucgcgggagcaaugggagcuguuucaggccgcgaagcggacauugguggaucccagcgcuguguguauugcggggagggacaccuguggcaccguuaagggcgaguccugaucugaagauccgagaacuuccaaaagaaacugacguugggucagagagaguuguugaguagaaguuggugaagcgaagaggguucuucagacaggaaaaaguacguacaagggcccugggacaagagagcauguucugucagagucacaaacacaagugguccuugugguugaaauacauaguaaaugaaaggggcauauaugcuguucaaguucaagagguagaaguuuugcguauauugagaauagaagccaaugaaagguuuuaagcaauggaauuauuucuucagauuuguauuuugaaagggucgucgguuacaguguggaggauggauuggagacaguaagaguugucaguaucauuguucaaaggagggugugggaaacuuagaaucaggguaagugccuggccuaggauuaccugguaggacugcaacacagaaucagccuucccgacaauacaucuucuccuuugagccucugcagaugugagggcccugcuuccucaggcuuuucuuacccuucagucugccuccaacauggaaucggccugcuuuguuuccuccuuuuucauccccuagccccauuaccauuguccaagccgcuggccucucugucugcaauuucuccccuucaguuuguuuucuacacugcagcuagagacauguuaaauauuuaauauacgugugugaucaugugucuccuguguucagaagccuccuuaccucuuacagaaauguaucagcucuaggcaaaagcucaaggugaaggguuggaauuccuggucucuggccuuggucuuguugcuuguggccuuugcauuuuccuuuggggaaaccuccauuagcucauuuacacauugaagaaagugggauaggugguuucucugcucuccagcuucccagaaguugggguggugacauaaaaguucuucuggguucuggcaggcuugacugggaagaauucagaugcuucugccagucugaaucagguccacaucucucccuucuuguucuccaggccucauccauucucuuuaggcccacugucauccccuguuuuccuccagggcuccaagcgccgccagcucuuggccacauuacgggcccuagaggcagcaucucuuucccagcauccccccagccuauguauaagugacucugaggaggaggaggaggaaaggaagaagaaaugccccaaaaaggcaucauuugccagugccucugcugaaguagggaagaaagggaagaagaaaugucaaaaacagggcccaccuugcagugacucugaggaagaaguagaaaggaagaagaaaugccacaaacaggcucuuguuggcagugacucugcugaagaugagaaaagaaagaggaaaugccagaaacaugccccuauaaauucagcccagcaccuggacaauguugaccaaacagguaccauuggauguguauauguguguguguuggugugugugugucggggggucagcugguucuacauacaagagugauuauccacugccauuaggauuggggcuaaugguguacucaggcaauaagaaguacuucucugcaggccacagucacgaucucaaagacagagguauggcugggaugacuugccgugacuccgaauguaagagaucuugccucaugugcaccuucccaucucccucccuguaggucccaaagccuggaaggguaguacuacaaaugauccaccaaagcaaagcccuggguccacuuccccuaaacccccucauacauuaagccgcaagcaguggcggaaccggcaaaagaacaagagaagauguaagaacaaguuucagccaccucaggugccagaccaggccccagcugaggcccccacagagaagacagaggugucuccuguucccaggacagacagccaugaggcucgggcaggggcuuugcgagcccgcauggcacagcggcuggauggggcccgauuucgcuaccucaaugaacaguuguacucagggcccagcagugcugcacagcgucucuuccaggaagacccugaggcuuuucuucucuaccaccgcggcuuccagagccaagugaagaaguggccacugcagccaguggaccgcaucgccagggaucuucgccagcggugaaugggggucagggacugugagaagccauguggugggucagucauaggcucagaucagaccaauaugugacccuugccuuccacucucaggccugcaucccuagugguggcugacuucggcuguggggauugccgcuuggcuucaaguauccggaacccugugcauugcuuugacuuggcuucucuggacccuagggucacugugugugacauggcccagguaaaccccuauguuaucuggcuugugcucuagggccaaccuccguaugcuaaucucuaacccuuccuuccccuuucccauccugguaucucagugcuggcuuucuucuucugcacugugugccuuauacaacacucucacucuccacagguuccucuggaggaugagucuguggauguggcuguguuuugccuuucacugaugggaaccaacaucagggacuuccuagaggaggcaaauagaguacugaagccaggguaagagcccccaggacacagaugcauguauguaugugugcaugcaugagucugugcacuuacacagaacuuucugucuuucucaggggucuccugaaaguggcugaggucagcagccgcuuugaggauguucgaaccuuucugcgggcugugaccaagcuaggcuucaagauugucuccaaggugagggccccaagacaucuguaccuguuuuugucucauguggcccuauucaggguacugguguucaggaaggaggcuuuaggcacaggaacagacauuuugcuccccaacggaagugggagcccugggaagcuuugugagcagaggcaguacauagagggagguguuuuaaggaguugggaugaggauuugguucucacugggucuuuucugccccuaggaccugaccaacagccauuucuucuuguuugauuuccaaaagacugggcccccucugguagggcccaaggcucagcuuucaggccugcagcuucagccaugucucuacaagcgcaggugaccucuggaucuuccuugaaaggggaggcagaucucaaacuccaggcucagaacugugaagacuguuuccagccuggcugugagccaagaccugguuccugguggacccugaggacaaagugugauaaaaccucuggcucagacuugcucuacugaaggcuucuugguuauaagaugcauaaagucacuggggcuagcuaaacaauaaagaguuuauugugagaacauggggauaucugucucaugacacuucagguguuaugaaaacuagaugguuuggaauucaaggcaucuuuagguuuugcucuucuuuccaacuaagaagccacauggccuuccuguccugccaucuccacucugcugucaucugaucugucuacagaucagcuuccucugcucacccauagcuucugcuccuucagcuucaguuugcccaggccuucaagguugcagacaggcagcuguugcuguuugacucugaggcaacugguuguccaccaacaucuuggcucaagacaucagucugagccaccaacuugagacuguuugguuguccccauaccgagcauuucuagugguuuaucuuuccccucuccccucaucuccauuuuuggaaccauauagcaucaagccacucccaacaccuauuguccugugggacuuugggauguauauagcugagagcacagauuuuggaaucagguagaccuggauuuaauucuuggccugcuacccagaggcacuuaaagucauuuaaucucuguauaucacauuccucauuuggaaaaugguagaauuuuugucuugcagggugguuguguggguuaacuggagaaaucuguagccagggcugggaacauaggaggugcucaguaaacuagcuaugacuauuauguguuguaagccuuauuguuuuuugaagaucuucccuaggcugguuggaggcugagggguaaagaauggauuuguugacuaaggaagccucugggagaggcuagaccuuucaacaggccugcuucauaggcuauuuaaugacuuuuaauagauucugagcuucuguccuuggagggguagugagggagcugggucucuguucauaaacaacuuguugaugccaugugggcuugggggcauugggcuguucauuggcggaagagucuguccacuaucucugccuugcaguggacucagaucagcauguccugggaaagcuauaggcaaggugcugagggaaggugaguuugaaugauagauucuaggccucccccaaaagguaucugccaugugcccagguauaaagauauggccucuuguacuuguuuccaggaauaccugacaguacccauugggagaucauagguucuaugcccugagccaguuggaugccucuaauaaggggauggagguuuugaaacaggcuguaguccag

SEQ ID NO: 15334 - RNA, 7774 nt, Homo sapiens
gggacggaggcccgcgcugcccaagagcgccacgggcggggcggggccggcggcgggcugcgggcgcggccggacgggaguuccccggagaaggauccugcagcccgagucccggugagugcgagaggacccgcgcccccugucaccccucacuucuccugagucccaaguaaggaacggagccaacccuggggaggacccccgguccccucucccagaguauacggagccugaaccuccccacuucccccaacucuguucgcggauagggucuaguugccugcucucggacauccguucagcagacacuaccucuucgucacccccugcccacccugacccgccuuuaccucgcgucuagaggacacagccagggaucaucccgcagccccgaacuccuucacagacccccacuagccggggacgcagcucaggcccccuacccccaacacaaacacuucucuccuguagaggauaaagcuugggguucauccuccuucccuggaucacuccacaguccucaggcuuccccaauccaggggacucggcgccgggacgcugcuauggacgacauuuucacucagugccgggagggcaacgcagucgccguucgccuguggcuggacaacacggagaacgaccucaaccaggggugagcugaaacgguugguggaugagaggaaggcuagagaucuccuggcuacguggaguggagugcucaugucuggugguggcggcugccuuugcuagccaguguaaugagugcuaagcauagccuguggggggcagaggguuuucacagaggacgcaguuugagcugaaucuugacugcagaauaagaguuucacaggcagaggcuacagagagcuuuccagccucaguagacugcauggccaaaggcuagggggcaaggcacagagcagagagaacaggaaauugucuggaguuccauauggcuggaggauagaugaucucugugggucggagcauuggguacaagaggaaaagaacaggacauaagacuguagaggucuccaaggaucagccagaucaugcaagcauauuuaggcuauaagaaggucuuuauuuuaaaagcaagguuuuaaagcuguauagugacauaaugagauuguccauuuuucaguaucgucuuggaugcuuugugaagagcagguggaaaggaggcaauugccuaguucaucguagaaguaaugaugucuuggacuagaauuagggugagugaaaaagagaagugaucaaauuccagaagucuuuaggacgaagaauuguggaacuugguguggggagugaguaagggcaaagaugaggaccaggguucuggcuugggaacuugguuguuuuuacugagauggagaaaacuggaggaugaggcauuuuauuuuggacauguuaaaguuaaggugacaauacagcaagguggaaauguugaguguguuguugguuaugcagauuugcaauucaggggaggaaucugacuuggagacacagauuugagagcuaucagcauauagauagcauauauauaucauauauauagaugauacuugaagacgugguugugaaggagaacgucucaggagaguggaaggcaagaggucaggggacaggaagccugcacgacagaaaaggagcaaccgcaaguugaaaaagaaauaggaaaaugugugaguaaagcuuacagaagagaauguuuuaaugaaggggagguagucaacggcaguacaggcuacugagagaucaaagaacauuaauauuuuaaaguagccauugaauuuacaguuggguuuuuuuuuuuuaaguuaagggguacaugugcagguuuguuggauggguaaacucaggucauggagguuuguugugcagaucauuucaucacccagguauuaagccguggcacccauuaguuauuuuuccugaucccucccucuuccuacccgccccacucugguaggccccagugucuguugcuccccucagugugcaguuaggauguauuugaccaucugugaguguuguuucagaauaaugggugaagaaaucagacuacauuggguuccuuaauuuaaggcacuaugaugaacaccuucugugcugggugcuagaguccagaaucugacauaaucucugcucucgauacagcagauuuguggcagauugaaaaguaggccgggcgcgguggcucacgccuguaaucccagcacuuugggaggccgaggcugguggaucacgaggucaggaguucgagaccagccugaccaacauggugaaacccugucucuacuaaaaauacaaaaauuagccaggcgugguggcgugcgccuguaaucccagcuacucggaggcugaggcaggagaacugcuugaacccgggaagcagaggcugcagugagccaagaucaugccacugcccuccagccugggccacagagcaagacucugucuuaaaaaagaaaaagaaaacaaaaguugagaggugagcaaauagugaaagugaauguacaccaguucuacaagguuggcugagauaggaaggcaagaagagcaguagugauggugacucagaguggcaaaaucaaauucuuuauuuuuuaaaauugguggaguuuaguuuuuagguuugacaggucaggaucaccugucaucuuagucuagacuucacugguucccauuagguucuacacuauuucucuuuaauacuuugcaaagucauuuguuccauuuuucauauaauucucaaaggguacccugauaaagacaguaagcacuguuacuguuuuguuggugaggaaauagaggcuuaggcaguugcccagugggccuagcaucuaggaagacucuagcugagucuaggaagacucuaggaagaugcugccagaaggaaaagggguggaauuaaugaaacuggaagguuguggugcugguuugaggaguaaaguaugggggccaaaguuggcuauaugcuggauaugaagaggggguuaauuccuugcaggucuucuugagauagaaguccaggcccugagguggcaggcagccugauagugaacagaacccuugugcccauacuuuugccccccgaguuuggccugcccuggcgccacaggcaguacuggaagcugauaagucagggcacaaauuaaaggucuaggaggcaagaccaacugauaaacagggggcguaaugcuuccuggggauaaucccaucucaaggaaaagcuuuuggcuauuucuguguuagcagaugcgagcaaguuguggaggaaaaugauuaacuuaaaggccacaccccccaaccccuucagcuguacgggcaucuggauggccagaccccugaucagcuccaggccuugccuagagucgcacacaggaagugaccacaacacuaaggcauccggaggcugcuggcccagaccacggaccgcccccugcuccgccccuugaaucugcagccccgaacuggagggaauuuccuuuuauggccccaggcugucaggcaggcccagcuccaaaccaauuguuuuguuuuguuuguauacuuuacuuuauaaaauacauauuucuuggaaaagaaaaaaaucagguauaguuuuaaucccaaaacagccauucucauuuucuucuguuuucuaugcacaggauugcuaaguaggggaauccugcuuugcauggugguuuguuaucuaccucaucaguagucaaaagcauuucuccuuuucaacauaaacccuuccaaaacaucauuuaaauuccauuccauuuuuagauguuaguuucaguaccagagccaaauaguaaguuuguucccucuucuauaaguuguggccugccuucuccaagacacccuucucccccacuaacaugcacugaacagcugcugucaauccauucccucaagaaacuuaaaggucuaacagacaagacaguccauuaacagauuuuuacaauccagugcaacaagugcugaaguagggggacauauaagaugugguggaaaacagaaaggaccaauagauguugcagaaggggugcaagagaaaccaggggaagagcacuaccaccuaaggaaaugagaugugggauauggugaagauaacacauuuuuuuauagagguuguugagauaucuaggugguugguuugguuugaagcucaggggaaggucugaaauggacagcuuugggaguugcuggcaugaaugagaaucaaaguccuagagagguaagccuucccagagaguauguaauuaucaguuuuucaggaaucaaaaccuuugccccaucccaccuccagcucaaugaccauugccccuuccucaaagggacgaucauggcuucucccccuugcacugggccugccgagagggccgcucugcugugguugagauguugaucaugcggggggcacggaucaauguaaugaaccguggggaugacaccccccugcaucuggcagccagucauggacaccgugauauuguacagaagguacguacaaacuccuucgucauccacaucacauacaugccaugagggucagucacaggcacuguaacauacaguagaaagcaugugugcucuucccccuuuucccaugcccugacaccaguaucucauuuggaacugacuguacuuucugccucuucuuuuugucuggccaugggguccagcuauugcaguacaaggcagacaucaaugcagugaaugaacacgggaaugugccccugcacuaugccuguuuuuggggccaagaucaaguggcagaggugaguacucagcccuuaauuccugagauggguaggaaguaaagucugagccuuggugggagauuuuggaacccucaacccauucugucaguacuacugugugacacuuacaggauuaaguucuacauuugugcauucaugguugguucagugacugccagcgagguagcaguggcucucaucauaauggccuuuucauuccaggaccugguggcaaauggggcccuugucagcaucuguaacaaguauggagagaugccuguggacaaagccaaggcaccccugagagagcuucuccgagguccaucucccccauccccuagcuuguguccucucgucccuucccaccugucuucucccucuguaccacagcuuagguuguuuuucuucccuagagcgggcagagaagaugggccagaaucucaaccguauuccauacaaggacacauucuggaaggggaccacccgcacucggccccgugagucaccacugugggaagaaggguuguaaaaggaaauaauccuggccucuuggggcuggguuagggugaagcuggguaccugaccugcccacacucuuaggaaauggaacccugaacaaacacucuggcauugacuucaaacagcuuaacuuccugacgaagcucaacgagaaucacucuggagaggugaccccugcccuucuugcccuucccucacuaaacccccauaaauuacuugcuuuguaccuguuuuaaguuuuuccuccaguuagugggcaaggaaguggcagcaacauuucaagccuccuaaccccuaccuguccugcagcuauggaagggccgcuggcagggcaaugacauugucgugaaggugcugaagguucgagacuggaguacaaggaagagcagggacuucaaugaagaguguccccggcucagguagugcaaggcguaaccuggaagcugcuaguuccaaggaacccugaauagcacugaaagagaucuuuuguacugggucucaaccacucccucccucuucuaggauuuucucgcauccaaaugugcucccagugcuaggugccugccagucuccaccugcuccucauccuacucucaucacacacuggaugccguauggaucccucuacaauguacuacaugaaggcaccagugaguagggauguugaauuuccuuggggaggaaauggcagagagggagccucucugaacuauuugacuuuugccuccucucagauuucgucguggaccagagccaggcugugaaguuugcuuuggacauggcaaggggcauggccuuccuacacacacuagagccccucaucccacgacaugcacucaauagccguaguguaauggugaggccacaagcucacuccuggcccaggccccaaaagcccuuugccuaucuaugacuuaccuccuucuaucuguuuucucuuccucagauugaugaggacaugacugcccgaauuagcauggcugaugucaaguucucuuuccaauguccuggucgcauguaugcaccugccuggguagcccccgaaggugagugaagucaucaugucgggagguaaaaaaggaccaccucagaaguaguggaagggggcagagacaggacaggcaagggggccagaacagacaagcccuaucucuccagcucugcagaagaagccugaagacacaaacagacgcucagcagacauguggaguuuugcagugcuucugugggaacuggugacacgggagguacccuuugcugaccucuccaauauggagauuggaaugaaggugagagcacaacagcauacauuuguguugcgggagugguuggugauggugaaaauaacuguagugggccuuggcuccucacauauuuguucggauauacaguaauccugucccaagggccaguggcuucucucuacaugacagacucaaauugugaggcugcuuuuuuucuuguauucgcagguggcauuggaaggccuucggccuaccaucccaccagguauuuccccucauguguguaagcucaugaagaucugcaugaaugaagacccugcaaagcgacccaaauuugacaugauugugccuauccuugagaagaugcaggacaaguaggacuggaagguccuugccugaacuccagaggugucgggacaugguugggggaaugcaccuccccaaagcagcaggccucugguugccucccccgccuccagucaugguacuaccccagccaugggguccauccccuucccccaucccuaccacuguggccccaagaggggcgggcucagagcuuugucacuugccacauggugucucccaacaugggagggaucagccccgccugucacaauaaaguuuauuaugaaaacaggcugguguggggacauggggacagauaaguacauuuagguuggguggcucaggugaaguagugcggcuucuucacauugaugccauacucgcugagggcaggggucaaguccuccaugguuagaguguacuugcgguccugagggaagagggaagagcaccaacugagcacaggaaucccggacuucaaucccagaugggugacccugaguaagucuuacaccuccccuacgauucaguuuccccaaagggguggcaggauaagccuccacuguuguggaagguaauuacugauucauuaagccuccccucacaccuugcucuugcuccgggagcugccggaggccgugcccuucauuuugcagugcuguagggcaucauuggcaauaucugagaugaauuucugggcagcuaaggagaugagccgaauucuagagagaaaaaacuuagaugagaaggagauggacaacauacugcacaagcacccaaaacuaaccugcccuggguuuacucacaugcgugggucugaggccucaaagccagcacgguucagguaguaaccagucacugcaucugggaucugagaaaucaauuaagagaacugucagc

SEQ ID NO: 15335 - RNA, 6665 nt, Homo sapiens
agagcucaugugauccgucacaugacagcagauccgcggaagggcagaaugggacuccaagccuggugagaaauugagagggcucgggagaaagggaucacguuggagggagcacacauugggagggugggaacacaaggacaacguagcucccacugaaacccaccugcugccccuacagccuccuagggcucuuugcccucauccucucuggcaaaugcaguuacagcccggagcccgaccagcggaggacgugaguugacuuagcacagacugcccccuuccccauacccuguucugccucccacuguccugguccuagcuucucucacccccgugccagcuccuaguacgcacuccauagcuucaucucuauguuccuagccucaguccccuaucauucaccucaugugaucuguaucugcuccuaggauccuccccaaggucucagcuccuaaucuggaaccuuccaugaccaauauuuuccaucuccacccuaaccaaagccaugucccugaccccugacccuacaggcugcccccaggcugggugucccugggccgugcggacccugaggaagagcugagucucaccuuugcccugagacagcagaauguggaaagacucucggagcuggugcaggcugugucggaucccagcucuccucaauacggugccuuuugggacugaggacaggaugugggaugcgguggagggacacagggcuggguugggcaugggauggcgaucaugucagagccugccaagacacuuguguuccucaggcuagaaaccuaaaaggggaugugguucaguauacaggcuuuaugaucaaauacgaacucaaauucugacucugcuacuuacuagcuaccaggcaucuaguacaacuuacguuccuuccccuacccucaaauccauucuaauuuccucuuuuguucacauacuaaggcugccaguucuaacucccaaagagccuuuggauuaaucuccuucuugccgucuuuuguuacgaccaacuccguuauuuauucccacuccuggacuacugcccagcuccccagcugaucugcagucuccucccuccaccccaccccucacuguacucccccacucugcuucaaaacagucucuccaacagucaaaauggauugguuccuucuccugguuaaagcccuucacagcagggggagugugugcuugugaacugcagaggcuggggacggggcagugugacacuagugugcauggcaggaaacagugacucaccaucguguuaagcuuaaaaucaacaaguaugcaaauuugagcuaaacugaauaacugguaccgaaagauuugaaaacauuuaccggacauaagcuuaaaauuaaaauggaaaauuuauauguauuaaccucauucauuuucaugaucauggcaauacaugcuguggugcgacauuugcaacuuacuggccuuuaggguaaauccauauuauuggccauggcauuucaagucucuccagccuuuucuuccucugcuucccaaguacacccuacaccugcacacauagcccuccuuuacccuguuccaggcuuugggaaguccugaugucucauaguugagguccaaaagggggaguuugggaaagcaaugaaugagggcaagugccucuucugaaucccugcaggaaaauaccugacccuagagaauguggcugaucuggugaggccauccccacugacccuccacacggugcaaaaauggcucuuggcagccggagcccagaagugccauucugugaucacacaggacuuucugacuugcuggcugagcauccggugagaggaaaugauugcuccauggagggcaccagucaucccaucagugagauggaugggagggaguugagagcuugcuggggcuugugggugggagcuaaugcauggggagacagugacugacugcccagggaugcucagagguagcuucuucuguuccguuuugagcuuucugaccucuguucucugaccuccagacaagcagagcugcugcucccuggggcugaguuucaucacuaugugggaggaccuacggaaacccauguuguaagguccccacaucccuaccagcuuccacaggccuuggccccccauguggacuuugguaacaccuauggggugaauggggguuggggcacacagauccaggggcugaggaaguuuagaugccauuggggacuggggguggggugaguuguaaggugggcauuacagucuauaagaucuccucaagccugacuucucccuacaguggggggacugcaccguuuucccccaacaucaucccugaggcaacguccugagccgcaggugacagggacuguaggccugcaucuggggguaacccccucugugauccguaagcgauacaacuugaccucacaagacgugggcucuggcaccagcaauaacagccaagccugugcccaggugagccaagcaaagagccccaggguccucauagccuccccacaguguccucaauuccuuaccacccugggacucacccucggacccacgaucucugcucugacucccuccauaguuccuggagcaguauuuccaugacucagaccuggcucaguucaugcgccucuucgguggcaacuuugcacaucaggcaucaguagcccgugugguuggacaacagggccggggccgggccgggauugaggccagucuagaugugcaguaccugaugagugcuggugccaacaucuccaccugggucuacaguagcccugguacuaccaagaggacuggacaguggggaagggggugggagauggguguugaucccugcucccucaagggaaugcuauaagcuggagagagauccugacaacccccagugacuaucuuugugcccaucccucaaaaaaaaaaaaaaaaaaaauccaggccggcaugagggacaggagcccuuccugcaguggcucaugcugcucaguaaugagucagcccugccacaugugcauacugugagcuauggagaugaugaggacucccucagcagcgccuacauccagcgggucaacacugagcucaugaaggcugccgcucggggucucacccugcucuucgccucaggugaccuccuacccuaaacuuagacaaugcuuacaccucugcagccugggagcuuugacuccacagugaucccugagccuggucucugacucauaaucugaacucagaccuuccaguagggaccacugaccugaccucuacacucugaccuccuacaguaacaaauuuccccucugacauccgaacccacauacuaagcccuaaccaauuaauaugaaugcuacacuuggucucucucaggugacaguggggccggguguuggucugucucuggaagacaccaguuccgcccuaccuucccugccuccagguaaguacucuagccuaccacucagguauaaccaccaccuuucacuugugaucucaugauguagaaccuuugucuugaccccaccaugugcuccugugguucagccuuaagcuuugccugcccugguugcuguacuccugucucuucuuccugcaggucccaggccccaaaucucuugugugggauacagcucccauuguuccuuuucgucaguucccaggcauuuuaguggaagauuugguggguguucuguagagaaaagugugcacagucaccucgggccaugccuugaaggcucaaaaucucuuagucaaucccauauacaugcuuccccacagagucuaguuccuccagcaagaccugggcuauacucaccccuccccacauaucuuggagguccccuuggguccccuacuauccaaaugcugucuucuccccucagccccuaugucaccacagugggaggcacauccuuccaggaaccuuuccucaucacaaaugaaauuguugacuauaucaguggugguggcuucagcaauguguucccacggccuucauaccagguacguguguuuguguggauggaugcaggguaagagugaggaugggggauccucaguucagcugacugcugggcaggccacaugccaauacucacucaaaaaugccuuucaggaggaagcuguaacgaaguuccugagcucuagcccccaccugccaccauccaguuacuucaaugccaguggccgugccuacccagauguggcugcacuuucugauggcuacuggguggucagcaacagagugcccauuccauggguguccggaaccucggugagaaucagcccaucuccaaacucucacucaggaacuacccuuacccccuaacaccuugaacaccuugcaccuagaaccccugacuccuuagagaugucugauacuuuaaagcaucacucccaaaaaguccaaucacucagaaccccugaccucuacuugcaccuucacucuuguaggccucuacuccaguguuuggggggauccuauccuugaucaaugagcacaggauccuuaguggccgccccccucuuggcuuucucaacccaaggcucuaccagcagcauggggcaggacucuuugauguaaguauggaagggaaggguguggacguuuucaaacaacuauggggagugcuaagggggacuugggggcaguuagggugguguggaauagccuuugaaaugugaguacagggugaggagauauacucuuuaaguacugguacuaguaggcccagaucugaugccagccuccucccuagguaacccguggcugccaugaguccugucuggaugaagagguagagggccaggguuucugcucugguccuggcugggauccuguaacaggcuggggaacacccaacuucccagcuuugcugaagacucuacucaaccccugacccuuuccuaucaggagagauggcuuguccccugcccugaagcuggcaguucagucccuuauucugcccuguuggaagcccugcugaacccucaacuauugacugcugcagacagcuuaucucccuaacccugaaaugcugugagcuugacuugacucccaacccuaccaugcuccaucauacucaggucucccuacuccugccuuagauuccucaauaagaugcuguaacuagcauuuuuugaaugccucucccuccgcaucucaucuuucucuuuucaaucaggcuuuuccaaaggguuguauacagacucugugcacuauuucacuugauauucauuccccaauucacugcaaggagaccucuacugucaccguuuacucuuuccuacccugacauccagaaacaauggccuccagugcauacuucucaaucuuugcuuuauggccuuuccaucauaguugcccacucccucuccuuacuuagcuuccaggucuuaacuucucugacuacucuugucuuccucucucaucaauuucugcuucuucauggaaugcugaccuucauugcuccauuuguagauuuuugcucuucucaguuuacucauuguccccuggaacaaaucacugacaucuacaaccauuaccaucucacuaaauaagacuuucuauccaauaaugauugauaccucaaauguaagaugcgugauacucaacauuucaucguccaccuucccaaccccaaacaauuccaucucguuucuucuugguaaaugaugcuaugcuuuuuccaaccaagccagaaaccugugucaucuuuucaccccaccuucaaucaacaaguccucaaucaacaaguccuacugacugcacaucuuaaauauaucuuuaucaguccacaaguccuuccaauuauauuucccaaguauaucuagaacuuauccacuuauauccccacugcuacuaccuuaguuuagggcuauauucucuugaaaaaaaguguccuuacuuccugccaauccccaagucaucuuccagaguaaaaugcaaaucccaucaggccacuuggaugaaaacccuucaaggauuacuggauagaauucaggcuuuccccuccagcccccaaucauagcucacaaaccuuccuugcuauuuguucuuaaguaaaaaaucauuuuuccuccucccuccccaaaccccaaggaacucucacucuugcucaagcuguuccguccccuuaccaccccugauacaacugccagguuaauuuccagaauucuugcaagacucaguucagaagucaccuucuuucgugaauguuuugauucccugaggcuacuuuauuuugguauggcugaaaaauccuagauuuucuaaacaaaaccuguuugaaucuugguucugauauggacuaggagagagacugggucaaguaagcuuaucucccugaggcuguuuccucgucuguuaagugugaauaucaauaccugccuuucauaaucaccagggaauaaaguggaauaauguugauaacagugcuuggcaccuggaaguagguggcagauguuaacgcccuuccucccuugcacugcgcccccugugccuaccucuagcauuguaacgaccacguaguauugaaauggccaguuuacuugucugccuuccuuuccaagaccguuggugccuagaggacuagaaucguguccuauuuaacuuuguguucccagguccuagcucaggaguuggcaaauaagaauuaaaug

SEQ ID NO: 15336 - RNA, 9060 nt, Homo sapiens
guuuucaucuccuuuuguguuuucaagugaauagcagaaaaacccuuuaauggugugcuuccuguacugggcuacacagugguguaccaagguauauaugaaaccacaguguaaacaaggcuugucuucccaagacaucaauuuugauagaaaauuguguguguucaugugugugugugugucuguguguaauguacaauauuuaacuugugagaauuaaaaaucuuauuuuucuauuaaacagauauguuguggaacagaaugcaaaaaugucagaaaaguuuaguucuuuccuggaaauguaagcacacaaaccauuucuauuauuaagauaucucagauuuaacuaccaaauuuaaggcugggcucaguggcucacgccugugaucccaguacuuugggaggccgaggcggguggaucaccugagaucaggaguuuaagaccagccugaccaacauggugaaacaccgccucuacuaaaaauacaaaaauuagccaggccugguagcaggcaccuauaaucccagcuacuugggaggcugaggcaggagaauugccucaaaaaacgaaaacgaaaacaaaacgaaaacaucaauaacuaacaaauuuauaucccagaaacuaaaggagagcuacacuaugcccaugcauuuaagagcacagagaggaaagccuuaaggguacagauauuacccaggcaugaacaauagggaaucagcuuugcaggaaguucuuuuuuagaugaagaaggaggaaacaggagaagggaggagucagugaguccaaaagacagagcuaagcagaagaacucaguauaacacauugauucauucaacagacauuuauagaugucuauuuugccucauguucuuuacaggguggugggaaaagugaauuagacguguuugugcucuuaaguaguucacuguuuaguaaugagugcugaacaauauaauuauaccguuguuguaaugaagaauguacaauguaaaacuggacugcaaaagaaaauaaagaaaacaguccuguuuauaauagcauuaaaaagaauaaaaucuuaagaauaaauuuaaccaaggaggugaaaaaucuacauacacacacacacacaaagaucuauacacuuguauacauauguaacaaaccugcauguugugcacauguacccuaaaacuuaaaguauaaaaaaaaaaagaucuauacacugaaaacuaugaggugccaaugaaagaaacugaaaaagaacaaauagcuggaaauacaucccauguuuauggauuggaagaauuaauaauauuaaaauguccauguuacccaaagugaucuacacauucaauucaaucccuaugaaaauuccauggcauuuuucauagauguagaaaaaaguccuaaaauuaguacaggacaacaaaagacuacaaauagaauaaauaaucuugauaaagaacaaaacuggaggcaucaccuuugcugauuucaaacuacauucaaaguuacaguaaucaaaacauuauguaccauacuguuuugcauguacaacuuaaacauagacacacagaccaauaaaacaggauagagaacucagaaauaaacccaugcauguauggucauguggucaacugaucuuuuuuucuuuuuuuuuaauagggucuugcugugucgcccagauuggagugcagaggcacaaucuuggcucacugcagcccugacuucccgggcucaagugaucuucccaucucagccuccugaggagcugggacuacaagcacacaccaccacauucagcuaauuuucuugauuuuuuuuuguagagaugaggucuccggauguugcccagccugguuucaaacucuugugcucaagugauccuccugccccugccucucaaggugcugggguuacaggugcgagccaccaugcccaacuggucaacuaaucuuugaugaggcaccaagaauacacaaugaggaacaaaaaucccuucaauaaauaguauugggaaaacuggauagacauaugcaaaaugacaaaaauggacuuuuguauuacaccauauaaaaaugaauuuggaauggauucaagacuuaaauguaagaugugaaacuguaaaacucuuagaagaaaacauaggggaacagcuccuugacauuggccuuggcaaugauuuuucagauaugacacgaaaagcauaggcaaacaaaauaaaaauaaacaaguuguaccacaucaaacuaaaaggcucuguacaucaaaggaaacaacaaaaugaaaagguaacuuaccgaaugggagaaaauauuugcaaaccauaucugauaaggggcugauauccaaaauauauaaggaacucacacaacucaauagcaagaaaacacaaaaaaucugauuugaaaauagguaaaggaucugaauagauauuuuucuaaagaagaaauacaugaaaaaguguucagcaccacuaaucaucagagaaauguaaaucaaaaccauaaugagagaucauccuacacuuguuagcauggcuguuauaaaaaaagauaagggaugacaaguguuggugaggauguggagaaaggggaacacuuguacacucuuggugggaauguaaauugguacagccacuaugggaaacaguaguaugaagguucuucaaaaaauuaaaaauagaacuacccuaugauccagcaauaccacuucugggaaacaaaaucaggauccugaagagagauaucugcauucccauguucacugcagccuuauuuacaauagccaagauacagaaacaaucuaagugucugucgacacauaaauagauaaagagaaugugguauauuuauauacaauggaauuguauuuagccauaaaaaaggaaauccugcuauucaugacaacguggauaaaccagaagaacauuaugcuaaaugagucaguuagacacagaaagaaaauuacguaugagcucauuuauauuugaaauguaaaaacauugaacucauagaaacagaguagaacagucauugccagggucugagguaugagggaaauagagauguugaucaaagggucuaaacuuucaguuauaagaugaacaaguucuggagaucuaauguacagcauacguggugauggauguguuaacuaaaaaaaaaaaaaaaagaaauuggaucauuggaauagugcugaguuuugcuuggguaauucugucaacacuuuacaaaaaacgcaaccuuucagcuuuuggcuagucuuggaaaauuuauagguguuuucuaucuguggauugguuagaaauauuccagaaaauuggaauauaaaaugugugggaaaugaauuagaaauaugcucacauucuugacaaucauuauaagcauuuaaguucuggaagaggaaggagaccauuucuuuugcuugguauacucaguaguguagcuuaacccuaucucuacaugugguaccauguuuauuguuuguaaagcucagccagagaguugaauauggcauggauguagcuuacuccuccuuauuuaaugaacauauauugagcaccuauuuuguaucaggccuuaugauagaguuaucaagaaugagucccaaucucuggcuucagcaguuuggcugaaugaagggaucaguuaaguagacaggcaacuaguuagguguaugcccacaggauuauaaauaacaguacacaagagaggccugagcccauuuggacggugauguggaguuuggggccucagaaaagugacuucugagcaaauauuugaaugacaaguaggaguggacuugaaagagggcaagcauuauaguagagggaacaucauacaccaaguaguaauauagucagagaauaacaaggaguuucucaugaaggguggcugcaaauagugguaggaaaggaggcugagaaguggccgggaccaggucauagaugaccuuugugucauuaaaugucuggauuuuuauccagcgaaggcggugguuagucacuggaauacuggcuaugaagaguguuuuucaaagaguagauuauaauccauuaguggguuguaaaaucaauuuagugaauuggggccagcauauaaaaggugaacaaguagaaaauaugaggguagaucauauuuguaaagguaaauaacauuuuaugaagauuuuguuucaaucauuuauguuuauggauaaucuguucugauguaaaauguuuuuugaccuguaggucacagucacaauuuuugagaagcacuuguuuaaagguucaguguuacacaaauuaucagauuacuuuuaguaguaauuaacagaaaauucagauccaaaugggaauaaucacuaaaaaagauuauuauuccaacguaacuaggauuccaguuugggagcucuuggugcuguaguuuuaguuguuuuuuuuuuuuuuuuuuuuuuuuuauacuuuaaguuuuaggguacaugugcacauugugcagguuaguuacauguguauacaugugccgugcuggugcgcugcacccacuaacucgucaucuagcauuagguauaucucccaaugcuaucccuccccucuccccccaccccacaacaguccccagagugugauauuccccuuccuguguccaugugaucucauuguucaauucccaccuaugagugagaauaugcgguguuugguuuuuuguucuugcgauaguuuacugagaguuuuaguuguucuaaucugccacucucaguguuaucuucugccuaaagccaguuccccaguggcacuuagaauaacaugccaauuuauucaucuaggcagaauagagcuuagauucucacugccuuaacuuaguuuaggccuguccacuacaacccauucaggaacuaaucuacuguaggaaacuguaaugcaauguggcaaauucaguguauuaucgaaacauagagcaccucagcugacgaagucaugaauuuagcuguggggaugggcggggagccaccuaggugauaccaaaaguuuguguguaaguuacauagguaaaagagagaaggcugucugcacggcagggacugcuuuaacaaaagguuguggacaggggagcugugcacagggaaacauccaaaauaggaacuuuuaugcuucuagagcauagcauuuagaggcaaaggaaguaguuggagugaugaguagaugccugaacaaggaggggagucaugauaaggaucccauaggaaauaagcaacuggagaucaucaccagggaauuaagaugaucagauucccgucaguacagccaaaguguagagggagguaaguuaggagguuguugaaguaacccaggauagagguaucuuggauuucuuacuagggagcaaguugacugcagauuugagaaacauuacggaaauaaacaugacuuguuaauuucagugucaaugaggguaaggaaauaaucucugacuuuucuagucaucuccccaagauaucaggcuuacaguguauuaacuguaaagccuaaacuuguuaccuuuugagaaaggagugaucauuacuuugucuaccuuacuguaaagaacuggcgcccaagacggugggaaccuuugagaguggugcucuuggguuuggaacgcauuaaagaggugccuagauggacuuggggggagcaguccacuaguugaagaaguuauuuauaagccagauuaguaaaauucuuuuuuuuugagacagagucucgcucuguugcccaggcuggagugcaguggcacaaucucagcucacugcaagcuccgccucccagguucacgccauucuccugccucagccuccugaguagcugggacuauaggugcccgcaaccacgcccagcuaacuuuuuguauuuuuaguggagacgggguuucaccguguuagccaggauggucuugaucuccugaccuuaugaucugccugccuuggccucccaaaguguggggauuacaggcgugagccaccgcacccggcaguaaaauucuugaugcuguuacuuuccuuguguuaucccugagccuuuagcaaauguuuuaggauucauguacuuuuauuuggaccaaaacauuaaaggggaagcagugucccuugaggccacugugguaguggcaguggccuguuauugugagcucauugaugguacagguuguuucuuaucucuagucucuauuagaugaacaguggauauuguaucccuucugccuaaauugaugcugggaacuagcagaugcucaaaaagcauguagggaacuguuggaagucccaaagggagauauauuucuggggucuaagaggaaaagcuacaggagcccagccacaauccaucuauuuaaaauaaagaugugguuuuaaggaaagugguuucucuagaaguuagguaugacuccuagauaccuagcuaggguggauauucaugcuaagacagaagagggguauauuuuuuagcagaagcagaguuguagcuuuauuucauaaauguuuugagugucuacuauauuucauuuaaaauauaagagcuuucuggcuauagugugaagaacaaaccauaguagagaaaaagagauaaagagcucuguugggaguagaugaguaucagacuaaggcagcuacagcuaaauuagcaccagaauaguucguucugucacugaagccaugucugcuacaccagugaucccuuuacccuuacucuuacuuauuaucucagacaguggauggguucagugggccaaauacacucagaagauagagccuaagauaaaaucucuucuacccacuuuacuggggauauggcaauuaucaggcacugcuaucaaguguuuggaccaagacugauggcuccuuucuaaguccuuccauaacuacuacccuacuaaagccucugaacccaagggaacggcagccuggcugugccaagaaaggggcucccagcuucucacauucugaagccggauuucccuuuucuggguucccagagaggccagauuugacaacaauaaaaacuuccaggaaauuccuaggagguuuaauuuccuaauccuucucucgcauagacccucuuucuuaccccuuccccucaccaagaggaaggagcuuauccuggagcccaacauccucugcugaaugucuccaccccuuuggccaaacugguggaacaucugaguucuuggguccucuccucccaggcccauucaggggguugaagggaacacauuaagguaaugugugauccugccucaaaacagaggacugauugcaguauccccugaagguucgcaggguacuagauuguuuaaggaaguuucacuugcagauugucacuccccuaccccugucaggaaguaaucuuucucuaagaaaucccaagcacucaucucuaggagaccagaugucaaaacacaaccaccucuggcaacauuuggaauuauaggaugcauucccauguaaacuggcauuaagaaaaacaaaauugcacuaaccaaaaauaacccaaauuuaaggaccagaagcauaagccaugaauuuacuaucucagguagacugagcauuuggauaauucucauucuccagaaaucccacaggaaggaaaaaauaaauaaauuuauauauauucauauaaagacuuuuaucuauugugcaaagagagggucaucuggcuccccagaagguucucaaccccaucaagacuguccauuuuacaucucuagcuccaguucuucucagagaguaaaagugcuccaaaggccugugaucauggguacugauuaagggcugcagacucuucagauccaguuaaaucccugguguuugagcugugugggagcugugguugcuugcuuccuggcuuugccugagguccugccgcaaacccugcagcagcugguuuaggaguguaagguggcugucucugcgaggcagaggcaggggugggaggcaauucccuuuauacucgaucacugccaucuuggcccgauccaaacuccgauuugggaucugcagcauucuuguguagcccccaguuugaucuuuguaccgaggggccaguacuugaaacagcuuugggaucaaauccuucuccuagagggagaauuauccaagagacagcagagucaggcaaaacugcagaggcauuuaacuuuacaccauucccaaagguaagguccauccacacauagaaagaccucccccuccccucgccaaucuggcauagucaguguuacacaaaggggucguuuauaggcaguugugcagagguauauucacaucgacuucaacuaacuuaagacacaguuucuaauuuaguuagcagcacuggcccauaagugaguacccaaguuuaauucugcauaguucuccuuuuuccaacccccacccccagggagcaaagggugggauuuugaaggcagauaggucgcacucacugugagccagaagucagccaugcgcauggcucguucguuagugucucccagcuucccauagucgaugagcugugaggacauaacaucacggauccaaccgagcaagaaaacaaggugccaaucuaauuucucuaaugccggaaggcaauccauucuuuccacuagccaagcaucuccaaucuacgccaccccuaacuccgcagcccuaaccagucuuccauuagaggcgauggaggggcggguucagcccaagguucugggggacucagacuuggggaaugguuuaccagguuggucccggucccuuuccacuugcagccggcuccgcccccucagaccagacccgcagaguggacaagagggccgcgcuccucaccuucuccgcguagccccucauuucguccacacgcgcccauggugccucgaugcguucgugccgcaccagcccugugagcaaguuccgcaacagauggaugcgggacucgggaccgaggcccauacggcgaaauacgcggccaugggagaucgcugcagcgaccgacagccgcauguuuccaacuucugcccgccccuuggaggccggaacuggaaacuggaagguagagccgguggcggcaauuucagggaacgcaugcgccu

SEQ ID NO: 15337 - RNA, 9060 nt, Homo sapiens
aggcgcaugcguucccugaaauugccgccaccggcucuaccuuccaguuuccaguuccggccuccaaggggcgggcagaaguuggaaacaugcggcugucggucgcugcagcgaucucccauggccgcguauuucgccguaugggccucggucccgagucccgcauccaucuguugcggaacuugcucacagggcuggugcggcacgaacgcaucgaggcaccaugggcgcguguggacgaaaugaggggcuacgcggagaaggugaggagcgcggcccucuuguccacucugcgggucuggucugagggggcggagccggcugcaaguggaaagggaccgggaccaaccugguaaaccauuccccaagucugagucccccagaaccuugggcugaacccgccccuccaucgccucuaauggaagacugguuagggcugcggaguuagggguggcguagauuggagaugcuuggcuaguggaaagaauggauugccuuccggcauuagagaaauuagauuggcaccuuguuuucuugcucgguuggauccgugauguuauguccucacagcucaucgacuaugggaagcugggagacacuaacgaacgagccaugcgcauggcugacuucuggcucacagugagugcgaccuaucugccuucaaaaucccacccuuugcucccuggggguggggguuggaaaaaggagaacuaugcagaauuaaacuuggguacucacuuaugggccagugcugcuaacuaaauuagaaacugugucuuaaguuaguugaagucgaugugaauauaccucugcacaacugccuauaaacgaccccuuuguguaacacugacuaugccagauuggcgaggggagggggaggucuuucuauguguggauggaccuuaccuuugggaaugguguaaaguuaaaugccucugcaguuuugccugacucugcugucucuuggauaauucucccucuaggagaaggauuugaucccaaagcuguuucaaguacuggccccucgguacaaagaucaaacugggggcuacacaagaaugcugcagaucccaaaucggaguuuggaucgggccaagauggcagugaucgaguauaaagggaauugccucccaccccugccucugccucgcagagacagccaccuuacacuccuaaaccagcugcugcaggguuugcggcaggaccucaggcaaagccaggaagcaagcaaccacagcucccacacagcucaaacaccagggauuuaacuggaucugaagagucugcagcccuuaaucaguacccaugaucacaggccuuuggagcacuuuuacucucugagaagaacuggagcuagagauguaaaauggacagucuugaugggguugagaaccuucuggggagccagaugacccucucuuugcacaauagauaaaagucuuuauaugaauauauauaaauuuauuuauuuuuuccuuccugugggauuucuggagaaugagaauuauccaaaugcucagucuaccugagauaguaaauucauggcuuaugcuucugguccuuaaauuuggguuauuuuugguuagugcaauuuuguuuuucuuaaugccaguuuacaugggaaugcauccuauaauuccaaauguugccagaggugguuguguuuugacaucuggucuccuagagaugagugcuugggauuucuuagagaaagauuacuuccugacagggguaggggagugacaaucugcaagugaaacuuccuuaaacaaucuaguacccugcgaaccuucaggggauacugcaaucaguccucuguuuugaggcaggaucacacauuaccuuaauguguucccuucaacccccugaaugggccugggaggagaggacccaagaacucagauguuccaccaguuuggccaaagggguggagacauucagcagaggauguugggcuccaggauaagcuccuuccucuuggugaggggaagggguaagaaagagggucuaugcgagagaaggauuaggaaauuaaaccuccuaggaauuuccuggaaguuuuuauuguugucaaaucuggccucucugggaacccagaaaagggaaauccggcuucagaaugugagaagcugggagccccuuucuuggcacagccaggcugccguucccuuggguucagaggcuuuaguaggguaguaguuauggaaggacuuagaaaggagccaucagucuugguccaaacacuugauagcagugccugauaauugccauauccccaguaaaguggguagaagagauuuuaucuuaggcucuaucuucugaguguauuuggcccacugaacccauccacugucugagauaauaaguaagaguaaggguaaagggaucacugguguagcagacauggcuucagugacagaacgaacuauucuggugcuaauuuagcuguagcugccuuagucugauacucaucuacucccaacagagcucuuuaucucuuuuucucuacuaugguuuguucuucacacuauagccagaaagcucuuauauuuuaaaugaaauauaguagacacucaaaacauuuaugaaauaaagcuacaacucugcuucugcuaaaaaauauaccccucuucugucuuagcaugaauauccacccuagcuagguaucuaggagucauaccuaacuucuagagaaaccacuuuccuuaaaaccacaucuuuauuuuaaauagauggauuguggcugggcuccuguagcuuuuccucuuagaccccagaaauauaucucccuuugggacuuccaacaguucccuacaugcuuuuugagcaucugcuaguucccagcaucaauuuaggcagaagggauacaauauccacuguucaucuaauagagacuagagauaagaaacaaccuguaccaucaaugagcucacaauaacaggccacugccacuaccacaguggccucaagggacacugcuuccccuuuaauguuuugguccaaauaaaaguacaugaauccuaaaacauuugcuaaaggcucagggauaacacaaggaaaguaacagcaucaagaauuuuacugccgggugcgguggcucacgccuguaauccccacacuuugggaggccaaggcaggcagaucauaaggucaggagaucaagaccauccuggcuaacacggugaaaccccgucuccacuaaaaauacaaaaaguuagcugggcgugguugcgggcaccuauagucccagcuacucaggaggcugaggcaggagaauggcgugaaccugggaggcggagcuugcagugagcugagauugugccacugcacuccagccugggcaacagagcgagacucugucucaaaaaaaaagaauuuuacuaaucuggcuuauaaauaacuucuucaacuaguggacugcuccccccaaguccaucuaggcaccucuuuaaugcguuccaaacccaagagcaccacucucaaagguucccaccgucuugggcgccaguucuuuacaguaagguagacaaaguaaugaucacuccuuucucaaaagguaacaaguuuaggcuuuacaguuaauacacuguaagccugauaucuuggggagaugacuagaaaagucagagauuauuuccuuacccucauugacacugaaauuaacaagucauguuuauuuccguaauguuucucaaaucugcagucaacuugcucccuaguaagaaauccaagauaccucuauccuggguuacuucaacaaccuccuaacuuaccucccucuacacuuuggcuguacugacgggaaucugaucaucuuaauucccuggugaugaucuccaguugcuuauuuccuaugggauccuuaucaugacuccccuccuuguucaggcaucuacucaucacuccaacuacuuccuuugccucuaaaugcuaugcucuagaagcauaaaaguuccuauuuuggauguuucccugugcacagcuccccuguccacaaccuuuuguuaaagcagucccugccgugcagacagccuucucucuuuuaccuauguaacuuacacacaaacuuuugguaucaccuagguggcuccccgcccauccccacagcuaaauucaugacuucgucagcugaggugcucuauguuucgauaauacacugaauuugccacauugcauuacaguuuccuacaguagauuaguuccugaauggguuguaguggacaggccuaaacuaaguuaaggcagugagaaucuaagcucuauucugccuagaugaauaaauuggcauguuauucuaagugccacuggggaacuggcuuuaggcagaagauaacacugagaguggcagauuagaacaacuaaaacucucaguaaacuaucgcaagaacaaaaaaccaaacaccgcauauucucacucauaggugggaauugaacaaugagaucacauggacacaggaaggggaauaucacacucuggggacuguugugggguggggggagaggggagggauagcauugggagauauaccuaaugcuagaugacgaguuagugggugcagcgcaccagcacggcacauguauacacauguaacuaaccugcacaaugugcacauguacccuaaaacuuaaaguauaaaaaaaaaaaaaaaaaaaaaaaaacaacuaaaacuacagcaccaagagcucccaaacuggaauccuaguuacguuggaauaauaaucuuuuuuagugauuauucccauuuggaucugaauuuucuguuaauuacuacuaaaaguaaucugauaauuuguguaacacugaaccuuuaaacaagugcuucucaaaaauugugacugugaccuacaggucaaaaaacauuuuacaucagaacagauuauccauaaacauaaaugauugaaacaaaaucuucauaaaauguuauuuaccuuuacaaauaugaucuacccucauauuuucuacuuguucaccuuuuauaugcuggccccaauucacuaaauugauuuuacaacccacuaauggauuauaaucuacucuuugaaaaacacucuucauagccaguauuccagugacuaaccaccgccuucgcuggauaaaaauccagacauuuaaugacacaaaggucaucuaugaccuggucccggccacuucucagccuccuuuccuaccacuauuugcagccacccuucaugagaaacuccuuguuauucucugacuauauuacuacuugguguaugauguucccucuacuauaaugcuugcccucuuucaaguccacuccuacuugucauucaaauauuugcucagaagucacuuuucugaggccccaaacuccacaucaccguccaaaugggcucaggccucucuuguguacuguuauuuauaauccugugggcauacaccuaacuaguugccugucuacuuaacugaucccuucauucagccaaacugcugaagccagagauugggacucauucuugauaacucuaucauaaggccugauacaaaauaggugcucaauauauguucauuaaauaaggaggaguaagcuacauccaugccauauucaacucucuggcugagcuuuacaaacaauaaacaugguaccacauguagagauaggguuaagcuacacuacugaguauaccaagcaaaagaaauggucuccuuccucuuccagaacuuaaaugcuuauaaugauugucaagaaugugagcauauuucuaauucauuucccacacauuuuauauuccaauuuucuggaauauuucuaaccaauccacagauagaaaacaccuauaaauuuuccaagacuagccaaaagcugaaagguugcguuuuuuguaaaguguugacagaauuacccaagcaaaacucagcacuauuccaaugauccaauuucuuuuuuuuuuuuuuuuaguuaacacauccaucaccacguaugcuguacauuagaucuccagaacuuguucaucuuauaacugaaaguuuagacccuuugaucaacaucucuauuucccucauaccucagacccuggcaaugacuguucuacucuguuucuaugaguucaauguuuuuacauuucaaauauaaaugagcucauacguaauuuucuuucugugucuaacugacucauuuagcauaauguucuucugguuuauccacguugucaugaauagcaggauuuccuuuuuuauggcuaaauacaauuccauuguauauaaauauaccacauucucuuuaucuauuuaugugucgacagacacuuagauuguuucuguaucuuggcuauuguaaauaaggcugcagugaacaugggaaugcagauaucucucuucaggauccugauuuuguuucccagaagugguauugcuggaucauaggguaguucuauuuuuaauuuuuugaagaaccuucauacuacuguuucccauaguggcuguaccaauuuacauucccaccaagaguguacaaguguuccccuuucuccacauccucaccaacacuugucaucccuuaucuuuuuuuauaacagccaugcuaacaaguguaggaugaucucucauuaugguuuugauuuacauuucucugaugauuaguggugcugaacacuuuuucauguauuucuucuuuagaaaaauaucuauucagauccuuuaccuauuuucaaaucagauuuuuuguguuuucuugcuauugaguugugugaguuccuuauauauuuuggauaucagccccuuaucagauaugguuugcaaauauuuucucccauucgguaaguuaccuuuucauuuuguuguuuccuuugauguacagagccuuuuaguuugaugugguacaacuuguuuauuuuuauuuuguuugccuaugcuuuucgugucauaucugaaaaaucauugccaaggccaaugucaaggagcuguuccccuauguuuucuucuaagaguuuuacaguuucacaucuuacauuuaagucuugaauccauuccaaauucauuuuuauaugguguaauacaaaaguccauuuuugucauuuugcauaugucuauccaguuuucccaauacuauuuauugaagggauuuuuguuccucauuguguauucuuggugccucaucaaagauuaguugaccaguugggcaugguggcucgcaccuguaaccccagcaccuugagaggcaggggcaggaggaucacuugagcacaagaguuugaaaccaggcugggcaacauccggagaccucaucucuacaaaaaaaaaucaagaaaauuagcugaaugugguggugugugcuuguagucccagcuccucaggaggcugagaugggaagaucacuugagcccgggaagucagggcugcagugagccaagauugugccucugcacuccaaucugggcgacacagcaagacccuauuaaaaaaaaagaaaaaaagaucaguugaccacaugaccauacaugcauggguuuauuucugaguucucuauccuguuuuauuggucugugugucuauguuuaaguuguacaugcaaaacaguaugguacauaauguuuugauuacuguaacuuugaauguaguuugaaaucagcaaaggugaugccuccaguuuuguucuuuaucaagauuauuuauucuauuuguagucuuuuguuguccuguacuaauuuuaggacuuuuuucuacaucuaugaaaaaugccauggaauuuucauagggauugaauugaauguguagaucacuuuggguaacauggacauuuuaauauuauuaauucuuccaauccauaaacaugggauguauuuccagcuauuuguucuuuuucaguuucuuucauuggcaccucauaguuuucaguguauagaucuuuuuuuuuuuauacuuuaaguuuuaggguacaugugcacaacaugcagguuuguuacauauguauacaaguguauagaucuuuguguguguguguguauguagauuuuucaccuccuugguuaaauuuauucuuaagauuuuauucuuuuuaaugcuauuauaaacaggacuguuuucuuuauuuucuuuugcaguccaguuuuacauuguacauucuucauuacaacaacgguauaauuauauuguucagcacucauuacuaaacagugaacuacuuaagagcacaaacacgucuaauucacuuuucccaccacccuguaaagaacaugaggcaaaauagacaucuauaaaugucuguugaaugaaucaauguguuauacugaguucuucugcuuagcucugucuuuuggacucacugacuccucccuucuccuguuuccuccuucuucaucuaaaaaagaacuuccugcaaagcugauucccuauuguucaugccuggguaauaucuguacccuuaaggcuuuccucucugugcucuuaaaugcaugggcauaguguagcucuccuuuaguuucugggauauaaauuuguuaguuauugauguuuucguuuuguuuucguuuucguuuuuugaggcaauucuccugccucagccucccaaguagcugggauuauaggugccugcuaccaggccuggcuaauuuuuguauuuuuaguagaggcgguguuucaccauguuggucaggcuggucuuaaacuccugaucucaggugauccacccgccucggccucccaaaguacugggaucacaggcgugagccacugagcccagccuuaaauuugguaguuaaaucugagauaucuuaauaauagaaaugguuugugugcuuacauuuccaggaaagaacuaaacuuuucugacauuuuugcauucuguuccacaacauaucuguuuaauagaaaaauaagauuuuuaauucucacaaguuaaauauuguacauuacacacagacacacacacacacaugaacacacacaauuuucuaucaaaauugaugucuugggaagacaagccuuguuuacacugugguuucauauauaccuugguacaccacuguguagcccaguacaggaagcacaccauuaaaggguuuuucugcuauucacuugaaaacacaaaaggagaugaaaac

SEQ ID NO: 15338 - RNA, 941 nt, Homo sapiens
agugugcuggcagcauguauuuucccaggacccuccucaaggcccgcaugaccuccuuauuccucaggcuguagaugaguggauucagggcuggagugacaauuguguagaaaacagagaugauguugucuugucuggugcuguggaaggaacugggcaagacauacaugaauguggcagcuccauagaacaucccaaccacagucaggugggaagagcaggugacaagggcuuucuuccuccccucauuugauggcauauggagcacagugaguagaauuuguguauaggaggccaguauagcagcaagagagggaaucaggaaggucacacccaucacauauaccaugagcucauaucuggagguaucagcacaggccaccuucagcaagugugggaucucacagagaagaugccugaucuccugggcccugcagaagggauagugcaugguauacacgguauauauuagggcacuuagggaugccaggauccaggacguggccaccaugagccagcaggcucuugagcucaugagggucauguaugucagaggaugacaaauggccacauaccugucauaggccaugaaggccaguaggagguccucagcaccacccauugucagugccaggaacaucugaagggcacagccuccaaaggagaugguguuuucucugcgcagaaaguccgcaagggccuugggagugacaacagaugugaacaggagguccaugagagagagcugcccaagcaggagguacaugggcauguggagccgggcuuccauggugauagccaggagcaguaggccauugcugaucagggccaacaaguauaggauuguaauuguagcacagagcaguucaggagacccacugucauucagaauccccaccaaaaugaagccacuucccaaggugaaguuccagagcuccaug

SEQ ID NO: 15339 - RNA, 953 nt, Homo sapiens
cauggagcuccggaacuccaccuugggaagcggcuucaucuugguggggauucugaaugacagugggucuccugaacugcucuaugcuacauuuacaauccuauacauguuggcacugaccagcaauggucugcugcuccuggccaucaccauagaagcccggcuccacaugcccauguaccuccugcuugggcagcucucucucauggaccuccuguucacaucuguugucacucccaaggcccuugcggacuuucugcgcagagaaaacacuaucuccuuuggaggcugugcacuucagauguuccuggcacugacaauggguagcgcugaggaccuccuacuggccuucauggccuaugacagguauguggccauuugucauccucugaaauacaugacccucaugagcccaagagucugcuggaucaugguggccacauccuggauccuggcaucccugauugcuauaggacauaccauguacacuaugcaccucccuuucuguguguccugggaaaucaggcaucugcucugugagaucccacccuugcugaaguuggccugugcugauaccuccagguaugagcuuauaauauacgugacaggugugacuuuccucuugcuccccauuucugccauuguggccuccuacacacuaguccuauucacugugcuucguaugccaucaaaugaggggaggaagaaagcccuugucaccugcucuucccaccugauuguggucgggauguucuauggagcugccacauucauguaugucuugcccaguuccuuccacagccccaaacaagacaacaucaucucuguuuucuacacaauugucacuccagcccugaauccacucaucuacagccugaggaauaaggaggucaugcgggccuugaggaggguccugggaaaauacauacugcuggcacauuccacgcucuagg

SEQ ID NO: 15340 - RNA, 1396 nt, Homo sapiens
cauggacaaugaauugguuauuuuaucaauaaaucuguaaacacuuauccagugcuuacagaaugggggaccccacagggacccagacacguggcacaguuuucagggagauggcugugcacagcugcugucauuccuuuccuucaggaugaaaaaagaugaucagggagaucccauuuagguagucagaauuaaguaugauuaccuggaagagcuggcuugaugggaauuuagcagggacagcuguaggcaugggcauaaaagcuggaaagcagugcagacagccaauuaacuaacaauuaggaucagaugccuuagugauaaggcaucuggugaggauggggcagaggucugccaaaagguauguaugguaaaaguuaaagccgugaccaaguagguugaguccauaugaugauagaccaugauuucuacuguguggcugguggccagccccugaggcugucuaagcaaaagggugccuggugcagggcuguguuugcauuccaucaguuccucaacuuuggucagaaucagaaucacccgaauggcuagaucagccauaaaggucaggcucucuacuuacaggaggcugggccucuugcuugauuaguucucagggugguucugauuaacagcaaaguuugaggaccacgagauaggugaaucuucagugcagagugaauggggagggcuguucggaggaggguaaccgguuaggaggcuauuguagucaucuagggugagguaauacagggacaggugaggcugugugagcagaugagaucaccaguagcgugaguuuggagagaagugcucuggucuuauucagcagcauuuggugcaccugacugcgcccucuauccagaaacccuuugguucgcuuaugggugccacucucacuucuggcugcuccuccugucuccuuuguccauuccucuucuccccgguggcugcaugguggaguguuucagggaguccuggggcuuccucuguuuuuauaccacuucuuaagucacuucaugcaauugcuuaaauacaucuuuaugaagaugccucccaaauugacaucuccaucccagacuucucuguaaacaucagacuccuauuuccaaauggcuacucagcguaacuuccuaggugucuauaggccucuuaagcugaacauuucuaaaaccaaucuccugauuucacccccagacaccccacauuguugcuccugcaggccuccacauucucuagguacucagggcaaaaaccguguaggcacacuugacucugcucucucaugcccauguccaguuuaucaguaaaucuuaugggcuuuguccccaagguauaucaggaauuagaacaucuaauucauuacggucugagucacuucaucucuugccggguu

SEQ ID NO: 15341 - RNA, 8823 nt, Homo sapiens
gacugccuagcacgucccccacagagccacacuucaugggcugucugcuuuguacuugaguuuauuucacaaaaccacggagaaagauacugaaauggagcucuuuccagccuccaagcaaggaggccccagcagccagucuccagccccuugagcccuuuuuguuaggcccacacccaaaagaggagaaccagugugugcgcgaagguacauggcaaggcacuuuugaaaacaucccaguuuaccguggugaaauugaacuuacucugaaacagaugaaaagggacaugcaaaauugcugagcacguggagguguuaguaggugaaaaucauguccuggguauaacccagcuucuccagguuagggugagccgccgucuggauuagugguggcgggccacacaccaggaugagcguggacuucgcuggaggaggaaggugcuccuugaucaugucggcaguaacgaagccugagcuguacuuccagccugaaaugaaggagaugcaggagcaagcugagcgaugccagguggaguuccugaucccaggccgccugcacacccacccucagccagggaggaggugacaagcugcucuacaaaggcuuagaagucuguacuacugcucccugcaaaaagccucagaacuaguaaacagcccucugcagcaaucaccccaggucccaggcucacugcagggacccugaagcccugcugcugucugucagcugucagcauugacgaggaaggagaacacaacgagguauaccgaggugugugaaucaguacagccagcuggaguuguccggcaggguguggccugguguuaguggaacugcgcagaauugcucaguaggguagcgcccucugccgaccagggaccuguaugacaagcagguacagccgggagcagugugagaggcgcgccuguggggugcucugugcacagugguugcugggaugcugucugggcugcagcagcugucugggggcucagcauguccaggugaggugggcgguaaggggugugguggccguaagcagaagggugaguggugaaggggucagugcccauauuagauguguaugugauggcuguguggaauggguggguguucacaguggacaggggcagugucccuuuugauguucagugcagcgugaggugcugcugauguauuagacaccugcucucgauugcccuuaaaagcaggccaucccaaauccuuucucccucaauuucucacauuucccaucuggagccagagccccaggcuuaacccccacaucugguccuacaaaacuaaaacaaaacaaagagacagagaccaguccucaaaguggucaaggguuggugcugacccauggugagugagggcaauggaugucguaccaaugggaggccuguccaggguguaccacagguugaacuggucugggugaguccuggcaauuucuucaagcucuuuucugaccaagauauccuccucugucuagaaaagaagcaacacugaaaaagccccuccagggccauccucuuguucccuggacugacuacaccggucagcauacuccuggccaaagcugccaccacuccagcuggagugcucgcugccaacucccacggcaaacaagaguucugcugcugcuccugaagcucaaacccuuuguuuuguggaugaaguuccuccauguggaugaagaaccuccaugggauguagguucccauggagcugcagugaccgccuccaacuagaaggaccuuagccaagcgcuggccaggauggcuucacucggagcuccagcccugccuccuacaucuacacugagcucuagcacagcaaaccuaacuggaacaagcucagugcaggcccaggaucuucuggaagaaauguaaugggcucagaaaguccugugauagaacagcacuggauaugugaaggagaggaaaacagucuggagccccauuugggggaaagggaaccaaagccaaaaauaaccugucacagccucaaagauaacugcacagaagaccuggaucuuaaaacuccucaugauucucaucccagucauuccacuucugggauucuguuuuagaaaauaaucuaaaaguaaucaagcguaggcacaauuauucaucaccauauuauuuagaacugaaaacagccugaauguggaaguuaguaaauuauagugcaacuugauaaaaacuaugaugaaaauauuuauaaagcaucuuaaagagaagaaaaugccuguugugguaaugcugagugaaaaaaaaaaagcauauauaaauuacaaauauauaacauauauagaaaaaagauuuaaaaaguaaguaaauauuuauauucuguauuuucugaaguguccacugaggacaucugugauuuuacacuuagcaaaaauacagcaguacaucuuaaggaaaaaaggaaugcuuagugcuuagggcuggcugaggagacacaaaagaguuaaauacaugcaaaaagcaggccuggacucagcuucuccagcugccagcagcccuguugaucccacuaagcccucccacagaugcaggcacccaagcagcaugagcucagucaaugcaggagaaaugaaaacaagagcccagcucagcaaacauuccauccuaccacugcaagcucagcaggaacugaccugguuggcaaagaugagggacauccugguccugucacugggguccuuggugauguggcgaaugagcugcaacaugggugugaugccuggaacacagugagcgagcagccagcuuucucccugucucugaagcccacagucccugaccugcagcaagcuucauaccuucccccagcccaaguuauccuuuucucacuucuguccccaaaacucaaagcaggaaacagcccuucauuuugguuuuccuuucuaaugcaacaguaagucagguagucuuucucauuuucauauggcaagauggaaagaacacucuaaguucuucaguguccucauucaucaaacaaugacggguaaaugugaucguuuuaagaaugccuauuacagugccuggcacauuguaugucuccuucaaagacugcucucuuucuucaggcagucauuuucaagggauggggagagucaggcuugaacuggaucuaggagccccugggacagcaugggugggccugcccagcuugcccccaagccugaccugaaagguccccacaaggcuccugagcagccaccauauugguuaggggaagcaggguacacagggucaguuucaagaccugucacugguucaucguucccaccuucuacagcuggaggcgaaaucucucauguugucccuuagaggaucaaaugacucccaagucagaaugggucucggggcucacucucuggauggagccccuagaagccucuuaccugugcccccagcaaucauucccaggugaucggccaguguuuuuuuaggcucacucgucuggucuggucugauuccaagauucccuggaaacacagagaaugcuuaugaccucugcaguucuugccuaaagagacugcaaaagaucacugacauuccuuaggacucccaggaggcacguccagcuaagggacugucugcaccauuuuaagcuggagaagcaggccagggcagucuccucagcuagcccuggugcuccagugcacaaagugggaauagagccugggcuuggucggggaaucgccgggccuucuguucugaggaaaaagaggggcaagcugaaguuaacacagagacucaaagagcauucucacucacggaggugaaccagugaguaaacaauggcuaugugaguaaccaaggagcauggacucccuccauccauuuuucaguauuagcaggcaccauuuauguaucaggcauugugcuggagauuuugauacaaugacgaggaaacaccaagucauuccccuaccuuacaaaagcugacaaccucaugaagugggugugugaauguguaacaagugugaucauuaugcauugugugugaaugaaugaagacuaaggacaaccccaugugacucaaaucugaggaguguacgagaacaauggaaccauugcaggaaucuuccucccagcugggagcccaaguauuaaccccuccaguaccuggcccaugguaaaacaagcguccccuuggcccucgaaaaaagauggucuccccgauuuucauguucuccaaauacugagucaucuucccaccuucaggauauuggggguguacauuuuugaaguagaucugaaaagcaaggcagcacugcuuucacauucccagacacaaugccacagccacguacaacuagaaaaugcauuuacugcuggaagcuuugcagagaaaguguucuccucucugaauuguuguacgcaaucccugaagaugaagcugccacaagguuaacuguagcuucacugcuggaaagcccugccuagggcauaugugcccucagagaaaaagcacugccccuccaccccaccacccucaguaggcuuggaagcacgagcuagccagauauggugggcacuauuuaccuuuauaauuagguccacaaagccucugucaucaucacuggagacagggguguaagcccugaccaccaauucauuaucgauuuuugccaagagcuggacauaguuaccuauagaaaaggcaucaagcacugagucaaagcauauuuagcuuaaauaaggcccaggaauaaaggacugagcuucagugaagggagcaaauacugggggcacaauguuaagaggggugggaagaagagagcagggaaggaacccaaauaugggaugcccggauccuaggccugcccugccucccugugcuacccuaggcaagucacuucaccucucuggguuuuggucucuucaucuguaaaaugggggugauaugucugcccaccugugaucuuaguguaacugcuuuuuggagcaggaaaagaucauuaaaguuggagagugaguauuaaaaauuacagaaaggggucagacaugguagcucacgccuguaaucccagcccagaggcggguggauugcuugagcucaggaguucgagaccagccugggcaagauggcgaaaccccaucucuacaaaaaaauacaaaaaauuagccaggugugguggugcacacccacagucucagcuacuugggaggcugaggugggagcaucaccugagcccaggaggucgaggcugcagugagcugagacugugccacugcauuccagccuggacgacagaaugagacccugucucaaaaaaaaaaaaaaaauuagaaaggaauauuugucuauucaagaaaaauauguggccuucacaaacuccuuucuuccuaaacuggauguaucacugagaucugugaauaaauuacaacuacuccaucuguauccugguacuaggcacagagcaggccugggcucacagauacuacagggcccuaggauuuggguacccauggagcaaaugaaacaacaauaucaugucuuccuggccuauggccuugugaggaguagcagugaaguuuuuaaccauguaacucugcccuuccuggguagaauucaauaaaccagguguggccagagaccuauggaucaugacuacaucccacugucagaugacacacugggcagcuacgaccuguuggauccaaaaugugagacucaaauuacuaaggcaauuaguggcagggacaggagugcaaucaagagauacuaagagcuagaggcaagagaaaguuuuguaacccuaacccuugacuaacuuccuguauguauguagucaguuuacucccucaguuucuacucgcucagaaacugaguggacuacauacgggaaauuagucgagacaaggaagauggaacagagagauggauagaaaccaagaccuaaggugcagggaggaggaggaggcaggaggagaaaaaagcaggcagaguaggcacuagaggggcuggucccugaagcugauucaaggggaugagccaagucuuugaggugccaacacucugggcucagaacaggcucaaugacucuggucauggucccucugggcaccagggauagccaggaguaagugagacaccuagcuuccuucugagaaccugaaacuggaaaccuggaaaggcucuuucauaugcagccaccuaggccuggccugaggguguccccagggcaaauggggcucccuggcugguccuucaagccccaucucuaacuugcuucacuuccacugggcugggacgaagcagcgaacucugaggccucauauuagacucucccagaggccucuacauuaccuugucccacuaacuuugcacggccuaggccaaggcugaggagauagugggucaaggcaguuucuaagcaauucucuaucucaaaguuuuucauucuuuuaggcuuccugccaacaggaccugccugacaggccgagcagggagcugagagacggcacgcacaacacugagcucucgugcauagagauggagugagggaacagcaaggaggcucaggggcccagcgagcuggcuagaguguaaucucaccaccugauagagcugaggucaagguuuuggccugugcauauaagacaaauaggccacggaguaggauccaccaggcaggcaagcagcacuagcagauuauacaaagcugcucugaaucccugauucuagcaguuuucuacugcacuaagacugacucagcuaucuagugguguuacagauuagaaaugggauaacucaacucuaggacuccuagggcuggaaucugcaacucguagggcuggucccuccuuaugugggucugaggccccugcagagaaucuaagugaccuugggggcagggcacaccugacucauuccugccuacccgcacauucugggccuuuccccgaccacugguuccucccaucccucccaggugcacaauacuuuguaguuucugaauuuucauauccaucagucacucuacuuucacaacaacccaagugagguagacaggcaggccugggaaaucccauuucauagacugaggcucagagagauugaaggacuucccuuaaguuccccagcaaggagccuuccaugagauuuuaggccuuuuggcucuagguucaguucuuuucaaugcucacugagguaccacucucgugucagcccaauuggaauaaugaagaaaagaaauuuucugucccacauccaucccccuaucuaucucccugagcucacaggcucaggaggagcaagagggcaucuuccacaccucaggacgugggaaaccuguguuucuguuaagagaggagggccuagcccccagaggccccaguccuggugaugacccaagcccggcucaccuacaggaagcccuaagacaugguccggcgaaggcaguccaaagcggaaccuccggguguuguggcugauuuucugauaaaacaaaacauaggcagguucugucagcuuucuagaagccuugcugggcagcugagaugccugggaaaggagguccguuuggcgcuauuccagcacacacacacacacacacagggcggcggggagugaacuggaggccaugagaugacugucuggaugcccugccaucccagccaucauccacuuacugccuuccacccacagggcugacccauuaccucuuucucaaucaagggcagcggguacuuggcuucaggguccuguaaggugauuggcucucuccuccuggaguucaugcucuucaggaccaacacgagcacagugaccccagugacggugauggucaggagcagggacggguccuggcagacacaaugugaacagagcaccucaggucuugcccgcccuggacagggcagcucucaggcgcagaacacccuccccacaccaaaggcacaggagcugagcucugccugcaggaaauaggcaaagagaacaguagugacacagaaggcggcugggagagccugucguggaccagaggguagggaggggucagcugcaggucacacaggaaggauguuucaggccccuggagcaggcagcacacauggccuggggugcucaggucacuaggccccuccuggcuacagccaaagguucauacacuggaagucccuuccuugaggugaagggggaggacaucaccccuaacacacaauccggaaugaggggcccagucccuaaagacagaacuagggugcguagcucuaagaggugccccgugacuuagggccuggggacuccccaacagucuccuggacagggcgaagggggccugggcacucaacugccagagacucgggagccuccccgcaucugucccuacccuacaaggccgcccugcuccucucccaacucaagcccgacagggaaaguugccucuccucccgccgggucacuggagucucagccuuccggaauccgagccggcccgccccacuccccgcccuucgcggucccgcccacgaccucuccccacgccucccgcuccggcccccaaccucccggucggacguucguucccggcucuagccggccuccgcgccucuggccucuuuccuuccggccgucccgacggagauauuucuucaauacuccauaaauacaccccgccgcggaacccacccggagugagacgcccaacacgucgucgaacugggguuggccgggggccgcuccccgccgcgggcccgcagacucguggcgucgccccgcagcuccgccuggccgacggggaaccggccgagacccggacacgcacgcccgggaggacaaaagcgcgggcggac

SEQ ID NO: 15342 - RNA, 8823 nt, Homo sapiens
guccgcccgcgcuuuuguccucccgggcgugcguguccgggucucggccgguuccccgucggccaggcggagcugcggggcgacgccacgagucugcgggcccgcggcggggagcggcccccggccaaccccaguucgacgacguguugggcgucucacuccggguggguuccgcggcgggguguauuuauggaguauugaagaaauaucuccgucgggacggccggaaggaaagaggccagaggcgcggaggccggcuagagccgggaacgaacguccgaccgggagguugggggccggagcgggaggcguggggagaggucgugggcgggaccgcgaagggcggggaguggggcgggccggcucggauuccggaaggcugagacuccagugacccggcgggaggagaggcaacuuucccugucgggcuugaguugggagaggagcagggcggccuuguaggguagggacagaugcggggaggcucccgagucucuggcaguugagugcccaggcccccuucgcccuguccaggagacuguuggggaguccccaggcccuaagucacggggcaccucuuagagcuacgcacccuaguucugucuuuagggacugggccccucauuccggauuguguguuaggggugauguccucccccuucaccucaaggaagggacuuccaguguaugaaccuuuggcuguagccaggaggggccuagugaccugagcaccccaggccaugugugcugccugcuccaggggccugaaacauccuuccugugugaccugcagcugaccccucccuacccucugguccacgacaggcucucccagccgccuucugugucacuacuguucucuuugccuauuuccugcaggcagagcucagcuccugugccuuugguguggggaggguguucugcgccugagagcugcccuguccagggcgggcaagaccugaggugcucuguucacauugugucugccaggacccgucccugcuccugaccaucaccgucacuggggucacugugcucguguugguccugaagagcaugaacuccaggaggagagagccaaucaccuuacaggacccugaagccaaguacccgcugcccuugauugagaaagagguaaugggucagcccuguggguggaaggcaguaaguggaugauggcugggauggcagggcauccagacagucaucucauggccuccaguucacuccccgccgcccugugugugugugugugugugcuggaauagcgccaaacggaccuccuuucccaggcaucucagcugcccagcaaggcuucuagaaagcugacagaaccugccuauguuuuguuuuaucagaaaaucagccacaacacccggagguuccgcuuuggacugccuucgccggaccaugucuuagggcuuccuguaggugagccgggcuugggucaucaccaggacuggggccucugggggcuaggcccuccucucuuaacagaaacacagguuucccacguccugagguguggaagaugcccucuugcuccuccugagccugugagcucagggagauagauagggggauggaugugggacagaaaauuucuuuucuucauuauuccaauugggcugacacgagagugguaccucagugagcauugaaaagaacugaaccuagagccaaaaggccuaaaaucucauggaaggcuccuugcuggggaacuuaagggaaguccuucaaucucucugagccucagucuaugaaaugggauuucccaggccugccugucuaccucacuuggguuguugugaaaguagagugacugauggauaugaaaauucagaaacuacaaaguauugugcaccugggagggaugggaggaaccaguggucggggaaaggcccagaaugugcggguaggcaggaaugagucaggugugcccugcccccaaggucacuuagauucucugcaggggccucagacccacauaaggagggaccagcccuacgaguugcagauuccagcccuaggaguccuagaguugaguuaucccauuucuaaucuguaacaccacuagauagcugagucagucuuagugcaguagaaaacugcuagaaucagggauucagagcagcuuuguauaaucugcuagugcugcuugccugccugguggauccuacuccguggccuauuugucuuauaugcacaggccaaaaccuugaccucagcucuaucagguggugagauuacacucuagccagcucgcugggccccugagccuccuugcuguucccucacuccaucucuaugcacgagagcucaguguugugcgugccgucucucagcucccugcucggccugucaggcagguccuguuggcaggaagccuaaaagaaugaaaaacuuugagauagagaauugcuuagaaacugccuugacccacuaucuccucagccuuggccuaggccgugcaaaguuagugggacaagguaauguagaggccucugggagagucuaauaugaggccucagaguucgcugcuucgucccagcccaguggaagugaagcaaguuagagauggggcuugaaggaccagccagggagccccauuugcccuggggacacccucaggccaggccuagguggcugcauaugaaagagccuuuccagguuuccaguuucagguucucagaaggaagcuaggugucucacuuacuccuggcuaucccuggugcccagagggaccaugaccagagucauugagccuguucugagcccagaguguuggcaccucaaagacuuggcucauccccuugaaucagcuucagggaccagccccucuagugccuacucugccugcuuuuuucuccuccugccuccuccuccucccugcaccuuaggucuugguuucuauccaucucucuguuccaucuuccuugucucgacuaauuucccguauguaguccacucaguuucugagcgaguagaaacugagggaguaaacugacuacauacauacaggaaguuagucaaggguuaggguuacaaaacuuucucuugccucuagcucuuaguaucucuugauugcacuccugucccugccacuaauugccuuaguaauuugagucucacauuuuggauccaacaggucguagcugcccagugugucaucugacagugggauguagucaugauccauaggucucuggccacaccugguuuauugaauucuacccaggaagggcagaguuacaugguuaaaaacuucacugcuacuccucacaaggccauaggccaggaagacaugauauuguuguuucauuugcuccauggguacccaaauccuagggcccuguaguaucugugagcccaggccugcucugugccuaguaccaggauacagauggaguaguuguaauuuauucacagaucucagugauacauccaguuuaggaagaaaggaguuugugaaggccacauauuuuucuugaauagacaaauauuccuuucuaauuuuuuuuuuuuuuuugagacagggucucauucugucguccaggcuggaaugcaguggcacagucucagcucacugcagccucgaccuccugggcucaggugaugcucccaccucagccucccaaguagcugagacugugggugugcaccaccacaccuggcuaauuuuuuguauuuuuuuguagagaugggguuucgccaucuugcccaggcuggucucgaacuccugagcucaagcaauccacccgccucugggcugggauuacaggcgugagcuaccaugucugaccccuuucuguaauuuuuaauacucacucuccaacuuuaaugaucuuuuccugcuccaaaaagcaguuacacuaagaucacaggugggcagacauaucacccccauuuuacagaugaagagaccaaaacccagagaggugaagugacuugccuaggguagcacagggaggcagggcaggccuaggauccgggcaucccauauuuggguuccuucccugcucucuucuucccaccccucuuaacauugugcccccaguauuugcucccuucacugaagcucaguccuuuauuccugggccuuauuuaagcuaaauaugcuuugacucagugcuugaugccuuuucuauagguaacuauguccagcucuuggcaaaaaucgauaaugaauugguggucagggcuuacaccccugucuccagugaugaugacagaggcuuuguggaccuaauuauaaagguaaauagugcccaccauaucuggcuagcucgugcuuccaagccuacugaggguggugggguggaggggcagugcuuuuucucugagggcacauaugcccuaggcagggcuuuccagcagugaagcuacaguuaaccuuguggcagcuucaucuucagggauugcguacaacaauucagagaggagaacacuuucucugcaaagcuuccagcaguaaaugcauuuucuaguuguacguggcuguggcauugugucugggaaugugaaagcagugcugccuugcuuuucagaucuacuucaaaaauguacacccccaauauccugaaggugggaagaugacucaguauuuggagaacaugaaaaucggggagaccaucuuuuuucgagggccaaggggacgcuuguuuuaccaugggccagguacuggagggguuaauacuugggcucccagcugggaggaagauuccugcaaugguuccauuguucucguacacuccucagauuugagucacaugggguuguccuuagucuucauucauucacacacaaugcauaaugaucacacuuguuacacauucacacacccacuucaugagguugucagcuuuuguaagguaggggaaugacuugguguuuccucgucauuguaucaaaaucuccagcacaaugccugauacauaaauggugccugcuaauacugaaaaauggauggagggaguccaugcuccuugguuacucacauagccauuguuuacucacugguucaccuccgugagugagaaugcucuuugagucucuguguuaacuucagcuugccccucuuuuuccucagaacagaaggcccggcgauuccccgaccaagcccaggcucuauucccacuuugugcacuggagcaccagggcuagcugaggagacugcccuggccugcuucuccagcuuaaaauggugcagacagucccuuagcuggacgugccuccugggaguccuaaggaaugucagugaucuuuugcagucucuuuaggcaagaacugcagaggucauaagcauucucuguguuuccagggaaucuuggaaucagaccagaccagacgagugagccuaaaaaaacacuggccgaucaccugggaaugauugcugggggcacagguaagaggcuucuaggggcuccauccagagagugagccccgagacccauucugacuugggagucauuugauccucuaagggacaacaugagagauuucgccuccagcuguagaaggugggaacgaugaaccagugacaggucuugaaacugacccuguguacccugcuuccccuaaccaauaugguggcugcucaggagccuuguggggaccuuucaggucaggcuugggggcaagcugggcaggcccacccaugcugucccaggggcuccuagauccaguucaagccugacucuccccaucccuugaaaaugacugccugaagaaagagagcagucuuugaaggagacauacaaugugccaggcacuguaauaggcauucuuaaaacgaucacauuuacccgucauuguuugaugaaugaggacacugaagaacuuagaguguucuuuccaucuugccauaugaaaaugagaaagacuaccugacuuacuguugcauuagaaaggaaaaccaaaaugaagggcuguuuccugcuuugaguuuuggggacagaagugagaaaaggauaacuugggcugggggaagguaugaagcuugcugcaggucagggacugugggcuucagagacagggagaaagcuggcugcucgcucacuguguuccaggcaucacacccauguugcagcucauucgccacaucaccaaggaccccagugacaggaccaggaugucccucaucuuugccaaccaggucaguuccugcugagcuugcagugguaggauggaauguuugcugagcugggcucuuguuuucauuucuccugcauugacugagcucaugcugcuugggugccugcaucugugggagggcuuagugggaucaacagggcugcuggcagcuggagaagcugaguccaggccugcuuuuugcauguauuuaacucuuuugugucuccucagccagcccuaagcacuaagcauuccuuuuuuccuuaagauguacugcuguauuuuugcuaaguguaaaaucacagauguccucaguggacacuucagaaaauacagaauauaaauauuuacuuacuuuuuaaaucuuuuuucuauauauguuauauauuuguaauuuauauaugcuuuuuuuuuuucacucagcauuaccacaacaggcauuuucuucucuuuaagaugcuuuauaaauauuuucaucauaguuuuuaucaaguugcacuauaauuuacuaacuuccacauucaggcuguuuucaguucuaaauaauauggugaugaauaauugugccuacgcuugauuacuuuuagauuauuuucuaaaacagaaucccagaaguggaaugacugggaugagaaucaugaggaguuuuaagauccaggucuucugugcaguuaucuuugaggcugugacagguuauuuuuggcuuugguucccuuucccccaaauggggcuccagacuguuuuccucuccuucacauauccagugcuguucuaucacaggacuuucugagcccauuacauuucuuccagaagauccugggccugcacugagcuuguuccaguuagguuugcugugcuagagcucaguguagauguaggaggcagggcuggagcuccgagugaagccauccuggccagcgcuuggcuaagguccuucuaguuggaggcggucacugcagcuccaugggaaccuacaucccauggagguucuucauccacauggaggaacuucauccacaaaacaaaggguuugagcuucaggagcagcagcagaacucuuguuugccgugggaguuggcagcgagcacuccagcuggagugguggcagcuuuggccaggaguaugcugaccgguguagucaguccagggaacaagaggauggcccuggaggggcuuuuucaguguugcuucuuuucuagacagaggaggauaucuuggucagaaaagagcuugaagaaauugccaggacucacccagaccaguucaaccugugguacacccuggacaggccucccauugguacgacauccauugcccucacucaccaugggucagcaccaacccuugaccacuuugaggacuggucucugucucuuuguuuuguuuuaguuuuguaggaccagauguggggguuaagccuggggcucuggcuccagaugggaaaugugagaaauugagggagaaaggauuugggauggccugcuuuuaagggcaaucgagagcaggugucuaauacaucagcagcaccucacgcugcacugaacaucaaaagggacacugccccuguccacugugaacacccacccauuccacacagccaucacauacacaucuaauaugggcacugaccccuucaccacucacccuucugcuuacggccaccacaccccuuaccgcccaccucaccuggacaugcugagcccccagacagcugcugcagcccagacagcaucccagcaaccacugugcacagagcaccccacaggcgcgccucucacacugcucccggcuguaccugcuugucauacaggucccuggucggcagagggcgcuacccuacugagcaauucugcgcaguuccacuaacaccaggccacacccugccggacaacuccagcuggcuguacugauucacacaccucgguauaccucguuguguucuccuuccucgucaaugcugacagcugacagacagcagcagggcuucagggucccugcagugagccugggaccuggggugauugcugcagagggcuguuuacuaguucugaggcuuuuugcagggagcaguaguacagacuucuaagccuuuguagagcagcuugucaccuccucccuggcugagggugggugugcaggcggccugggaucaggaacuccaccuggcaucgcucagcuugcuccugcaucuccuucauuucaggcuggaaguacagcucaggcuucguuacugccgacaugaucaaggagcaccuuccuccuccagcgaaguccacgcucauccugguguguggcccgccaccacuaauccagacggcggcucacccuaaccuggagaagcuggguuauacccaggacaugauuuucaccuacuaacaccuccacgugcucagcaauuuugcaugucccuuuucaucuguuucagaguaaguucaauuucaccacgguaaacugggauguuuucaaaagugccuugccauguaccuucgcgcacacacugguucuccucuuuugggugugggccuaacaaaaagggcucaaggggcuggagacuggcugcuggggccuccuugcuuggaggcuggaaagagcuccauuucaguaucuuucuccgugguuuugugaaauaaacucaaguacaaagcagacagcccaugaaguguggcucugugggggacgugcuaggcaguc

SEQ ID NO: 15343 - RNA, 927 nt, Homo sapiens
gauggagauuggaaaccauaccacagugacagaguuuauuauuuugggguuaacugaggauccuacacuuugugacaucuucuuugugauauuucuaggaaucuacauugucaccuuaauaggcaauaucagcauaauaaagaagcuguucccaacuucacacucccauguaccuguuccucagccacuuggcuuuuguggacauagggcuugccacaguagucacaccuauaaugcuuaugggauuccuaagacguggaacagcccucccugucacuagcugugaagcccagcucuguucuguagucauguuugggacgucugaaugcuuccuacuggcgaccauggccuaugaucgcuauguggccaucugcucaccccuggugaacuccacccacuugucccccauaaucugcauacucuuaguggggguuugcuaccuggguggaugugugaaugccucaacauuuacuaguuguuuauugagucugucuuucuguggaccaaaucagauagaucauuuuuucugugauuucucuccuuuguugaaacuuuccugcucaaauaucuccauuccugaaauuaucccuuccaucucuucuggaucuaucauuguggucacaguauuugccauagccaucuccuacaucuacauccucaucaccauccugaagaugcgcuccgccgaggggcgccacaaggccuucuccaccuguaccucccaccucgcugcgguuacucucuacuauggaacgauuaccuucauuuaugugaugcccaaauccaguuacucaacuagccagaacagauugauaucgcuguccuacacagugguaauccccauacugaaccccuuuaucuauagucugaggaacagagauguaaaggaggcacuaagaaaggcaacugucagaauauauucuuagg

SEQ ID NO: 15344 - RNA, 497 nt, Homo sapiens
cauggucaaccccaccguguucuucgacauugccgucgacggcgagcccuugggccgcgucuccuuugagcuguuugcagacaaggucccaaagacagcagaaaauuuucgugcucugagcacuggagagaaaggauuugguuauaaggguuccugcuuucacagaauuauuccaggguuuaugugucaggguggugacuucacacgccauaauggcacugguggcaaguccaucuauggggagaaauuugaagaugagaacuucauccuaaagcauacagguccuggcaucuuguccauggcaaaugcuggacccaacacaaauggaucccaguuuuucaucugcacugccaagacugagugguuggauggcaagcaugugguguuuggcaaagugaaagaaggcaugaauauuguggaggccauggagcgcuuuggguccaggaauggcaagaccagcaagaagaucaccauugcugacuguggacaacucgaau

SEQ ID NO: 15345 - RNA, 925 nt, Homo sapiens
uucaggaaaaccaauguguucuugccaucaauuuucucauggccucuuucaccuccuuauuccugagacuguagaugaggggguucagcaugggaaucaccaccguguagaucacaaaugccaccuugaccugauccgcugaauagcuugacuugggcaucacauaaacaaacaaaauggucccauagaacaaagugacugcagugaggugggaagcgcagguggagaaagccuucuuccuucccucaguagagcacaccuucaggauggagugaaggauguagauguaggacacgauuaugguaaacagcgugcugauaaggacagaugcagaggagauggcaggggauauuucagcaauguaaacauggccacaagaaagcuucaagagugggaagaggucacagaaaaagugguugauuuuauuuggaccgcagaaggacagguucaucaaacagccuguaaaagacgaagcguucaggcauccacccagguaggaggcucccaguaggaggaagcagacgacugggggcauuuggauggaguaaagcaggggagagcagauagccacauagugaccagcaggaagcacucugugguuccaaacaugacaucagagccaagcugugcuauacagccugugacaggaauagucguuuucucucuuaagaaauugaugagaaugauuggcguaacugauauggaauacccaauguccacagaagccaaauggcugagaaaaagguacauuagcgugugaagcugugggcugcuuuggauuaagaggauuaugcuaauauuucccgguauaguaacuauauaaacugcuagaaaaaacacgaagaaaauggcacauagcauaggauugucuguuaaucccaaaauaaugaacucugucacuguuguauuguuuucagucuccauc

SEQ ID NO: 15346 - RNA, 3162 nt, Homo sapiens
gauuaaauuuuuauuucaugagguaagacuuucgauuugugggugaaucugguguaaugaguuucauuugagaacacuuuauucucuaaaguuguauguguacacacaagucauaauuaagaaacaaaacagauguaaucuugcagucagcuagcaaguaacuuuagugaauuaaauuaaguuucugccaucaauuuagugugaguuaacaggcaugauucaauuuaccaagauucuucauuuauccacccauaagaacagaaacucacguggucuuucacugccgucuaaacuuggcacucagcuguaaugcuaauauaaauuaauuaagugugagucucacuuugucacccaggcugggagugcagugcugugaucuuggcucacugcgaccucugccucccagguucaagugauucuccugccucaggcucccgaguagccgggauuauaggcaugcaccacuaugccagcuaauuuucguauuuuuaguacagaugggguuucacgguguuggccaggcuggccucgaacucuugaccucaagugauccacccaucucagccucccaaagugcuaggauuacagaugugagccaccaugccuggcccaagacacuuuuuuuuuggagacagggucucacucuaucacugaggcuagaguguagugguguaaucauggcucacugcagccuugaccucccaggcucaggugauccucccaccucagccuccuaaguaacugagacuacaggugcacaccaccgugccuggcucauuuuuagagaugaaguuuugccauguugcacagguuggucucaaauuucuggacuccagugaucuguccaccucggccucccaaaguauugggauuacaaaugugagccaccauggcuggcccagcuagacauuucggagaaagauaaggcuauaaggccagaaaacuuggagaugagggucaagcuggccaucaacagaguggcccuugguaaacuuuuuauauuucuaggcugaaacuuuguucuucuguauauuauguccaaaauaauauuauuugauucuauaauacuucaauuuguuaacauuguuacacuaggaaaagauuugguuugacuaaauaucuuaauuauguucugaauauuaaucauacaacauuuugcauaaugguuaaauugguauuucaacuuacuugauauaauaauauuuuaauuggaaauaauaaaagucauuaaucaauuuauacuaggugacuucauucauaagcauaacuugaaauucccauuucuucccuguccuaugaagaaaauuguaugucucuuuuaaaaaacuaguguuguuuaacugauaaacauuguaaacuauguaacuagcuaggcgucucuuuuauacaucaguuguacauuucagagaacugaaauguuaaucuguuaucuacugauuuucaaguguaccagauuucaugguaaaaauucuccaacuaugcuauaaauguaaugguuuuacaauuuuauacaaauuauacaauuuuauacaaauuacauuaauaacauaguuauuauggaaauugacuggauucaaacuaugugggauucugauccagauucuaccacuugcuguguaaccuuagguaaauuacuuaacauuugcaaacuuaguuucccuaucuauaaaaugguaauaauaaaagugcuucauauuauuuuauggaaauuaaaauacguaucucuguauauauaauguauauaauacaauaauauguuauauauuauaugcauauagauaaaauucuuaacccugagccaguaauuugauaggcauucaguaaauguuagcuaauauuuguguucauuaaucuuacauuaauauauuuuaaucauuuuuguuauauguaccauaccuuuuauuauucuuauaagucuuauguuuuaaaaucuuucucuuuaaagcaacuuuaaauauauuucauuaaaaauacaaauugaaaaggauauacauuauuugaagcaauuuuuugguguucuaaaacagauuuuaaaauauagaaagacugauuacacauaaauacauaaacaaugaaacccuaagguaaaaaaaaaaaagucugaacuuuccuugaaugauacaucuguucauauuaaccuucauguauauauuaaugaagaugaagccaucaaauuuauaacauuuuaaugugcuguucucauuaggguucauuuagucagcagcuacuucgucucaugaauucccugaaggacgggaaucacaccgcucugacgggguucauccuauugggcuuaacagaugauccaauccuucgagucauccucuucaugaucauccuaucugguaaucucagcauaauuauucuuaucagaauuucuucucagcuccaucauccuauguauuucuuucugagccacuuggcuuuugcugacauggccuauucaucuucugucacacccaacaugcuuguaaacuuccugguggagagaaauacagucuccuaccuuggaugugccauccagcuugguucagcggcuuucuuugcaacagucgaaugcguccuucuggcugccauggccuaugaccgcuuuguggcaauuugcaguccacugcuuuauucaaccaaaauguccacacaagucaguguccagcuacucuuaguaguuuacauagcugguuuucucauugcugucuccuauacuacuuccuucuauuuuuuacucuucuguggaccaaaucaagucaaucauuuuuucugugauuucgcucccuuacuugaacucuccuguucugauaucagugucuccacaguuguucucucauuuucuucuggauccaucauuguggucacugugugugucauagccgucugcuacaucuauauccucaucaccauccugaagaugcgcuccacugaggggcaccacaaggccuucuccaccugcacuucccaccucacugugguuacccuguucuaugggaccauuaccuucauuuaugugaugcccaauuuuagcuacucaacugaccagaacaagguggugucuguguuguacacaguggugauucccauguugaacccccugaucuacagccucaggaacaaggagauuaagggggcucugaagagagagcuuguuagaaaaauacuuucucauga

SEQ ID NO: 15347 - RNA, 1094 nt, Homo sapiens
ccacuuuucucaccuuuauuuaucaaugcuguguaauuuuuuuaaauguucaggcucuuuuuuugucuucugagggaaaaccccaaauacacugccuaguguuuuucuuagggcuaucugcauuucuuuguuucucagacuguacacgaugggguuaagcagaggcaucaguauuguauauaucauggccgucagcaugucuucaucgaaggaguugcuguucuugggccucaaauagacaaagcaagcaaauccauaguguauggacacaacagugaggugggaggagcaaguugagaaggccuuagaccuccccuuugcagagggcaucuuuaugacuaugaacacaaugaagacauaggaaaucauaauuaaaauacagcugcccaccaacacaaaggcagagagcacaaaaauagccauuucaugauagaaaguguaauuacaagcaagggagaccacuggugagauaucacagaaauagugcuggauaguguucaagucgcaaagagacaaguugaauacagugacgaugaugcacagagaaaacaggaacccaaccauccaagaagccaucaucaucugcaagcagaucuuucuugucauaagggugugguacugcaguggguuguggauggccguguagcggucguaggacauagcggccaugaugaaacaguuguuggaugcaaagcccagaaagaaaaacaucuguguggcacacucaggaagagaaauggucuugcucucugauagaaaguccaccaacaugcgagggauuacuaccacagugguacaaguuucugaaaaggacaggccacagaggaaaaaguacauaggagugugaagguuguggcugagcuugauggcccccauuauggacacguuugcagcuaggauggucacauguagaagagaaucaccacaaaaaguagacucugcaggucugaaaaacuggaaaauccccacagaaggaauaggcucacugcagugugauugcccauccuccuggugggcacggccacugucuaucaauggugcagaggggcucuuggucacaagucugagaucacuguauaaagcuucuuaugcac

SEQ ID NO: 15348 - RNA, 947 nt, Homo sapiens
aaugaaaagacaaaaucaaagcugugugguugaauucauccuccugggcuuuucuaacuuuccugagcuccaggugcagcucuuugggguuuuccuaguuauuuauguggugacccugaugggaaaugccaucauuacagucaucaucuccuuaaaccagagccuccacguucccauguaccuguuccuccugaaccuaucugugguggaggugaguuucagugcagucauuacgccugaaaugcugguggugcucucuacugagaaaacuaugauuucuuuugugggcuguuuugcacagauguauuucauccuucuuuuuggugggacugaauguuuucuccugggagcgauggcuuaugaccgauuugcugcaauuugccauccucugaacuacccagugauuaugaacagagggguuuuuaugaaauuaguaauauucucauggaucucagggaucaugguggcuacugugcagaccacuuggguauuuaguuuuccauuuuguggccccaaugaaauuaaucaucucuucugugagacucccccgguacuagagcuugugugugcagacaccuucuuauuugaaaucuaugccuucacaggcaccauuuugauuguuaugguuccuuucuuguugauccucuugucuuacauucgaguucuguuugccauccugaagaugccaucaacuacugggagacaaaaggccuuuuccaccugugccucucaccucacaucugugacccuguucuauggcacagccaauaugacuuauuuacaacccaaaucuggcuacucacccgaaaccaagaaacugaucucauuggcuuacacguugcuuaccccucugcucaauccgcucaucuauagcuuacgaaacagugagaugaagaggacuuugauaaaacuauggcgaagaaaagugauuuuacacacauucugau

SEQ ID NO: 15349 - RNA, 8949 nt, Homo sapiens
caugccaaacacauaaccaacuucucuaccuacaauauucacuuccuaguuucugugugaucuaaaacauuuuccucccuuccacccggcaauaaacucacauaagaugaaauuaauuuacaaaagguaggcuccguuuauuagagucacacacaacugacuaucucagugugacucaagaccacaaaaaacccauuucuccuucacuucugaguccugggguuaauaccuagaccagcaaguguacugcuugggguccauucacagguuuacaaguuuuucauugagugcaaucugugacugugugagguuggccagguaggucaccaucaaaagguccuggaagacaaagaauacacaaugagugggggguuggguggaaagggagcaaaaaggcuggcuuuggccagcucuaugguagacacuggguaugaggacagcuguggauaaaugacagcuaggagagacugaauaaaagucaaaaagguagaagacagaaaggaaaugcuugagaaggcuuucuuaucucuacugauacacuuauagacuaggggugccuuagcugaaacccauggauggaauauagggggucugugaacucagaugggggaaauaaguaauugcauuuucauuaaccucugaauuuuaguguuucuuuccaucacgaauuuagacaguaagucacaguaguaucagcaguaaaugagacaauggaaucaugggagaaggaaggaagucuccaaccacgcauaacacaccucuuccuuccucccaaccuggacuucaguggggcuauaggugaagcccugucucuauccuacuccaggucaccucacccaacucuuuucacauuugaguguaugugcugaggugggggaagaaaccaggcaagaaggggcucaggaagggcacucacauugauguugcuguugagcauggucucaaagucaucgggaacuauuuucgguacuugguuaaccaggcucaucaggaagcggcccacaguauugucagcugacaccuuuccagacugaguaccaaaacaaagacucgaugaggcaguuaauuauaaccacugagcccuaccauuucaucagcacaugccucagugaucccaggauagagaacuauguccucccccuuuguuuuuucuuuccccucucaccaguacauccucugcauauugcaacacuguacucagggcauccuggaugcgagcugaugccccuccuacuugcugcaagucacuugagaguccaaucacucuguuggggcuaaagcaggucuucaugaucaggucaacuauggaaguugguuggcaggguggcagcggcaguggugggcaguaagagagagaauucagucaucccaccaggaaagagauggucuuaacguccuacuaacucuguuucccaacuccccuuagacucagucugcucagucacacuuccugcugugcccuuaucagcuuuucuuccuccuaauagagcucaacuccuuuuaccugguaugcucaucaccgguuuugaucucaugugaaugguauguggccucuggugcugaucauuucccaccuuuaacaguuucucaaauaacuccuuaaaucccauuuauacaagagaugacugugacuucuagucuucacaaaccuuagaucaauagucccuuuucaaaccacccaaggccuccguccauguugcagacuagcagcccccuucccugaaaaugccuauggccucucgcgaguguauggaaagguuacucaccuccgaugcguucagugucguaguacgcguauuucacugucagaggcgugaacaucacucccaugguccucccagggacucccauuaaagugcugcggaaggagaagccaaaguaaacagauggccuugggagaggguuuccaugucuauucugggcugagaaagcagauacagcaggaauauggcucucaagguucugauagaaagggugggaccaaaugaaccccagaggucucaugggagcaaaaguuacuuucuccccuuagcuuuucccacauaccaaacccuugaucuguaaggggggccuuugcauuuggccuggucccuuuagaggauuacuucacacacggugcagugucagugacgagaggacaggacucaauuaccccguagagcuggcugucuagacagcuaccuaccauggaaaggagacagagacaaaucuuuucggggacuacgcccuucaucagcauugaaaaaggaaaccaacuccugcccaccaaauuacauugggugcuauaagucaucucacuaaagguauucuuuuuacuaugucaauuauauaccuggaucuauacuuuacuaugucaacuauauauaucuuucucuaucuacauauauauacauauauauaguuggaucuuauauauauauuguauauacuggauccauauauauauauauacuggaucuugaggagucugaaauaccugggaagguuaagaagucaggcaauggcuagugcuuagugguaugccaacuggcucauaaagacuuggcauccaccaucuuugucuuacuguguacuguguaagaguuaacuggcuaugucagugucagacacagaaccagcacaaaaucaacagccugacagaugcacuaacagcugccuucccuuugaccauggucuuuccaacuaccacagcugcuuccucagcaugccaccagggccuuucccaacaucccccauaacuggcauuuuaaccaccugcaagcucaacguguucacuguaaugucauugucauuaaaacugcacucaauccuggguuaauaaauguguucaaaauaaggacagucauccuuauaaucuguauuacccugagcgcugugcugaguucuagagauaaugacaaacuaauggguaauucagaaaaguaaugaauguggugaaggaucaugacaagaauaccaugugaugauuggcuguaggaacuauggaauaguuagguccuacaaaagaugacuugacagcuugcucaaauacuuaaaagggcaaugaguagaaacuggaguacaacuaggaucagcgguagaaauuacaggaacagauuuuguuucagagugaaaccuuuagaauaacuguugagagagaggaacaggcuuccuaaggacacagcaaguuacacauggaaggaauuaaccuugcuuggggugggggagggauggcaucugggcaugguuuuaugcccuuguagcccaagacuguggucaccugacguaggcuuugaugcucaugcggccguucuggagacuuguguccacagugagguggaugggguugggggccucucggcuguaguacucguggaucagcacagagugcucugugaugucauggcccguagcguaccugugaaauggaacacagugguggacuccugucuauauguggcgucaauaucaaacacaacaguggcaugggugucuucaggguaccggacacuucuacgguaggacaccuagugacaccaacugccaagagcaauacacacaccgaaaacuaugucaaauaaaaucaaaggcugacuuagugcugaugaaaaauuccaagucacuuacaagguaauucgaaauauccuggccccacaggaucagaaccaccagcaaaacccacugaauucacaguuccuacagguaacacacuuuccuuuuguuuuuuagagacagggucgcacucugucacucaggcuggaaugcaguggcaaggcaugaucauagcucacugcaacuucaaauuccuggccucaagugauccucuagccucagccuccugaauagcuaggacuauaggugugugucaucaugccuggcuaaguuuuuaaaaaauguuuuuguagagacagggucucacuauuuuguucaggcugaucuugaacuacugggcucaagugauccuccugccucagccucccagcugggauuacaggcauugagccacugcucacagucaguaauacacuugcaauacucuugccuccaaaaggaagaguauaagauccaguccaguagcaaaagacaccggcaaucacgaagagaccuuccauuaaccccagcccccaccuccccaacuuaccagcccaggaugagcucauuuggagaaacuuuuuuaugcaguucauacauauucuuagcaaauuccaugucaacagccaccuaagagggaaggcaggaaagcaagcuaagaagccagaaguccaaagaaaaauugguuaaaaaggacaagaggccacccccaauaaacagaagaggcccaggaaguacguacaaaugggaagaagcuccuuggcuacaggagcucuaguuaugagugugggagggaccgugaggggagccgagcaaaugaacagcuaaaaacugcagagggacagcuuggauucccacucacuucaucuucugacucauugugcggcacugaaaagcaauuggugaccuccacugaguguuugucgacaguuccugugaaagagagaaucguccauguguuauauaauccuagggcucccaacaaccucugacuacuuuugaaaugcuuuugaugaucucuucaaugucaaugaacaccuaacugaacucauuagcuccaaguuuaguccggugcaucgaugggaccagaauucuccagggaacugaaacuguggugugaucgccaacuucucccucuaaucaucaccaaauaggguuuauucuuccuuuacaaggucuccuuuugccuguuacucuccacuacuagccuauuccagaccuucacucuacggccuuuuuuuucagccucuacacuuucucccuguaauuuaaucugcagagcuaccuggaauauuuuaaugguuacauagacugcuaauauaguggccaaguuucagacacugagacgucaggagcuucaucuguaccucccuuuagccaucuggucccauggucagucuuaaccuuaucaucauccagaaaucuaucugcgaaccuuagaagucagucuuuuaccacaaacuuuuguucuaguucugauaccuuuacuuccauauuucuuuuuuucuuuuuuuuuuuucugagacgaaaucuugcugucgcccaggcuagagugcaguggugcaaucucggcucacugcaaccucugccuccaggguucaagugauucuccugccucagcuucccgaguagcugagacuacaggugcgcaucaccacgcccagcuaauuuuuguauuuuuacuagagacgggguuucaccauguuggccaggcuggucuugaacuacugaccucaagugaucugccugccucagccucccaaagugcugggauuacaagugugagccauggugcccaggcuguauuucuuuuauuuauuuauuuauuuauuuauuuauuuauuuauucccacuacauuuguuucuugaccuaagaccacuacguugaguuuuccauucucuucuaaucuauuggaaccuccuaccccaggauuuaaaaguuucccucuccaccagaaaccacaguguugucuauaucuaccaguguuuaucuaauuccaacucacuaugguuucugcucccuucacugaaacuaugucccuaaaccaaaugcacauauauccuuuaucuuauuugaccucucaucagcguugaacagacuugaccacuuacuucccaucuuaaaacuuuccuucuaguuuucuuccuaccuuucuaaucuuguuggcuacuucuuccugacuuuuuagguuuuuaggguuuugucucuguucucuugucuuuuuauucaauguuccuuuucuaggccaggcccugaucuagaaauguuuuuugugaauaaaguuuacacgccaauuuuuuuauggcugcuuucuugcuacaaaggcagaauuaaguaguugugauagagacugcacacaaagccuaaaauauuuaccgucuggaccuuuauagaaaguuugccaaccccugcuuuaggugaucucauccaauuuuauggguucaauuaccuucuauauuccaaugacauaauuccuaaccugacauacuugcccacaucucuuuugcacuccagaccuuuagucaaccccuaccuucccuuucuucuuucacacuuaaccaaagauguagaagucaucccugauauuuucuucuaaucccucacuucugaucacaccauguccugucaacuuuauuuccuaucucucaacucacucauuccagagugauuuuuaauuccuauucaguguuagcugaaaugcucaggagcuuccccaaagagcuucaaaugagguuagacuuucauuuugucuucucagggauccagguaauucccuucacagcacuuuacauuuguaauuauuuaauacuucuuagggcucugcccucugcuagcuucauuuccugcucuaccuccugucaccuacauuccuguaauacugaauguuucagacaguggauuuaccaggcuuuuuuauacuucuuguaguugcuuuaaugcccagcucaaacgucaucuuuuuugugaacuuuuccccaaccuucugaaauaguuaagucuucugcauuuccaugccaccaugacacccuucuauuggaacauuuaucauauuacauucuaauuauuugcauuuaagaguacacuucuaucuugaguuuaagguuacaggagagcucacuuuauuacacuuugaauucuaaauaccuuaacaguuuuaugguacaaaaaaagcaccaaugacuucauuuagacaaaugaaauguuuuguguauaucuaaggaaauaaguucauagcaagcagaaucuauucuuuauucuucuguaaguauugccucuauaacaccuauagcacuguaccaugauuccagucuggaagaggaucugaggauguagauuagauuauaccuggucugacuggaucacuggaauauuuggggcgcuaaagcauaaaucauggguaaugaauuaguuucuuuaaauagcuuuagcgagcuuggaaaauuagaaagugcagccaaaagaguaaguauuugcugagugucaagucagugaugcaaaaauaauuuauuacagaagcucagagcagggcacaguuacagaacaccaucaugcuguggaagguuaagaauggagugaggguccggguaugggauggaggaccggcacuuaaugcuguugcugggaacguggaagguagguagagcuuaaacaaaugaaggacagcaggaaaagcacuuguggcaaagagaacgcaaaagcuuggucugagaaaagacaagcaauguucagaagauaugaauuuaaguuucuguaaaaugcuauaccgucaaagauagauaaaggagagaaaaugugugucuguaugcauuggggugguccaggccugaugugaauggcaacuaacagcuguaccuaaugugugccagcauagucagaaguuuuuaauuuagcucucacaaagacuaagucuaaaguagcuccugacagaacagauuuuagguaaucugccccaagucacauggcaaauguuuugugaggucugcuuacaaaucuugucugcuuugcaauauaccaacugucuucuaugguguaagaacuaguagauguucaagaguaugaaagagaaagaaugcuuguaaauaaaguggauucacaaagcuauuuaaaaucuggcacuaagauggaauggaaacgaauuucaugggaccagcauagucuccagaaaggaauuuauuaucaacaaucccucuuuagugcuuuuccauuuuacaaacuacuuuaacauaaaauaucuauuccccaaauuuggaacacaggcagagaaugggucauuuuucgaccugaagguuaagggcagaaauauaaacagauaauacaacuguuugcguccaaaugcaaaaugggggaacaggguuucucacauuagguacuaauauuaggggacacugagggacacagaucaggcucagacguuuaggacagcagaacacuauaaaaucccaagcggguuccaaccaaaccgguuuacuuguugggaggaauguuuuuuuacaaacguccccacuccuuugacaacugguuagaaaacuuugucaauaccuggaaaacgaugacauuuagucaguggauaagggagaaauauguggucacugguauagggagucaaggguuccugacuucccacucggcgugugaacucauuuuugguagaugcagcccaucauacuugccauaaacugcuguuuauguaaaauguaaaccacuggcauaaauguaaaccacuggcauaaaauauucaguaaaugacacaacuacuccuuguguauuuuaugucgcuuaaagugacagcaauccggcaggagagagaggagagaugcaagugcuugagaagauaagucacagcaaaagguaggaugcagauauagauuaagaggucauuggggaugggaggaaaggacgguaggacaccaggaauuaaagaauuaaugaguuaggggagugagauaaaugagaagugggaggaagaaaagaauguuaacuuucucugaccacucacccaacagggucccgauaacucgggcagcacccucguugcgucucucguagcuguccacaauggaggccaaaaugacugggugcagccugaccacgcggccgccggggaagggcccuggaagagcaggaccaggcagagcgggcgcuggggucugcgcuggagcuugcgcugaggccggggucuggccaggagccgcaguugcagccgcugcugccgcagggucugaggaugaggcuggagccgcagcgggaaccggagccgcagccggugcuggcguuggcgcuggaacugaggcuggggccgccgccgggacugggguuggcguggccggaggagcacuuacugguaccgccgguguggccaucuugucgagaaagaagga

SEQ ID NO: 15350 - RNA, 969 nt, Homo sapiens
agugaccccaaaacugaccgcccuaaggucugugcccagggagguggggcguggcggcugggggccaggcaggcagggggaggaccugccgugcacugagcccccuuugcugcuaggaggagauccgcauugaugccacuacaguguucguggaccccuaugaggaggccgaugcccaggugagggggcacgaugccaccaccuaggagggucugggcuagugcacuuuuccaccccaagccuagcaucuguccugcccgaggugcugccgguuagccagcgcccuguugugccacagauugcgcaggagcggaagacacagcucaagguagccccggagaccaaagugaagagcagccagccccaggcagggagccagggcccccagaccuuccgccagggcgugggcaaguacaucaacccagcagccacgugagugccgcggggcuggccucccuguuucccaugguguuuccuagggcugacugaggucugagggucagacccagaggggcaagcaagcuaugggcacuggucccggccgugggcuugugcuguguggccucugcagccgagggacugccucugaaggccuggccggggccucuguggguggaagagaucaaauucagggggaugugggagcagcaggugggagggguugggccuacaccgggagggcuguauggagacacagacaagucaggaggggcugagggagggugugggcucccagcggcuucuucucuucccaggaagcgagcagcagaggaagagcccucaaccagugccacuguccccauguccaagaagaagcccagucgggguuuuggggacuucagcuccugguagcagcagguuggccgcuguggaccuuggugggguugcagggcugggggcccauguccacaucuccauuuccagccuuucuagccugcccucugcugccagccaauaaauugcuugccu

SEQ ID NO: 15351 - RNA, 3118 nt, Homo sapiens
accacaaggaaaaaguaguuagcauuuaaugaaacucccuccauguggcuucaagccaccaggacacaggcccccccaacacucuuaaucuucuccucagcucuucugcugaagaauuuggccuucacgaugacaggcugcuuugggagcuuucccuuucccagaacuuuguaguagcccuagaagaacagagaaaaaaguuuacaauacacuguaguagguaccaacugcgugaugggcgugaggaaagacugccaacccacuuucuaaaucccuaggcaggguauguauguuucugaucugggcacuaacgggggcaccgacugcccccaccagugaaucaagaccaguagauucucuucgaguacucuagcacaccaggacaagaguugugucaggaugugacucuagucucggcaaagcauaagccuccuccugcucaaauacccccugcuaagcaaaagaagacaaccaccuuccugaccaccagaacuacucaauggacauuaaauaggcugggaagugaauuuaaagcgucccuaggguucuggccucuuaacacuaccucuauauucaugagaguuaagacugacacagggaccagaacccccgcaaggacagacauaauacaucuguuuugggggaaaaucucuucagauaaugcauggcacugaguaucaauggaacauauuaggauucuauuaucuggagaacaugaagggccaagagcugugcucagugaaaaccagcuauaguucaagcacgaaaugcaaaccugauacaaccugggcagugacaguaggcacugcuacggauagggaacuaccuaugauaauucuaccacaggaagaauaucaaugucugguagguaacugggaaguacagauuauauaaguggauuagauuaagccagaguuuuguaagggaagguauggaaguacagaaaaacauccaauuaacuuaccgaucgcaccacaucaaugaugggagcagccccagucuuguuuuuagcagcauucacccgugucuguucacugaccaaaguccacaauuugucaagguugacaguugggcagaagcucugguuccucuuuaagugguaaugcuucauaccaacuuucccaaaguagccuggguggcuaggaagagguaacaaccaccuucauacacacuccaauuaagaugcuauguuuaucaucuuuauaguuaccacccccuauuagaguguaaauuauucacugguguagagcagugucaggcauaugauacaucuguugacuuaaacaacuguuuuaaaaaccaccaaagacuaucaugaggaaaaggcuagucuuauuuccuggaaccaggauaaaccaccgacaaugucagaggcagggccgagacuaaaauucaagucacauaacagcacucuauggaaaaucuacauacuccuauaauaaacgucuucugaauagccaaaauuuaucauccacuaguuuguggguaggugaaugugaagcaugucucuaaccuggugacugacugugccauaaggcccacagccagugaauaaggucagcaguuacucuucgaggacucuagcacacucaggcaauagccgauacccaagcgugacucuagccucgaugacagguucucaguucacaccaaguguuaacuugguaaaaaacagcaauaggcaaggcuugcuucuaaacuuuuuguuuaagccagcccucucucugccccuaccucccaagcugugucaauaaaagcaguccaaggacacuuacuauuugucgaaguugauccgguggugaugcagaccaccagcauuaccgcggccgccggggugcuuccggugcuugccugcaggaauacaaagcuacguggggccggugugauggcucaugccuguaaucccagcauuuuaggaggacgaggggggguagaucaccugaggucaggaguucgagaccagccuggccaacacggagaaacccccgacucuacuaaaaauagaaaaagaauuagccgggcgucguggcgcacaccuguaauaucagcuacucgggaggcugaggcaggagaaucgcuugagcccggcaggcagggguugcagugagccgagauuucgccacugcacuccagccugggcgacagugaucagucucacacacacacaaaaaagcuacaugcaccacacagccuucucaugcaucucaauacuuccucgcacaaaagcagaguguuucccagacuucugugucccgcuuacgcuguucccacccuaccgaugccgguuuucagcaaugcgauuacuuuaggauuccgggugaaacaucuuuucagguuccacaucacagcauucccacaguacuccaugucuucaacuaacccaauaccgugccugcucaauuccuauuaccccacugaugugaaauuccuuagaacuggaauacuagaggaucgucagaaaaaaaucaacagcugugcaacuugaccacaaaaaggucuuauucuaacccacuuauaggcuaccgaucuccagacuagcuaagcacccgaagagagcccaaggcccaccccgaggggaagccggcacuuaccuaugcggccguggccguggcucacguggccccuaaguuuccgggucuuccucagucuggauggcuguguggaaaaagcuuggugguaaggccuaaggaauuaggggcagggggcgaugcccgccagccgagaugguccuguaagccugugggucaaagaccuaacuucuggagcguuugggaaagcugaggguaccgauccgcucagggccgugaggucucaccacgguagcgcaggggcccgcguguccuagagauccgaaccgcgggccuaacacacggcuccgggagccccgccccgggcccgcgccggccacccugccccgcaggcggccaugcgcagccuggaagccccgaccaugguagggaguggaugacuaggggcaaugggaauacagcuuaggggucuccgccggcaaggaagaggaggcaagaaacgaaacaccuaccauguuggcagcccagacgaaaaaggaaggccuucgccaagucucgcgagguaucggccacgggggcggggcaaaacg

SEQ ID NO: 15352 - RNA, 3576 nt, Homo sapiens
gggaauuuggaaauugguguugguauagucuguuacuuuauuccuuuguuguuaguuuuauaagagcagaugcuggcagguaguaguaacugaccagucaugugacuugacuuuguuaccauaauauuguugcucaagccacuagauauguauccuguccuuggcuggcaucgaacgacacuauauacacuuuaaugcagguuuuggcuguuuguuaguuuauuuaaacaacuacauagcuggguauucccagauagguauuccuguuauuuuggagucacacagaccuggguuaaaauccauuauaaccugugcaacauacuuuuaaacccuuugguuuuucauugcuucaucuguaauguagggacaauaccuuucaggauugucaggggauuagcaauaauggaggcaagggccuggcauguagcaauuguucaauaaauaguaucucuauucugucugcguucacuccuuucuucaucuucauuaucagcuuuuuccaugguaacagguuuuuacuagaugaaaauguuuucauguuguagcaaccaggcaaacuucaaaucuuggcccugccaccuggcagguggaugauccuaguacaggccacugaaccuuugugucucacuugcaccaucucuaaaauaugaguagcagcaccuaaauuuacugugaggauuaauugagaaaauacacuugacucuuaggccaguuccuggcacacauuaaacucuggauaaauguuauuuuuuauuucacaaacgggugaaacugagagagcuuagagcaggacauauaggcugcuuuaccagcuuugugaauaugagcuucucuggcuccugcuuuccuccugguggaaugaaagggggauuagacgaccucaaauauucucuugucuaaaaugcuucccucgucugcugggucaggguggugaccugggcaggauuugaucuggagcuuuccuccacauuguagguuguuggaggaagagucuuccaagagggcugaacuagaaaaguggcacuuggagcagcagcaggccauucagacaaccgaggcggagaagcaggaguuggagaaucagcguguccugaaggaacaggcccugcaggaggccauggagcagcuggagcagcuugaguuagaacggaagcaagcacuugagcaguacgagguaaugagacuuggcccugcaaacuuguauauuuaaauuuuugaaaaacauuucucaauaauagaauuauuugcuuagcugccaauaugaagcuguaguaagaaucuugcuuagcuguaagaaagaaaaaagagggaguuuuuacaggagauaagauauauuauacauccaucagagacagaaacugcacaguaauuugaacagggaaaguuuaauauaaaacauuauuaacugucauaggagauuaccuacuguguuguaaagaaggcuuugagaaugcaggaacagcagacguagggagcagccacugccucgaaaacugaggcagagcaccagggagggaguggaucuggaagagcauucuuugcuucuugccccuuaaccccaguguugugauccauaccuccauggagagggugcacagauggcagaaaaguuuguugaggugcugugccagcaaagcucacugggaggccaccggcaaaagcugcccacagggaggugcuacagaaacucacugguggugagcacuguggguguucugagugccacaggagccgcugaguggaaccuagaagaaaagucccucccuccucgugucccuucagcacccucuacugacaaagcuuuaugcugccagcuagugaggagaauuauuuuaguuucaccagcaggacaguucaggguggauuuggaguggagaggcaguaaacuguaacuggcacacagggccauacacccauuguaauucguaugcagaugguggaagaauaggcuuuggaaucagacagccuggguuccaauucuggcucuaccauuuccugcugugugacucucggcagguuacugaccuucucugaacccguuuucacucuguacaaugggguaauaguaguucccacuucuuagaaugggcuaugagaggauuuaaugagauaauucacaaauacauaguaagggcccaauaguugugauuugguucuuaaacuacccgugugucugcauaguccaaaauccacuuuuguuucaggaaguuaaaaagaagcuggagauggcaacuaauaagaccaagagcuggaaggacaaaguggcccaucaugaaggauuaauucgacugauagaaccagguaacagacucuaugaaguaaucauauauuuauuuuuauuuuucauuuuuauuuuauuuaauuaauuuauuuauuuugagauggagucucgcucugucgcccaggcuggauggagugcaguggugcgaucuuggcucacugcaagcuccgccuccuggguucaugccauucuccugccuuaaccucccaaguagcugggacuacaggugcccgccaccacgaccggcuaauuuuuuguauuuuuaguagagacgggguuucaccguguuaaccaggauggucuugaucuccugaccucgugauccgcccgccucagccucccaaaguccuggaauuacaggcgugagccaccacgcccugcccauauauuuauuuuuaaauuuauuuuucuguuucacuuguguauuugaauuguacuaaagaaacuuuuuuagcccaaauguaaaaaaaccaagcuguucaggauaaauuucucuugaaaaucuuauccccuaauagguaagagggcccaguuaauccccuugguauacaucuucuaauuguuuuagcugguaugacauuuaugcauguuccucaaagaagaaauaaaguagggaaguuacuauuuugucuguagaaaaaugaugggguauccugaagaauauaauacuuccuguauuuaaagcauguuugccucuuagguucaaagaacccucaccugaucacuaacuggggaccugcagcuuucacugaggcagaacuugaagagagagagaagaacuggaaagagaaaaagaccacggagugacugagcuugcuggcagucacgucaguuauguagauacugcauggcaggagagcuuuacgcuaaagacaaaagaaacagcuuugggggccgggcgugguggcucacgccuguaaucccagcacuuugggaggccgaggcggguggaucaccugaggucaggaguucaagagcagccuggccaaccuggugaaacccugucucuacuaaaaauacaaaaaaaauuagcugagcgugguggcgggcgccuguaaucccagcuacuugggaggcugaggcaggagaaucacuugaacgugggaggcggagguugcagcgagcugagaucaugccguuguacuccagcuugggcaacagagugagacuccaucucaaaacaaaacaaaacaaaacaaaacaaaaaaacccggcuuugcugcuuuuaacucuucuuccuucugugccucucuaagugggucaguauccuaaggaagccuucuuauuuaucuucc

SEQ ID NO: 15353 - RNA, 2327 nt, Homo sapiens
aucagcauugagacaguuuauugguuugcuguucgcauaucacccauuuuauguaaauagauuauacagagacucgguguuuccuucuuccacacaggagguaaucagucuuucucuuucaugcacacaaacacacucacauuccacgcggcgaacaacuuuacaccucgcugagacauucacgucuuaaaauaggggaggacaauauaauugcuuuuaaaaugcccuuaauacaauauauaacguacaaaaauaucucuauauuugaaguuacaaaaaaaaucuugacagcaacaaacuuaaauauugauaguuaccucuguauguacaacacgcauugcacuuuuccucuuuagguuuuggaaaguucaaguaauagugaggcuugcgcccugguggggugacacgccgugagaaaucaguuugugggcgagcacggcuguggcucagaccccugcuccgggggucucagcauucauuucucaguuucuccucuccuuaagccuggcaaacacucggauucuucugcaccccgcccccuggggcacuugcaccugagcaaggcuaaggaagcgaagcccccagaaggaggggcccuugcaaagccagagcucgccgccggacggugccucccggacucagggucuccgcagggcugucagagcccgguccccacaccgcucgggaaguccuucgucccgggaggcaccagcgggaugcuugcgcgacuauuccuuguaccaugggcgccuaaauccuaaagaaaguggggagcacuuccacucgggggggcuggagccccgugugcuuguggcuuagaagacaccagaguccgacccgggccggccucgggcagggagcgccggcgccggcggccguagcccugggggcugaucuugcuccugggggcgacguuguccuuguccuuaucugugaacugguagaucuggugugccagcuucugcaccgugcacgucccgaagcggcagccaaagcuccggaggcccuggaaguuguucaugcucuggcgguagcgcuugacucggaugcgggcggcauccggacugcugcgggcggggggagggggaagaaaggcaacuugagaccccaucaagcagagcuuuggccccaacaccgggaacgggagccauucuagagccagagggagcuggaaacugcucgcgccaucugagcugcgguccagccccgacgaucccccgggccaggggaguggagacagagaacuccucccgcacaccuuccuucccucccgucccuggacagcacagggcguaguuaccugucuucggggcuucgagaggcacccuucauguccuggggccgaauaagggucugggcaggcccggccuucacgucagcgagcccggugggguagcugcuggacauccgcaguucccucuucccacgacucagagcccacuuauuccaccuggaaaacacaagcagacccgauucgcgugcguucaggugacgcccaggccugucccugcucccauucacuucuagaccuucgggaccaacggucaguuccccuugccugccagguaccagcaagggggaaggcgcugcccggacucacuucuuucgaaacuccgacgcgacauccaaccgagcggugucagcgccuaggaaggcgagcgaacccagguacaucagggcgacggaaaccagcuucaucccggcugcgaagcgcagacccuggaaaagaagaaagagagucgagcgugagcacccgggccagcugcaccgcccgggcggggcacggagggcgggcaggggccccggcgaggcggguuuagcccgcgcuuucccuggcucagacgcuuaucucccuccgcgcagagaggcgccagaggcguuugcacgcgccggccgggugacaggccccgcaggggaggccgcugcaccccgccaggcucccagagggucucugcucaacuucuuggaacuuggcugacggagcagaggggacugggucucuggaccuccagcugugugcacgagcugggcccaggauaugggguguaucuaucucucagagaacccuccaaaguggguuguuccccucacccagcgcucccaguuuagggccuuggcaagcacugccccccaccccaccucuuaacccgcagggucugcggcaccuaccugcuaagagagugaucugccaaguacuugaaggagaaagucucagacgucccacuggcaauggcaaaacuccgaaguccaagcccagcugcagugagaagcccgaaguggcaaggcuugagcuguucuauccagugucaccaagaaaccacugagug

SEQ ID NO: 15354 - RNA, 658 nt, Homo sapiens
cauggguaaaugguguaucugggauugaaacccaugucuccuggcucaaagcccauucucugcugccaugagcuucuggugacccuuaugccuucaugaacugugcucaccuaagaaccccaccuggccuuugaguugaaaacacccagccuggccuuucauuauucuuuuuguuucgaaugcauuaucccuaucuagacaauuggacuuuggcccuucuggguucaagaauuaagacugguguuccucugugucccaccuagaauccaacacaggggccacucgguacagggccuucuguaacccacauccugauuuuaccuuccagggagacuccuguggacccgcaguuugcgcagcagcacaucagaaauauuaggcaugacaucuaagccacucuuugacucuucuuccucaauagcuggggagaguucagaaggaagcccugaaaaaaaagugcuuacuuauaaaaugucucuuugaaaucacaguaguacuguuggcagcuagcuucaggagcuuugacauuuauaaguaucuaguucuauguuaagggcuuuuuaauuguuaucuuacauuauucucacaaugagcuagaacuuagucaucccauuucacauguagauaagccaaggcucagcaagguuaagucacuugc

SEQ ID NO: 15355 - RNA, 2211 nt, Homo sapiens
caacuucuuaaaaaucuucuaagcaauuuauuccaaagagcuuugaacccauuuguaaaaauauaaaaaugcaacaucuucugguugacaucaggaaagauggaacacuacuagcugaauuucaauaaaaaccuuugcaugguuguuggauggaauggauaaaaaugaaacuuuuuucauaucaguuuuuuuuuuuaaaucguucuaaacaugcauuaggaagaguggccaaagauguacuuccuccuuuaggaucuacaucuuugugaguuaccuuuuuuucagcuuaugacagccauuaaaaccaaguacaaaaauaaccugacguucaaucagauauuuuaauaacuauuucacgaaguauuaaagauuuuuaaaacuaacgaaaccuagucaaucauauugauuuccuuaaauauuuuuagugagaauaacaaagauuuuuauaccauuaauauggaaaauaacuaaguuauuuuaaauguuuaugucaucuuugucuuagccuuuuuacauuuuacaaauguuuuauaauucugcacacagcaggacacguauaaaacuuauauaaguauauggauuuuuuuuugguaacgggauuacaauaaaaaaaaguuuggagaacacaagugcaggcaguuaaugcuguggguguuaggaacaugacaagauuauauuaucucagcaugcuguaagaucacuguauccauaaaagucuucaugaaggagccccgccgagucuccauaauggaagcaggauuuggagaaaugacuucugcaaacuuuguuuaguauaacacaaagcaccaugcuuacuacuagagaagauuaaaauucucuaaaaaccuuguuaacggagaucacagguugaagcauacugcagcucuacucuuggaaggcuagcucagucucagacuuggcccugauggagaaggaaguucccuggaagagggcaggggagcgccucuccaauguaguugcggggggcgggcggugaggacaccgcuucauaagggaagggguggcugccuccccaagcaggggguggccccugaggucccuccagcugggggcccuugagagggaggguggggagaggggaaaagaacgucaggagagugaacgggagcaaauaaaacgcuguccauucugacuggaagggccagagccgugucuaagggcgggggccgggagguggcccgcgguggugucucuaccaggacgaggccugggguaucugaagaggggaugacguccaggcgcuuugcuaaagggaagccagaaggguaugaguugcuagggucagagauggggcuuucggcucgagucuuucccugcagggcagagaguccgaagagcccgagaaggcagggaggacagugggccugguccuuccccggccggcagagggagucccgagauggaacguccagcucuccucuaacgaaaagcguuugcauggcugucucgccaauucuguaccucccggggcugaggaagagccgaggugacuagaagcuagcgacaagugccggccaccuccgacgccaggcgccgggcuuggagcccgacgggccgaauucucgcgagagcggccgccgccauuuuuccauugauugcagcgggcugggggaggggccgacgacgaaggcggcugugguagcggcggcggcggcggcggagcccugggucggugucugcgcgcuggugucugaggcccaggcugaggccuccgcuauugcuggagcgcaggcggcggagaggaugacugccgcugccauucucucuugagcuagcgagccgccgccacccuccacccucccccggcagggcggagaggagcggccggagucagcgauggugcccggcgaggagaaccaacuggucccgaaagaggugaggggccccagaggagguuaggccuuaggccugcggccgcucgaggcaacacaggcccgggccgggguucggcugcgggcccggccggggugcaggcucggcugugggggaaugaggaggcgugaggcagucggggguggacggugggugcggcgagcaguugggagacccgcuggcucuaggggccggggagcggaccucccgccucggguuuuauggggcuggacgaauaaaggagcggacgggaaagaaucagguucugcucuaggggagaagguggccuuuuaaguucuuguuuaacguguggagccg

SEQ ID NO: 15356 - RNA, 2211 nt, Homo sapiens
cggcuccacacguuaaacaagaacuuaaaaggccaccuucuccccuagagcagaaccugauucuuucccguccgcuccuuuauucguccagccccauaaaacccgaggcgggagguccgcuccccggccccuagagccagcgggucucccaacugcucgccgcacccaccguccacccccgacugccucacgccuccucauucccccacagccgagccugcaccccggccgggcccgcagccgaaccccggcccgggccuguguugccucgagcggccgcaggccuaaggccuaaccuccucuggggccccucaccucuuucgggaccaguugguucuccucgccgggcaccaucgcugacuccggccgcuccucuccgcccugccgggggaggguggaggguggcggcggcucgcuagcucaagagagaauggcagcggcagucauccucuccgccgccugcgcuccagcaauagcggaggccucagccugggccucagacaccagcgcgcagacaccgacccagggcuccgccgccgccgccgccgcuaccacagccgccuucgucgucggccccucccccagcccgcugcaaucaauggaaaaauggcggcggccgcucucgcgagaauucggcccgucgggcuccaagcccggcgccuggcgucggagguggccggcacuugucgcuagcuucuagucaccucggcucuuccucagccccgggagguacagaauuggcgagacagccaugcaaacgcuuuucguuagaggagagcuggacguuccaucucgggacucccucugccggccggggaaggaccaggcccacuguccucccugccuucucgggcucuucggacucucugcccugcagggaaagacucgagccgaaagccccaucucugacccuagcaacucauacccuucuggcuucccuuuagcaaagcgccuggacgucauccccucuucagauaccccaggccucguccugguagagacaccaccgcgggccaccucccggcccccgcccuuagacacggcucuggcccuuccagucagaauggacagcguuuuauuugcucccguucacucuccugacguucuuuuccccucuccccacccucccucucaagggcccccagcuggagggaccucaggggccacccccugcuuggggaggcagccaccccuucccuuaugaagcgguguccucaccgcccgccccccgcaacuacauuggagaggcgcuccccugcccucuuccagggaacuuccuucuccaucagggccaagucugagacugagcuagccuuccaagaguagagcugcaguaugcuucaaccugugaucuccguuaacaagguuuuuagagaauuuuaaucuucucuaguaguaagcauggugcuuuguguuauacuaaacaaaguuugcagaagucauuucuccaaauccugcuuccauuauggagacucggcggggcuccuucaugaagacuuuuauggauacagugaucuuacagcaugcugagauaauauaaucuugucauguuccuaacacccacagcauuaacugccugcacuuguguucuccaaacuuuuuuuuauuguaaucccguuaccaaaaaaaaauccauauacuuauauaaguuuuauacguguccugcugugugcagaauuauaaaacauuuguaaaauguaaaaaggcuaagacaaagaugacauaaacauuuaaaauaacuuaguuauuuuccauauuaaugguauaaaaaucuuuguuauucucacuaaaaauauuuaaggaaaucaauaugauugacuagguuucguuaguuuuaaaaaucuuuaauacuucgugaaauaguuauuaaaauaucugauugaacgucagguuauuuuuguacuugguuuuaauggcugucauaagcugaaaaaaagguaacucacaaagauguagauccuaaaggaggaaguacaucuuuggccacucuuccuaaugcauguuuagaacgauuuaaaaaaaaaaacugauaugaaaaaaguuucauuuuuauccauuccauccaacaaccaugcaaagguuuuuauugaaauucagcuaguaguguuccaucuuuccugaugucaaccagaagauguugcauuuuuauauuuuuacaaauggguucaaagcucuuuggaauaaauugcuuagaagauuuuuaagaaguug

SEQ ID NO: 15357 - RNA, 116340 nt, Homo sapiens
cagagccgugucuaagggcgggggccgggagguggcccgcgguggugucucuaccaggacgaggccugggguaucugaagaggggaugacguccaggcgcuuugcuaaagggaagccagaaggguaugaguugcuagggucagagauggggcuuucggcucgagucuuucccugcagggcagagaguccgaagagcccgagaaggcagggaggacagugggccugguccuuccccggccggcagagggagucccgagauggaacguccagcucuccucuaacgaaaagcguuugcauggcugucucgccaauucuguaccucccggggcugaggaagagccgaggugacuagaagcuagcgacaagugccggccaccuccgacgccaggcgccgggcuuggagcccgacgggccgaauucucgcgagagcggccgccgccauuuuuccauugauugcagcgggcugggggaggggccgacgacgaaggcggcugugguagcggcggcggcggcggcggagcccugggucggugucugcgcgcuggugucugaggcccaggcugaggccuccgcuauugcuggagcgcaggcggcggagaggaugacugccgcugccauucucucuugagcuagcgagccgccgccacccuccacccucccccggcagggcggagaggagcggccggagucagcgauggugcccggcgaggagaaccaacuggucccgaaagaggugaggggccccagaggagguuaggccuuaggccugcggccgcucgaggcaacacaggcccgggccgggguucggcugcgggcccggccggggugcaggcucggcugugggggaaugaggaggcgugaggcagucggggguggacggugggugcggcgagcaguugggagacccgcuggcucuaggggccggggagcggaccucccgccucggguuuuauggggcuggacgaauaaaggagcggacgggaaagaaucagguucugcucuaggggagaagguggccuuuuaaguucuuguuuaacguguggagccgggagagaucauuucaaagaaaacauucuggaacaguugccuaugggcacggcagggugacggugcugcuucuggguuugacaguggcagcguauagcuuucagcgcuugugaaaucuacacccaagugagaucugugggagggcagacuuaacuguuacgacuuuuuucaacuccuguuacuugguaguacuauuggccugccuaaauggggccuaccgaagaucguggaaaaguaguacaugggacauuaauguaaaggaaggagauaggagaacauuaccacauggagagcugaacucuuuuuuuuuuuuuuuuuuuuugagguuggguuguguaugccaauuugagugacuucuuaaauucuuaaaagcaagugauacgagaagccuugacuacuuggcuucucuugaauaguaguagaagauuuaggguagaauccagcacuggccagcgaauuucaacguauuaauaguaucucuguuggcuuuauaaauaucuucggcguauucaaauguguauuuuuaacuggcugaucaucaggcuaaugcuuuggauuuuuauuucucauauaccuuaaauagagacaaguguuggauugaaauuaacugugugcgaucuugaaauuaaugagugaucauuacagauucuuaaauuuuuuugugccuguuuuacuuguuuuguagcaauucuuuguuacuuaagcaagcucugacaguaugcaagggugauauuauuggaguuauguaccuguaugauacaaguauuuucccagcuuugucagaagggcagugauaguuguuuugcaaggacgauuuuuguaaaaggcagagaguuaugugucaguauuuguucaucaagcgucaccaacucugugcaaagcagauaaacagaugaguuaaucagaauucuugccuugggaacuuucugagcuacuaagaaagggaacacuaguguuuguugaacuccaauuagggacuagguacuuuaccacguaaguaauucuuaugcaaggaaggaagugauaggugcuguaagaaagguauaaauguguauuucauuuuagagcuucauauugcugguuuucauuuuuauaaaaaacaaaauucuuucuuaauuuuuugaccauuagaaaaauaucauauagguggaacucugcuuuaagaaaacccaacauuagauuuauuucccuaauaacuugauuuauagaaaacaugauaugauaauagauaccgagcuuugcagaaacaucuguuguguaaaaagugauaacagcaacggaaguuuaaagauuaaaugccuguccuuuuaagauuaauucccuucccugaggcuuuaaauucaucacaacuuauguuuuuucccuuucuucuuuuuauggaccauaugccuuuauugucuauuccuuagucucaucuucagucuucuuuuucccugguuccuuucaugauuccuggaagcaugaucugugguucuuaccuuuuauagcuagccaacuagcuuuuucuucuuugauggccacacucauucuuuauuaaagugauugccuccaguuccauauuugcuucuggauuacuggaaacuuuuucugaaaaucaccaguuaucucuuaaaugaccaaauucuuugacuuuuuuuuucuugccucuucugcuguucgaauucucugcaggaucugauaguuuuuuuaaaaaaacaauuucuugauuuuagugauacuccacuuuucuggucauuuucccaccuguuuguccuaucugcccacucauuuagucaaggccuuucucuucuuuuuuguauucuuaauuggcacuuuugugugauccuugaagcuccgggacagguccuuuuaaacaguaguagaaucauacagugcuagagcuaagagaaagcauaaucaucaucuaaguuaccccuccacuuuacaguuaagggaguuaggcccagaagauugaaagugacuuguucagggucaaauaaugaguaaauggcagaccuagugcuagaacucacuuccuuugcuacuauucccuugauuauacccuauuuuacagagcccuacauguaauuuagaggcucuguaagaauaguuuguaacucucuaaguacauauauaugugaaaauaaauggcaaauuaaaaaauuucaugcauuuauuuuaauggcuuauuaucaauaaucuaaagauuuuuuuuuuuugagggccuuuguauagggaaccucugaccccugcuagauuuagaucuugguuagaugugggcaugugugcgugcguguguuggaguguauaguuguucagugaauaauauauuuuggucccugaaacucaaggacaaauguaccuuuagaggacucuugaagaagacagcuuaguguaguacaggcauuggcaaaccacggccugugguccagaucaguucacagccugguuuuguauggccugugaguuaagaaugaguuuuacauuuucgaauuguugaagaaaaaaagucaaaagaauuauaauagucugugacacaugaaaauaauguguaauucaaauuuuagucuugaaacagcuaugccauuuauuuaguauuuuguauggcuacaacagcagagaugaguaguugcuacagagacucuaugcaggauaaauuugaaauuacuuagcuugguauucaaggcccaguaccauugauucuggccacaaccuguccuuccagcuuaucucuucucccaugaaacagguuuuuaauguagucaaacagguuucucucuaacuugcauuucacuucuguuugugcugcccccuccuuccuguucaaaaccuucauacacauuuuuccauaaguaccucauaucucauuuaugcuaaauagccuuuucugaccauuuuaaccuuagagauuucucccucuuagaagaccuuuauauaggaauagaauucauuuggcaauuacuagauggugcuuggcgacaucuauuaugaucugaaacuguaaucuacauuuuauauauuauuuguugugaauuccuugacagcaaagacuugguauguuucucugucuuugcuuuuuguuuuuguagguuuuguacuauagguuuaagacagugucuuuccuggagcagauauucaguaaauauucguugauguggugacagaguuguaaguaaauuuagcauucuaaccaauuauccuguccuuggagguuuuccacagcaucauuggcaagcuauuugccaacuuuugcuuuaauacauacuucuaugacuaaucuuugauaaaaucuuugucuuagaagagaucuguuauuuuuaaguuuuugaguugagagaagucuagaucucuauagcugccaucuuuugauaguugccuuacagaaauguuaaagcauuucccauaggauaguuuuucucaucauugaagaugggagaggguagccugagaacugaccuuuucuguucugagucugagcuuccucaguucuuuaacuguuucuuaguuccucucuuuuggacauaaucugggguuuuuaguauuccuccuaaauuguuguacccagaaagagcaaagagagugguaucucuucauuguggugaagaacagagcuuuucacccguuucauucugccguaugucuuugaauuguaguauauugauuucugcuuugaggucucuuuuaauagcaucccaauuuuaauuauuguuugguugcuauuuuguuauucuguuuucuuauaaggaugugugucauuaauauucauugaguacucacugugcauauuacuguauucugccaaauaggaaaaacuuagaauagaaaaauuuguucuucucucaagugucuuauagaaugaucaaggauaaggugcauauuuacugaugcuuuaaaaauaauacuuaaacugcaguacuuaaaguagugcucauggacucuaaauccagagaaaauggaaaaaaugaaggaaaaagaguagaaauguaaauucuuuaucucuggguuuuuuucuccugucuuucaugcaaucacuacuucugucuggaacugguuuuggcaucuaaugaugaugaugauaguaauaaccaguauuuauugagcauuuauuuauauaccagauacuguugguugugcuuuguauuaacucauuugagcuucacagcaaccucagaguacauaagacacauugauagcaaaaacaacuuauuuuuauuucuauugucugacuucuuauaaaauccauucaucaguaucuauuauggaacaugucaaaugcauauucuuuuaauuuuauuucuccuaauuaaauuaccugaggaaaugugcugcaauugucauucuugauuuuagugauucuuuuaaaaugaggcuuuuucuuaaauuucagauguugacucucucuuaccaguaagagacaaguuugucaaguuauacccgccagcguuuuaaacaaauuggaguguuuaauaaaagucaguauuuuagauaucauuggaaaugcucauuuaaugaaugaaagcaaaagcugaaugcagaauuguauaugauucuaauuuuguccaggaaaaaaugaacaauuuaggguuaaaugcguugaaagauuagaaggaauacacuaaaauauuaagaguugcuauuucugaauuucuggauuauugggauauauauuuagacuuucauauuuaaaaaugagcauguacauuauuuucaaaaacagaaauugagaugaucugauuguaguuuuggggguauuuacauaguguuuuuuuuuuuugugcucacaguuuuccuauuuccccucuccucuuacucuguauauuugucuugaguaaucggauccacuuguauagcuucaaccuuugauugugauuuacacauuuauaucuccagcccugaccccuucuagauucagauuuccacuguucuggauaucuguacuugguuguacucuaggacccacaaauuaaauauagguaauaucgaacuuauuucuccuucccuucucacaacccaauucuugguguucuccuguuucaguuaguguuaucgccaucuauuuauaugcuuaaguuagaacaguuuuugacuccucucuuuuccuuuuucucacauauaguucaccacuuagaaaaugucucuguauccuuaucuuucucuccauggcucugccuuugucuaauuauuguuauuuucuccaauguguagccuuucuaauuggucagucugcuuccaaggccuuuccuuucuuaaccauccuccccacaacugccaggguuacuuucuaaaacagaugagauuaagauuuaccuguuuuaaaguuuauaauuauuacccucugauugcaauuugaaugauagguacuauuuguaaacaguaugugcuagacacuaugcuaaccaguucacuuacauuaucucauuugacaguaugacaguauuagcuauuauucuucauuauccauuuuacacaugaagaaacuaggcuuaaagaugcuaaguaacuugcucaaaguuacauagcuauuugauucuaaaucaagguagcuuuaaccaguaggaaaguccuugauaauauggauucaguugauuuuuuaaauuuaauuuuuaucaaaguuauguuuaauacaugcauauauuuauaagaguuaaauagcucugcagaacuauagucacuugucacuuaaugaugaggaccuauucugagaaauguaucauuagacaucauuugaacaugauacagugugcuugcacaaaccuagaugguuuagccugcuacacaccuaggcuauauggcauugccuguugcuccuaggcuacagcauguuacuguacugaauacuguaggcaguuguaauacaucauaagucuuuguguguucaaacauacagaagguacaguaaaaauaugguauuuguaaucuuaugggaccacugucaucuuugugauuguugaccaaaaugucuuuauauggcacaugacuauauuuacaaaaacaguaggucucugcaaauuuccccucauuucaggcugccuaggggcaacugcuuucaacucauucuuuugauacuuacuuccauauuugaaacuggcauuuuuuuuuuuuuuuuuuuugagacggagucucacucugucacccaggcuggagugcaguggugcgauaucaccucauugcaaccucugccucccggguucaagcgauucuccugccucagccuccugaguagcugagacuacagacgcgcgccaccacaccuggcuaauuuuuuguauuuuuaguagagaugggguuucacaguguuagccaggauggucuugaucucuugaccucgugauacgccugccucggccucccaaagugcugggauuacaggcgugagccaccaugcccagccgaaacuagcguuuuuauaguguuacuucuugauuuuucaguuuaagauauuuuucaguuuaaguaaaaaugaggguuuaccacuauccccaaccacacacaagcacacauuuuaacccugcccaguacucccaauauugucauacugcaagucguuuggauacauccgcauuucauagagauggaguuucacuauuauugcacaagcuggucuugaacuccugggcuuaagcaauccuccugccucagccucccaaaguacuagggcuauaggcgugagccaccaugcccagccuguauacaucaguauuucaguuuauaaugacuccauuuucaccauguuagcuaggccagaguuaguaauuuuuaacaauuuugcuuugcuuaguuuucuguauacuuauuaaauuagccaagugguuaucaauuggggcccauuuucucuccagaggacauuuggcaauguugggggaggggaggagagugcgggugugugcuacugacaucuaguggguagaagccagguaugcugccaaauauucuucugcacugcacaagacagccuccuguaacaaagaauuagaaggcccacaaugucaguagagcuguuguugagaaacccugauuuagcccaaacuaucucucaaguguauaaauggcuuaucuucaaaccuaccaauuuugacuucgugagaagcucuuucccagggccuucugaccuacuccaguuugaacuuguuaaagcuagaacuuuugugcagcuguugucuuggacuugcuuuacugucaucuuuaugauucucucaguucugucuuguuuuggagccccuguuucuguaucugguaucuuuggcugucuuuguuuacuuucucauuuugaagggccacuuucaauaguucucuggaugggauagaauuuuuucaagacuauacaugucuguaaauguuuuuucuccccucuuguuuuauggauaguuuggcugggcagagaacucugagucagaaauaauuuuuucucagaauuuugaaggcauugcucuacugucuucuauuuuucugugucgauguugagaucagaugcuuagaacauccuuuucaacuauuuugaaacuuucuuuuuuucucuuugcgagcuagagagagaaucuuuguccccagaguucugaaauucuuguauuauguaguuauaugucuguuuuuuuaauucauucugcuaauccuguucaaucuggaauuuaucucauaaauucugcaaauuuuccuuaaauaauuucuuugauuuccucuccuucauuuuaucucuccucucucuuuugaauuccuguuguuagauguugggccuacugauggguuucucuaauuuucuugucuauuuucaucuauuuuccauuucuuuacauuuuuuuucuuugcuuucugggagauuuuucucaacuuugucuuccaguuuuucuacuaaguucuuauuucugcuauaauauguauaguuuccauuccuuuuuuugaaaaaaaaauccuauauuuguuuuauggaugcagugucuuaucucucuuaggaaauauugguaguuuuuuuuuuuuuugucugcauauucuuuuucuuccaaauuuccuuuuucuguuuguuugcuuuggucuuuaucuuucauauuuguugcuuuccuuagaugucucaugauccuuggcagucugugcuuauuuaagagagaggcccuaagcugaauggaagcucugcuuuugugugauuaugguuuuuuguguaggaugguaaaucuggaugauuuccuugcagacucccagucuuaguccauuugggcugcaaaaacaaaauaccauaaacuggguggcuuauaauccacagaaauuuauuuuucacaguuccugugagugaggcugggaaguccaagauaaaggugccggcagauuuggugucugguaaaagccugcuuucugguucacagagcagcaccgucucgcuguguccucacaugguggaaggagacaaggcagcucucuggggccucuuuuacaagggcacuaaucucauuuaugagggcccugccuucuugauccagucaccauccaaagaucccacuuccuaauaucaucauauuggcaaguaggguucaacaugugaauuuugggguaaggagacauaggcauuuagaccagggcacccagugacacaucuuuucuuuugugcuggauuguuuucccagacaaaauuucucaucuuuugccaggagagaacaagcuugagagcugaguaggaaaaggggauaugggucucaucuuuaagcaugcagauuaaccuaauuccccaguuuucauuauggcacccuucaaauucaauugagcauguuguccucuagucuagauauauccuguuauaugcucucuagagauuguuuagucuuuuaucagaaaggguugaagaguagaagaggaggucuggggauuuucacuacuucuuagauuuuggucaguucuaguuuggacuccacucucguucccaaagugucugaaacuuccaguuccugagccccuuaguuuauuuuuuuguuuguuugcuuuaauguauuuacacaagaauugcggaaagaguacaaaguuuccguauacccuucauccagcuucuuuuuaucuuaacaucuuauauaaccauagaacgaugaucagaagaaauuaaccuuaguauaauauuauuaacuacacuacagaauuuauucagauuuuaccaguuuucccucuuauaguuuuuguuuguuucaagauccaaauuuaggauaccacauugcauuugguuaucauaucuccuaguuuccuuuuaucugugauaauuuuucagucuucauuuucaagaucuugacacuuuugaagaguacuggucaguuauuucauggaauggcucucaauuuggguuuguggaugcucucucaugaauagauugagguuaugaauaaaaagaaggauuaucacagaugggauguguucuucuuagugcauuauguugguaggggggcaugaugcugauacguacuacuggugauguuaaccuugaucacuuggguaagagggugucugcuagguuucuccacugugaaguuacuauuuuucccuuuaauaauuauuaaguacuuugauuuaaaguuacucagccaggcaggucaaacuuuaaaaauaaaauagcuuuuaaaaaucaaauucuuugagaccaugcagauaaccuauuucccccuaaauuucugcccacuaauuuuaucaucuaucugugaucuugccugcagcaauuauuacuguggcuuaauaauagugauuuucuauuucucucauuauuucuacauuuauuaauuuaaauucuucugugaggagaauuuguccuuccccccacccccauuuauuuacuuauuuauuuguaucaguauggacuuauggauauuuauucuuuggauuauaauccaauucuauaucauuuauuuuguugaucaagcuguuccaauuuuugccagggggugcuuuuucuggugggcuucugugcucauccuugcuuuuugagcacucacuuccuuacuuuccaacaccacauaaugcuucagcccaucuuauguuuuccuugccccaacccuggaaucaaccaguucuccaaggaguuuagaggucuuuugguguacuaaaugucagugugauauaaacuaggugucuuugcuuucuucuaggcuaacauggaauucagccuuccuaguuguaauugucauugccacuuauucuguuuucuagcuuuuaaaauuguguuucuguuuguuugggguuaauagucuuucaaaaauuucuuaacugggaggcaucagagcuaaauccuuauauucagucuauccucuuuaaccagagauucuuaauguuuuugucucaugccccaagccaguuuuguacaaaccacauuccacuacauuaguugcuguuccucagaugugcuguuauauguucaugugucacuucugugcccuugcccugacugaauacuaugaaguauuucuuuuuguccugcaguuuuuaaggaguuuuaaauggguggacuuuuauuuuacaugaaaaugacuauuugaauaauuaggauucuugccuaucuucuauuuucucuuuuuuggauuagucauauagauuuuuugucuuuuagugcccagauacuguaauuuuuuuuuugccaaauggaaaggaggaguuccugcaucuccagaauaguaggguauggugauagcccaaguuagaaagaaaagauuguaucaaaaacagggguuguaaaaaacagagcauuaaauauauauauuuaaauaccuauuguaaauuaaaguuccaaaagacaucuacuuuuagaacaaauuccuugguauuaaggaccuucuucaguucaggcagcauguguagguggcaugauaugcagaggcauauucuguuaugagguuuaugacacagauuuucaaaucuaacauacagacauucuccauuguggaaaaguauuuggcaaaaugauugugcuuggcagugauggcagaugacugacaaaaaaugaugugaucuuucacaucgacguucuuaaagaauauguguuuuccugagccugguuuuuacugguauaguguaagaagggauggauguagauguagugugaguaaauagaugcguccucucuaccuuacugcauacuuccauuuccuuuguccuuagguguggaaguaauaauugcccucuucuuucauuuaaugaaacuaaacugaaacaugcauacauaaaguauccauguauaugaauguuuuaauuuaugcaaaacuguuauugauauaaccugcuguugagagauuacaguuuuuacaaaaauuacugagauauaugucucaaguuuugauguucuuuaaaacaugcucuuaaaauccuauccaaccggcugggccugguggcucacaccuguaaucccagcacuuugggaggccgagauggguggaucacgaggucaggagauugagaccauccuggcuaacacagugaaaccccgucucuacuaaaauaaaauaaaauaaaaaaaauuagccgggugugguggugggcgccuguagucccagcuacucaggaggcugaggcaggagaauggcgugaacccagaagguggagcuugcagugaaccgagaucgcaccacugcacuccagcuagggggacagggcgagacuccgucucaaaaaaaaaaaaaaaaaaauccuauccaaccagcaaaguccagccugaaaauucuccucuuucaaccugauugcauauucuuaauccuaaaauccuacagcaccuuuggcauuugaaaaauucugcuucuuuauuauaaguuauuuguuauuucaguuaauaccuucuauuagaugggagguuccucagagucaggacacuacagcuggagucccuagguucaaauaccagcugucugacauuggacaaauuccuuaaccugucaguaccuuaguuaauuaaggauaauucuaaguaccuccuagcauuggugggaagauuaaaugaguuaauacauguaaugugucaugcacacaauaagcuaucaauagauauuagcuauuaccaccuucuguuacuaccaucauuucuaucauuaccuucauuucuauauccucccccaggggccaucacaaugugcuguacauuguuguuauucaacaaauauuuguggauuaaaugaaaaugaaauuauauuuuaguuaugcaagucauuugaaguugacagcugauuacagccugucagcuacuuaucuuaaugucuacagcacuaauccuaaauuauuguuagauuugacagguucucuuauaugaucaaguaagaccuauuguuacagcuuugaaaauuggaacacauaggccgggugugguggcucacgccuguaaucccagcacuuugggaggcugaagcaggcggaucacgaggucaggagaucgagaccauccuggcuaacacggugaaaccccgucucuaccaaaaauacaaaaaaaauuagccgggugcaguggcgggcgccuguagucccagcuacucgggaggcugaggcaggagaauggugugaacccgggaggcggaguuugcagugaguggagauugcaucacugcacuccagccugggcgacagagcgagacuccgucucaggaaaaaaaaaaaaagaaaagaaaauuggaacacauaacaaagugaaaguauuaaaaguaaaagaaauuuugaguucagcuaaugagguucugagaaaaauuaguuugguuuauauaggugguugucaauucacuagauuaacacauuucuuguuuauuaggauucagugcgaaauguuauuuuaaagcaggauccauauuaagacaguuucugagagaacuugauguguuugauaauuuugauuuucuguagcucugguguagaacuaguugacauggauagaagagacugucccugucagugguacuaugaugaugcuuuaaauuugaugcuguguaguggacugcuucuauacuaauaauuuucaaguauuaguguaauaugcuuauauuaaauaaagugacuuucuaguagagaaaaauuaaagaaagccuaagugacauaauucagaaaaaggucuagaacuuaaaucuuucuguauaaagaugugaauccaauaccugugguaagguuauagguuuaacuucaggaaaaucaugaaccucauuuacaaccucagugaaauuuuuuaguacaaccaaagcauucuaguuuacuacaaauaccuuucuuguuuuaaauacuuauuuguauuuaauaaugaauacacuuucauuguuuuuaguguagauuuccauggcuccugauuuuauagaauucauucaguuaaacauugaguuaguagcugccaagaacuacuacagagagauucaaagaugaauaaggaaucuggccuaguucuagauccuagucuagacuaauggaagagacaaacaggugaccagacaaauauauaauguggaaauaaagugggaccauagagcggggagcagcuggcuuucucuaggggauucugugagaauguaaucacaaaggcugacuugauuauuauguagagaaggaggaauaguguucaaaacaagaaaguuuguagugcauuuuaggaaguggcaaaaaauuuaguguagaugcauggggcgccugguucuggcagauugugucuaaaaauuccaaaggcuuugugugcccagaaaguguuuagauuuuuauuguuuagacauuagggggcaaaaaauauuuuuuuccccagaaaaagucaacagauuuguuuacaauuguuauaaaauuuaguugcugaaacuuguucauggaaacauuuuuuacuugcuggaauguuuuuuguccccaacauuaauaccaaaaauuugcauacaaaucaaagugggggaaaaacuugcuaauaccuuauucucucauccauuuauuuccauuugcaaucauauaauuagguaccuuuuuguuuuuuaagaauaaaauauuucuuuucauaauacauuuuagcacauuuucuacauaugagucuuuuuggugggauauccuuaggcauaauuguuacauauuugauauggauaaaacaaaggugggugucuucaaauaggcuaaccagguaggccucacuugccuuuagaaaagugucaguggcugcacucuggaaguauagaucuguuuugaaguucucacaacugaugcuggaagggaaauuugcaagugagaaguucagcauacauuugauaacuucugaucugauuuucacugagagccacaguacaaggcuuauaaugaugugguuucuuaaccuuucuaguacacaacauauucuugugaguggcuuuuguagcuaguuacuuccugugugcuuuaccacuggcauuuuugugggcauuuggcuuuguaggaacuguaguguagagaacucccuauuuacuucucuucuuggcugaagcucugcaagcuaaaggugacaccgugcuaggcagugaugacuguugguggcagucacagugcaguaacugagaacaccauaaggaaugucuuuaauuugagaauuaauggaaucuuccuaagguuauccacagugcuccaaauaauauuuauuuaauaaaaauaaaauauuuaauaaagagaagcucuggauuauaaaccuaguuccagguugcauuaauaaguagaauuuuuguauaacucaucuccaaaagaugcagcauguugcuuuaguaaauauaaauaagcuaucaaugaauuuauauacauuuccuucauuuuauagugucuguccuuuuauguguuuagguauuuuacuuguauugccuuuaaguuuacaccaguuuauauaaucuauuauuuuauaucuauuuauaguacuuugugauaacaagagaauuggugaaaaauuauauauuuaacaaccacaacuuauuaaaauauaucugagaaauauugcuuugacauuuuaaauucguaugucuugaaauauuuauuuaccuuuaguuauuuaccauuaacacaaaacaaauauaauuuuaagaguucuaagaaaaguagacgugacacaaaaauguuucuacaguugaguaauaugauuuuaacacuggaagggaggcaguaguuaugaggcaggagaauagagucuggacucaggagcuuaaggccauuucacgcuuacuucuuagaacuaaauugaaaggaaaacccucacuuuccaugccuaaguaacaaaagagccggaggcuacucccuuugcagaccccuaccuuuucugcguggcagauggaaaauugaaaguaccucugguugguugcagaaagcaaccaaucagacguuugcaaaggaguguaacuuuguaacuucgcuucagccucugguugguuguuggcaaacagacugauuacgggccaaaucuucauuugcauagaagugcagcuuuguaacuucacuucagccucugauugguugcuuuccacaaccaaucagauguuugcauaggagagugaccuuuguagcuucacuucagccucugauuuggcaccacuucauuuacaugaggugaauaccaagugaccaaugggaaaccuuuggcagguauuuggacccaagaagauucuguauccaggcccuuuagccgcugcuggugcaguucccauuaguggaguguacuuucguuuucaguacaucucugcucuuguuguuucauucuuuuccuugcuucuuuuguacauuuuguccaauucuuuguucaaaacgccaagaaccuggacaugcuccaccgguaacgguuaaauacuaauauuauagccccuccauuuucucgguaagaaaaacuauaaaggccacagaaacucauuaaguuacuuagggucucagguaaugaaaggacauaagugagacuuuuuguuuuuuaaaucaguguuacugagguauuauuuauauauagaaaaauucauccuuuuaaggcauacaguuuuguaaguuuugacaaacauacaguuguacaaccacuaccauagucaaaauauagaauauauccaucaucucagaaaaguucucuguugucucuucaucaccucaaaaaaguucucugucgucucuuguaaucaguucucuuccccuuccuccaggcucuggcaaccacugaucuguuuucuguccucauguuuuuccuuuuccagaaugucauuuacauggagucauauaguaugguagcauuuuggguaggaauuuuuucaccuagcauaaagcauuugagauucauuuauguuguugcuucuaucaguagucuauuccuuuuuauugcugagugccacaguuuauccauuuaccagcugauaaacauuuggguuguuuccaguuuuuggugauucugaauaaagcuacuauaaauauuuguauacaagcuuuuggguggacauaugucuucauaugguaaguguauguuuaacuuuguaaaacacugccaaacucuuuucugaaauggcuguaccguuugugcauucuagacagcaauguaugagaauucugguuguucuguaucuuuguuuacuuggcagugucaguuuuuuuuaaguuuaguuuuguuuuuuaaccauuuuauuaaguguguaguggugguaucuguuugugcuuuuaguuugcauuuuccuaacgacugauaacagagcaucuuuucauguacuuaauacugguuuuuauuaagcuuaauccagcauccuuuauguauuacauauuuaagguuuugcuagguacugauagaagggagaggaauaaaaagaguauccucaaagaguuugugauuuauauagggaaaacugguaauaauguuaacaugaugcuaguuacaauuuugguaggcucuuugagaaagggauuuacguauugacuggccuuguggaaaggacaguaguuugggaaucagaaaacucaagugguuugacuuuaccuuaguugcuuaaccuuucugguauuuuucuucuuucauuuguuaaaugaaggaguaaggccgcauaagguauaagguuugucgcuaaauuauguaucuacauaguuuuucuuuccaggcagguuuugaaaccuugugagaaugccagucagaaaacaaaagaucuuugcagauguuccucaucugaugaaauuccucuuaccugcauccccaaaagauaaucuuuugaaaauuuaaauauugaaauuuuaguauauaaauuucauuauguacaagaauugcauguuucuuaaauguauuuuaaggguaguaacugauaguucucuaauaauaacuuauuuuuguaugguauuacuauaauucauagagcauuuucaagaaguucuccccuucgauagaaaaacuauguggauggccaggcaccguggcucacgccuguaaucccagcacuuugggaggccgaggcaggcgaaucauuugaggucaggaguucaagaccagccuggccaacauggcaaaaucccaucucuacuaaaaauacaaaaauuagcugggagugguagcacacgccuguaguuccagcuacuugggaggcugagacagaagaauugcgugaacccgggagauguaggcugcagugagccaagaucgcgccacugcacuccagccugggcaacagaaggaaaaaaaaaaaagaaaaacugaguggaggauauauuuuauuucuuuucuuauuuuauuuauuuauuuauuuuuuugagauggaguuucgcucuuguugcccaggcuggagugcaauggcgcgaucucggcucaccacaaccucugcuucccggguucaagcgauucuccugcccacccuaccacugagcggaggauauauuuacuuuuaggacccugagagugagagauaaguuaaaugauucguguaggauuacacagcuagaagaaaaguagccacuuugacuuaaggagucuaaucuagaucuuuugacucugcaguccauuguucuuguaccauagaucacucuaauaggaaauaaacaaacuuuaaaaaguguuaaguaacguuaacguuucuuucagauguauaauuucauguuugaaguauuaaaagaauguaauauucuuaagaauuacuguccaugcuuuuaaauaaaaugcaugguaacagauaauauaaacaagcucccuugauuuaguaauaauaaguagaauguucauaaccuauaaacaagucaguuauuucacaagcugagucacugcuugucaacaacagccuacucacagaggaaaucuuagcuguaaucaaaaauaaagauaacagaaauaguaaaggacguauuauuucgccuccugagaauaguuuugguuucuaaguuuagauaccuacaguauauuaucaguggguuacccauugccaauacuagaacagcuauuaaaaggagcaaggcagagugggaagaguauuaggauaaaagugagaggaaaaguaauacauuacaauuuuaaugcuacaaacaugucagcauuauacagucaucagaaggccucuguuauuuagaagaccuguguucaaaugugacguugggcaggucacuuaagguuucucaauuucuuuuucuucaucgauaaaauaaggagccucaucugauguucaaagguccauccaacuuuauuuuauuuuauuuuauuuuauuuuuugagacggagucccgcucugucgcccaagcuggaguauagugacacgaucuuggcucacugcagccucugccucccagauucaagcgauucuccugccccagccuccuaaguagcuggaauuacaggcaugugccaccaugcccagcuaauuuuuguauuuuuuaguagagacgggguuucaccauguuggcuaggguggucucgaacuccugaccucgggugauucggcugccuuggccucugaaagugcugggauuacaggcgugagcuaccacacccggccccauccaacuuugaauguaguuguauguugagugugaugagccaucugguugguugguuuuuaauugucaaaauaggucaaucauaguuaaauggauuguaaacuauucuuuuaaaguucugaaacuuugcauuuuuaguuuccuauuaauugauugaguacuugauguaauuuguugcaacaacuaaaaauaaauuacauaggaucaaaggaguuuuauuuauuuucuaauuuuaauauacugugggguucugggagcuuauuucaugacuguuuuagaauaaaauggaaugcauuuaccugagggacacccuaauacuagagcacagagggcagguaugaaaauaaguauuuuuacaaaauuuuaaaagcauacuuuauccaagucagccuaguuauguuuuauuacuugaguguuuuuauaguauauaauuuagaaacaaaugugauauagugacauguaauuuauaacauguuuauuaauuuaaauucagaaaauucauaccaugauacauugaacaacaugugcuaaaacaaauuaucacagaauuuguauuuaacuagaauaauaaagcaaaucuacuuauaauuucuuuacugcuuuaggcuuuuagaacagguacaaagucuuuuuuuuuuuuuuuaaggaaaacacacauaggauuugaauuaaaagagccaauuaaagcagagcaugauuaucaucaaacuucacuuaaguaguaaaagcccuuauugcacuaacaaauucacaauuuaaaaugagauuacagaauuuucuguuucaaaaucaguuucuagaaauuaaguuuuuaaagcacacuuuaugcuuccaaaagcaucagcuauaauacauuaugaaauuauuuuucugaaugaauauauuuugcuuacagaauucuguguaggacuuagauuuucuacuucugugguuuguuuuuaguaguaaagauuguaaaauagcuguuuucauuucuuagcuaagcacaaucgugcauaagaaucugcuuaucuuauuauauacauuguggguuuuuucauguucuuguugugucuuuaugauuuucugaaguauuaguguauuccugacaagucuccucacauccuuugacauguuuguuuuccuugaguauauaagcaagaggaaauaaauuacauguuuuuagaaaaacugauauaaauccuagauaaggaaaauaaaauuuuuugagaaauuugagccuacagcuagauauucuggauguaauuugacagugguagaaaagcuaaggcuaagaagacuuuucucuucuuuuaauuuguauaaacguaugggauacaagcauaauuuuuuuuuucuuuauuagagauagggucucgccauguugcccaggcuggucucgaacuccugggcucaagugauccucccaccuuggccucccagauuauugggauuacaggcaugagccaccacacccagccuacaaguguaauuuuguuacaugcauagauuguguaguagugaaggcagguauuuuaggguauacauugccugaacaacauacauuguacccuuuaauuaaucuuucaucaucuaccccccucccacccacuuagggcuaagaagacugagccauuuaggggaaauugcagagggauacuagugggaauggaguugaagauaaaguggauacuaagaaagucuugaauuuuuauauuaguauaguuugcauuauuuuccgauuauaaugauuuauagagauuguuuauuagaaaggcuugauuauuuacagauguugugauuugauuuuuaaauugacgagucaugggaaaugugguauauuuuaaugauguacuuuacuucaguuuucauccacuuuaaaauggaagcauucaaaacaugaaaucacaaaaauagaaaagcaauuugaugcucaaaaacuuagaaacugaaaaaaggcuaaaaaauuauaacuugaugauguuuuuacucuuaguucucuuguauuuacauuuauuccuaaaucgaaauacacugaguaaaaaguucagucagauuuuuaaaaaauaugaucagacuugucauauuuaagaacacagcuuucugcugcuuaacuucuauagcuaacacuuuagauuuuaaguaaacaacgugaauuuuaauacagaaaguaaauuuuuugaagggauccuugaguauuaagccaauuauaacuguucuuuaaucuuuacuguccacugucaguauuuuaguaguauuuaggaaauuggacaucuuuauuuaaauuuucagaauaccuacaaaugcauucuuaguuauuugauuauuucucaugcuauguaacuaucuuuuuaauguuaacuuuuacauugaauaaaucauuuauuuauuuuaauguuuaaguuuuuccacauuuggccagugcgagcccuuucaccugacuuuauauguccucuuaacguacauacaccauucuuugagcgcuuauuuucuggcaguacaagguaucccaaauuauuguaauuucucagcccuaauucuaagauuagccauuucugcaaagaccucuagguucuuuuucuggagaaugauacuuagaaauugagaucuggguucuaauuguacuacuauuauggugauagcauugcuucuaguccuuucaguggaaggagcuagaaaauaugcauacaaacacauaugugagugagagcuauauuuauuuuauaucuauuucucucuaauauguauguauauauccacucaaauuauauuaauuccuuuaauaaacaguuaaaaaaauuuuuuuguauuacaagaaaaauguaggaauuuauuuuaugcuuauauuuauuuauacauauuuauaauaugccuauauguaguauguguuuguaauguagacauguuggaaaccuaguguguuggcaguuuugcuucuuccacaaauuuauggaguuaagcuauuuauaaaaaauuuauuuuuuuaaauuguaaaauacacauaacauaacauuuacugucuuaacugucuuuaaguauguacaguucggugguacuaaguacauucuuauuguuguacuaccaucaccaucaucuauccacagaacucuuuucaucuuacaaaacugaaaccauguaccuauuaaauaacucgccauuccucucugccccuaaccucuggcaaccaccauucuacuuuccaucucggugaauuugacuaguguagauaucucauauaguauuugucuuugugacuggcuuauuucacuuagcauaauguccucaagguuuuuucauauuguggaauuguuucaggauuucauuccuuuuugaaacuguguauguguguauaucauauuuauacauuauagaauauaaucuuauuuuuaauguaaaguagauuuuuagcauuuuuauuucuauuuagauaacuuucuuuagccauuuucuuuuagguuaggucugcuggcaucaaaucuuuucauuuuucuucaucugagaaugucuugauuucucuaugauuccugaaggauauuuucacuggaaauguaauucuggguugacagcucuucuuucagcccuugaaguguugugccacuuccuucugccucuguugugaugugaucagagaaaucugcugucauuugaauuguuuuacccuuauaguuaagauggguuuuccccuaaauacuugcaaaaaucuuucucuuugucuuuaguucuuaagggauuugauuaugaugcgucuugagauggauuucuuuagguuuaccuuauuugggguuugcucagcuucuugauuauauagguuaaugucuuuugccaaauuugggaaguuuucagcaguuauuucuuugaguacuuuuuaaaccugcccucuuucuccuuuucuucccaguucugaaugacaugaauguuggaucuuuuguuauaguccuacaggugcuugccacugaucauuguuuuagggucuguuuuuucuuuauuguucaaacuggguaauuuccauuguuuuuaucuucaguucacugauucuuuugucaucuucauucugcuguugggcccaccuaauuaguuuucauuucgguuuuaucuguuauuuauuugcugagacuuucuguuuuuuuucaggcguuuaguaauugcuuguugaaacauugcuggaucuuaugguaauacuauguuuaguuuugugaguaaccaccagacuguuuuccacaguggcugcaccauuuuacauuccuaccagcaaugcacaagaguuccaguuuccccacauccuuaccaacacuuuuuauuuauuuuccuuaucucucucucuuuuuuucauuucaauggccaucuuauaaugggugugaagucguuacucuuugugguuucugauuugcauuucccugauuacugauguugaccaucuuuuuaugugcuuguuggcuauuuuuacauauucuuuggagaaauguuuaaguucuuuguccauuuuuuaaucaggguguuaggguuuuucuguuguuauguuauaagaauucuuuauauauuugggguauuaaucucuuauacaguuugcaaauauuuucucccauucugaguugucuuuuuacucugauagugcccuuugauguacaaaaguuuuaauuuugaugaaguccaaguuacuuauuuuucuuuugcugccugugucuugguaucauuuccaagaaaucauugccaaauccagugucaugaaacuuuuucccuuuguuuucuucuaagaguuuuuauaguuuuagcucuuacauauaggucuuuaucuauuuuuaguuaaucuuuguagcuauucauuucccuccuaucuccuuuguuaaagagaaaauaaaagcuucaugaccaaagauugaacacugaguaacaauuuuacuauuaaacugggaacuagauccaauaacaaaggggugguggucaggauaagacucaaggcucaggagagggaaagugguagguuuuuuaagagcugaaacccaugaacaaucuguuucauaucagauaagcaaagucugucugugccugauuagauggcauaugugagcuaauuguuuaggcauuguguuccccugaguugguggugguucuucuggaaaguugucguggugaugaacaugauuaugguacuaggugaagauggcacuaugguaguuuaguagaaaucaggcauguuucacugucaucagucuagguggcuaggucaggauucaucaccuuccuucuggggucacuuucuuuuuuccuauaauacauuuuuuaaggaguuucuuuaaugauaaucuauuggugacagaaaucucuguuuuugcauuccugauagauauuuuugcuguuuauagcauucugggauaacaguuauuuucucucacaacaaugaaaguaucaugcuccagucuuauggcccacacuuuuuccuauugacaaauuaggcauuagucuaguuguuucuuuuaagguaaucuguuguucucucugacugcauuuuuuuuuuuaauuuuuaauuuuuacuuuuauuuuuugagacgaaguuucacucuguugcccaggcuggagcucaauggugcgaucuuggcucacugcaacuucugccucccagguucaagcgauucuccugccucagccucccaaguaguugggauuacaggugugugccaccacacccagcuaauuuuguauuuuugguagagacaggguuucaccauguuggucaugcuggucuugaacuccugaccucaggugaugcgcccacccggcccuuucaaaguguugggauuauaggcgugagccgcugugccuggcccucucugacuacauguaaauucuucuccguuuauuuacucugcuugagauuuguugagauucucggcucuguggauucgugucuuucauugguuccugaaggguucuaagccauuauuuauuuaaauauucccucugcuuucauucucucucuucaggauagauauuaggucuuacucuauccuucaugucucuuaaugcucuaauguuuuacaucucuaugucacuagaaguuuagaaaaugucuuuaguucucuuauauagaguucauuaauucuuuuuucaaauauuuuaaaugugcuguuaaauuuuguguuuuuaauuucuauuauuuucuaggaauucugcucagacucaauuuugaaccacuuuuuuauuucuugaagcauguuaaacauuuauuuuauaauguaacugauaguuucaauauugaaguuuuuguggaugucaucuacuguauuuuauucuuagcugacucucuuuaaugguaccauguuuacacacagugauuuuuuaaaaaugugagcuguucauuuuucuuauacuuaugaaaauaauuuuuguggaaauuaguugcacuuuggaauauaugugauuccuuccaggaagaauuugugauuguuucugccaggugccugggaauaucacuauucuagaaccauuuucaaagcaauucuuggcuuggaguuuuguuuuuuuuuuaccaccagguggugugaauuggggcugcaaaucaucaugaagaccagcaugugguugcacguucuuaggaguacccuccucccaucagcuucaagguuuuaaacaggcaguccucuuucagucucuaggaaggagagguugaaaaauaguagaauagacaauguuuuauuaacuaacuuuccauuugagauaauuguacauuuacuuguaguuuggagaaauaaaacagauaucucauguacucuucacccagucuacacuaaugguaacaccuuauggacuauaauacacuaucagaaccaagauauucacgugauauagucaagauauagaacauuuucuucaccacaaggaucccucauguugcccuuaguaaccacacucacuucccuuucacucccuauucccucuuuaaucccuggcgaucacuaaucucuucuccauuucuauacuuggucauuuuaagaguguuguaaaaauggaaucacagauuguagagucuuuugggguugguuuuuuaaaauuuaguauaauuuucuggaaguuuuuucagguuguuacauguaucaauaguugguuccuauuuauugcuuaguaguuuuccaugauauggauguacuauaauuuguuugaccauuuaguugaugaaagacaucuggguuugcaguuuugggcuguuguaaguaaagcugcuauaagcauuccuguacugguuuuuaugugaacauaauuauuucaucugugauaaauguugaaaagugcaauuucuaaguuguaugguaauuguauauauaguuuuuuuuuuuaauuacuggacuguuuuccagaauagcuguaccauuuuacaggaaggcaugagagauucaauuucucuacuuugccaguauuugauguugcuauuuuuuuuuuauuuuaaccauucugaaaacgaugugguaauauuucauuuugguauuaauuugcauuuaucuaaugguuaguauguuguacaucuuuuuaugugcuuauuugcaucuguuuauacgcuucauugaaaugucuuuucaugauuuuugucuaugugcuaauuggauuguuugcuuuuuuuuguagguuuuuagaguucuuuauauauucuagauacuaauccuuuguugauuaugugguuugaaauauuuucucccagucuguaacuuuuaguccuuaacggaaucuuugcagaguaggcauuuuaaauuuugaugaaguccaguuuaucaauuuuuccuuuuauggauuaugauuuuggugucaaggcuaaggacucugccuagccugaguacugagaacauuuucuccuauguguuuuccuaaagguuuuauaguuuuauguuuuccauuuauguuuaugauccacauuuauguuaauuuuaauauaagauggagaguuagguugagaauuuuuuuuuuuugcuucuggaugucuaaaugaaauauuacagcaucauuuuuggaaagacuauuuuucuuccauugaguugcuuuuguaccuagucaaaaaucaguugugcauauuuguguaggucucuauugugacauugaucuauuuaucucucuacaaauaccacacagucuugauuacuguugcuguauguuaaaucuuaaaaucagguaaacugagaccuuucacuuuauuccuuuucaauauccuuuuaguuauucugauuccuuugccuuucccuauaaauuucaggauaaucaucaaaauuuucaaaaagucuugcugggauuuugauaggauuugcaucaaacuuugcuaugguuugaaugcuugccgucuucaaaauucauguggaaauuuaguuucuauuaugauaguauuaagagaugucaaauaccuuuaagagguauuuagaucaugagcgcucugcccucaugaauggacaggaguggguucauuaucgugggaguggguucacccucucuuucacccucuuuuugcucuugcaccaugugaugccuucugucauguuaugauguagcaggaaagcccuugccagaugcuggcaucuugauauuggauuuccuagucuccagaaccuugagccaaaacaauuucugugcugguaauugggguauuuagaucauuuauauuugauguaauaauuaauauauuagagcuuaagugugacauuuuguuuuuuuguuuucuguuucuuuuuuuuuuccccucuguuaucuuuuacuuguuuuccuguggguuauuugaacauuugucuauuuugauuaauuuauaguauuuuuauuguuuccuuuuauauagcuuucuugguggcuucucuaggugugacauaauguaaaccaacuuaucacagucuacagguguuauuuuacuaguucaagugaaauguagaaaccuuauuucccuucauguauuuuuacccuacccuguuuauaauuguguuaaauauuuucuugacuuguaaccacaucagacaauauuuuaguuuuuaccucaacugucaagucuuuaauaaaaacucaagagaaggaaaauguauuauauuuagcuauauuuuugcugucuguauucuuuuuuccugauguucuaagguuucuuugaugauuucucuuuuguuuaaagaacugucuuuagcuauuccuuccuguaggguaguuccacuggaugcaaauucuuugaguuuuccuucaucugagaaugucuugaauuccacuugauuauuaaagcaauuccugggucguucuugaagggcauuucugcugguuauuggauucugguuugacgguuauuuuuuguaagcaccugaaaaauacugugccacuuccuucuggccuccgugguuucugguaagaaaauuaucccgcuuuucuguucuuucucuuuugauucuuuuuccucucuuuguuuuaauuuuaauaguuucuugugcugugucuuaagcauucauucauucaucuacaucagugcuuacauuuguuaaucccauccauguuauuuauuaucuuagauacuuauuuuuuuucucuucauaugggucauaguuuccugcuucuuugcauguuuguuuauuuccagugggaugccaaacauugagaauuuuaccuugguggguccuggauguuuuuuauuccuguagauauucuugaguuuuguucuuagaugcagaugguuuauuuguaaacaguuugauccuuuugaguuuugcuuuuaagcuuccuaagguuggaccagaguagucuuuagauuaggucuaauuuggucccaguacuaagacaguacccuuuugaguacccuuaucugaugcccugugcauuaugagauuuuaaaaauucugguuggugggcagcugggugcaguggcgcacgcauguaaucucagcgcuuugggaggccgaggcggauaggucaugaggucaagagauggagaccauccuggccaacauggugaaaccccgucucuacuaaaaaaugcaaaaauuagcugggcaugguggugcaugccuguagucccagcuacucgggaggcugaggcaggagaauugcuugaacccaggaggcagagcuugcagugagcugagaucgugccacugcacuccagccuggcaacagagcgaaacucccucucaaaaaaaaaaaaaaaaaaaaaaaaaaaaaaaaaaaaagaauucugguuggugggaaccuaagugagcuccagggauucuuuuccugugguucuuucccuugccucaggcacucucuuuacacacauaugcugaugagaaaucagccaaacacucuagggggaugcacuguaggucccuuggagcuugcuguuugcacagaguguccagcuuucuucugcccuguauccugcccugcgaguuguagcucuuuccaccccuugaacucccaacuccuuuaacucagggagauugcuggacuccaccugcacucucccucccugcacugcagccuagaagguggcuuaccuuuuuuguuucugcuuucacagggaucauuaccuguguugccucuuguucaguguuugaaaaucauuguuucauacauugggagauaaggagcaccaacaggauuggaauguuagauaagaugagagaaggacuugauugagaaaugaacuauucugauuaucuuuugcuauauaacaaucugcccccagaucuagugacuuuucucguagaugugcaguuuggguaagguuaggcugaaacagcuuguuucugcucugcuaggcaucagcugggggcagcagaaaggcuaggggcuggaaucgucugaaagcuuccucacucaacauguaggugguugaugcugguugucugcugagaucucauuugggauguggcuggaacaucuacacauaguuuuuccaguggcugcuuggcuuccuuccucacagcauggaggcuggguucuaacaguaaggagcugagggccaggaggaaguuauuacaccuuuucuaacccagccuugaaaaucaugcuguguauuacagggagucacuaagucuggucuauauuaaaggggacuggaauuagccuccuacuuuugcuggaggcaaguuagacuccuacuuuacguagggaagcaagucaaagaauuuguggauauguuuuaaagccccacagcagugauacuugagcaaaggaggugaggacauccagggaaaaauauuccagguacaugguacagauacauaaagacccugaaggaugauggaugccugauaguuuagauuugcuuauagauuaguuaccacugcacagcaucaccuccuugagagcagggugaacaguguugggagaacaguguugaaagauaguugcaguucaacaauuuuuuugugaaaggcaccauguauuaaaaauucuaaaaaugcguacauauacuuugaucuaguaauucuuucuuugagaaauuaucuuaaggaaaaauuauacaaacaagcaaugcuguagugaauguuuggaggggcuuaaaugcccauuaauagcagauuaguuaaauuaugguuugucuauauaauggaacacugcaguuuuuaaacugaauguuuuggcauacaaaaacaaugaguauugagggacaagaaguagauuucaaauacugguauaugaaauuguccuauuugguuaaaaguacucucucuguauaauaaauauuauaugugcauagacuggagaagaugagaugagagcaaugguggcuauuuuagaguugcuuuucagaaaacuguauguugcuauuauaacagaaauauauuucuauuguaaaaguaaaagcgccuuucaagagaauauguugauuucuuuuuauuaacugaagaagggagaauaagacaaaauauguacagaaaaaguguagagugauguaaaaucaagauuuuucaagagauuaucucuugauuauagguuacuuuuauuuccuuuuauauguuuuuguauuaauuguaauuuaauuguuaaacucauaagaaggagauauauauuaaaauaguugugagggauauuguuaagcagccuuguuuuaagaguagcugucgugaaaaauucaaauuuuuagagacuagcaaaaucaagagaucucuugguuuccuuuagugcagagaacugcagaauuucuuuacuggacacaaaauauuaugugacuuacaacauuugauuuacacacaauucuuaagcuaucauucuuuauuaaaauggcuauuuccauauuuaucuuauucuuuaucaccucuuuaucauagauuuuuaguaacuuugcacauucaugaauaaaauucuagaugauguacuaauacuuuaauuaauacauauuuuauugcaaaaauguuuuuagguuaauuguucucauuucacugucuuuucccuuuauuuuauauaaauaauuuguaauucauuuuguucuuauauaccauaggauguguuuuggagaugcagacaaaauaucuuugaugaaaugaagaagaaauuuuuacagguagacugcugauguaauugcuuuaaugugauaaucagcagagcaaguaacagcauguuaguauuuuuauuuaauaucaaggcaugucuuaaguuuuaugcuuguuuggcuauuuuauuucuacccaauuuuaauaauaaaaaagucaccuuaaaugaauuuguaucugauaguaccuuguuuuuaacuagugaaugagggagaaaaaacugauagaaaaacuaaagaacccuuuguuaugauguuggguaugauaguugccuauuuuuccagauauauuuauuuucugaaauauuaauaauuuaggaaauuaaaucauuuaaaaauuuacaaagucaaaauccagaaauccuauuacuauugauuuccucagagccugugugcacuacagacuuaaacuuccaugugauguagcauucuggucuaaccuuuacuuaauacuugauuuuccuucagucccuuugcucuguuuuuuccccagaguugcuccuuuaaucucucuuauccuucccaaguguggcaacagaccacuuagaaaaagaucauguagauaacaucagaguuggcugcaguuuugaggugggaugaagggaguaucuuaaaaauaaagucucuuuuuuuaauguaaguuaggaccuucauuaauagccuuagaaauguuacuuguuaaaauaaaaaugaagagucuaaaugaagcugauacuuuuuuuuuuuuuugagacggaguuuugcucuuauugccuaggcuggagugcaauggugugaccucggcugacugcaaccucugccuccuggguucaagcaauucuccugccucagccuccggaguagcugggauuacaggcaugcaccaccaugcuggcuaauuuuuuuauuuuucguagagacaagguuuugccauguuggccaggcugaucuugaacuccugacuucaggugauccacucaccuuggccucccaaagugcuggguuuacaggugugagccaccgugccuggcagcugauacguuuuauaaauuucaaccaacaaaaauauucauacuaucaauucuguuuuaaaaucuguggcaauacauuaaucuugaacuguggauacccagaugggaaugcucuaaggccuaauuacuuagcuuguggcagcuccuguaccaaaagggagagaaaauugacuuauuguguguguguguguguguguguguguguguguguguguguguguguguuuaaaagcuuguaaccauaauacuauuauuugcaauaacauugaaaggaagaaugucuuagagagcauggguuaaauuuagagguaaagcgguaccuucauaauuuuaaaauacuuuaucuuaauuuuuucucuuagaaauauuuaaaucuugauaauuuugaauuuugauauuagcuuauauucuguaugcugaugccauucugaacauauacgaucaauuuuaaaccucaguguguauucuuuaauaagaaauacauaggaguauuuuuuugaaacaaaaauuaugauguuaucagagaacucagauuugagcuuaaaacuauugggaaugucaagaaaaggagacaagaugacuuaagaggcaagcaucccuucagcgggcucuaaaaugucuuagaacuaugccaacgacuucuagauguuucuagcaguuaaguguaucuuuggaagaaaacuguuuucagugcuuuuuaucccaauauguuucaccuuuuauaaacaagacuaugguuuuauucuuucuacuuuuuuuuuucuuugagacagagucuugcugucgcccaggcuggagugcaguggcacgaucucagcucacugcaaacucuaccucccagguucaagcgauucuccugcuucugccuuccaaguagcugagguuacgggcgugugccaccacacccagcaaauuuuguauuauuuguagagacaggguuuugcccuguuggccagguuggucuggaacuccucaccugaagugauccucccaccucggccugccaaagugcagugauuacagaugugagccaccucaccuggccauuuuuacuuuuuuaaaaaggauuuuuuuucuucaaacuuugcuaggaaaucuagcuuuguuucugcaaugaauguagccacagagcacucuauuagcuuauacaguaaauauaacugcuguugacuuuccccuuagucucauaaguguaauauugcuaugaguugccuguaaaauaaauaguuucaacuuuaggauuuauaccuuuuuuuguacuuggcuagauuuucuuuguagaaaacuuuguccucuucaaauagcgcaucuaaacuacauuaaauguuuuucuaaauggaacaugcuguaggcuuuucuaaaauuuuacacuuguuuucucuuaccucagguucaucagagaacucuugacuaaaaauuuuugcucccuucccuaaaucaugauguauccucagaugccuuuucuuaauguuggauguaguacuuaaaugaaaaguaguaccuuucccucccuaccaacagcaccaucaucauacuuuccccacuugaacuuggaugugcucgaagguguuuagcuauauuuauuuuuuaucuauuacuauguaacaguggacccuaaaguuuagugacuuaauagggcauuuaguuuauuuguucagauuucugugggaugggauuggggccagggcucaccagcuauucaguucugcuccagguggcaucaucuagaauuacuuggcuccauuaaguugguggcagucauugaauggaacguccaaaaggcuuuucucauacaucaggcaccucagugucuccaccaaguggcugcuuccucugaauguggauuucuagggcuuccucacagcaugcugauugaucccaggguaacuggauuucuuacaugguggcuggguuauaagagggaauguuuccaagaaauacaaaagcagaaacugcugguuucuuaaggcucugccuuaaguuacacacacagcgugacuucugucacauucucuuggucuuagauggucacgucagauucaugagaaaaggaaaaaaaaaagaauggcaaagaauuuuuugcuaucuuuaauccaccucaagacguaauuguuuuuaccuuugggcauaaguaggaucaguuuugguuagggcuacaaagaaauuaagaaagauagcugcccuaauuucccauuuccagaaaaaaccuuuuuacauuuaaauguuuuggaaauguuuccugcauguuuaauuuauauuguauagguuuuuuucucuugaaaagcuauuuaagaaaaaaaaaaacuauugccauaucuuauuggugguaucuuaaaauugcaacaacaaaaaaauuguuuucuucucaguucccaaacuggagaggggaaaggaggagagaaauuuuacuuuagugugauuacuguuagcaauggugauucuaaaauucagaugaaguccacauguuauauuaaaguauaggugaaauaagaaugggcccagaaaguugaguguaaaguagaauuuagcaguggcuagcuuagagcuuuaaagaagagcagagcuuuuuaucuguuuaaaucauccacaacagaauucaagaguaaaauguaauuugcugagaaauucuauguauaaggauuuuaaggaaauaaaguauaugaaguuuuauguagguguucaucacagaauuauuuguaaaaguauaauaaagucuuggagacaauaaaauagaauuuauuaaguaaauuauuauuaauccguauacuaacaaauacuacuuagcuguuaaaaugaugaguuaggaaaagcuuuacagggaaagauugcaugauauaagaaagauguuagaaaacagcauguguauucuaauccaguguuugugauuauguagcaugcaugcauagccuuucucucucucucucucucucuuucucucucucucucucugugugugugugugugugugugugugugugugugugugugugugugugugugugcgcgcgcgcagauaagauauuuggaaggauauaugccagcaugcuaauaguuaucuguggguuauagaguuacagauuauuuccauuuuuuccuuuauacucuuaguauuuuuaaaaaaagcaaaauuauuuauauguacggaaaagaagggcuauuacuaaaaagaauauaagccacacaugagauugaauuuuguuuuuuucuguauaacauauuuagucuuuagauaggauuucauugagggauaauuuucccacauggaaggagaggcaucuggggugcuuggacccugcauucacauauuuagggaaagaaccaggaacugcuaaugucugaccauaugauguugccacaucaccauucuuauguaugauuacuauuacagcacuuuugauuucuaaauucuuagcguugucuuccuuugaccaucaacuccagcuuauuugaagcuuuaaaaucuggcuacuacaguauuuuauaccaggaacgcugaaucauucagacuugaucuaucccugaaguauacuauugaaucuauaaaaguguacguuuuguaguugaaauuuauuuugagucauuuacucuuucaucauaaaccagcauuuuuaaaaagaucuauuuuauguuuuuuaguuuaggguuaaaauguguaaaauaaucuauuaaauguguuaauauaacaucuaaaauauauaggugaagguuuuuuuaucuuuuuugaaauguauguuaauaauguucuuuuguuucuuuuauuucacagaaauguauuuucuuuuuauuuuuuaaguaaguuuuuaguaauuaaauauuuggaugugucugaauuguagugcuacccaauuuauuuuaaauauuauacuuuuauagcaacuuacuuuuguucuaaacuaauuggaguaacuuuaauuuaaaugaucucuugcaaacccaaaauugugugucacagaaacaaaugauaauuguauuacuucaacaaacaaaaaacuuuguggcuaucccaucuucaguacuagccaauuauaauuauucuuauuuaaaaauggauaauauagaagcaacaaaagguugaagcugauaguguuauaaaaacuaaggaagaaauaaauuuuuguguacaccaccaguuuguagagaucauauuucugaauagcccauuauggagauggugagacaucucucaguuuaaugccacaccugacugucagggaaagcaagagauuuacaucaucagauuuguauaucagaaauacuauucgggguugaaggaauauaagauuggaagaaguuaaacuucuuaggaagcuguuccauaauuuuguuguaggauauucuuauugcugcaggcaagaauaaagugaaggagguaguucaagagauauucaaaagguagaauugauagguuuuggagacuaugugagguaaagagggaaggacaaggaagaugcucauuucagcuguuugguuucagcagccaggcagaugauggugccauucauugagauggccauuauagaaggagggaaaggaauuucuuccaauaaaguaucuuugauguagucuuuuaccccuguggaaaguggaaaagugguguccuuuaacagcuugagggagggcauagcuuauuugagaaaguuuaagcaggaaggauaauuugugacccuaauuccuuucuguauugguaauugaaacuguuuccuuguuuuuccuucccccuccuccuggcucaucuguuuggauaagcuugucagccccugacacguuaauaaauggagcuuuuuggacaucuggacuuaugaguacagcagcauaaagaucaggagaugugguagccuguaucccuuaguuauagauuuuuuaaucuuuagacaauccuuacugcauuuuugcacaauucccauuuuuuuuuaggagacccagaaauauuugauuugacuguggcuagcaugguaaugacacauuuuuuaaggaucagauuuuauaauuuuuaacuuaaaauugcuuaaauauuacuaucuucauggcuuauugaccauggauuuacagucuuaaaggugaaagcaaauaucuccaaaaaugauuguugauucugaaaugugccuugauucuuccaaaacaaacauauacggugcuuauauguuugacauauccauuagaaugcguuucagacuacgauaaaacagagaaaauagcacagagaaaauacuuaguauuuccugaggucuuuuacauuuaaucauaaaauuuuauagcuaauuauacuuuuguuuugcuuuaaagauaauauauaaagucauauuuuucuuaaaauuucagauagaaaaugcugcugaagaaccuagagucuuauguauuauacaagauacuacuaauucaaagacagugaaugaacggaucacuuuaaauuuaccagcaucuacuccagucagaaagcucuuugaagauguggccaacaaaguaggcuacauaaauggaaccuuugacuugguguggggaaauggaaucaauacugcugauaugguaaaauccuagacuuaagcuucuaaaaauguuauuauagccauuguuguuguuguuacugaugauaauguuaaauccuggaacucuuaaaaucauaaacaaaaguauaacaacuacaguaagagccuaugugcagcucaguaauuggauccuucuucuuccuuugccuccauucuggauuuaacauuugcucguccuaaaguuuacauaaugucauuucaucaguuuuuucauucaugaaaggugacucucauaauauugucucaacuaaagaaaaauuucuauauuuacugaacagaaugaugaucaucuuauauuauuccgugaaaaaagauuguaaaaucauauuuuaugaucugauuuuuggaaaagaagaaaaauauucauaguaagaaaaauggaagcauauaugccucauacauuacaguguuaaccaagauuaucucuagcugacuauuucuuuuuauuugugugucuaugugcauuucugggcaacuuuuuuguauguuuauuuuucuuuguaugaacauguguagcuuuugacuuuuaacucuuaagcuuaaaaacauuuuuaacgacugcagucuugucagaucucuuugaggguauacuuucuaauuuuagucgucuguuaacuguuuccuuaauuauuuaucccuuauccauuauauuuaguuucucucuuucaugguguagcauuucuuuaaauauuuagugauuuuuauuuucugcucaucuuuauauuugagaaucucuguucacuucucugugaaugcugauuaaacuuaccauauucaguucuugcuuguuguggaaaaagggugagacgugcugcuaggugugauguguuuauacuuguucugggauuggcuggcuucugacucuuuaggguuaggagcugaucaguaccuuguuagacagcacugugcuaccucuccggucacagugcccacucuuuacccugacaggaaauaagcacugcugucugcuacguaguccaaggagaaaaagagaggagauaccaaacugaucagaaugccuuuuccuacuuccucacuuuuagcuguuuccuggccucuaugucuugaccuuagucugaaguuccuuacuaccuuuaucuccacaguagucuucucuuauaggaucuuugggcugugguuccccuuaguuuuauuuuuccauagaucugauccugucuguuuucuauuuuuuaauuucucaaaauuuuugguuugcuaagcaugcucuuuuuugacauuuuauggacuuuaggggaggauuauugguagacaucuucuuaggucaucauuugaccuaaucuuguauuaauguuuacuaccaaaauaaacaauugcaauuauuaaaaaaauuucuaggaauccuugauagacaucuguccuuggaccauuuuuauaaggacacugauuccauucaugagggcuccauccuugagaccuaaucagcuccuaaggccccaacgcuuaauaucauugcauuggggauuagguuucagcaugugaauuuuggggagacauaaacacucagaacauagcagagguacugaucacuuuugcaugggagugugguuaaggaagaagaccauugaguuggaucucaucugcguuauuagaacaguauucuagauagccuuuuuuguuuccuuucucucuguccaaauucacccuacauaauaguuagaauuauuuucagucaucuaaaguuguagcacuuaugucaccuucuaguucaguaaccaucaaucacugcucauugcccacugauuaaaaaucuaagacaagcuauuauugguucuuuaaggcuuuauacucuuaaaucccagauacuggauugguuuauuuucuuaacauagauuuccauauuuuucugucuuaaguuuuccagaaaaauaccucuaacagucagugaaguugaauguguaucccuaugguauuuggaguacauauuuuaaguuggucccacaggagaaucaaagauguuugauguugccugauuugcccuuaaaaucauauuaugcuuuuuauuccauaauauauuuguuuuuuuaaaaauauagaacuaauguuuuaaacugaaauuaaccaguaaaauugguagucggacaagacauagaaagauaaacaauauuuaaucugagacuuugaacacuuucugguacaucaccacauaauuuccaguguuguccuuuuucaguuuaaaggauaguuguguacuguccuagaugauauauaauaucaucuuuuacccuuaaaaagccuuacucaguguuuccucaugccgcuuuaaaaguaauuuuuuucucuuugaccuccuaugcccuuuggcugcaccacuuauaguuccuuuuuguuauagguguuacucaucugugucuuuccauuuccaaugucagcauuuucauuacaggaaccucguauaaauuucauauccuccauaaacauuccuucuaggcauucaaaaagcauuuguuaaauuaucuuccacaauagcuuuaaauagcuguaugucaggauuaccuguuucuuucuuuuuagcuauuacuguacucgagcucuauuucuguauuuuuauuugccuccuguacauuucuacaaauaugacuacuuucuccugcuuacugcguagugcugaauggauacuccucagaaaacuaagcccauuuagcuacccaccaccuuguauacagacacuuacugagguaaaaccccuguguauuucagcugugugaucugaucaugucccaccagugacuuuaaggaacccagcaaucccuuucuucccuccauguggcugcuuuuagcuucagguuuucuauguccuguuuuucuuguggauugauagaugugagccaaaguuaagagguagauaauauauucgcuguuuuauuuacuuaacacgucuuuugcacuuacuguguuuauaguauucuaagcucuguacaaauguaaucuuuuuuaauccuuauauuaauaacuacucuaugagguagaugcuacuacacccucauaggugaagaaacugagucauggggaagugaaauaacuuuccaaagucacacagauaguaaguagcagaaucucuuacaguuaauuuuuuuuguccucaguaccugcacuuuuauacaacguuaaucaguguuaauuuccuaagaaauaaaggcauuuucauaaaaugaguauaaggagacucugcccaugucuuugaaacauuaaaaacauuucuuaauguaacaaaacaguuuuaaagauguuuaucucuacucccucauuuuucucaacagcagucuggagugagugaguagggcuuggggcauacagaguuuccucucucauccaccagcuagaguauauuagaaugacagcuagaguugaaauugcccuaccauauaaguuaggugaagacuugacucuuagauguuuaauuuucaaaggucugaucacagucacuuccauacccccuggguccucugaauccuagugguacauuugaaauagguaucauuuacugggacaggcuuuuccuuaaggagucuuucuaaaggcuauauuauauacuacauuaguuuuauuuuuguuacauuacauaauuauguuacauaauuauuuugguuggguugcuuaguauguugcuuaucugguauuuuucaucauauuuauauaucaaaacauuuugguuuuuaguuauguaaaauuaucuuuggucaauuuucuugaaaccccauuaaauaucauauugcauauauuguauagaacauggaaagagaaauguuuauagauucuuuuuauguguauguagugcuuaacauuaccucuuaacuuucgccuuuucucuuuuuaguuuguuagauguuggggaaugugagucucugggauaccuaucaguguaugcacuguuacugggcuuagcuauuccaguuaaugaauaaaugaguuaauuccaagccuagaugaagagaauuuuaccagaucauuacuaaaaaaauacuauuuaaauguagauauguaucuauuuacagauuacuuauuuuauguuucucauaaucugaaacauuauguuuuauguccauaggcaccacuggaucauaccagugacaagucacuucucgacgcuaauuuugagccaggaaagaagaacuuucugcauuugacagauaaagauggugaacaaccucaaauacugcugguaagcuacuuagaaagccccauauuuauaauuuuugugcacugucaccuacuacuugaggaugcaguuucccaaaggaaauaagauguguuuuguaauuuguguaauaaauuaauauuuuuucauuuuauguugguuuguuauaaguguguagaauaacauaguuacacuggacauccacagcaacauuauuuguguauacagucuguugccgccuuggauuuaacauauacugcugucuucaagaccacugccacaccagggaugggggugggucuaggauaagucaaagugccacaaagaucuccuguguuucaguagugacccuuccuuuguuuaagcauuugcuugguugcuguaaaucuuuggugguuuucaugagguuuuucaguaucugcaagaaggucauuuccguucucacuuccuccccuaaccugccaccuuuuuuggaaugacugguguauacauuaaauguuucacuucuauucuuuuaauguuuaucccaauucacauuucaguggacuuuccuguucagcccaguugccuuagagauaucuaaugcaguaucucccaauuugagggcuauuccaccagagauuuuuuuuuuucucucagugcguuguagaggacaugaguuaaaaaagaguaagagggaggggccaagauggccgauuagaaauagcugcgguccacagugcucauggagaggagugaaaggggagagugaauacagcacauucaacugaaauauccaaguucucgcacugagacugauuaggcaaacaacucaacucaaaaagaaugaagaaaagcaggguggggcgauggcccacccaggagagacacaaagccaaaggaauccccacccccagccaagggaagcugugaaugauuguaugacucugcccaggaaaccacgcuacuuucauggaucuuugcaacccuaagaucaagagauccccucaggagcccacgccaccagggucuuggguccaauacacagagcuauguggaaucuugguagagcagccacucggacacacauauagaccccaggaguuuuacauacucugaccccaggauccccaacaaggugggaaguccauacauaaauaccccuaggaagggggcugaauccagggauccaagcagcauuguucugcaggccccacuuccacagcaccucacaagcuaagacccacuggcuuggaauuggcucccaacggguuuucagcaacuuccugcaggugcauucaggccagcaacaguucaggacccccugggacagaguuuccagaggaaggagcaggcugccaucuuugcuguuucacagccuucacuggugauaccuccagguaugggaaaaacugaggcaacuagggucuggaguggacccccagcaaacugcagcagcccuauggaagaguggccugacuguuaaaaguaaaacaaauaagcagaaaauaauaacaauaauaucaacagaaaagaccccacacaaucccuauucaaaggucagcaaccucuaagaucaaagguagauaagcccacagagaugagaaagaaucaacacaaaaaugucaaaaacucaaaaagccagaaugccucuucuccagaugaccgcagugccucuccagcaagggcacagaacugggcugaggcugagauggcugaauugacagaaggagguuuuagaagguggguaauaacaaacuuugcugagcuaaaggagcauguuguaaccuaauguaaagaagcuaagaaucgugauaauacaggagcugacagccagaauagccaguucagaaaggaacauuacugaccugauagagcugaaaaauacacuacaagaacuuuacagugcaaugacaaguaucaauagcagaauagaccaaguagagaaaagaaucuuagagcuugaagacugucuuucugaaauaagacaggcagacaagaauagagaaaaaagaaugaaaaggaaugaacaaaaccuccaagaaauaugggauuauguaaagagaccaaacguacaacugauugggauaccugaaggagacaggaagaauggaaccaaguuggaaaauauacuuaaggaugucauccaggagaacuuuccuaaucuagcaagacaggccaacauucaaauucaggaaaugcagagaaccccaguaagauacaccaugagaagauuaaccccaagacaauaaucgucagacucuccaaggucaaaaugaaauaaaaaauguuaaggguaaccagagagaaaggccaggucaccuacaaacagacaaacaguagaccucucaguggaaacccuacaagccagaagagauuagggaccaauauucaacauucuuaaagaaaggaauuuccaacccaaaauuucauaucuggccaaacuaaguuucaugagcaaaggaaaaauaugauccuuuucagacgagcaaaugcugagagaauucaucaccauuaggccugccuugcaagagcuccugaagaaagcacuaaauaugggaaggaaaaacuguuaccagccaguacaaaaauacacugaaguacacagaccagugacacuaucaagcaaccacauaagccaggaaaauagccagcuagcaucaugaugacaguaucaaauuugcacauaauauuacuaaccuuaaauguaaaugggcuaagugccuuaauuaaaaggcacagaauggcaagcugaauaaagagucaagacucaucaguaugcugucuucaagagacccaucucaugugcaaagacacacauaggcucaaaauaaagggauggaggaaaauuuaccaagugaauggaaaacagaaaaaagcaggagucgcaauccuaguuucugacaaaacagaguuuacaccaacaaagauaaaaaaagacaagggcauuacauaauaguaaaggguucaauccaacaagaagagcuaacuauccuaaauauauaugcacucaauacaggaacacccagauucauaaagcaaguucuuagagaccaacaaaagagacuuacacucccacacaauaacaaugggagacuuuaacaccccacugacaguauuagacagaucaucgaaacagaaaauuaacaaagauauucaguaccuaaacucagcucuggaucaaguggaccugauagauaucuacagaacuccccaccccacaacaacagaauauacauucuucucaucaccacacagcacuuacucuaaaacugaucacauaaucagaaguaaaacacuccucagcaaaugcaaaagaacugaaauuacaacagacucucagaccauagcacaaucaaacuagaacucaagaaauucacucaaaaccacaugacuacaaaauugaacaaccugcucccaaaugacucuugaguaaauaaugacauuaaggcagaaaucaagaaguucuuugaaacugauaagaacaaagagauaacauaccagaauuucugggaugcagcuaaagcaggguuaagaaagaaauuuauagcaccaaaugcccauaucaaaaagcuaggaagaugucaaguuaacaaccuaacauuacaacuaaaagaacuagagaaccaagagcaaacaaaccccaaagcuagcagaagacaagaaauaaccaaaaucagcacagaaaugaaggagauagauagagacacgaaaaaccuuucaaaaaucaacaaauccaggaguugguuuuuugaaaaaauuaauaaaauagauaaacugcuaguuagacuaauaagaaaagagaagaaucaaauaaacacaaucagaaacgauaagggggauaucaccacugaccccacagaaauacgaaaaaccaucagagaauacuauaaacaucucugugcacauaaaauagaaaauauggauaaauuccuggacacauacaccguuccaagacugaacuaggaagaaauugagucucuaaauagaccaauuaaaaauucugaaauugaggcaguaauauauagccuaccaaucaaaaaaagcccaggaccaaacagauuuacagcugaauucuaccagagguacaaagaagagcugguaccauuucuacugaaacuauuccaaaaaauugaaaaggaagaacuccucccuaauucuuuguaugaggccagccucauccucauacccaaaccuggcagagauacaacaagaaaagaaaacuuaaggccaguaucccugaugaacaucggugcaaaaauccuuaauaaaauacuggcaaacugaauucagcagcacaucaaaaagcuuauccacaugaucaaguuggcuucauucccaggaugcaagguuuguucaacauaugcgaaucaauaaaugcgauucaucccauaaacagagcuaaagacaaaaaacacaugauuaucucaaaagaugcagaaaaggccaucaguaaaauucauuaucccuucauguuaaaaacucugaauaaacuaggaauugaaggaauauacucaaaauagcaagaaucauauaugacaggcccacagccaauaucaaccugaaugggcaaaagcuggaagcauuccccuugaaaacuggcacaaaaugagaaugcccucuuuuacuacuccuauuugacauaguauuggaaguucugaccugggcaaucaggcaagaaaaagaaauaaaagguauucacauaggaaaagaagaagucagauuaucuuuguuugcagaugacaugauccuguaucuagaaaaccccaucgucuuaugauguauuuucauaaaaucagcuuaagcugauaagcaacuucagcaaagucucaggauacaaauucagugugcagaaauugcuaguauuccuguauaccaacaacaggcaagcagagagccaaaucacgaaugaacucccauucacaauugcuacagaaagaaaauacccaggaauacagcuaacaaggaaagugaaggacaccuucaaggagaacuauaaacugcugaaauaaaucagagaagauacaaacaaaugggaaaacauuccaugcuuauggauaggaagaaucaauaucuuguuaauggccauacuguccaaaguaauuuauagauucaaugcuauucccauuaaacuaccauugacauucuucacauaauuagaaaaaucuauuuuaaaauucauauggaaccaaaaaagagccugaauagccaagacaauccuaaacaaaaagaacgaagcugaaggcaucaugcuacccaaguucaaacuauacugcaaggcuacaguaaucaaaacaucauacugcugguaaaagaacagacacauagaccaauggaacagaauagagaacucagaaauaagaccacacaucuacaaccgucugaucuucaacaaaccagacaaaagcaacgaggaaaggauucucuauuuaauaaauggugcugggagaacuggugagccauaggcaggaaauugaaacuggacuccuuccuuacaccauaaacaaaaauuaacuuaagacagauuaaagacuucaauguaaaacccgaaacuauacaaaaccuuagaaaaaaaucuaggcaauauuauuuaggacauagguacaggcacagauuucaugaugaaauuccaaaagcaauugcaacaaaagcaaaaauugacaaauggaucuaauuaaacuaaagggcuuccacacagcaaaagaaacuaucaucagaaugaccagacagccuacagaaugggagaaaauuuuuacaaucuauccaccugacaaaggucuaauauccagaaucuacaaggaacuuaaauuuacgagaaaaaaacagacccauuaaaaaguaggcaaagggcauggacagacauuucucaaaagaagguauacaugcagccaacaaacaugaaaaaaagcuuaacauuacugaucauuagagaaaugcaaaucaaaaccgcaaugagauaccaucccacaccugucagaauggcaguuauuaaaaagucaaaaaacaaaagaugcuggcaagguuguggagaguaaauuaguucaaucauuguggaaaauaauguggucauuccucaaagacuuagaggcagaaauaccauuugacccagcagucccauuacugaguauauaggcaaaggaguagaaaucauucuguuauaaagauacaugcacucauauguucacugcagcacuauucacaauaauaaagacauggaaucaaccuaaaugcccaucaaugauagauuggauaaagaaaauaugguucauauacaccacagaauacuaugcauccauaacaacuaacaagaucauguccuuugcagggagauggauggagcuggaagucauuauucucaggaaacuaacacaggaacagaaaaccaaacacuacauguucucacuuauaagugggagcugaaugaugagaacacguggacacagggagggaacaacacacacuggggcauguugugagggagagcauuaggaagaauagcuaagggauacuggacuuaauaccuaggugaugggaugaucugugcagcaaacaaccauggcacacauuaccuggguaacaaaccacauccugcgcagauacaccugaacuuaaaaguugaaaaaauaauaauuuaaaaaauuaaaaugccaaaaaaagauuaagaaaaccuggucugauuuaccucacucuuuuacaggcugagacuuuuucagaauccuucuguuuaaugacgcuuugcucaggaaagauuguucuguuugaugcuuuucauuuagaaguuuauugugauuaacaaugccugucuggauacuagacaguaauuaaacacaguccaucuguacugaagcaguaacagaauaugcucucugaucuucauuaauugcaucauuuaguuuuaugacaucaugagaagauuuugauuagucugagugacauugaaaucuaaaauagcuauuaauuuagggaacucuggauucacaguucagggauucauguuuuuaaaugcauaagaauucuucaguucuguucuaauugcuugugcugcuuuuaugucccuuaauccuuuucagcaucuuccuuauuaaaaugaaguuucuugucagagacaguaggaaacuauccaucucaccaacaauaauuguguguccccuaugugcuaggccuacguggccaggaugauauaaaaaugaaugauagacugucaucacggaguacaaugguacuuuucguuuauuaguaccaaaaaucuucucucauguaaacagaaaauuugaaagaaaauuuagaaaguaacacuuuggaagggggcaugagcaccuuuccagaguguuuuguaucaggcaucauucaaaccuuccuacaggaaauggugaaugcuguuguuucagcaacauuugcuauuuacuaacuauuugaauauguugcauuuuaggaggauuccagugcuggggaagacaguguucaugacagguuuauagguccgcuuccaagagaagguucuggggguucuaccagugauuaugucagccaaagcuacuccuacucaucuauuuugaauaaaucagaaacugguaagauuuguuguauuuucauaaaaucauagggcauuagauccaaaguaaucuuagcgauuugaagccuaauccucuuauuuuauggauaagaaaacugagaccuagagcaggaguacuagcuagcagccgcaaaguuagaagaaguaugugguuuacuuuuccuucaacccacucguuucuacuauauugcugcugccacuauuuaauaauaacguaaacauuauugaauauuauguuuuuaaggaagacuuuucuuuucuuuuuaauuuucuuuuuuuuuuuuuuuuuuugagacagagucuuguucuguugcccaagcuggagcacagaagcuugauaauggcucacugcagucuugaacuccuggacucaaucaauccucccaccucaguccccugaguagcugggauuauagguguacugggcacaguggcuaacaccuauaaucccagcacuuugggaaggccaaggcaggaagauugcuugagcccgggaguuggagaccagccugggcaaccuagccagacaccaucucuacaaaaaucaaaauaaaaaaauuagcugggcauggucgcuguugcuuguagucccagcuccucaggaggcuuaggugggaggauugcuugagcccaggaggucuagguugcagugagccaugguggugccacuauacucagcuugggugauugauugagacccugucucaaguaaaaaaaaaaaaaaaagaaaaagaaaaaaaaaauucaagacuucuuuuaauaauuuucuauuuugacuauacucugaaauuuuuaaaguggacuuccuccagaaaggaaagucuguguugucuacuuuuacaguacuuccauuuugaagcacaugggccaugcuuauuuuaugggucuguuguguuaucuuuuaguuuauucauuuuagugcuugaaaugaaucaugucauuuugaaauuucuuuuuuucucaauacgauuaagccuauguuuuuuaauuuuuucacuuuauugagcaaguaaaauggcuuuuuuaugcaaagguuuauuuacauacaagauuguuuaaucgccuaaugaauaaaucuugauaaauuuacauauuauuucaucuuaaaacaaaucuuugcaauagauaguauguuuuauguugaaggaaaugaaaacggguucagagaagccuuugauugcauaugucauuaaugguguuucaugcuaaguauggcuucagaaacuuuacucuuagaacuucaaaacaggugauuuuaaauauuacauuacaaauaucaguguaaaaagaacacuauaguguuacauugcagauugcuuauuuuuaauuuuauuauuauguuauagagauuagagucuugcuuugucacccaggcuggagugcaguuguaagaucauagcucacugcagccucgaacuccuaggcucaagcgauccucccaccccagccucccaaguagcuaggacuacaggugugcaccacaaugccugucuuuuaaauuuuuguagagaugaggucucacuauguugcccaggcuagucuugaguaaucuuucugccucggccucccaaguagcggggaauacaggugugcaucacaacgccuggcuuuuaaauuuuucuagagaugaggucucacuguguugcccaggcuagucucaaagugaucuuccugacucagccucccaaguagcugggauuacagguagaagccauggugcccaacuccagguuuuguuuuaaugucaucuguaaucuuucguuuacuauauuuuguaauuagaauuuagaauaauuuccucauagcuaguuauugugcagcuuuaaugguuuauuuuuucuggaaauaauaguaaaaccugauuauguuugguauuuaggauucauuucuaucaguagaacuuuuuguagcaaacaaccacaauaaaaaaaauacaaaauuaucuuugauuucagauaauaggagguaauuaaacuguuucccauuacacuaucuagaguagugauucucagauuuuaauuucuuuaaaauuaauuuuggggguacuuguuaaaaaugcagguuccagccgggcacaguggcucacuguuauaaucccaucacuuugggaggccgaggugggcagaucaccugaggucaggguuugagaccagccuggcuaacauggugaaaccccaucucuacuaaaaauacaaaaauuagcugaccgugguagcaggugccuguaaucccagcuacucgggaggcugaggcaggagaaucgcuugaacccaggaggugguugcagugagccgaaauugagccacugcacuccagccugggcaacagaaggagacuccaucucaaaaaacaaaaaagaaaaauguagguuccaaggcauuacuucccaaaaugcugauauagcugcucuguaguaggcuggaagaaauugcauuuuguuucuuauuauucugagauagcuacauuauucugagauagcugaaacacugugagagaguuccagauuuaacaaaucaagauucuugagauauuugcuuugucuucugacaauugauucagucauuuuugcaccaaguauuuacagaacuccuacugugcuuguacuaacuucaacuuccuguggcucucugaggccugugaauuccuugagacuaagacaugcuuuuuuaaaacgcucuuucuuugauuauacaaauauauuaaaauacaugucauugucuuacuauaaaauaaaaaagugaaaauaauuuacaguacuacuggcaccacuucuagcaauuuugcauauuuuuaucuuaucuuuccucuauauguguacuuuucagaaaauggggaaucaugaguagauuuuuaauuaauguuuuucacuuaauacuauaugaggaguauuuuuuaauguuauuaaauaguauuuuaauauggggcuuuaaauggcugaaaaauaguuucauuuuauagguucagauauuuaaauuguaauuauuaauauugcugauauuauuaugaaaauucuuauacauacauuuuuguuuucaucucugauuauuuccuaaagauaaaaauucccagaaauuauauuaguaaguugaaguuuacuuaaaaaaauauuuuuagaagucuuugcuauacauugccauguaaucauagucuuuguucgcauuuacuguuccucacacaccucuacuccacucccuuucccuaccuguacauuuuccuccaggguucuagggguccugccuuccugaguuacucuauaagcauccaaggugguuguguucagaaauuauuuuaucagggguuguguucagaaauuauuguaucagauaaaauuauuuaaucaaaccauugaguuugcauuuccuuaagaaauuauuauaaauuuuggcaccaugugugaaauguucuuauuagaaaaugcucucaugauuuuaacuuagggcucuagaaacacauuucucaguaaagcaauggguuuggguacucaacauacucuuuccugucucuuuccuaccacuucccacugguagccagccacuguugauaggagaugguggguuggggagaaauaaggaguagauugaaggcuaaugugaacuuacaagugauuagaaacuaaauccaugauaccugucuuuggccaguuuuuuuaacagccuuuuuaucuacuucaggaguuggccuauuugauuccacuucacugggccuguuugauuucuccuucuuuagugguugguucuguuuaggauuucuuuuugcaugugcccucuacuggaugguauauguucucauauucuucuugcuuacugacuuauacuaaaaauauugauucauaacuauuucagauguagaauccacuugauaauagcugccauuugaaguuuguugauuuagacaaugcauaaugagaaagguuucuguuaauucauuagcacuuuuaauagugucaccaaaaucgucauacuuuuggaaaauaguacauuuaugugacacaguguucauucuguuuaaauauggugccaaaucaaguacaaaagaucauagagucauaugugauuuuuauaccugaugguaaaauaaagagcuauggcaaaaauuaauugccauuacucucuucuucucuucucaagccuaccccgaaaacauuuuuuuaagcccaguaaagggaaacaaggucacaaacaagugauacaugauugauguguauguacacaaaggaugauaguaguauucauuuaccuuguaaggcuccaaguagauugguucucccccagacuguugaggaauugggaggaggaggacggagaagaaaagaaaucccagagcagccucagcucagaagaagauacagaacaauuggucuccuggacaaauugcuguuguuugugggaaaggcucuguuuguaugaacuaaugaaauaauguuuuuuauuauuaauaaucagcuuagauaccauacaaacuuguguuacuuguaagucauacacauugcccucucaugugcaucugcugcugugcuaaguaauaggagagauagaagucagauucaaucccugcuuucacagucugaugggggagacauauaagcaaaugggucguuacaaaacagugagauaaaggcucuaauacggauuaaauauaggauccuaugagaacaacucaaguggggaauagucuggaauagaagcaguuuaaaauaaugcaaugauguagauuaagauauaaaccacccaugcauacacgguucuuaaaauaaaggugaaaaaaauaaaagcuugaaccuuaguacaaagugaaaagcagauagcuaccaugcuuggucuuuucuuggaauccuauaaguacagaugguguggauacauaucacccuuugcacagcaugcugaucuauagaauuucauugacaggcuuguugaaacagaugaagucacucugcauuacuuagagucucagcuuuugugaguuugcauguagugaauuuaucucguauguuauucauucuuacagaaauuggcuuauagggcuugaugacagggguaacugguucuguauagucuuucuacacuggauguguguggugcuguuuaaagugaauauguuuaugcuuuuccauuauaaucuaguuuaauauguuuaaaaguuuaauauguuuaaacguuuagauuuugggggaaaaaguuuaugucuaugccaguaacacauacuuuacugaacauauuacucuuaaaauguuaaugucauauaaucuccauguguaccucuggacauaucuauaacaagguauccugacauuuucuacaaaacaaagcuuacuuagagcacauauuagaaaagggaucuuuucuuaggugcuguugaacaaguugaaauaauuuccaaaugaguaguaacuuuaaccucugaaucuuuacugugaauuaaauucuuauuauguuuuuguuauuuuuaauguaaaugcugauuaauguacauuuguauuuucucuuuaaaggauaugugggacuaguaaaccaagcaaugacuugcuauuugaauagccuuuugcaaacacuuuuuaugacuccugaauuuaggaaugcauuauauaagugaguauucaaaaaaauuguauacauaaaauugauuuaagaaugaaaauaucacuuuuaacaaaauuuaucuucuugcaguuauuuuaaaguuuggggcauuucucacaccauaagauauaacuucuuuccuuacguaauaacaaagaucuugugaaaaacagguauaugaaaaaugugugcggagagagaaucagaaguauauagagagcaaaaggauaaaauugaugagauuuacauguaggguaaaaagcuucccucucuuguagccuuaacacccuuuaugaagaaauaaauaacugcuuuugagagaauucgaauauauaaauccauacucuccuuccaccucucaauuuaaguauccaaaguuuuuuuuuaacuugcaaguuuuguuucuaauuaaaauauaauacuuacagcuuguuucaugugcgugugugugcguguguguguguguguuuccuucuaaaagacuccauauacauuagauaguuuaaaaugcucuauggaggaagucuauguuuaaguaaacccugaagucagacauuuauuuuuaugaauauccuauuaugacacauuuaacacaccuuugcuuuguauauuuucuuuaagauaaacacauaauuuuuuaguuuuuaaggauacuuuuaaguaugaguaaacugauuuuuuuuuccuuuuuuguguuacuuuccacuaacaucuuuaaauuacuguaaauauguauuuagguuauuuuuggaacuuuuaauauugcugauuguguuacucaacauuauaucaccauuagauuaaucugucagcuuguuaucugaacuuacagaaguugauguauuugucauucuguaugcauguauugcccuguaguguuuaaaugcuaggcacuugguggauagagagggaauuaguaauaagaucuuuguucuugaguaauuuauaagucuuucuacaauagcaauauguauauguuugaaauaguuuaaauaacauuuaaagacagccaaauaccauuagaguuuaaagagaagaaagguuggugaaacuuggagaagaaaguaagcuucagguaggucaugaagcuagauaugguuuggccagguugagaagaaagagaauacacugugcagauaggaggccugucaaaagugaaagugaauaauaggaagggcuaccugaguguuagucauuguuuguaucagauaguguuccgagcacuuuauauauagacucacuuaauucucauaguaacuguaugaauuuuaugcuauuauuguccgcauuuuacaaagaagguaacugaaggcacagagaaauauagcuuugccugaaagcacacugcuagaaguugcaccuaguagaugccaggauucacuacucuguucugccugugcacuagcggaugccaauaagcacaguguguugcggggggcuucaggagaucagcauaaccagaguuuugucagaguacuggaggaugagguuaauaaauagaguucagagccugcucucaaaacuagcacagaccagaucguuggacaaugugccuguuuuagggaguaugcacaggaauggggauccugggcacuuguuuaaccaucuguuuuaauacucugaaaguggacuguaaauuuacagcacuguagaggaaauuaagagcauagccagggcuauucaucagcaaacauguauuggacauuuacugugugcuaggcauucuuuuagguauaaggauuagagugaugaguaagagaaaguaccucauuuagagcuuccuuagguaaaccuauauauaagcucauuucacagaaucauguaugccagguagaaaauaaagcugaguaauguggagggaguaauugucaggagaagaggaggggagggucacagcuucagguaguagacaguaagggccucccugaggacauuccaggaacuucacaggaacaagcccucuaaagauuuacaguaagagcauacaaggcauaagaagccagaaguguaaaggucuucaaaaaacaaaagaaacuagaaauccguugugacaauccuggugaguaaggaaguaggagacagacaugaggucaaacagaaaggaaggccuugagauugugagaauagagugaaguuuauagcagguggggaaacaaagccugagagcacucaugauguuucuuaauguagaacuaagaaccucauugaacuauccacagaguagugcuaguggaaaaggauagacuauccacagaguagcgcuaccaugaaaggauagacuagccacagaguagcacuagcguaaaaggauagacuaucuagagaguagcacuaguguaaaaggauagacuagagaguagagcuagcguaaaaggauugacuauccagagaguagcccuagcauaaaaggauaaaguauccagagaguagugcuaggauaaaaggauaggguuuuguuuauuuucuucacuuuuuuuuuuuuuuuuuuuuuuuugagacggagucucgcugucgcccaggcuggagugcaguggcgcgaucucggcucacugcaggcucugccuccugggguucauguucauucuccugccucagccucccaaguagcugggacuacaggcgccagccaccucgccaggcuaauuuuuuguauuuuuaguagagaugggguuucaccguguuagccaggauggucucgaucuccugaccucgugauccgcccgccuuggccucccaaagugcugggauuacaggcgugagccaccgcgcccggccuauuuucuucacuuuuugcauaguagccaacagagaaccugccacuugauuuggagucauauacgugauggguuaaauacauuguuuuaggaaaguuuauauagugcaguguacaggauugauuugaaagauagagaaccccggaggaaucuguuauuaaaccaggcauggauauauuagagucagaaugaugaugguggcagugguuacauuucagauugaaaacuaacauggcuuagugacaaauuuuacuuaggaguaaaggaaaggaaagaaucacauaugcaccaaaguuucuaacuaagaugacuaaaguaauggcaaguaccagcaagacuuaaaaccuuuucagguauuuguaccaggacuaaaggacaggugagaauucagucuuauuuuacaguaauuccucccuauuagugaauuuaccacacaagaaauuugagcauuuucuguuuuaaccaauauuuucucacaguuaacaagagaauuuuugaucucauaaugucaguuauaaguacccgcuauugaagauaaccagaaaaaagggagcuggggauugagaauagaagaggggaggauuaaagcagaaguaagguauugaauagagguguuugcagggaagccuugagaagaaaaaggugaaauguacuucauugacuucugugaggcggaagggagugccaguguguaacaaaaggaagaugagaacagagcugugacuucucaguccuaaaguaagaaaaauauugaacacucuaauagaaagccauucccaaaagaaaagaaaaagucuuuuaguaugucuguaaagugcaucagagaaaaauuaaagcucaaaccuccuuuugaaacuaaaaaguggggaaauaguaaucuuacuccuaacuuaagauguaaaauaacauuaauauuguuguuacuuaauauuuugucuuagguguauauuaugaauacagaauuauuuuaaagacuuugguggguacauuaccaacuuuaguaccucaaucuuauuucuuuccaugagaucuuaaguucuucaguugggaauucacuuguuauugagacaguagcuguagcuagggcuagacugcuguuuaucauaaguuugugagggugaaaaucuuaccuggauuauuauuuuguuuacuuucuuauauucccuuucaaaagcuuuuuauuauggaaaauuuuaaacauucaaaaaaagggaaguaggcugagugcaguggcucacgcuuguaaucccagcacuuugggaggcagagguggguggaucacuugaggucaggaguuugagaccagccuggccaacauggugaaacccagucucuacuaaaaauagaaaaauuagccaggcgucauggugcauguguauaaucccagcuacucgggaggcugagacaggagaaucgcuuaaaaccaggaggcagagauugcagugagccaagaucaucccacugcacuccagccugggcaacagaacgagacucugucucaaaaaaaaaaaaaaaaaagagggaaauaguguaaugaaucccucuucaccagucauucagcuuugaauauuauuaauaucaacucauagucaaucuuuuuugucuauacccuccaacuugauuguuuggaagcauaccuccaucauaucaucuguaaauuauaucucaggucagggcuacgauuucccugauugcgucauuuaacaauuuguuuaaaucaagauccauaugagcuguauauugcaguugauuaauaaaauucuuaaucuauuuaauuuguuuauaauccucuuucaucuuuuuucauccuugcaauuuauucccugcaaaaaauagaaagaaaacugaugucaucuauccuguaguuuuccacaguuuggguuuugaugguuguaugccguaguaucucacguaauaguauucuucuguuuccuguauuuuugugaauuaauaauuaggacagagguuauggucagauucagguuccacaguuaaaugagcuuugccuucuuuucuugagcacuuuugccuuguuaugccuuguuaugccuuuucuuguuaaagucuaaaguucuucugaauuuaugaauuagggaaacacuaauguuucauuagauauuauuaguuucaauuagcauucaaacucuguauagcuuccaggauuaaaaucuuacauuauuaugauuuugauauuaauuaugcuuuuaaauaauaaaaucauuuuauaaauacuuuauuaacauuuuauuuuaauaggugggaauuugaagaaucugaagaagauccagugacaaguauuccauaccaacuucaaaggcuuuuuguuuuguuacaaaccagcaaaaagagagcaauugaaaccacagauguuacaaggagcuuuggaugggauaguagugaggguacuaauucucuuguaaugauaagcguucuaauauucaaacaaauucuagaagacaauaauauuacaaacacauuacacauaauuaccuuuaucuuaaaccuuucauugcaaguuuguugucauauauuuucuaacacauuucauaacucuacaaugaaaaauaacaaacaugacaaauauuguagcaccauaaagcauauauuauuuauagaaugcugcaaucuauuuucuggcgugugauuuccuuuucaugacugucauguauauucuuauguucuuuuuuaaauuuggcauuauuuaagguagacuucaauauuucugucuauuugcuuuuaaacaacagauuguuucauuacauaaaguuuauagcuauuucuaauugaauuuuaucuuaaaacagcuuggcagcagcaugauguacaagaacuaugcagagucauguuugaugcuuuggaacagaaauggaagcaaacagaacagguaauuuauaucucucaaaucaaggggacuguuuccuaauaaaucacuuguuacccuaaaugacuuuuauucuguuggaauguuuuaaaacuugggcauuagucucaugguuaaaguacccaaugggaaauugaaaguacugaguucucauuuagccauuaacugaguuauaaauaccaucauuaaaccacccuagaccucaguuuucucaucuuuaaggaaauugggcuguauaaccuggaaguucucuuuuagcucugaaaauuauacauuuaaaaacuguauauauguguuuuggggaugauuuuugaacagcauuuucagauaauuagguaaauuauauguuuuguaaucuguaacacaaguauagucaugaagcauuaccuuuauuuugaccaaugaaauauagucauauguauuugacauuuaggauccucauuaaucuaacccgauucuuauguaauggaaagaggagcagguuagaaguggaaagaacauuagauguugggaugaggaguaaggcugaaugggauggggcucaauacaugggaggguuuauacuggguauaguaaaugaaggucacagggauaaaaggggaagaguauauaagguagcuagaagggucugauaucugauuggaacuacugugauggcuuggaccaguuuuuccaaauguagauuacaaucuauucacggguuauaaaaucaguuuauugggccuacaacagcauuuucaaaaaauggaauagaauagagcauaagagaacaucacauaagaguaaguauuauuuuauaaagcucuuguuacaguuauaugcacuggguugcaguguaaauuauuuucuuauggugauuugcuauucaguauuugaaaaacacugguuugaaccacuucaaaaggccguccuaggugaagaagacaaucacauaugacugacgcugaugaaugaagaaggcuucauuaaauaagugguuuuaguguagacagugacggucaauccaguuugaaggcuuauaaauccuauuuguuugaagaaauguaaguuuaugaaagaggcaagauguaguacacuuauccucaugccuguucuuacuuaggagauuaugaaaaaauuuuuaaguucauuuagugaucuaguuucucucauagucuuauggggcuguguuuuaguaacuauguagaugguauugggggcuguuucuucuucauagaucugaaguuacucuuuuuccugguuacaucccuuucugugggucagcacuuccauuaagaucagcuggggcauuccuacugaguucccaaguuuugguacaaaacucuuugguccuuacuuagggaguuaccuaccgccuuugagucagaaaagcccuaguuaacuaaguuuggggacuaggugagagauccauucuuuuaggugaggauauuuugagagagguggauuuuaagauuuuuuuugaauuuccauacauuuuaaaaagauuaugguguaauauuucucuauaaaauuguguuauguauauuacugaaagcuaaaaaguuugauuugcaucuugagcuagaggauaugauuuauacaucagaauauauuauugugagaagugauauacauauguaaguuauaaaaacucaaccaauuguuuagcuguauaauuauuaacaugcuuaaagugauagguuaggauuuacucucaucuuaauguaaagauaauuugaggcuuaauugguaacugauuucaucaaaacauuaaucguucgguuuucucaugaugaauauugaaaucguuaauuuuugcacacugacucaaauuaguguuaaucuaauuuuauugauuuuagguuauuuguguuguuuugauuuuuucuauaaaauuuuagauaaaucuuaaauauuacauaauauauaauaauaaauauagauaaauauuaauguuuucaaagauuuuagcuguaaauaucaauauccuuuuguaaaccauucuaaaaaguguagaauguuacauguuuuaaagguuauuuuuaaggaacacuuaaaaauguaaauauuuuauuuuuaggcugaucuuauaaaugagcuauaucaaggcaagcugaaggacuacgugagaugucuggaaugugguuaugagggcuggcgaaucgacacauaucuugauauuccauuggucauccgaccuuauggguccagccaagcauuugcuagugugguguguaccuuucaccugacugcuuguguauccuuacacagaauacauaauagcacagugguauaaucucuuguaagguaaguaucauccuagauacaccuucuuggguuguuagucauuccugcauuuaaauuagcaagaucuagaagauuuuugacccuucagugaguccuaauagugcauguauuauaagagagaaagugaaugcaaauguacugccucaugguucaguguuuuauucuuuuggauaggugauuagaugauuucacuuuuaucuuuuuuuuuuuuuaccucuaaacagucuauuuuauaaaugcuguuauugugaccacuuuuugcacuggaaaguacuuuguuuuggggggauuguuuugauccauacacuuuuaaaauugguaaaagcaccucugguuuuuaugacaaacaguccauauuuuuaaaagaagcaucccuacuuuaaauauuuaguuuaaaaaauauacauuguaguagcacagauaauucaaagaaucaaaacuguaaucaccuuaauuauucauauacugaguaucugauuggaggauuagcuaagauuuucucauuccauaugucauccauuucuuaauugcuuuuuuauaauuuuuuaauuguauuuuaucuauacauauguguauuuacuuauacgacaggaaaauaauggaaagacuuaaguugauauuuaaaauuaaagugcucagaaacauuuauuugaaccuaccaugugccaggggaagcuuucaaagcuaaauaagauaucuuuaaacaauagaauuucauuauguuuuauguuuuggucuuauuuauguuguuauuaaacugaugguggcuuguagcuaaaaaucaguuuuuuaaaagcuuuucuauacuucuaagauagugcuacaaguaugguuuaguccucuggccucuaggaugauugauuccuuuugauuuuuucuccuaccuuuauauggcuauuaggaaauaaccagcaauaaauuauggaaucagucaauggagauacaaagcaagcaucuaaguaaaagaccuuuucuggguagcguaagaucaagucuccuuucugcuacuguuuuucauagucggcuuccugaguauauuugaaaaguuuuuuagauguuuaguacuacuuuuuuaaauggccaucuagguguauuaaaugagcuuugguuuggauggcuaguuuugguuuuuauuuuuuaaccuuauuuugcuuuaauuggcaguucaaaguagaaaugacauacugaaaaaaucauugaaaaacuaacauuugucuuucaaugacugauuuccuaacuaauuuuuaaauacucgcauuucucugacaaaauauacuagggaaauauuugguagucccaagugauauggacuauuuuuuauaccuuauuuauuaaaguauuuuuaugaaaauuuuuccauauauacauuuaauuuaguuuuuaacauauuaauugaauauugaggaagcuaaauuuugcuguauuaaaucuuauauuugaguauucagcaaauauaauugcucagcuaaaucuuuaugucauuauuuauucaccugcugauuugccaccacucucuuaaguauauuaauagacaaaguaauggagugauuuggaggauacuucuggggaugugaacaauaucacauuucuaaauggaauucuccaaagguaguauccuccacugaugauacaugggugguaguagugguggugguucagugggaauuggaaguugcagcuaugaagcaguaugugagcagguuuauaacacacaugcgcuaauagggcuugcggaagagaacuuaaaacuuucuagacuuugcuggaaucucuugagggaaauuacagcaggugaaacuacccaagauagggguucuaaggaggauacuaccuucggagaacuuuaguuagagguaagugauuucucauuauuuucugaauuuaaaucuauaaccuaacucuucuuaguccacaaauaucaucauacagcaucuaaaauugguuauaugucacugcuugccauuuuguauuuuguuaacuguguauguuucaaaaagaauuugacaugcuuuaaaaagaauuggaauuauggauugcaaaaaucugguuaaaagagguaccauaaaaucacucauugagauuauauaaaauuggccugaauuuuaacuggacucucuuaaaauuauuauucuaccuuuuuuaguggacugguauuuuugucuuauuuaauauauuagauauagacguaggcugggcauaguggcucacaccuguaaucccagcacuuuagaaagccgaggcgggcagaucacuugaggacaggaguucgagaccagucugacaaacaugaugaaaccucgucucuacuaaaaauuagcugggcauuguggugcaugccuguauucccagcuacucgggaggcagaggcaggagaauugcuugaacccaggaggcagaggcugcaaugagcugagaucgcaccacugcacuccagccugggcaacugagcaugacucugucucaaaaaaaacaaaaaaagauauagauguagacauauacacuagcacgugcaugugcacgcacauguacacacugaugguuauauauucuguuuauuguauguuuuguuuagugugccacaauauuauggguuuaauuucagauaauuaagagugaggucuuuuaaaaauugaaggguuuuucuuuuuuuucucucucucuuuuaaaaaauuuauuaaauauuuauuucuuuuuuuagagauggggucucgcuguguugaccaggcuggucucaaacuccuggccucuagcaauccuccugucucagccucucaaagugcugggauuucaggcaugagcuaccacgcccagccaggguuuuucuuuuuuaaaccuucaucuaaaauguccaauuucuggaguuguuuuaucuuuauggucaaauaaauuaacuugcaaauaauagguaggauuaaaauaggacugaaaguagcacucaucuaacuuauuauaauauccacaaucaauuuuuauggguuuuuuuuuaguaugauaacagguuauuuuuauaaugagugcugggagacuucugcaguuuaaaaaauaagcucccguaaaguagggaggucaaaaaaagccuuuuauuauaauaauuucuuuuuucaauagauuuuuaguuauuguaacugauauuuguuagauuucugaucuucauuuuacucauccaaguacggaaucaauauugaaaggcucuucugccauucuguauaucucagauugaguucuguucaauacuagucuguaaaaggauuuaguagauauuuuggggaagguguccuugauuaaauagauuugggaaacuauaacaauaauccucuuuggaaauaucacagugcauauuauauuuuaaaugccccagugauuccuguaguugagaaguuuguuuaaauguguuuaaccuagcauuuucuuucucugugggacaucuguuaauaucucaagagacauuaggauucugaggaacauaauaugggaagcucuacauuagauuaaggugauuuaagaaugucacuacuuuguuuauauuuguguccuugggauguugagagggagugagaauacuaaaauauguguuauaauuuccuguuguuuuacauauuuuuuauuaauccugaaaaauuaauaucagcugaagaauuacuuguaguaaucuuuaaauaauuuugcucuuaaugacuuauuagauaguuagaaccuucuauguucacugacuagaucaaaguaacuuugacuaugcuuauugccaaccccaugugagaauguauuaaauaaggagauaguucuaaguauauucuaguaauacauagaaauuagaaauauuaacuuuuuguuuguuaauuaugaaagcauaauuuauaaauuaaagaaaaacaauguagccucauguuugacauuaucuaaggaagugcuuuuuuauuuaacaguaaaauuuuagacacugucuuuuuauugguguauuuugucauacaacauuuauuuagggccuacucuauggcagacacuguucuaggccauuuucuuuuaggauacuuuuauucuauuguucauuacguacauuuaaauaccuguuuauuaugacaaaaacguguucaaaguuugaucaggguuuagcugcauaauuucauacagugccuuuggagaaauaagauuauauaaaagacuuguuuccuaaguaaacauaguuuaaugauuguuuuaaaguuuugaauggaaaauugugaaauuaguaagugugaaaucaaaagcauuucaacuauuuacacaaguuuauauuauaagucuuacccugacauaacaggugguuuggacauucuuacaugggugacucagccacagaacucauuugggugaagcagugguccaaauuuguccaaauauguaagcaucaguuaaagaaaaaucucuuccacagacucuacccucauuuuuccaggaauguguaugguuggacauagugggaacaaguuuaaaaaguggggacuucugcuuucaggaagauggaguagauguacauugcccuauuccucccacuaaaacaacugaaaaccuugagcauuauauguaaaauaaacauaagaagacugaaagguggagagaaggcauacacacuagggaccucagcacccaaggaauaacacgguggugaguuccauggguuuucuuuuugccuaauauaucccaggcuuggaacugaagaagcuggcagccuggaaacagcaauggguacagacugaaaaacccuguucucuuuaacugaaggacgaggaaaaagacagccuagcaagccagaaaacuuuuagaccauaacugcugugcucuaaccaaacaccacagaaagaaaaggccuuacaucaacuugugccugccagugcugaguggggagccuagauucucuguuccuucaccaccucccagggguaaagaggcgagccccuccugcuugugucaguguugggguguaguacugagauacuccugcccuuuacagccaagguuauaucagcagaggccuacugaauacccagaauuccuuucccugcgcagcacuaacaaggagcuuccuccauucagauguccacauaggccaagugggaaaccuggacuucuaaugccaucuggcacuaauauggcagagcccuuuccccagaugguacagugucaaaggaggcauuuaaacuagaagguuuaaauaugguccagaaucucauaacaccccaaauguccagguuucaauuaaaaaaucacaaaucucaguuugaguuaaaaaagaaaaccaguagacauaaacacugaaaugacaaagauguuagaauuauuugauaaauauuuuaaagcagccaucauagaaacacuucagugagcaguccuaagcacacugaaaacaaugaaaauuuuagggaaucaguuagagauacaaagaaaugaaaauuuggaacugaaaacugcaauaagcaaaauuaaaaacccaguggauaggcugaacagcugaaugaaagagacaguaggucgaaucugugaacuugaagauagaaugauagauauuacccagucuaaacagcagagagaagauagacugaaaaaaauauauauccucaaggacuuaugggacuauaacaaaagguuuagcacugugucauuggaauacuggaaggagagcaaagguguaacacuugugucauuaaaguccugaaaggagauuaauaaggaaaaagaaggcaggcacaaagaaauaauggaugaaaauguuccaaauuuagcaaaaggcauaaaccuacagaucugaguagcugagcaaaccccaaacacaauaagccaaaauaaaucaggaauggccauauuagugucagauaaagaagacuuuagagcaaagaaaauuaccacagacagagagggcuguuacauuguaauaaaagugucaaacaaccgagaagacaacaauccuaaauguguaugcagaaaauaacacagcugccaaaauacaugaaggaaaaacugucauaacuaaaaggaaaaagacaaaucuacaauuacaguugcagacuucagcacgccucccucucuuacugauagguagaacaacuagacagaaauagcaaagagguagaacucagcaacaccaucaaccaacagaucuaaugaacauugcuaaagugcuucacccaacagcagcagaauacacauccuuuucaaguauccauuaaauauauacgaggauagaccauaugcucuggaccauaagaccucaaaaaauuuaaaaucauggaaugugugauuuuuuucaacaacaguggaaucagauuagcagacaggaauaucacaaaacacuugggaaauaacacuucuaaaugauccaugggucaaagaggaagucucaagggaaauuuuaaaaauauuuugaacuuaaugaaaaguaaaacauaacgaauuuuuuugaggcacaacuaaagcaauaccgagagggaaacucacaguauuaaaugcuuauacuaaaagacaggaaaagggccaaaucagaaaucuaagcuuccaccuaaccugaaaaaagaagagcaaaagaaacccaaagcaagcggaaggaaggacauaauaaagaaaagccgagaaaucaguaacauugaacaugagaaaacaguagaggaagucaacaaaacaaagggcuggcucuuugaaaagacaauaaaauugacaaauagcaagacugacagagaaaaagggaaggcaaaaauuuccaguaucaggaaugaaaaggauauaacuauagaucuugcagauaucaaagggaucacaacaaacaacucugcacauauaaauuugacaacuuagauaaaacgaaccaauucuuugaaaagaacucaauaggaauuagauaauuugaauaguccuguaacuguuaagguaauuacauuuauaauuuaaaaccucuugaaaggaaaucuccaaaucuugauuguuucacuggauacuuguaucaaacauucgaagaacagugaacaccaggucuguacaauuucuuuucaaaaaaaaagaaaggaagaggaggaaacccauaguccugugacacuauucuuaccugauauuaaaccaagacaguucuuaaaaaaaacaguaucccuuauauguguaguugguaaaauucuuuccaaaauauuagcaaauggaauuaagcaauuuauaaaaagaauuauauauugugacuaggauugauuuccgggauucaagacuggucaguauuuuaaaaaucaaugaguauaaucuuccauauuaacgagccaaaaaagaaaauucauaugaucauaucgauuuagaaaaggugcuuaauaaaauucaaaauucacuuauaauaacucagauuacuaggaauagagggaaauuuccucaacuugauuaaaaaacguaucuaaaauaucuauagcuaacaucauacuucauugugagagacugcuuucuuccuagggaauggcacgcuugucuaggcaaggaugucugcuccuaccacuccuuuucagcauaguccuagaaguccuagccaacacaguaagguaagaagaggaaaugaaaagcacuacuaaaggaagaaauaaaauugucuguauuuuuaggugauaugauuaucuauguagaaaaucccuuguacaaaaaaaaaaaaaaaaaaacaacaccugaacuaauacgugaguuuagcaagguagcaggauaaaaauaacauaaaaaauaaauuguauuucaagauacuaacaaugaacauguagaaagugaaguuuaaaauacaauaccauuuauaauuuugcaaaaagaaaaaagauggaaauccaacaaaaaauguacuggaccuauguguucaaaacuacaaaacuuugaaaagauuauguuaaauaagcuaggaccagaaagacagauauuacauguucucauuuacaugugggaacuaaaaauaaagcugaucucaugaagguagagaguagaaugguaguuaccagaggcugggaacaguguguuugagagaggcggggauaaagacagguugguuaauagguacaaacauacaguuagauagaaucaguaaguucuaguguuugagagcagauuagagugacuauaguuaacaauauauuguguauuucaaaauagcuagaauagaagauuuuaaauguucccaauacaaagaaaugguaaauguucaaggugauggauauccuaaauagcuugacuugauucuaugcauguaucaaguaucacauguacuucauaaauauuuacaguauuaugugucaaaaaaacuuugaaaagaauaaauggagaaacauacuguacuuauuaauuggaagauucaauauaguaaagauaauuacauagucuuaaugcaguuccugucaaaguccagcaagauuuuuugaggacauauacaagcuuauuccaaaauguauauggaagccuaagaaacuagaauagcuaagaguuuucaaaaauaaaaauaaaguggaaguuaccagucuacaugauuuggaauggaauacuacuuagccaaaaagacuuauuauauggcuauaguaaucaagacuaugugauauugguagagggguaggcaaauagauccguggaguagaauagaaaacccagaaauagauccacacaaauaugccuaauuauugacugagacacaaaagcaagucaauggaggaaaaaugguguuuccaacaaauggugauggaacaacuggacauccauaucacaaaaaugaaccuugacuuaaaugacuuuauacaaaaauuaacucaaaaugggucauaaacuuaaauguaaaauguaagacuauguaacuuuuagaaaaaacauaggagaaagucuuccagaucugggcuaagcaaagaguuuuuagauuugcuaccaaaaguacagucuacaaaagggacaauuagcaaacauuaaaauuaaaaauauuuacucucugaaagcccauaugauaaagagaaucuccagacauauuugcaagcugucuaucugacaaaggacucauaucuagaauauauaaaguacucucaagacaucaguuuagaaaaauucaucuagacaauuggcaaaagacauaacauuucauuaaagaggauauacaaaugucaaauacagaaaagauacucaacauugcuggcuauuagggaaaugcaaauucaaaccauaaugaauauauuauucuuuaccugccagauggcuacaaauaaugacagcauggaaaucuggugacuauguggagaaacuguaucacacauacacugcuggugggaaugugaaauguuauggguaguuucuuauaaaaugacacgugcaguuaccauaaacucuagcaauugaacuauuggucauuuaucccagaaaaauugaaauuuauguuuacaugaaaaccugugcacaaauauuuauuccaucuuuguuuuuaauauucaaaacuggaaucagcccauaucugcuucaguaagugaaugguuuaacaaacugugguucauacaaaccaugaaauaguacuuagcaauaaaaaggaacaaacuauuaauaaacacaaaaacuugaaagaauauccagggaauuauuccgagugaaaaaagccaaucucaaaagguuauuacauacuuuaugauuccauuuauguaauacuuuugauaugacaaccuuuuagaacugugggacagauuaaccauuaccaggucuuacggauuuggugggagcagggagaggagaagcaggugguuguggcuauaagaggguggcacaaguuauccuugcauaggaacuguucagucuuuugacggguguugaauauaugaaccucuacaggugauagaauuguauggaacuuaauagacacauauacacaggcaaaugagugcacuaaagcugggaaaaucugaauuagauagguguaugaaugccaauaucaugguuaugauaugccauaguuuugcaaaauguuuccaguaaacugggggaaguguacaagaggucucuguauguuauuucuuacgauugcauaugaauuuacaauuaucucaaaaguuucaaugaaaaaaaaaguagacagcuuagguaaaaguauauaggccuuuuccuaguuaaaaaguaguaauguuaaaguauauauucgggaaagacaguugaauauauuuuuaaggaaaacaucauguuccuguauaucaguaguaccaaaauugcuuaguacaucaaaaucaggaaauaauucucagugguggaucuacuuucuuuuuuuguucauguaaaaauugaaguaugguguuuuaacacucauuucucuauucaaaauuaaguagauuuuaauugaugaauaauucauauguacacauaaaugguuaaaaaaaggauuuauaggcaauaccauuccuugcauauaccuuuugauugcacugugccuggauuauuugcauuagcucuaaaauuggaauaacccguauuguuuuugauuggagaacuaaggauguaagaauucuuuauauucuauccugaauucugaaaauuauaguguaaaaggaugugcaggcugggcaugguggcucacgccuguaauccuagcacuucgggaggucaaggcagaggauugccugagcuuaggaguuugagaccagccugggcaacguggugagauccugucucaaauaaguaaauaaaaagaugugcagaauuacauuuugcauaauauauggggagcaguaagaucuagaauaugaaacuguugucacucuggaauuaucaacaugguacucugacugaauuaaauauucucaaaugagcagaacaaaaccugguauccaaaaacuuaagcaaagaaauagauuuaaaaaacaaaaacaaugcuguaagaaaugaagugggaauucaucaaauucaggaaagaaacagaagaaaaagacaaaaauaucuuagaagugaagaauaaauuaaaaaaugcucaagagaaaauagaaagaagaucuaaugaaggacauugaauggaaaugagauuuuuguaaaaguaaaaaggaucucagaaaaaaaaaauugaaagagaagaccagcaaaggguguccaacauaauuggagucugugaagaagaaaaauaaaacaguggaccagaacuaauagauaaacuguaauucagagaaaguuucugggaauaagggaaaugucaagucuaccuuuugaaggaccuggaaugauaaacucugagauguauuuuaguaaacuauuaaagaugaauugaggccagucacaguggcucaugccuguaauuccagcauuuugagaggcugaggcaggaggaucccuugaacccaggaguuugagaccaguuugggcaacauauugagaccaugucucuacaaaaaaauaaaaaaucaguuaucaguugugguggaaugugccugugguccuaacuauucaggaggcugagguaagagaauugcuugagccagggauuucaaagcugcagugagccagcacaccacugcauuccagccuggaugacagagcaagaccucaucugaaaaaaaagaugaauuggguuggcaucauauuucagaagaacaacaugcaaauccugccaacagaguagcaauuuccagaaauucaagaaaguaccagccaaggauuugauagccaggcaaguguuucuuaauuaugacagcuauaaaaagacaaguuugaauauucaggaacucauuggguauuauauccaugagccauugaggaguucauuagaggaugagcuuaacccaaccaagagaucacgggcagcuucggcaaaagaacugugagcacuuacuauauuaaauuaaggccuaaauacaagggugggaacacgggaacagcagaguaguauguaauguuacauguuagacaaaguacaaauaauaccacuuuuuagaagggggagagaaagggagagcagaauaagaucacagacuguuguguggguggggaauaaaggagaccauuuaaaacuggcagacacugaaagcuuaagaaagaguaaacagggugggggugggugggaaaaaaagagguccaaggacacuaacaaaacuauaaaugcaaaaguaacuguagaauaaaauuacaaaccuugcuaaauaccaaaagaaaauguaaaaaauaacaaaggaacacaauaaauauuaccuaacacacacaguaauuacacaguagugacugagauaggaccaagcauaccagucauaucaaauaugagugggcuuaaauugccuauuaaaaagauuuucaaguugguucagaaagcaaacauuaaaauuugauuuaggcaggaaucuguaaguggauguuaaaaucaaggguggaagauuugguaaggcucaggauuuuugcauggucuccaaguaucuccuuacagauugcuuauuagccgcgagaguaaaaauaauaacuauaugguagagagacuggacaauaccuugaccagauaauuaaagcuaauaucaccaaagagaaaguuagguacaucauggccugugacuaugcuacccuuagaagggcacaucuuugcuaaugucauaguagccuagcaaggaauguauaaaucuaauaaugaagaacaucagacaaacccaaauugcagaacauuuuauaaaauaaguggccucuguucuucaaaaaauaucaguguuaugaaagaaaggcaaacucuggaaugccucgagauuaaaggaaucucaagagaccaaacaaaaucuguggccuugagacagauuguguacuagauggagagaaauacauuguuaagguaauugacagaauuggaauauggcugaugaaaguacuuuaucaguauuaaauuuuccagaguuugauuacuguuuguguaagaauaucuuuauucuuaaaaagucauauugaaguuaagaggcaaagcaugaugaggugugaaccuacucucaaauggcuaaaacaaagauacauaauaauguuggguugggcgagggaaagcaaaauuggcaaaaauguuuaaaaguugaugaauaugaguaaaguauuugagaguucucuguucuuuaaacuuuucuccaaguuuuaauuuuuuuuaaagaucucuagguauuaacuauaagccggagaccaauacacacacaccaaaguagaauuugaguuacauaauuaucucacucucccucuccccccauccuuuuuugaauauugaguuuuuaccaguuuaaauuaccacuauuuggaaagccugacauuuaguaucagucuguguuaagcuauagauguaauuucuuuaaagcuuguuuuucuguuguuuuuuauagaacuuuccuuuuucccccaaaaauaugccugagagggaaaaaaaauuuuuuucuaaaugugucauuugaccaccaauaaaaugcauggucauguggaaaaaaacccagccguuugguuucuucacuuguuuccuuguguucugagaacaaaauaggggaucagauggguuuagacaccuuugaauaucuaugucuuuucuuauuuuuaucuuguuccaaagugagcucuaucaaacaauauguggacaguaguuuucuaagcuuugccagauauuuugcaacuacgaccauuaagcuccuuuaucuuuugaggaacagcuuguccuauaucaaaagaaaaauauuugaagauacugucuuaaugauuccauuucuuuuaguuuauguguaauauuaucaguaguucugcuuagcccaugugugaagaaaagagagaacaucagaugaaauuugagauuaugcguccaaucuuauaugcuauauuaacuaauuuuuuaaucgugaaaaaccaauuacuaaaauaaaaauuaacuuuaugccacugauucuuuaacaguauuuauaugaaguuucuuacuucuguuguaaugcuguauggagaaaagagaaccacgugguucuaccaaauuaacaauccaggauccucauuauacauuuccaaauggaacaguaucucacacacacacagaagguugcacaguguuuuucaaucuuuauaacuagugcaguggcagauuacugacugauccuaacuauggcgauuaaggaugcuuacaugauuuuuaaguguaugaaaagugugaauucuuuagagaacauugauauuuacuguacaguuuuaaaugcuuccuuuuauaagaagauugaugcaugcaacugcuuuucuuagaaguguggaauuacuuuuuaucuaaggacugaggauauuuuuagagauuauuuagccaaacacugcaauguaaagucaaugaaaaucagguugaaaugacugugauacugcaauacuaagaaaggcaaaucuuguguagaaugaaauaauuuuuuuugcuuaauuuuuauagugauaauauuauuuuacuguugauaauuuuccuugguacauuuugaguuccuaaauuucuaaccauucuacuuauaacuuuuaguaauuacagucuuuuuuauucaggauuuugucauuaauauaauauuuuaaguaauuauaaaacaaauuuuuuucuaacuaggaagaagcauugcaugcauuuauucagccagagauucuggauggcccaaaucaguauuuuugugaacguuguaagaagaagugugaugcacggaagguaaaugccauguagagauuaauacuuaggaaucugagauaauauuccauauucaauagacucucccccuuuuuguuguuuguuuuuuagggccuucgguuuuugcauuuuccuuaucugcugaccuuacagcugaaaagauucgauuuugauuauacaaccaugcauaggauuaaacugaaugaucgaaugacauuucccgaggaacuagauaugaguacuuuuauugauguugaagaugagguaaauauuuguuauuuuaaaguauuuuucauuaauccacauuagucagucaugguuuugaaagagcuguuugagguaauaacacugaugucauuuggacugucuucuugauggaaacuuuuucuuucuuauuuucuaauguggaauucaauaaaaugauuuaccuuuguauaagcuuuuccugacugcauaaauuauauuuuaaauauucuuguuugaucagaguaacuuaugauacucuuugaaaagacaauaaggaacucagcuuuggaauuauuucuugaaguugagugauaaucuuauauuuuauaauuucgucguuauugaaaccagccugaagguaagccauacucauguuucugaucuauaauaaaugcagacaaugccuaugauggaaugaaugaaccaacugaauagcaugggcuuaauuucuuguacuuaccuacuauuuuguauuuacuauuugucuguuuuccuuuuuuaguuuuuuuaauuugaaacuuuauuuaaauaauuuaagcaugggauuugaagugacacaugauguaaugcuuaucaauuucuucccacacuuuggccugccaaaauucucugguucuucuauccuuauucaaugaaagacuuacaauauuccacucuauuauuuuggaaacucuucugauuuuauuauguggaauacuuauaaucacuuaggcuaauuauuucaaagugauuuauucucagaauuacccugaagcguuuuuuuuuuguuuuguuuuguuuuguuuuacuggaacugauuacuauaguuauaaaaaaugccuuuucccaggaguucaaaaauaauuuuaaacauucacuaaguuuuauuuaguacuauugaguacuaugaggcaguuugguguagaagagcacauguuuuaggcauagcuagauguggauucaaauucuuguccugcuacuugcuagccucuugaccuuggauaauucauaaaaccuuuugagccucauuuccagaugccauagaugaaguagcuguucauugaaugguaacuaugaucaauaacauuuugaaaaguuuaauuuaaaauaaugucucagacaguugcgcuuaagcuaggaaaucuacccaaagugugccagacuuugagaggagacauaaucuuuguaggauuucuacucaaauagagaucaguaguagauuggucuucugaauaugccuaauauauuucucauaaaggaaaauuuuuuccaaagaaggaaaacuuauauaugaagcuuaguagaaacuuccuagagaauucuagguuuaguucuugggacaagaaauguuuuggcucagcugaagaaguuucaggaauuauaucucuuuggacuuagaucuauagcuggauuucaucuccauuuauccuugaaccuaaccuucuugagagaugaagacuguauauuagauguaguaccuacaacaagaguuccuggcaaaaaguuugugcuuauuguauauugcuugguuucacucaagaacuucuaugcaaugccuuauacauuucaaaagccugcaucuuagaaaauucucaaauuauuuaaauaaaaacauuuuuagagauguauauaaaacguuaaagggggaaaggauuguuuggggguuucuaacaaagagaauucuucaaauuaaauuugugugaaugugguuuaaaaccauaaaguagaaaaguauaaugugcuguaaccauuauauuucuacuuccuguaaaaagacuaucaaguucuuaaggaugaauacaaugucuuguuucucuuucuaauuaucuguaauaccuaacgcacugauaaaccgaguuggacuuuuuguucaagaaaagaaauuauauucuuuccugauuugagaacaccagaagcucauuuuggagcucagcuucucugauuuuguggauuuugcuaaaagaaaugauaauuucaaccauuauguuguaacaguaaacauaaaugagguuuaauagaauucugaaucacuaauuuguuguauuagaauuuuaaggacaugauagaaaugcuuuuaaaauacacuguugcuuguuuaauuuuacuuaaggucucaauuuuuaagagaaaauaaauguacucaaaguaaaauauuuuuacuaauauguuaaauugugugaaaauauuagcaguauauagguacaaaguuuuguugaacauauuuucucuguauaugguuuauaacuaagauaauuaugucuuauuaagaaaucuccucagacugaaaguugcacugacaguggagcagaaaaugaagguaguugucacagugaucagaugagcaacgauuucuccaaugaugaugguguugaugaaggaaucugucuugaaaccaauaguggaacugaaaagaucucaaaaucuggacuugaaaagguaccuuuuauaguuugcauuuuuuaguugaaagugagaauaaucucugacuuccuauauaauucuauagcuguugugacugauaaaguuaucuuuaaaagaaacuuaauuuuugaaaguuaagacuucucaaauauaguuuuuuuguacauauauauauauauauauauauauauauauauauauauauauaugacuauaauuaaacuucaggaaaaacugcuuacagguaagaacauuaauuuuugggagaccauacuuuaaacugucuaagcaagcuggaugguacagaaacgaugccuaguagucaagaaaccaagauucuauuaccaccucugccuuuaagguugcagcaagugucuauaaauuuugucugaguuuuccuauauagaaaaguaaaauguuggauuagucauugauuuuuaaaagucuggccaugaaacacuuuaugagacaauuaauaauagaucugaucuuucugaguagggaaaugccaaagcccccuagucuuucuucccuguccugcgauaguccucaagacacuuugaaaaaugguauaguucuauggauuaucauuugaaaaccacagaauuggauaaucucugggauaggaucuugccccugugucaauaacuuuaaggguuuuuuagaccauuuuuuuccacauauauucuguuuuauugagggaaagauuauagauaaaacgucuugagcauggugugaauaauaaacuccuaaugugaagacugaucacuaacucagguauuacagagucauuaaauauagggauuuuuaaggcaauauuuaaaaauagaguuuuacuuucauaaaucuguuuuuagaccaaggccauucuucuaauuaucaccaccacccuuuacuuuuuaaaauuaucuguuucauucagggcagacaguugagcagggauugcuauguaaugaauaauguaauaaguacauuguaacugaguauagaaacauggcauucuagcaggaguuggcaaacuauggcucaagagccaaaucugggcccuugccuguguuuuuacauacacuuucauuucaucugcaaauaaagacaguauucuuccuuucccaucugcaugccuuuuucuugucucacugcacucugugggacuuccaaugcaguguugaauagaguggugagggagaacuuccuuaccuuguuuccaaucuucagaggaaagcuuucaguuucuuaucauugagugugauguugacuuucaguuuuuuauguucuuuuccuacuuuguugaaaacuuuuaucaugaauagguauuggauuuuuccagauuuuuuuuucuaugucaguugauaugaucauguauguaauuuucuucuucagccugaauuacauagauugauuuucaaauguuaagcugucuuugcauaccuggaaugaauccugcuuugucaugguguguguuucuuuuuauacuuuguugauuugauuugcuaauauuuugcagaggauuuuugcaucuguguucaugagaugcauugaucuguaguuuuccuuucucauagugucuuuaucugcuuuuggugauguugggcucauguaauaaguuagggaauguucccucugccuuuauuuuuggaagagauuguggaaacuugguauuguuucuuaaauauuugguagaauucaccagagaaauuaucugggccuggugcuuucuuuuuuagaaagugguuaauuauugauuuaauuucuauaauagauauaggacuuuucagguuaccuguuucuccuuugugaguucuggugguuugugauuuuuaagaaguuggucuguuuuaucuguguuaucaaacuugggggcauagaguuguacaaaguauucuuuuauuguccuuuuaauuguccuuuaauguccuuuuaaugcagggaugaaccuucuuucauuucggauacuggcaauuugugucgucuuuuuaaucucgguuagccuaauuagagauuuaccaauuguauugggguuuuuuucuuccaaaggaccagcuuuugguuuuguucacuuuuucuguuguuuuccuauuuucaauauugauaaggauugcauugaaccuauagaucacuuuguauaguguggacauuuuaacaguauuaagucuuccaguucaugaacagaggaugucuuuccauuuauuugugucuuuaauuucuuuccuugauguuuuuuuguuuuaguuuuugguuuuuuuuuuuuugagacggagucucgcucugucgcccaggcuccagugaaguggugugaucucggcucacugcaaguuccaccucccaaguucacgccauucuccugccucagccuccugaguagcuggaacuacaggcaccggccaccacgcccagcuaauuuuuuuguauuuuuaguagagaugggguuucaccauguuagccaugauggucuugaucuccugaccucaugauccacccaccucggccucccacugggauuacaggcgugagccaccgcacccggccuccuuaauguuuuaugguuuuucacuguaugagucuucugccuccuugguuaaguuuauuccuaagaauuuuauucucuuugacacuauuguaaauggaauuguuuucuuaauuuucuuuuuggauuguuaguguuagugaaacaauaaauuguuaguauuuagaaaugcaacagauuuguguguguguugauuuuguauccugcacuuuuuguugaauuuacuuguuaggguuuuuuuuuuuaugcggaaucuuuauuuucuacauacaagauugucaucagugaacagaaauaauuuuucuucuuucuuuccuauuuggauaucuuuuauuucuucuugccugauugcuguggcuaggacuuccaguacuacguugaacagaagugguaagaaugggcaucuuugcuuuguucccaaucuuagagggaaagcuuuccguuuuucaccauuuaauaugaugguagcugugggguuuucauauaaggcuuucauuauguugagguaauuuccuucuauuccuaguuuguugaguguuuuuaucaugaaaggauguuuaauuuugucagaugcuuuuucuuuaucaauugaagcgauccugugguuuuuucauucuguuaauguaguguauuacauugaucacuuagucaugauguauaguccuuuaauguguuacugaauuugguuugcuaguauuuuguuaaggauuuaugcaugaauauucaucaaagagauauuguucuauaguuuuuaguaucuuugucuaauuuugguaucaaagucacgcugaccauauagaaugaguuuggaaguuuuucuccuuuuuacuuuuucagaaaguuugagaaggauucguguuaauucuucaaauguuugauaaaauucucuagcaaagcaaccugguccugggguuuucuuuguugggagguuuuugauuacugauucaaucuccuuacuaguuauagauguguucagauuuuuuaugucuucuugagucagccuucauaagcuguuaaacguuuguagaaauuuauccauuucuucuaggguauccaauuuguuggcauauaauuuuucagucucuuaugauccuuuuuauuuuuguggcuucaguauaaugucuccucuuucauuucugauuuuuguuauuugagucuuuucucuuucuuagccuagcuaaggguuuguaaacuuuguugaucuuuucaaaaagccagcucuuaguuucauuuuuuuuuccuauucucuauuuauuucugcucuaaucuuuauuuccuuccuucugcuaacucugaaucuaguuuuuuucuucuucuuccucuuuuuuuacaucccuccuucccaacuuaguuuguucuucuauuucugguuccuugugguauaaaguuagguuauugauuugagaugucuucuuuuuuuuuuuaauguaggcacuuacaucuauaaacuuuccucuuuuguuucauugcauaaguuuugguauguuauguuuuuguuuucauuugucucaagauauuuucuaauuuccuuugugguuucuucuuugacccauugguuguucaagaguguguuguuuaaaacaacuuacacauauuugugaauuuuccaguuuuccuuuugcuauugauuucuaguuucucuccuucacuuuuaaaggauuauuucucuggauauagaauucuagguuggugguaauuuuucuuucaacaugaaauauuucauuacacucuucuugcuugcaugguuuauaaugauaaaugugcuauaauucuuauccuuguuccucuauagguaagguguuuuuccccucugccuccccugaagauuuuuuugucuuugguuuuguucaguuugaacaugauaugccuaaacaugggaguuuuuguuuuuuguuguuguuuugguuuuugguuuauugggcaggauggguauuuauucuauuugguguugagcuuccaggucuguugcuuaguguuaccaguuuuuguaaauaaagauuuaucagaacacauucacucugguuguuuacauauuauguaugucugguuuuguacuauaaugacagaguugaguaguugcgacagaaaccguauggcccagaaagccuaaaauacucacucuuugacccuugcauuagugggccaaaugaucuagauuuuaguucuuacuuugcuauuaauaaacuguaucacuuuggacaaaucauuuaaucugugugccuuucauuugcuacauuuuggaggaauuuggacuaggugcuuucuguucuacgcagaucuagaaauuuguaauucuguuugcuaguaccauguuugaagauguauccccuuuuaauuaggaguaauguauugcuuuguuaaauaguaguaaaagagaagaaaauguuaggacacguuuuuauguaauuuuauuuacaaauuaucaugcuacauuuggaugaaggcacuuuacuuuccuuccuacuuuuuggcaauguauuugugauuugaaacuaaaauuauugcaauugggaacccuuacucugucaugacuguauuaucuuugcuuuaaaauagauauauacaauucuaauuuggaaggugauucagucuucugaauauaucaccauuauugucaucuagaaguugcugcuauuagaauuuuccaggaagauaauuauguuggcuuugaucauuaugaugaaacuuaaaaaauguauagcuguugguuggcagacuuuuucuguguuuauuuuuuuucuaaauggggagacugcuuaugauaagauauucauaucauucagugauaucaaaauuuugucuaguguauuuacuacauucaaagcauuuuaauuuaauaacaugggguuaccacauuucauaaguuguucaaugcuuuaaacacauuuuggauugcaaauaaauucugaaacuuccucccuaucaccacuguaauuaauuuuaguuuuaggaauaaaauuugaaccacaaaacaaguuuucagacauuuucaaaauuuguucuagaaauuucacuaauuaacaauauauuguggucaguuuaaaguuauuuuaagauaaauuagaauuucuugaaaguuauagaaggcucuacaaugcuuuuuaggaaaagaauaaagaagagaaacccuaguacuuguagaaaaguaaauaaaauaaagcuugucugucauaaacuggaaaucuucugaugucaaauugccuuuuuaaccuccuucucuguuucugucuuccuaccuguucuuuuuuugugauagaguuacugguuugcagagucucuaguaucucaaacugucuuaggaguugugaaguacaugggcuucugaaagaaaagauugucuuaaauauaaaaauaagucauuauaaaugaccucuuuuuuuuaaacaaguugccucuuuucuugauuuucuuccacaaauacuuaaguuugccuaaaauaaucuuuaguuccaaacuuuaaagaauuguuugcagaacaggaagcuaaagaaauaauauuaauuuauuguagauauaguauaauucaggauucauucuuaauaugagagaacaaaucaguagaucaugauaucacagauaaugcauaaauacauuagaagauguuccaaauaauuauauuccucagcucuuuuguaaaggaaauagaauuugaauaagaaacaguauguuacuucggauuuuuuuuaucgacuguguauuuuagaacagcacuguaauuagcaucugcuucugaaauuuuagacuauuauuuaauuuuuacauauguaaguuuauauuuacagauauauaugguuucaaagguuauagcauaauuaaaauguggaagagugcacugaugaaacuuguguaacuucugguauauacaguuguuugauaacuugccauuuuuguuuuaccuuaggggaaaguugaccuguaauauauaggacaacuuaccauguuacuucucuguguguuaacagagaauaggaaauacacaaauaaggguuguguuuuccuucuccucugaguuacuuuuauuuuuuccccuuagaauuccuugaucuaugaacuuuucucuguuaugguucauucugggagcgcugcugguggucauuauuaugcauguauaaagucauucagugaugagcagugguacagcuucaaugaucaacaugucagcaggguaaggagguguccuuuaagauuauuacucugaaaggugggaguaaggauguuucuaaacaacaguaaaguuuauuaagaaugagugaaucugucuagugauacaucuuaagacccauaucaaaucugucuuuaauuuuugcuuuuaguaaaguucuugccuuuguuuauuauuucuuuguuuugcuuuguuuuguuuggggcuugcugaauaucuccagagauagacuaccaauuuuccucugggccugaaccuucauaggugcuacuugugcuucacgugugauuaggaauacuagaacuggcuggcugguaagcagccacugauuaugauuaaauuuugugaauugguagcugugugagcaaucaugaaggucuuugauagcauuuaacucugaggcuaaagauugaguuacauauugacguuaaugugauaguguuauagaauuugcaaaaaaaaucauguaacacauuuucagauaacacaagaggacauuaagaaaacacaugguggaucuucaggaagcagaggauauuauucuagugcuuucgcaagguaagcaauuuccuaauuuucaguguuuaaaaguuagaauuaauuauagcuucucaguguuuuuuuaucaucaaagauuuaaccaagggauugaggaacuacaacccaugagccaaauccaaccugccuccauauuuuggaaauaaaguuugaacacugacauagccauuuguuucuauauuauguguuaaugcuuuuacacuauaauaacauaguugaguaguugcagcacagaccauauggccugcaaagccugugauuuuuacuauuugguccuugcuggaaacaacuugcuggccccugacuuaacuguuguauguagacauuccaauacacaguuuuguuaaagacuuuacuguauuaccaagaggagauacggaaucuucucuaaaugugauaagaggaaacagauuuuccucuuaucuggaauguuuuaaaucucagugugucugugaacagugacaugauuuucuaauuguuuuuuaaaaaaucacaauuuaaauauuucaugcuuagaaguggaaucuuuuuaaucuacuuuuuguccuuauuaaucuuuuuuauguuucuacuaguuccacaaaugcauauaugcugaucuauagacugaaggauccagccagaaaugcaaguauguuuaccuacaguuauuugauuuuaauuuguguuauaaacuaauuucuuuuguaaguuugcaaacccagauaacuacuuuuaaaugauaggauaauuaaguuguuuuaugccuggaagaauuauuuacaaagacuguuacaaaauaauaccaaauguuaaggaccuugaaaaaauguuguugaauuauuuuuuaauauaugaagagacaaaacuacauuaaauaaauugaauguuuauuaguaguaagauuauauuaugugcagucugauguagggacgauaacauuuuuggaauuauugcuuuuaaaauauugcaguguuuguuuuuucuugcuaauucugacucaggcuguauuacaaauaucuagggggguguguacagauacauauacaggugauguguuugcucauagucuuuucauaauuaaaaaaaauauaaucacaaucuuugauuucaguauauuuccuuuguuuagacacuaccguugcuauuaguaaaucuguuucaagcauuauguuuuuauucacauuuuuguaaacccucauuagauggugaauucaauugguacaaggcuuaggacuuacucaucuuuucacauaaaguauauucuaggaucugucauauaguaauguucaauaauuuacuauggaauuauugaaaaaauaaauggaaauuauaguaagucauuucagaacagagauuuaagagcagaaguaaucauuuguacuguauuauaaagaaacuaccccaaagaguaagcugacccaggucauagcuaucuggaagcagagccaguauuguaauucaugucccucacguggacccaaccuuccaauagugcaauaacucagccuucuuuuacucccccaacucuaguuuuguuauaaagcaccagagggcgcuguaugacaugacauggaauauuuuuuaaauuagaguucuuuccuagaaacaacagcuuuuaccuuuuacggacacaugcuguuuuugauaaaauuuuuuuccccuuuuuaaugccaaauaaucauuggcuuuauuaaauggugucauaauuucauauugucccuuugaaugcuuugaguuacauaugaaguuguaauuauuaagaaaaacuuucguaaaaaugauuauaugugagucuauaguaaugauuuuuugcauauacuuuauucuuuuaacuaauuguuuaaaaguagccucacaaauuauaucaggcuguccucgcauugcuauaaagaaauacccaaaacugaguaauuuauaaagaaagauuuaauugucucacaguucugcaggcuuugcaggaagcaugaugcuagcaucugcccagcuucugaugaagccucagggagcuuucagucaugucagaaggcaauaugggagcaggcauuucacauggcaaaagcaggagcaagcaaguuccgggguugggggaggggugccacacacuuuuaaaugaccagaacucaugagaacucaguauggcaaagaaagcaccaagccaugaggcuugacccagacaucucccaccaggccccaccuccaguauuggggauuccaauucaacaugagauuugggcgaggacagauguccaaacuauaucacauaaucaucacuuuuuguauucaaaugaaucuugaccauauagagagggagaaauccaauagaugaaggugucaguuuuaugacucugcauucuuugguuaggaagcagcuaaagacugcuuugagaacacaggaaagauaauaguaaacaaauggguaguacucaguagcagcaacagcagcaguauuuauuaaguuuuauuguaucucagguaguaacuuuaugggguagaugauauuaauaagcugaagagaccuacauuuggagaaguaaacuugcccaaggucacacaguuugauggggauggcaugauuugaagucagaaauuauuuucaaguugcagagagcuuuuucauucuaaaauauuaauccacauacuggaguuguucuggagccaagagccauuuugaauaaauacauggcucuuuaagauauggaccuaaccaugugucccuguuaacugucucuuaacccuuuucuggacgaagcuuguauuccaaguugagagaaggauguaauggagauauaucuccaugagugcuacaguagaaguauauaccaugagagcauagugaagcaggaugaauaaaggcagcucaguuucagugacacugucuuauccuguuuuuauuacuaauagaauuucuagaaguggaugaauacccagaacauauuaaaaacuuggugcagaaagagagagaguuggaagaacaagaaaagagacaacgagaaauugagcgcaauacaugcaagguugaauuccaucauuuuauuuuuaauugaaagugcuauuuuuaagcucgcuuaccugcaauucuaaugacuaacucauuggguugauucugagacaauuaugcuaucaugaucauugaacaguguaaccaacuauacuauaaagguaaaauuugauuugauuugauguguaaaaacccaguaacauguagugacggugcucagugcuggugaagccacaguugagguagacacauucucuuauccuacuaaaagaaaauaaauccguaaaaacuggauagaaauugaguaguauuuaucaagagccuuaagcaaaaucauauuuuuuaauauaauuucucuuauggaauuaccuaaggaaauaaucauaauuacuguaauaaucuugauuacagggauauucauuauagcauuuuccaaauuagggaaaaauuggaaacaacacaaauguauauugguaggggaaugauuacauaaauaugauacaugcuuauaaggaaacaugcaguuguuaaaauuaauguuuuugaauuuuuguauggugugagacauaacuggugucaauuacuaagugagaaagaauagauagaagagugaucucaauuauguucuuuuaaaaaauugcaguauuuugacaauuaggaauaaaugcuaucuacggaagaauugaacuuuggaacugcagaguugaugaugauauuuuacauuuucuagauaaaauuauucuguuugcauccuacaaaacaaguaaugauggaaaauaaauuggagguucauaaggauaagacauuaaaggaagcaguagaaauggcuuauaagguauguuuaauugcaucauuggcauuuacuuacuaauacaacaguauuaacauaauuucccaaguuuuuauaauggauaauaguuauauaaacacuggcaguaaccuugguaacugguuaauuuaucucuuaccgaguauauuuauaccucuccuuuggagcauagucaguugauuuugaaaauuuucucccucuggaagccauuugaaguuucuagaucccagaauuaaaauuaggaacagaauguuuauuugcucuuucuauucauuuaacauacauuucaugaguguuuacuauaugaaacauuagagauauuagagugaauaagauaacaugagguguuagagauaccaaagugaacaaggcguggucacugccuucauggaguuuacaaucuacuggaaagaacagacaaaacguacuuaaacaucacaguuugcaauuauuuuauuauuuagaugcuauaaauacauuaguaguaaauugagaaaauuuauuuugaaacuuuaaccaugagaaagggagacagcgaugcaaaaaguugaggaagaauauacugguccauagucagaugcguuacccauuccaucacuggcccaugcucaaggaagaauauucgaaguagagugaacagcaugugcaaaagugcugaggugaggagaugcuuggcacguuuaagaaacugaagaaaggagccauauguuuagauuguuuugagugagcacagaguaccauaaaaugaaauuagagauuuugugaaauagaaguuuacguuuuguucucuaagaguaguggaaaguuauuaaugagguuugaaaggcaaauggggucacugcuguuucaccagaucauucuaaaugucauuuaugauacuuaacaaauauaaguuuuccccuuuccauauaagcaguaacagaaugacugaaauuaaacagucauuaccuagagaaaaaauugcauacuacaucauuuuguguauaauuauauguggaaccaauaacauaacuaaaaauaacacacaagauagcugacauuguuucugaaagugugauccagugcaaucugcaccagagucacauucuuauuaaaaaugcuaauugcugcagaugaaucagaauuucucuguuggagccuggaaauaggcauuuuaacacauaucucaggugauucuuaggcauagucaaguuugagaaucacuuauauuauacaucugguccugcauagcacuuaucaguauugaaauuuuacauuuaauuguuugacuauuuuaauuaauauuacugccccucacuaaacuauaagcacauacaagugcaaaaaccauucugguuuugcucacaguuuuauuuuuaguacucuucccugguauauagaauagucaaaauugguuggguauguugaauggauaaaugaaugaacaaacauuaagauggauggauggcucuggauuugcuucauuuugguaaaaauucuuuaaauauaaugguggacugcaagcauuagucuugaaaauaggaaguaaaaguucgcaaauaaaaagaaacaaacaaacagaaaagagaaauaagucaaucuuauaugccaaaaauagagcuucauuguuggggauggggguuggggaggaguagagaucaauggggauacgcugaggcuuacaaguccuucuugaaacucauaaucacaaccuuaaaugaacauugaauacuucuaagcaauccuacuguguuucucuaggaggcuuauuuccuaucaagagaguuguugcaaccaggguaugucaucuauuggugacauaagcuauaaggaaauguuaugauagaaauuccuauaccaugagcuuuaaguauucuggaggcuaauauugaaaggggauaucguagaagccaaacccuuugugauggcuuuaugagacaugcuguccuccuguacuuagauuguuacuaguuacaugaauuaucaauucuacuccagauuggauuaagaaaacaaaaggugcauauucuaguuggcuguuugguuguuuuccucuguguuuccagauuaguugauuaugaacaauaguuacaauacauugauuuuguuucuacaccuaaaguuuaugauguuaacuuuuuaaaaaauaaaaaauguauuuaguacaugcuuuauaugauuggagggauaaugaaacauaauuauuuaaaaauaacauuuaaguugugccuguaacuuugaugucuuugaugcaaaucauaaauguguggauuuuguuagggccuauuguaauguuauuccccaacagacuaaaacacuguguauuuauauauguauauauauaaauauauauguauauauauuuuuucuuucugggggauuacuuucuuuuagaugauggauuuagaagagguaauaccccuggauugcugucgccuuguuaaauaugaugaguuucaugauuaucuagaacggucauaugaaggagaagaagauacaccaauggggcuucuacuagguggcgucaagucaacauauauguuugaucugcuguuggagacgagaaagccugaucagguuuuccaaucuuauaaaccuggaggugagcaauuuuacacuauuuuuaguuguucuguacuuagaauuuucaugagaaaguuuuuuuuuuuauuguagaaaugaacauaauuuaaauuuuguauauggucuuaaaauguagaauaauuuugacagguugagaaguacucagcaacagcuuggaauuaaguucuagauuacuugcaaagaguuguguacauaauuuuaaaaacaacaaaaaacaacaaagcuucuagcuuacggucuucaguggguuuuuucuucuccagugggcgguacugaaucauucuggaugcugucaaucccuaaaguuaucaauugcucucuuaggaagaucucucuuucucuuucuuucucuuuauggagaagaccuugguccaaaaaaguauauucccauaaagucucagaaguagaggcuguuuuucaggucuucuuuggaaggguggauucauuaucccaucacugucagcauuuacaauuuuucgucauccucucuauuucuacaggucccagggacuucaucuuuucuuucuucauuaaaucuaucacauucacucagcacauugaguuuguuauuuuuuuuucuuugagacugcuuaggaaaaccaaaauaucaugccccuaguuuucccagagacaguuucccuauagacaguuacauggucuguuuuuguccagaguuuucuauaauuaccauauguaaauuguaacaaauagaagaaaagcagaauguuuauauaauuuuacaaaauccauacuguuuugucuuggcccuaacuccuuugcaucagugguuagugagaauuagguucucuguguuuuuucccuaaaaguugaacuuacaaaacuuuauucugcccuuuuacaauaauguucuucuguggauccuguauaucuccuuuuuaaaugaaggccucuguuuacagaguagguuagauguaguauucuuucaaggagucuacggcucuuaagugggaaaauuuuauuucuggaaaccuuaugaugucuacuucgacuucuaagacucuacccuaucuauaaagagucccuuaaggacauuuccuugcuuuuuuuuuuuuuuugcuagacaagaaaaagaaugauuaggauauaacaugagucagcaguaauaccacuuauuugaaagagaacucuaaaugcaaguguggauuguaagacuuauaaaguagucuuuauucauuaauaaucaagaucuuagcagaauauuuugucaaauuuagauuaacaacguagggaaaaaacugaggauugacauaaaacaugagguuaaaacagauacagaauaacuguguauuaaguacaauguuugaagaucauuuauuuuucaagugauuaagaguuuaauuguaaacauaaccuucugaaaacagaagagaaugggauuaaauuucaauauaaaagauuuaagugagaaaacaaaggcauaaucagaacaguuuuuguguggaauuuuccuugggauauaggaaauauuauuuugaggauaagucuuugaugaugaacaagguggcuuaauaagggguuuguucaaaagcaagcaggagugcugugucaccuuuaauauuuguuuugcaguaacuggugauuuauauuuauucaguguuguuuucaucuguacuuggaaguuuggauuugucaccuguuagaaacacauuaagaaugcauuacucaugugaaauacauuaaaaaauaaccuccaauucuguguuuaugucuucaaaugugacagaagugauggugaaaguucauguuguugaucuaaaggcagaaucuguagcugcuccuauaacuguucgugcuuacuuaaaucagacaguuacagaauucaaacaacugauuucaaagguaaguuuuaaaaggggucuguaaauaaauuuuugagagccugcuauguacaagacacacuaugugacaguuaugaauaagauacaugcuuuaccuccaggagcuaauuaauauuuguaguuaggagacaacuguaguuaaaagaaacagauugaguaaaguguggagguaagaaaguguaaggcaaguacauauaacaacuuauauguguuggcuggauuaucauaaaauacaggauuggaaauguaaguacaguuuauuucaugaagagcuuuaaacaguaaacacgaaaguuugggcuccuuuuuggcguaggcaauaagucgaguuuuuguuuucgucauuuuuaagugcggcaaugcugcauuuagugucuggugacacuagacuagcguuccacaugccuugaggggagucaggaauggagaggaggaagcuguugaaauaauucaagugcaguuguaugacuggaaaugagagaaggcauggauuccaagagagauagaaucuguaggacuuguaauuguuaaauguugggguaaagcagaugcaccgaugaccugagccagggguuucaaacuuggguaaccagaaaaguagggauacauuaauagaaauagaggaggaaggugaggcuguagacuugacagggaaggugaugaauuaaauacuggugccauuaugugagcuagugauaaagaacauaggcucauuccgauuuuuugagcuggaaaaauauaacaaugaaaacauucaaauuuuggggggcaaaaggauuaguccacaccagacaaaugauuaucauccuuacaaggguccuguacucugcagaacccugagcauacaaacggcagauuuugcaggguucuugaaccguagguuaauauucccugguguaguggaaauuguuccauaauuacaaguugaguccaguuuucagucauucaucuuaugguagucuugucuuucaucucauuaucugggguuguaaauaccuguuuagcagaguuguagugaacauuaaugaaaaauaaauaaaugcucugaggaaaaaaauuguaaggcauuauguaagaguuggugguuauuauguucuaaaaaaaagucuauauuuugacuucuguauaugacuucuaacaauuuugcuaaaguaauaaccaagaaacaaaucauuuugugaaauuauauuuuaugauuaaauugcuuguaaaugcauacuauguugguauaauauacuguauauuacauuuuuaaaauaugaaugacaaauguaaaaaaaauuaguuuaauaagcacucacacauaauacaaaagaaagagacacaguaguuucuuccccaagaaguuaauaaucuuacugagaaaaauaugucuauagagaauaaaggcagucacaaaacaucauguaaacaaauacaguauuuuuaaccagccugcuuaagaauuagguauuuauaacugaugaccuuaguugcauugaaaagaaauuguguuuuuuaaauguaaaguauuuuuaucugcugcuuucaugucaauuuauaaaaugacuccaaaaauuaaagauguggacuuucagaaaaacuuaaaauuuucccuacuaaucuucucauuuuacacaaaggaaaauugcuuauugcuuuaauaaaaguauuaaaaacuauucacagacuauagaaaggccugucaaaagccaagaaguucaacauuuugauaucagcagucaaaaagucaguuacgcaguuucuuuggaaucagaucacucauuuacuuggcaaguuugagagcaauagagauucuaggaaaaaauccuuaccuuuaaaauaguuucagagcauacauuuauaaaugguacuuuguucuccugauuugcaguauaauuuauggcuauaaguaauuuuucccuucaauuauucaaaaauuuuaaaaccucuacuaaaauuauguuucucucugcugcuuuuaagaagaacucagcagugucuugcuuucccauauuuuuaagucaagcagaauuauuuuugaaagaguacuuuuuauuaaauugcuuucauuauaggccauccauuuaccugcugaaacaaugagaauagugcuggaacgcugcuacaaugauuugcgucuucucagugucuccaguaaaacccugaaagcugaaggauuuuuuagaaguaacaagguaugucauuuacuuuuucauuacuauuuucuaugcugguaguaguaaaugaaauuagguucaauauuauaagccuggccuccacagcuguucaacaucugucuggaacuuaauuuaaaauucucaacccaguaauuaccuuccuuuguagucaggucaggucaggcucccuucuguccugugaaucaguccuacugguucuccucuucuuugccuuuguucaugugcacucccaccuggaguguucuuccuccucucccugcauuuuuuuuuuuucagucuccagauuaguccuaccucuuuggugaagacuucauaaccauuucuucccacagugauuauguccccuggauuguguuuauucuugagcuugucccauaaagcagugcuucauggugagggucagaggcauaccugguauagagaaaauuauaaucuugaguucacccaacauuauuccuuuugccuacuuauuuuucucuguuggaaaugagaaaguucauguuaauccucuucuuuugucuugcuauuauuauguguuugaucauuuaucauuuuucauauguguuuuuaucacucuagucucauucaucuuaguacagucuagucuuuuaucucauuuaacuuuuuuaguauuuuauuacuaauauguaauuuuuauucaccuacacuucuaaaacuuuuguguggugggggaggggauguacguguauauguguguguauauguaaaacauuaaaauuucuaauccccuccaguacauuacuuuaggguaagaagugcaguagggaaacuuuucuuuuuccuuaaacgguuagcguacugguuucaauuuguaacauuuacugaauaggauaaugauaguguuauccuuuuaugcaaaacccaacaugcuauuuauaauugccaaauuuaugccaaguacgaauuucauuuuaaaaaaagauuuauuauggaaaauuucaaacguaaacaaaaguagagaaaauagggaaaauagagugaacccccacacauccccaucucucagcuuccacagugaucaucucguuucaucuauaauuuaaccaccuacuucgcccagauuauuugauaaacuuccucaggaucauaucauuucaucuauagauaauaugaacauauauaucuaaaugaagagaacucuuuuaaaaaaaugacaauuacauuauauaccuaagaaauaccuuaauaucagucaauaucuagucaguguucaaauuucucugauugucuuagaaaauuuuuuucuguaaauuuuccugugucuuuuuuguuugcuuccuugcaguuuguuacaaagccaagucauuugcccauuaaauuuuuccaugaucuggauuuugguguuauauucacaaggugucuuuacacauguuccugugucuguaguucaggcuaaacuuggauuuccuaaaggugaaagauuucuacaaucuaaagaaaaaccagaguauuaauuuccuaaagagaaggauauauaauacacaacuuucugaaauuggacaacccaauaaacaagauguuuguguguauguguauguccauaccgucuaucuuaguguaguuuuauggcuaguuacaaagacauuugagccuaauguucauuuuauucagucuccaaaacaauagaguccuucagaaacuauaucaucacacauguuauaacauaacuguguauuguguuguauugaugcaauauaaugaugaugaugaaugagcaugucacuaaaauuaauauauaauaaaacucugacuuacuauguagguguuuguugaaagcuccgagacuuuggauuaccagauggccuuugcagacucucauuuauggaaacuccuggaucggcaugcaaauacaaucagauuauuuguuuugcuaccugaacaauccccaguaucuuauuccaaaaggacagcauaccagaaagcuggaggcgauucugguaauguggaugaugacugugaaagagucaaaggaccuguaggaagccuaaagucuguggaagcuauucuagaagaaagcacugaaaaacucaaaagcuugucacugcagcaacagcaggauggagauaauggggacagcagcaaaaguacugagacaagugacuuugaaaacaucgaaucaccucucaaugagagggacucuucagcaucaguggauaauagagaacuugaacagcauauucagacuucugauccagaaaauuuucagucugaagaacgaucagacucagaugugaauaaugacaggaguacaaguucaguggacagugauauucuuagcuccagucauagcagugauacuuugugcaaugcagacaaugcucagaucccuuuggcuaauggacuugacucucacaguaucacaaguaguagaagaacgaaagcaaaugaagggaaaaaagaaacaugggauacagcagaagaagacucuggaacugauagugaauaugaugagaguggcaagaguaggggagaaaugcaguacauguauuucaaagcugaaccuuaugcugcagaugaagguucuggggaaggacauaaauguauguacuucaaaagaaaaacgguccuugaaacagcaucaguuuuucucucaguuuauuuaaauuuucaguuaaguguuagguacuuaguucuaagaucauuuguaacuuucuggauuauaagauuauugacgcaguuguaaugaacacuguucuuagaccugugcaguaaauuagaugguaauuauaucagaacucugagauaagaaguaaaaaaaaauaguauucaauguuaggaaggaauuaugauauaauuacuaaguaaaaaauuagggaauauauuaaaaaguaaauaauauuuuuuaaaagcugagaaacuuuagaaaauuugauauucaaugcccaggaaaauguuuuauuucuacaugcucuucccucucuccauuuccaaugcaaacaacaauucccuugccauacccccuuaaaaaguccuuaaucaacugggaaagucagagaaagaaaaagcgcucuuaaaauuuuuucuguuacuuugaaguaacuccaaagcaaggaguuacuagaaauuccaaugcauaaucucagaaagagggaaaagaucugagaguuugggcauuuggcauaagcaguaacaacaaaaacauuccagcauaguaugagacuuaaaauaaaagaaccuuuauaaaaccuuagacugaggccagccaaauaauuagcaaggcaaccagguuuaagauacaaaaucuuucuucaaguguaaaggagaaguagcuggaaaaguaaguacuuugcauuaguucuagcaaagcaaauauuaauauuacuccuuauauuuuuauauuuuaguuuucagaaugcuuauuuguucucauuuaaagcuucuccaaacuuuguaaagcaaacauuaguauccugaugugacagguaagaaagccaaagcucauagaggaugaaugacuuguccaaaagugcauauauagcuaguaaaugggaccauuacuagaauugaaggcaucuaauuguuccuuuuaccuuuggaagggagccccacucuuuauccauccagucauccacccauccaaguaacauuuucuaaauccauacuagaugccaggcccuauguaacuguuagaagcagagacaacugagaugcagccuuaugcuucaucucauggggaggaggugcacagucacccacucugaaaauuaagugcuaugaugcuuguagucucaaaauucuaucugcuaaaacaaaguaguagaaauuaugaaauaauacaaguauuuaaauuuguguuuuuaacuaguuggguuaaauaacacuggaaucauacaacauucauacauauaucuugcagaaacucaaguaugaaaacguggauuggcagaacaaaauagagggaaaucguauuguaauaauguuuuaaauuucuauggaguauguaccucauaaggcucauuagcuuacauuguuucauuaguuuuuuuaacagcugugugaaauugauauuguuagaccguuuucacugaugacgaaacuggucaaacagauuaaguaauuugccugcagucacauagcuagucgcucacacugccaggaugagacucagauaucauuagccaccaccccauagcugcuaccacuguucuuuccuugcaucuuaguaaaggaaaaauaguaguaacugcucugcuuuuuuaccauacucaacccaucaaggacauuagaaaaauuaaaaguaguuccucuuuaguagaagguuggaaauuucuuuuaauugguuuguuuuagaaugaugugcuaaaaauuugacuggaugauagucucaaccguaggaaaaauuugauucgaugggaauacuuagaauuauaguuugaaaagucucauuuccaucuuagaacaguuaauaaaaucuuuuaaauggagaauguuggccauauuuggaaauucauaccaggcuaauuuccuaguguucauugaaauaguaaacauggugaagaagagaaaccauucacuacaacuuauguauuugggcuuuuagaagccauagaaaaggucuuguuugaaaagaaaaugugaccccggaaaaugucuucucauguuuagaaaacugguuuggagauaggggaguagggauagcagcuagcaaccagguuuuucuugagucugugcuaagacugauucauugcagcuccucagucaucugaaagaaggucccugggaaaacauggggaugaugaguaguaauacacauucuucagagugauaaaauggcaaggaagaacagguagacaaugaauuugauauuuaaagaaugaugcacuaugcacaguauacgcaguucacucaggcaauaaucuguacuuaaaaugaugguccuuaagauagcaguuauaauccaagaguuguuucagagaauaauuacagaucauucucugagaacacuguccuaguaggacuaguuauaguucauaggcacuuggguauaaacaggaaagccaagauaaauaaagaugguagugcauuuacacugaaauuucuccguacaauuuugguuaccgcuucacuuaagaaauucguaagggucaguuacagugccucacaccuguagucccugcacuuugggaggccgugaggggaacugcuugaacccaggaguuagaaaccagccugagcaacauaguaagaccccaucucuacaaaaaaaauuuuuuuaauuagccagcguggucaugugccuguaguucuagcuacuucggaggcugagguggaaggaucacuugagcccagaggagagaggcugcagugagcuaugaucguaccacugcacuccagccugggcaacagagcgagacccugucccccccccaaaaaaaaaagaaaagaaaagaaaaggaaaaagaauaaaagaaauacguaagagaaaggaccaaaaaggaaaaucauaaauacauuuuaagguuguucugugaagacauagacucuucagucugaagagguagauaggaaaaaugguacaauaguaaucucuaaaacuacaaaguaauuauagccaauaaauuaacacucuuugccaaagcuaugcuaaacauuuuacauguauugaccccagaacauaacuuugagguuuaaauacuauuaccuguauuuuauaguaaagguaauugaaguacagaaaaguuaagaagucagagucacaaaucuaauauaugaagaggagccaggaauucauucaggccaggccaucaaauuccagaaccaguuggucauaaucaccauauuaaacgauaucaguaaccagcaaacauuuuugucuuccuaugacacagcacuacuagagguuaggaaagaaaccaaaauggcaauaaaagcuuguauuugaguaaugcuuuagaaaagacuuuuacuacauuugucacaacaauguuauauguuaugaucacgugggaaaacagguugagggagauuggaugaccugccuacagccauuuaucagaguaaagugacaaaacugaaaucuagccauaggcuuuccauuucuaauccgguaauuuuugcauuacacccuucuguuaagaaauuuaguaccucguuggauagcauagacagaagcuuguuugccauaagcuggauuauugacauagaggggcacuccuuaaagcuuaaaaagugacauuuuaaacaaauuaagagaaaugcugccucaaaacucaaaagguagauaguaaauaaagcucaucacccucuucauacuuucuucuaauuuguucuugucacauuuucuauuaaugagccuauauuuuauagccaggaaaacaaugaacauuaauuuauuugacaagucaucugagaaaaauucaacccaaguguugauaugacaugggaauguugguuuaccaggaguguuuuaaggccucauccuuuaccuuccauguagcuuuagcagaaaaaccagaccuaacauggagggagccuuagagccagggagguccaguggccugaggcagcgaggcagcacugccuuauuaacugagagucugguuucugcuuucuucuacaauaugaagaccacagucaauagaagcauuccagauguguccucaugaguggcuuauaaaauuagggacaaaagauuaaaauaauaagcauuagggaaaaacgaagcucaucaaagauaauccuauuacaauaccaagagagcuuaaauuuaagccgggaagagguaagaguuucugauccauuuaaauacaguuccuguuaauuacagcccaaccacaugauaaaucagacaucuuaguaugccagucgugacuuuuuuucuagugaaaaucugaaaauuaaauaauauuacuaacaguuuuugaggcaaucacgcuguauuuggcacugugcugaaagcaugauaaaugaauuaccucacugaagucacauugcaacacucaggugggcacuauuaucaucuccauuuuucuagugaggaaauggagguacggaggcuggcgccgugucccauauaguaaguaagcagaagaggugggauuggaaccaccagagcuuacacuauuacuguguagagcuagaaguguauauauuuuaaaagaauuccuagaagcuuguuuuugaguuuggcaaccuaaacaaagaaacaagcacuuaaauagcucagaacauuuuaagcugucagauaaaaccuaucagaaacccuguguccauguuuuuuguccauucagugugguauauuagcuaaagucuaacugaaaagggguacucuuuacugcauacaguguaauaaaaaguauaugaucuguuuuauuuauacucagagguuucuuuuacauuuuuguuccuguuuugguuuuuuuuuugugcuuaggguugauggugcauguugauaaaagaauuacucuggcagcuuucaaacaacauuuagagcccuuuguuggaguuuuguccucucacuucaaggucuuucgaguguaugccagcaaucaagaguuugagagcguccggcugaaugagacacuuucaucauuuucugaugacaauaagguugauuaaaauaaucuucgaguaguuagagucuauuuuaaaugauagauuugagaacagcuuuuacuacuuccaagugaggugaaguagauaaacuggaaggauuuuuuuuuaaugauuaaugguaauuugggggguuuuuuguuguuauuuuucuucacucaucuaacaaacauuugugaaauguuagcugugugucaguuacuauucuaggugcuggggauucagagguaaaagauaugccuguucucagagagccuauaaucuagaguauuuuggaaaguuuaaaaaugggaugagaauggguuguuuauucugcugagacagcaugucuaaaaaaauguuuuuaacuuauagauuacaauuagacuggggagagcacuuaaaaaaggagaauacagaguuaaaguauaccagcuuuuggucaaugaacaagagguaaguaauacguuuaagaauaauauaagguuacuuuuuacaguuacugaaaacauagaauauauuuuauucauagucauuuuauuucucugaagcaaaggucagcaaauuuuuucugggccuugcaguuuagcaggccauacugccucuguugcaguuacucacuucugcuauuauagcacaaggagccauagacaauaauaagccaaugagauggcuaugucucaacauuuuauuuacaaaagcaggcagcagugaacuuggcccucaggccacuguuugucaucccugugcucuaaaguguugcuacaaaugcugaaaugagacaaaauuuuccugcuuuuaaaaggaaaagaaauuuuuuugugcgugugcuugcuuucuggaaacaaucauacagugcuacaggugaauagcaguugcaagucauuuuaguauguaacaagcauuuauauagugucuacugugugcuuuaggugcuugcaaauauuaacucauuuaaucaucaguuaacuaagauacaagcacuauuucuuauucucauucuauagaugaagaaacugaggcacagagaaguuaaguaucuuggucaaggucacugcuuguaaacggugugggugaaugaucuaaacaggccguguuuuuuaaggggucaauaaaauauuuuaguccugugguauacuagccuuaccacaaauacccaaaagaauaaggcaaagaucauauuuucagaauguuauaacauccuauuguuauaacauucuguuauaacauguuauagcauccuguugaagaacuagacaaaugugaaaaccauaaauuuaucauaaaaugccuuuauucauauaagauauuuuaucuggcaucuguuauuucucuuaaugugacccauuacagucauuuugauuuacauauuuaaucugaguuuguggaaacugucucuuuugagacaauugguuaaaguauuuggagaauuaguauacauuucccucauuuuaguccauaaaagugguucuuuuugcuuucaaaauuauaacuguuaaaagaaggaaaauacaaguguguuauccuauuuaaccuuuacaaugacucagugaggaagauacuguucccaguuuacagaacugagacacagagauuuuaaguaaacuugcccaagauagcugagcucauaaauaguggagcuaagguuucaaaaaaggaagauagacucugaaacucaggcccuuaauugcaaauaaaauguuuugguaauuuuuauuuuaauguguuaauauuaauguacuuaagguauaauucaagcucugauuguuuauguuuauauuucuagccaugcaaguuucugcuagaugcuguguuugcuaaaggaaugacuguacggcaaucaaaagaggaauuaauuccucagcucagggagcaaugugguuuagagcucaguauugacagguaaaguaaaauuaaugucaucagcgauuugaagaaagacuauguggucaguugaaauggacugguaugauuuucuaaaacuaggagaauuaaaauuuccugugcuauucagaauuuuaguaugacagauuaguuuaauaggacuaaacaagaguauuaaaauuuuguuuggauuuccuauacagaauucuaaauuugaauuacuggaaacauuucuuuauuuccccagauuuuaacaacucauuauuugacuuuuguauuugaacauaguucauuuuucuuuggugucagauuagugucaaucuuuaaauugagaguuucaaauuauagucguuuuaaaugucuuaucacauuuguagguuucgucuaaggaaaaaaacauggaagaauccuggcacugucuuuuuggauuaucauauuuaugaagaagauauuaauauuuccagcaacugggagguuuuccuugaaguucuugaugguauuuucaauauuuuuggggggaaguaucaguuagaaauacucuagaacuaauagaagccuauaguuuuuaaucaaauaaugaguuacgaggaaucuaauauacauuauaguguuuuguguuauauuaagcauaacgauauccuuauuauggauugaugugauuccuaccuacgucuuauccuugggaguuuuauuuucuuccccuguguccuaauguaacugcuuaaguuguuuuugaaagaauaaucagugucuuucagccuucugcuaucuuucucugguucccauuugccuuuuaaguauucuuuuuuugaauguugagaauauuaauucccccuuaugaggaaauuacaaaguuagguuuuuaauacauuuuaagaaaacucugcuaauauuuucuuagccacguuuguucuuuaguuucuuuuuuacuauuauggcuuauuuuguauugaagacaugguacugauaauuuaucagagacucaagaacaaugacuauuuguguccuaagccagguggcuuaaagaauagaaguguauugucucacaaucugagaucaggcugucaacaggguugguuccuucugagugcugugggggagaaucuguuccauacucucuccuagcuucugugguuuuuggccaucauuggcaaccuuggcuuguagauacaucaccccagucucugccuucaucuucaugugguguucuuucugugggcuugucugucuguauuguuuuccccuuuuucauaaaccacuaguccuauuguauuagggcccacccugaagaccuuauuuuacuuugaguaucacuggaaagacccuauuuccaaauaaggucacauucugagguacuagggauuaggauuucaaaaugucuuuuuguggggggcacaauucaacccauagcagugaccuugaggagguccaaguagcagacauacuugucacaccucccaguuuucguuaucaacauuggcacauuuaaaguauugguguuuggagggaggcuuauaggaggaaaguuggcuuuuagaagaucacaucaagguaaacaacuaguucuauauucuuuuuuugcuguugcuuaggaaaauuuuaauuuuccuuuucuucuguagaaaguaaaauaugaauucuggauauuuuguuacaagauuauccuaguuuuuagagagcucaauaauacuaacaccucauguauuucaggcugcuucaggucuaauucaaccauaaauuuaaaugguugaaauucugauuaauugacaaguuaaguugggagguaaggaacaacuaggauaccaucuacuaugguguguaggcaagugcuccagauugugauuucuuugaguaucuggggucguagggaauaaucacugugccuggguaagucaggaagagaucauaaaugacaaagaagucacccuuguaaggauugaguauguauuagcagagauggauucaucugaaaaugguacuagauggugggugccugcaucaguauuauuucaguauauuuucacaucaagauaguugaguaagaaaugucaugugauuaaauccaagagguauuuauugaccuguaauuugccagacacugcuaaucccuugugcuacaaaaaugaguaagaaccacuuauuggugcacacagucuguggaagaaacagaacugcaaaccugucauucuaaaauaauagguacuaagggacugaaucaguagaaguucuucuuguguacaccagagaaaagugacaauugaguugaugcuugaaaagugacaauugaguugaugcuugaaaagugacauaauggaaaagugacaauuuugaagaaucacuaaauuggggaguaaauggaaagagaaggauuaauaauagcuuuagugaaaaaagaggauaaagugaaguugauuuguuuaugauuuuagauagggauaggagccaauagagaaacaaagauuggaaauccagagaagagaguaauugguaaugcaguguucaacaggagucaggagggaguggaauuaggaguacugguuugaagaagagaggaauuaucuucugagacuggagagaagagaguaaauauuucauucucaaaaacuccuugggauaauuggguuuuuucuugugcccacuuuuuaagaguaacacuugaaguaaaucuuuuuguuuaguaaggcacuaagggaaaagucaaauuaugaaccuucagaggaaauagaaugaugaccuaaucuugcauauucuuagggguagagaagaugaaguccaugucacagcuugcaguuuugucaagacgguggaagccuucagagaugaaguuggaucccuuccaggagguuguauuggaaagcaguaguguggacgaauugcgagagaagguaaguucauuuuaaacaaaacauguaucuuauguuguauauguauaucauaauauuaauaaaauauauaauauauaaacaauacauucuuccuguguugcguaagagaaaaccuaggaaguaguaccaaacacuggugcagcaaccuuucuuuuugguuucugucacaccuuguggcacacucugguuguucaggcuccugauucuuugaaaaauuacuuuggcuccuggccauucagaaguggauccucacuuucuguuacuuggaccaauuuuguccuaaguaguuagaauuaguuagaaguuacuagagugaauugcuuuaugucuaaaaaaaaccaaaugaagucgaauuguguagagaauccagaugaaggucuguuuugcauuuuaagaugggauaucuaaggaucucuggggaaagggugaauuagucaaucugugguacuagcacaaugagcauuuugaaaaagauuuauuuccauacuucauacuaaacacaaaaauaaauucuaaauguauuaaguuuauauauaaaaaaaguaaauguacuaggugaaaauauguaaaauauuaaauacuaaaaauauuuucauauuccuggaaaaagauauuuguaagcauaauaccagaagccaaaaaaagaaacuauagaccacguaaaaaccuauccucugcauagccaaagaaaaagguauuuaaaaagcaacucauaaacaaagcuaaaagacaauaaacuaggaggaaauuauuugaagcaguuauuaaacaugcuguccauaauuuauaaggagcuacuaccuuaauaagaaaaagacggaacaaaucuaauuuuaagaaagacagcaugaauaggcaauuuauagaaaaagaaauacaaauuaaagaauaacguuauuuuucacucuuaaauuggugaagauuuagaaaaucaaaaaauaccuagaguucucaagguuuaggggauacagacaauauauaccuuugauaaguguauaaauugauaugauuuuuuucaaguucaguuggcaucauuugucaguauuucggauuugcaauuaaacaucugggaauucgaucuguagaaguauuugcagguugggugccauggcucacuccuguaaucccagcacuuugggagguugaggugggcagaucacuugaguucaggaguucgagaccagccuggccaacauggugaaacccugugucuacuaaaaauacaaaaauuagccaagugugguggugcaugccuguaauuuuagcuacucaggaggcugaagcuggagaacugcuugaacccaggagguggagguugcagugaaccaagauugcaccacugcacuccagucuaggugauggagugagacucugucucaagaaaaaagaauuuauuuauuuauguauuuauuuuugagacggaguuucacucuuauugcccuggcuggaaugcaguggugcgaucuuggcucacugcagccuccgccucccggguucaagugauucuccugguucagccucccgaguagcugggacuacaagcacaugccaccacgcccggcuaauucuuuguauuuuuaguugagacgggguuucaccaugugcgaggauauucauggaaguauacaguagagcuuuguaacuuggaaaaacugaaaacagucucaguguccaucaguaggagauaaaauguauauuguucgguuauugaagagaauguggucacuuuguauccuauuccucuaggaacagaauuauuauauagagauauuaaucugauuuuacauguuuuagaaacguggguguaguuuguguaugcauaggaaaaggucuggaaggaauauacuaacuugguauuucugggacaugguauuugcaggguggccgcuuucugcuuuuucuuaauuuuuuuacaugaaacauuuuuuaaacugagcuauuucuguuugugggguaaaaggaaaauaacuuuucuaagcaaguuaauuuuuuaaaugaacucaaauaaaauguuuuauuuuacagcuuagugaaaucagugggauuccuuuggaugauauugaauuugcuaagguaaagcccugagaauguugcaucuguguauugugcaugauaaacacagcuaguggcaugauuuauucauucauucuuuuucuuuuuaggguagaggaacauuucccugugauauuucuguccuugauauucaucaggauuuagacuggaauccuaaaguuucuacccugaaugucuggccucuuuauaucugugaugauggugcggucauauuuuauagguaacauucacaauguuuuuguugcuguuaguaauacauuuuuggcgugcauacauaucuuauuuuccauaaauaucuuuacuguuuuuaugauauggagcggcacuaaccgguagaaauacagugacagccaaacaugauuauaauuugaaguuuucuaguagccacauuaaaaacaauaaaaagaaacaggugaaauuaauuuuaaaaauauuguaaacccaauauauccaaaauaugaucauuacaugucaucaguauaaaaaaucauuuguauuuugcauuuuuuuauuguacugagucuuagaaauauuguaugucuguuauauuuccagcacaucucaauuugaaccaggcauauuucacaagcucaauagccacauguggcuaauggcuguuguauuggacagcacagauguagaggaaaaagaauagucauuggagccucacaaaucuggguucaaaacuagcuuucugauuuaccuagcuccucaucuauaaaauugcaacaaugaugucuaccuugcaggauuuuaugagaauuagagcuguugcauguaaaauaacuggcacagugccuauuauagauguucaauaaugauagcuguuacuacugcuaauaacauggaaguuauucuccgccacuuuuagaaguaagcaauauguuccugugauuaacaccuuagaaaucugggacaucucaguauauaaaauaauauuacuucaccaguaacagauuucauuaucuugcugaggagcaucauagcauucaagcauacauuaauagagguggagggcucuacuggacuaauaugugauuaauauuuuauauguagggauaaaacagaagaauuaauggaauugacagaugagcaaagaaaugaacugaugaaaaaagaaagcagucgacuccagaagacuggacaucguguaacauacucaccucguaaagagaaagcacuaaaaauauaucuggauggagcaccaaauaaagaucugacucaagacugacucugauaguguagcauuuucccugggggaguuuugguuuuaauuagaugguucacuaccacuggguagugccauuuuggccggacaugguugggguaacccagugacaccagcacugauuggacugcccuacaccaaucagaagcucagugcccaaugggccacuguuuugacucggaaucauguugugcacuauagucaaauguacuguaaagugaaaagggaugugcaaaaaaauaaaaaaaaacaacaaaaaaagcuaaccuucuauuagaaaaggggacaggggaaugaguaaacuucuuuuauugcggacaaaugugcacauagccgcuaguaaaacuagccucaaacaggaugcucauagcuuaauaauaaaagcugugcaaaggccaugaaugaaugaauuuucuguuuauuucacugaugcacacauuaccucauugacaauucagaaguaaauccaacguguguugacucuuggaaagcagcaaaaacaggagcugaagaaaagaaauucuuggaaccagccguaacccaguaaggaauugugaaguuguguuuuuauuuuguuucauuuuuugcagaguauuaagaacauuauucuggaacaucagaacguuucccuuagaccgaucccagcagguggcagcucagauugcugcaguguuguaauuauaacugauuguacuuaaguuauggauguagagaauauguuucauucauuuauucagcauguaaauaaaauugauccuguugaguuaucauaauugcaguucaacuaucugccaugauuauucuuuucacguaucauucauucuguacauuuguguacauugagaaguauagcaaucuauguaaauguaauccucagugagguuccucagugcuaggucccauaggauugucguugcccuuguuaaugagguuucucuguucagcggcuucaauuuuuuucucuuuguacaucuaguuuugaagauuuacuucaaguuugaaucuucuagaaugcuuguaaguccaguuuuaauuuuuagagucaauuuguaguuacauguaguuuaacuuuugggaaacgucuuaacauuguucugaauaaacuugcuaaugaggucaggucaugguacagacugaugcagucaacaugauuucauugcagaguuuauuaguaucagcaaguuuuugcuuugcuaaauaaaaguacucaaugaacacaauucuacauaaauuuugacauaccaucuaauuuauaaaaaucaauaaaaaagguuuugguaaaacuuuuucaugccagaugcuguuuacaacaaugaacaugccaauaaaacauuuguucauucuguuguguuauuuuagucauuaaacuucuguggaugaagaaucuggguuaagaauagauuugucaucuuuaaauaugacauuuuguaauguguauuggauaucucauuucuaugauaaagguauauuuacaguaaaguucucauaagagaaaugaaaagcuguguuaauaucuaacuuuggggaacccugucaguauuucagauccgauuuuuacccuuuuuuucuuauaagaaagauaaaauuagaaaauacuguuagcaaauguggcucugccauuugaauauaaucaccgagaauuccaugucuuaaaagucu

SEQ ID NO: 15358 - RNA, 4971 nt, Homo sapiens
auauuuucccugucuuaaccacugguccagucaucccagugggcuucucuuugucucucccagauuagaccuuugggugagauuggcaucacaacaucuaaucugagucugucuuuuguccuucauucuguauggcagucucccuuuguuauaaaagcuuucuaaagcauacuaaagaagccuucccagagccccgucuugcuucucuuccaggugcucuauccccucgagacccucuggugccaggcuugcuucacggccaucuuguguugucacugcagaguuuggaggccaguuuuccacagccuaaacagggaggagcugcagaauggggcucuggucucugggcauucauuucccucauagaggcugagaauaaaacaaggacuuauucacacauguucuagaaccccagaauggcccaaguuaccugagaccaggguuucucaaccuugacaccauugacauuuuggacuggguaauucuuuguucugcagagcuguccuuugcacuguaggagauuuacuaauaucccuggccucuacccaguaguaccacuagcaccuauuccccacccagcgugucuccagauauugucaaauaucccaucgggugcaaaaugaucccuggucaagaucuguugcccaagauguuacaggucacaaugaccacauuugaaauuguuuucccuuucauuuuacccugugaaagcaucucuccuagagccuugcaagaggcaggugacauuguguccauauuucuuccuguuucagaacuucuguuucacaacaauuucucucucgcuacaaguauucuuucacucagcacuggggaaguugggaacagcuggucaccaucaucccuuuaaucaacucacaccuguuuaaagaguguuucugauuugaccuucaucccuuaguuuacuggcguuaaaaaaagucucagcaauuuucauuauuucucgugggucucauuaucaaaccuuuacuuauuucggcauauuuccucugggcuucuucuaguuucugccuuacaagcaaugcuguucuguaaauuuauugaaaccucuggaacauuucaccuuuagagauggaggauggaaggauugguaccagaagagggcuaagauacguuuucugucuugagcugaaagcacagucuacucuccuucguuuugucgaugagaaaguugaggccagaggggaggugacauguuuagagucacccagcugguuagugacagaaaaagcgugagaguugucuaggauuccugccacuuuggucccuggccucuccugggggaggcugcuguucuuaggugcucuaagcuuaaucccucagaauguguggacaggucagcuuagaagagauggggagauucaggaucccccugugccagagcacagccucaccggaugcugcuucccacacugaaguguccuguccgaccauugcuaucugaggcauccacaagcagguaggaaagcuggcgagccauuuuacuuccugaggacaauuccccagccacaggcucugagucaaauuucuauuugguaagcauccuagcagcaaaguccugcacucagaccagccaaaaaacagcccccauuccaaguacuuggugucaaaaguccccgaacgacuuuuaaacccaagucuucuuaagguuucaguacugugguggcuuuagcaguuguuuuugugcaacuauaaauuauuuaaaucaucugagaugacagucaauuuuacaaaccagguacauauuaauuuguauaauuuuguauaugcucugguacacuaccugaacuaacgaaggguagaacuaauucuguuugucaguguucacaccuguaacauuaggaggauaugucugcauugcuuauuucuuuauguugguguuucuguggcaaagcccugcacauggcauuucugaaaagccuuaaaucuuuaagauguugcauguaggguaugcagugcaaaaggcugccucagaacugugagcccuuuuguaagcuggaagcauuucucuuacuacuguuacuuuuguaggaaguuuucaauucagagcugccaaaguguucccguaagcagugccuuaguaauaccuuagucaugccgccagccuuuucuuacaccaauuccuaauguucauuuacgaauuggcccaauauuggaaacaaaacaagcaaaaauugucuucauuuuuguuuuguaagcccauuuuuucuccaguucuauaggaaacugacugcuugguguaaaauccgaaacuggacacaagucaguucuuucaccacacucaaauguauauaccaaaacaaaagguugcaacuucauaguuuacuaugaaaagcaaauuguacuuuuuaauguugccuuuuaaauucaugaccaaauacuuagcuauuugugaaucuucugcacucuagcaugaaagugccuuugguuugagauuccagcuuagaaaagugcugccauaauaacgauaauuuguagagagaccaaaaauauuuugagaucaccguaaugccuuugguuuaccgggaugaguaaccaaccacaggccucuguucacaagagcacgacgugguccccgccugcugcuagucugucugccacugggggccucccaacauccauagcacacuucagcggaaggaccccagaaacuguuguguuugugugugcugaugaccuagugugucauuucaccucgucacccagcccugcguccggaugaggggacuucugcacaaaugacagaaucucggcugguggacagauacuacagcuuucuccuccuccuuguguucguguucagucucuguggagacuuucuuuuccauucaaaugacagugcgcacuuaucugguuuacacaaugauaccauuuugaaaguuggaagccucaaacugagacgacagugcagaacaaaacaaaagugaguuagggucguuaaaauugaaguguucuucuuagggcaaacauguugacuccgaguauuguguaugaaugugcuacgagaaacuuccaaagagcaccauucacaauuuggcauuuucaaagaauguuccagcccucaaaggggcaacucuuuaaaguccuuguuggcuuuuauccaaaccuuguagaaauugggaaagcugauagagguaaggaagacgagugaaaaggacaagaaggccaaacaccagccaaaaagaaacuaggaaaaaaagauuuucuuugcuaauauagauguaaaaauaacaucagacaucuuugaaaauuagccucuaaacucuuaauacauacguucugugugucucuaccuggcgucuuuaagaauauccucucugggcucugaaauuuuaggagugauucuuauccacuccaaguuguaaguauuuguagaaauuugugcaaacaaacaaaaacuaucaaaugaaaagaaaauguacucaaccuaacuuauaguuagcagcuggaauucucaacucuucccugccagcacuauaccacaguguggaagaaauuagucaaaugcuuguuuuccugcuucucuuuucaacuguuacugugcuuuguuugaaaguaguuuucucucucaaagccguugcuuauaucguuaagaaugaagguuuguguuuaaaauuuauugcauugcaaaggguaguuucacugaagucaugcaccauuaaauaagaugaaauauuuguauuuauuguccuacuuccuaagccguaacuucuuuuccucugugaauuugcauugagucacucaugcuacacuacaucgcuuuaguauuugagauggcauuuauguuuccucucguuuaucaugaaauggggucagauuccaucagauuccaccucugucagguggacucuugucugccuuccaugaugagauuuuuuuucuccuuccccuuucuuuaagagaggcugacagaucuaggugucaaucaauuggaaaccagucucugauuuuuuuucauuaguuauuuucuaucauuaguuucacuguguaaauuagauaucaacugcacuucuuuaaaaaaaaauacaucucccuauuaccuccuugaaagauuuacuucuguaggccuuuuucaauaggcucaugacugcagacaaggaaaaaaaaaguaaaaacaaaaacaguaugugccugaaaaugacaaaaaaaaaauuuguaacauuuaaaaaagaaaccugaauagccuuuaauucuuuaauaauacacuuaaauuuuauguaaaucgguuuucgccacguguguuuguucacauucuaaaugacuuaaugggauucucacggucugugucuuugugucacguguauaaaaugggcuugugauguaagcguuucaucuggucagugguuccuuugauauuguacugcugcugggagugggcuguggaaccugccuucggguaacuggguuccucuuggguagauuggagagaugggggugggcgugggcaaauucucacacauguuuucuuaaccuauuugcagaaacuuucaaaaggcauuugauuaaaccucuuggcaguacaguauucuuguauuuguuaacgucuguguuuagguacugguaccuuuuuguuuuaaaauguucuaaguguuggcuuuaaagugaauuuaucuuuaguaugauaguuauaugaaaauuauaggauuugugugcagagaauuuuuuuauaaagugcuuuguaaaaaaaaaaaaauguauucuagcuuuugcgguacauaugugugauaacuuuaauacccaugacaguuaagugcaauuauuucaucacucuaaaaaugcuauuuuugugucaguuccugcagguguuuucaugucuuugcaaagugacacauuuugaugccuucuugauaaagugguagacauuuuguagcuuucuagaaacuuuguauucauacgguaucaaugaaaaauaaagaaaaugaaagugugggucaccuuuuuuaucugcagaag

SEQ ID NO: 15359 - RNA, 3589 nt, Homo sapiens
cagagccagagcggcgggagccgguccugggcgcguugccccgggagcgcccgucguccgggcagagcgcagccgcaaccgcgaccacagccgcagucgcuuuccagccugccuucggugcgcagcgggggaacagggcuagugcagccgccggaggggggcacgggcuccucucccaucccagagcuacugggcugcccuugcuguccucgccgccccagcagaccccggccggaccugccaccugcgcccugguugcgccauggauccuucggaaaagaagauaucgguguggaucugccaggaagagaagcugguguccggccucucccgccgcaccacuugcuccgacguugugcgagugcuuuuggaggacggcugccggcggcgacggagacagcggcggagccggcggcuggggucggccggcgacccgcauggcccgggagagcugcccgaacccccgaacgaggacgacgaggacgacgacgaggcgcugccgcagggcaugcugugcgggcccccgcagugcuauugcaucguggagaaguggcgcggcuuugagcgcauccuccccaacaagacgcgcaucuugcgccucugggcugccuggggcgaagagcaagagaaugugcgcuucgugcuagugcgcagcgaggcaucgcugccuaacgccggcccccgcagcgccgaggcgcgcguagugcugagccgagagcgccccuguccggcccgcggggccccggcgcggcccagccuggccaugacccaggagaaacagcggcgaguggugcgcaaggccuuucgcaaacuggccaagcucaaccggcggcgccagcagcagacaccgucguccuguucguccacuucgucguccacugccucguccugcucuucgucgccgcggacccacgagagcgcgucgguggagcgcauggagacgcuggugcaucuggugcuuucccaggaccacacaauucgccagcaggugcagcggcuccacgagcuggaccgcgagaucgaucacuacgaggccaaggugcaccuggaccgcaugcggcgucacggggucaacuacgugcaggacacuuacuugguuggggcaggcaucgagcucgacggguccagaccgggagaggagccagaagagguggcggcggaggcggaggaggcggcggcggcgcccccucuagccggcgaggcgcaggcggcggcgcuggaggagcuggcccggcgcugcgacgacuugcugcggcuucaggagcaacggguucagcaggaggaguugcuggagcgccuuucagccgagauucaggaggaacucaaccagagguggaugcgacggcgccaggaggagcuggcggcgcgggaggagccccuggagcccgacgguggccccgacggcgagcugcugcuggagcaggaacgggucaggacgcagcucaguaccagccuuuacauugggcugcggcucaacacggaccuagaggccgucaagucggacuuggauuacagccagcagcaaugggacagcaagaagcgcgagcuacagggccuucugcaaacuuugcacacuuuggagcugacgguggcaccggauggggcuccuggcucuggcagucccucgcgggaaccugggccucaagccugcgccgacauguggguggaccaggcccguggacuggccaagagcgguccuggcaacgacgaagacucggauacgggacugagcucuaugcauagccaagacucggacuccuugcccaugugcgaaucccuuguguagggguggggggcggggggcggggggcgggaacagggggauucuuuuuucuugcagaaugcagugggccagccggcucgcggacuugaaaccaggcuguugcgagcccagagcuccggcugggcagcagcgcucugcgcagccucgcgcucaucuggcuccggggugagugcagagcagggugaggguagaagaaguaggauccucaauacaagcucauuaaagagagggaaggagggaggaggcaagaacccccuauacuggaaaacaaacaacccaaggaaauugacgugguccgagcccauuuucaaaguaaggaaguauaauggagauuucgcuacucuucuguaugggaaggacugauggcagcuagaacuuuaguuugugguaugaagugcuuuaaaagaaacacuuggaugaaaaggaaauuccuugaauguuaauugugacuguaaacguguuaaaacuagccaaagaggacgcacuggugucggucucugccuuucuuaccucuuugauaaaacccauaggcaccaaaauccuggcuguuuacauuucugcagauuugggaauuacccaucugcuaaaucauuugucuuuuauuuucuuucaaaggcuaaacuguaucgaagucuaacccuguauuuccuccuaguaaacacaauagauguuaaaagggaauucuuuucccaaaauaaccuuuuauuauuacaaaagccaaacauaaucauuugagauauaaaauccuggcaaacauaaucgugguuaaaauuuaaucugggcccuuugggaucugucccuucaaaggcaggugaguugcccuuuaauucguauugccacuucauugacucaaucacuguuauuucagaaaaaaauaaaaggaaguagcagaauucaaguuacgcaaaacaaaacuugcugucuaacaagcacucuuugaaagcaaagauguuuuaguguucagcuuuuaaauugagcuaugugauuaaaaccaaccaugaccuuaacggauuuuacccaaacucgucuaacuucaguauguuuugucagagauuaaucaguuacuuguucaaacuuaaauugagauaguguaaauaucaggguuuccuagauaaggacagaaaagaaaaaaauaaaacaaucucauaguacuccuugggugaacaaugugauuaacgauggcacguagucauggaaaaaaagauaaaaagugaguuaagaacuugaauuacucuugucuggcacacgccuaugcacaugccaggagaugcaagugcaacaccaucucaguagcuggcgacagagcugguggggacuccauguaauuguuccaguuguuucaauuaaaacuuaucaguuguagcuaguuguuggccccgcggaaggagccugcuggccgauuucccucugcagcucaguacuucugaggaaugugggaucuaaucuguccugagaagguuauuaacaauggggcaugugugugguaccagcauggugcagaagccucuuaucaaccuacucuugaggggcuggcuccaguuucaacacuacaugugaagauaacuuaagaggucuugcuuuauacagaaguuccuucccuugcagagauucucuaucugcuuguugccaaugggagccugcccuuaugaccuccucaaaccacuguuugugcugucuccuuuuuagagacagcaccccccacccgccccgcacuaccaccaccacugcccugguauuacaacaugugugccuguuugcagauuuucaaguaaaaaugggaauuuaaaggccauuuucuuaauugau
